United States Patent 12,569,549 (FLAVIVIRUS VACCINE) - sequence listing, part 69

SEQ ID NO: 23768 - RNA, 9879 nt, synthetic construct
  misc_feature 1..9879: note = derived and/or modified CDS sequence (opt11) from DENV-1__FJ850081__SS-prME
  source 1..9879: mol_type = other RNA
agcgtaactatgctgctcatgctgctgcccaccgccctcgccttccacctgaccacgcggggcggggaaccccacatgatcgtgtcaaaacaggagcggggcaaaagcctcctgttcaagacttcagtcggggtgaacatgtgcaccctgatcgcgatggatctgggcgaactctgtgaggacaccatgacatacaagtgtccccgcatcaccgaagccgaacccgacgacgtggattgctggtgtaacgccacagatacgtgggtaacgtacgggacctgcagccagaccggcgagcatcgtagggacaagcggtcagtagcgctggcccctcacgtgggcctggggctggagactcggaccgagacctggatgagctccgagggcgcctggaagcagatccaaaaggtggagacctgggctttgagacaccccggcttcacggtaatcgcgctattcttggcccacgcgatcggtacatcaataacccagaaggggattatcttcatcctgctgatgttagtcaccccatcaatggccatgcgttgcgtgggcatcggtaaccgggacttcgtggaagggctgtctggcgccacgtgggtggacgttgtgttagaacatggatcctgcgtcaccaccatggcgaagaataagcccacactcgacatcgagctactgaaaaccgaggtgacaaaccccgccgtgttaagaaagctgtgcatcgaagcgaagataagcaacactactacggactcccggtgcccgacccagggcgaagcaaccctggtcgaagaacaggatgccaacttcgtgtgtcgccggacctttgtcgatcgcggctgggggaacggctgcggtttattcggtaaagggagcctgctgacgtgcgcgaaattcaagtgcgtcaccaaattggagggcaagatcgtgcaatacgagaacctgaagtattccgtcatagtgaccgtccacaccggcgaccagcaccaggttgggaacgaaactaccgagcacggcaccattgccactatcactccccaggcgcctacgagcgagatacagctgactgactacggggcgctaaccctggactgtagccctcggacgggtctggactttaacgaaatggtactcctgactatgaaagaaaagtcctggctggttcacaaacagtggttcctcgacctgccgttgccgtggaccagcggagctagtaccagccaggaaacctggaatcgccaagatctcctggtaacattcaaaacggcccacgccaagaaacaggaggtagtagtactcggctcccaggagggcgcgatgcacacggccctcacaggggccacggaaatccagacttctggcacgactactatcttcgccgggcacttaaagtgcagattgaaaatggacaagctcactctgaagggcatgtcctacgtaatgtgcaccggatcgtttaagctggagaaggaagtcgctgaaacccagcacggcacagttttagtccaggtgaagtacgagggcacagacgcgccttgtaagatacccttcctgacccaggacgaaaagggcgtcactcagaacgggcggctgatcacggccaaccccatagtgaccgacaaggagaagcccgtgaacatcgagaccgagccgccgttcggggagagttacatcgtcgtaggggccggggagaaggccctgaagttgtcatggttcaagaaaggatccagcatcggcaagatgtttgaggcgaccgcccgcggggcgcgccggatggccatcctgggcgacactgcatgggacttcggctccatcggcggcctcttcacctcggtggggaaacttattcaccaggttttcggcaccgcgtatggggtcctgttcagtggcgtaagctggaccatgaagatagggataggcatccttctcacttggttgggcctaaattcccgcagcacctccctcagcatgacctgcatagctgtagggatggtgaccctgtacctgggcgtgatggtacaggcagactccgggtgcgtaatcaactggaagggtcgagagctgaagtgtgggtcgggcatcttcgttaccaatgaggtccacacctggaccgagcaatacaagttccaggccgactcgccgaagcgactgagcgctgcgatcggcaaggcatgggaggagggggtttgcggcattcgcagcgccacccggttggaaaacataatgtggaaacagatctccaacgagctcaactacatactgcttgagaacgacatgaagttcacagttgtcgtgggggatgccaatggcatcctcgcccaggggaaaaagatgatccgcccccaacccatggaacacaaatacagctggaagtcgtgggggaaggccaagatcatcggcgcggacattcaaaatacgaccttcatcatagacggacccgacaccccagagtgccccgacgaccagcgagcctggaacatctgggaggtggaagattatggcttcggtatcttcaccacgaacatctggctgaagctgagggatagccacacccagatgtgcgaccaccggctaatgtccgcagcgatcaaagatagcaaggccgtccacgccgacatgggctactggatcgaatccgagaagaacgagacctggaagctggcccgtgccagtttcatcgaagtgaagacctgcatatggccgaaaagtcatacgctgtggagcaatggcgtgctggagtccgagatgataatcccgaagatctatgggggccctatctcccaacacaactaccggcccggctactttacccagaccgcgggcccgtggcatctggggaagctggaactggacttcgacctgtgtgagggtacgacggttgttgtggacgagcattgcggatatcgtggtccgtcgctgcggacaactaccgtcacgggtaagataatccacgaatggtgctgtcgcagctgcactctgccgcccctgcgcttcagaggggaagacggctgttggtacgggatggagatccgccctgtgaaggagaaggaggaaaacctggtgcgcagcatggtcagcgccggcagcggcgaggtggacagctttagtttgggcatattgtgcgtgtccattttaatcgaagaggtcatgcggtctcgctggtcccgtaagatgctcatgaccggtacactggccgtcttcctgctcctgatcatggggcagctgacgtggaacgacctcatccgcctctgcatcatggttggcgccaacgcctccgacagaatgggaatgggcaccacctatctggcactaatggccacctttaagatgcggcccatgttcgctgtagggctgctgttccgccggctcacctcccgcgaagttctgctgctcaccataggtcttagcctggtggccagtgttgagctccccaatagcttagaggagctgggcgacgggctcgcaatgggcattatgatgctgaagctattgaccgatttccagccgcaccagttatggactacactcctttccctgaccttcattcggacctcattgtccctcgactacgcatggaaaaccatggccatggcactgtctattgtgtcactgttcccactctgcttgtccacgacctctcagaagaccacatggctgcctgtcctcctgggcagcttcgggtgtaagcccctgacaatgttcctaatcactgagaataagatctggggccgcaagtcttggcccatcaatgaagggatcatggcggtaggcatcgttagcatcctcctatcctcgctcctgaagaatgacgtccccttggcggggccgctcatagctggcggcatgttaatcgcctgttacgtgatctctgggtccagcgctgacctttccctcgagaaggccgctgaggtatcttgggaggaggaggccgagcactcgggcaccagccataacatcttggtcgaagtgcaggacgacgggacgatgaagatcaaggacgaggagcgggacgataccttgacgatcctcctgaaggccaccctgctcgcagtgtccggcgtctatcccatgtcgatacctgctaccctgttcgtgtggtacttctggcaaaagaaaaagcagaggtccggagtactgtgggataccccttccccgcccgaagtcgaacgggccgtgctcgatgacggtatctacaggatcctccagcgcggtctgctggggcgctcccaggtgggcgtcggggtgtttcaggacggggtttttcacacgatgtggcacgtcacccgaggggccgtactcatgtatcagggcaaacgactggagcccagctgggcgtcggtcaagaaggacctgattagctatggcggaggctggcgattccagggcagctggaacaccggcgaagaggtccaggttatcgccgtcgagcccgggaagaaccctaaaaatgtccaaaccacgcccggtacctttaagacccccgagggcgaggtgggggccatcgcgctcgacttcaagcccggcacgagcggttctccgatagtgaaccgcgagggcaagattgtcggcctctacggaaacggagtggtgacaacctcagggacgtacgtctccgccatcgcccaggcgaaggccagccaggaaggccccctacccgagatcgaggacgaggtatttaagaagcgtaaccttacaattatggacctgcacccggggagcggaaagacaaggcgttacctgcctgcgatagttcgggaagccattaagcggaagttacgcaccctgattctggccccgacccgcgtcgtggcctccgaaatggctgaggctcttaaaggcatgcccatacggtaccagaccacggcggtaaaatcagaacacactgggcgcgagatcgtggaccttatgtgccatgcgacattcacgatgagactgttatccccggtgagagtgcccaactacaacatgatcatcatggacgaggctcacttcaccgacccggcgtccatcgctgcccgcggctacatctccacgcgcgtcgggatgggagaggccgccgccatcttcatgaccgccacgcctcctgggtcggccgaggcctttccccagagtaacgccgtcatccaggacgaagagagggacatccccgagcgcagctggaactcgggctacgactggataacggacttcccgggcaagacggtgtggtttgtcccctcgatcaagtccggcaatgacatcgcgaactgcttgcggaagaacggaaaaagagtgatccagctgagtcggaagaccttcgacacagagtaccagaagaccaagaacaacgactgggactacgtggtaacgaccgacatctccgagatgggtgccaacttccgcgcagatcgcgtgattgacccccgccgttgcctcaagccggtcattctgaaggacggcccggagagagtcatcctagccgggccgatgcccgtgactgtcgcgtcggccgcccagcgccgcggtcggatcggaaggaatcaaaataaagaaggagaccagtacatctatatgggccagccactgaataacgatgaggaccacgcccactggacggaggccaagatgctgctggataacatcaacactcctgaggggatcataccggccctattcgagcccgagagagagaagtccgcggccattgacggcgagtatagactcagaggggaagcgcggaagactttcgtcgagctgatgcgccgtggcgacctccctgtgtggctctcctataaggtcgcgtcggagggattccagtacagcgaccgacgctggtgcttcgatggcgagagaaataaccaagtgctcgaggagaacatggacgtcgagatctggaccaaggagggcgagcggaagaagctccgtccccgatggcttgacgcgaggacgtactctgacccgctggcgctccgggagtttaaagaatttgcagctgggcgccgcagcgtcagtggtgacctgatcctagagatcggcaagctcccgcagcacctgactctccgcgcccaaaacgcgttagacaacctggtgatgttacacaactccgagcagggtgggaaggcctatagacacgccatggaggagctgcccgacaccattgagaccctgatgctgctcgccctgatcgcggtgctgacaggtggcgttactctcttctttctgagcgggaaggggctaggcaagacatctatcgggctcctgtgcgtgatggcctcatccgcactgctctggatggcaagcgtggagccccactggatcgccgcaagcatcatactggagttcttcttaatggtgctcctgatcccagagcccgaccgccagcggacgccccaggacaaccagctggcgtacgtagtcatcggactactgttcatgatccttacggtggccgctaacgagatgggtttactggagacgacgaagaaagatctgggcatagggcatgtcgccgcggagaaccatcatcacgccactatgctcgacgtggacctgcgcccagcttcagcttggacgctgtatgccgtcgctacaactgtgatcacccccatgatgcggcacaccatcgaaaacacgacagcaaatatcagtctcaccgctatcgccaaccaagccgcgatcctgatgggcctagacaaaggctggccgatcagtaagatggatattggggtgcccctcctcgctctgggctgctacagtcaggtgaacccgctcaccctaacggctgccgtgctgatgctcgtcgcgcactacgccataattgggcccgggctgcaggccaaagccacccgtgaagcacaaaaacgcaccgcggccggtattatgaagaacccaaccgtcgacggcatcgtgacgatcgacttggaccccgtagtctatgacgccaaattcgagaagcagctcggccagatcatgctcctgatcctctgtaccagtcagatcctgttgatgcggacaacttgggccctctgcgagtcgattacgttagccaccgggccactgaccaccctctgggaaggtagccccgggaagttctggaatacaaccatcgcggtgtccatggccaacatcttcaggggaagctaccttgcgggcgctggtctcgccttctctctgatgaagtccctgggcgggggtcggcgcgggacgggcgcgcagggcgagaccctcggggagaagtggaagcgccagctcaaccaactttcaaaaagtgagttcaatacctacaagaagtcagggatcatggaggtggaccggtcagaagccaaggaagggctcaaacggggtgagaccacaaagcatgctgtcagccgcgggactgccaagctgcggtggttcgtagagagaaacctcgtgaagcctgaaggaaaggtcatcgacctgggttgcggacgtggcgggtggtcctactattgcgcgggcctgaaaaaggtgacagaggtgaaggggtacacaaagggcggcccagggcacgaggaacccatcccgatggccacctacggctggaacctcgtgaagctgcattcgggtaaagacgtcttctttaccccgcccgagaagtgcgataccctgctctgcgatataggcgagagtagtccaaatccgacgatcgaggaggggcgtaccctgcgggtccttaagatggtcgaaccatggctgcgcggcaaccaattctgcatcaaaatactgaacccctacatgccgagtgttgtggagaccttggaacaaatgcagcggaagcatggagggatgctcgtgcgcaaccccttatcccgcaattccactcacgagatgtactgggtgagctgtggtacggggaacatcgtgagtgccgtcaacatgacaagccgaatgctactcaaccgattcaccatggcccaccggaaacccacctatgagcgcgatgtggacctgggcgccggcacccggcacgtggcagtggagccagaggtagccaaccttgacatcatcggacaacgcatcgagaatatcaagaacgaacacaaatccacctggcactacgacgaggacaatccgtataagacctgggcctaccatggcagctacgaagttaagccctccggttcagcctcctcgatggttaacggcgtagtccggctcctgaccaagccctgggacgtaatccccatggtaacgcaaattgcaatgaccgatacaacgccgttcgggcaacagcgcgtcttcaaagagaaggtggacacgcggactccccgggctaagcggggcaccgcccagattatggaggttaccgccaaatggctgtggggcttcctctcacgcaacaagaaaccgcggatatgcacgagagaggagttcacccggaaggtccgcagcaacgccgccatcggggccgtgttcgtggacgagaaccagtggaatagcgccaaggaggccgtggaggacgagcggttttgggacctggtgcaccgggagcgggaattgcacaaacaaggaaagtgtgcgacctgcgtgtacaatatgatggggaagcgggaaaagaagctcggcgagttcgggaaggctaagggctcgcgggccatctggtacatgtggctgggcgcacgcttcctggagtttgaggccctcgggtttatgaacgaggaccactggttcagccgggaaaattcgcttagcggagtcgaaggagaaggcctccacaagctcggctacatcctgcgcgatatctccaagattccaggtggaaatatgtacgcagacgacaccgcgggatgggatacgcggataactgaggatgacctgcagaacgaagcgaagataacggacatcatggagccggaacacgcgcttctagccacgagcatcttcaaactgacgtaccagaacaaagtagtgcgggtccaacgccccgccaagtccggcactgtgatggacgttataagccggcgcgaccaacgtgggtctggccaggttgggacctacgggctcaacacattcacaaacatggaagtgcagctgatccgccagatggagtcggagggcatcttcagtccctccgagctcgagaccccgaacttggcgaaacgagtgctggactggcttgaaaaacacggggccgagcgcctcaaacgaatggctatatccggcgacgactgcgtcgtgaaacctatcgacgatagattcgcaactgcattaacggcgctgaacgacatggggaaggtgcggaaggacatcccccagtgggagccttccaagggatggaacgactggcagcaggtcccgttttgcagccaccacttccaccaactcatcatgaaggacggccgcgaaattgtggtgccctgccgcaatcaggacgagctggttgggcgcgcacgtgtgagccaaggcgccgggtggagtcttcgcgagaccgcctgcctcggcaagagctacgcccaaatgtggcagctcatgtacttccaccggagggatttacggctggcggccaacgccatctgctctgccgtacccgtcgactgggtacccacgtcccgaacgacctggagcatccacgcgcaccatcaatggatgaccaccgaggatatgctgagcgtgtggaaccgggtttggattgaggagaacccatggatggaagacaagacccatgtgagcagttgggaggaggtaccctacctggggaagcgtgaggaccagtggtgtggtagcctaattggtctgaccgcccgtgccacctgggccacgaacattcaggtggcaataaaccaggtgcgacgcttgatcgggaacgaaaactatctcgactacatgacgtctatgaagcgcttcaagaacgagagcgacccagagggcgcgctgtggtga

SEQ ID NO: 23769 - RNA, 9879 nt, synthetic construct
  misc_feature 1..9879: note = derived and/or modified CDS sequence (opt11) from DENV-1__FJ850084__SS-prME
  source 1..9879: mol_type = other RNA
agcgtgacaatgctgctcatgctgttgcccaccgccctcgccttccaccttaccacccggggtggggaaccccacatgatcgtgagcaagcaggaacgggggaagtctctcctgttcaagaccagcgtgggggtgaacatgtgtaccctgattgcgatggacctgggcgaactctgtgaagacaccatgacctacaagtgtccccgcatcaccgaagtcgagcccgacgacgtggactgctggtgcaacgctaccgatacctgggtgacctacgggacgtgcagccagaccggagagcaccggcgcgacaagcggtccgtcgcgctggcgccccacgtgggcttagggctcgagacccgcaccgagacttggatgtcttccgagggcgcctggaagcagatccagaaggtggagacatgggcgctgcggcaccccggattcacggtgatcgcccttttcctcgctcacgccatcggcacctcaatcacccaaaagggtatcatattcatcctgctgatgctagtgaccccttccatggcgatgcgctgcgttggcatcggaaaccgagatttcgtcgagggactaagcggcgcaacttgggtggacgtggtcttagagcacgggtcctgtgtgaccaccatggccaagaataagcccactcttgatatagagctgctgaagactgaagtcaccaaccccgccgtccttcggaagctgtgcatcgaggccaagatctctaacaccacaactgactctcgatgcccgacccagggcgaggcgacactggttgaggagcaggatgccaactttgtctgccgcagaacgtttgtcgaccgcggctgggggaacggctgcggcctattcggcaaagggagcctactgacgtgcgccaagttcaaatgcgttaccaagctagagggcaagatcgtccagtacgagaatttgaaatactccgtcatcgtgaccgtccacaccggcgaccagcaccaggttgggaatgagacgaccgagcacggcactatcgccaccatcacgcctcaggctcccacgtcggagatccagctgacagattacggggcgctcacactcgattgtagcccccggaccggcctagacttcaacgagatggtgctcctgactatgaaggaaaagtcgtggctggtccacaagcagtggttcctcgatctgccgctgccgtggacctccggggccagcacgagccaggagacttggaatagacaggaccttctggtaacgtttaagaccgcccacgccaagaaacaggaggtggtcgtgctgggctcccaggagggcgccatgcataccgcgctcacaggggctaccgagatccagacatcaggcaccacgacgatctttgcggggcatctgaagtgccgcctgaagatggacaagctcactctgaagggaatgtcctacgtgatgtgcaccggatccttcaagctggagaaggaggtcgccgagacccagcacggaacggtgctggttcaggtcaagtacgagggcaccgatgcaccgtgcaagatcccctttttgacacaggatgagaagggggtcacccaaaacggtcggctaataacggctaatccgatcgtgaccgataaagaaaagcccgtgaacatcgagactgagcctccattcggggagtcgtatatagtcgttggcgctggcgaaaaggcgcttaagctaagctggttcaagaaggggtcctccatagggaaaatgttcgaggccaccgctagaggggcccgccggatggctatcttaggtgacaccgcctgggactttgggtccatcgggggcctgttcactagcgtcgggaagctcatccaccaagtgttcggcgctgcgtatggcgtgctgttttccggcgtaagctggaccatgaaaatcgggatcggcatcctgctgacctggctgggactaaattccagaagcacgtccttaagcatgacctgcatcgctgtcgggatggttaccctctacctgggcgtcatggtgcaggccgactccggttgcgttattaactggaaaggtagagagctcaagtgtgggtccgggatctttgtcaccaacgaggtgcacacctggaccgagcagtacaagttccaggccgatagcccgaagcgattatctgccgcgatcggaaaggcctgggaggagggtgtttgcggtatccgcagcgccacccggctggagaacatcatgtggaaacagatctccaacgagctcaactacatactgctggagaatgacatgaagttcaccgtcgttgtgggggacgcaaacggcattctcacccaggggaagaagatgatccgcccccagccaatggaacacaagtacagctggaagtcctggggcaaggcgaagatcatcggcgccgacatccagaacacgacattcatcattgacggacccgacacaccagaatgccccgacgaccagcgggcctggaacatatgggaggtcgaggactacggctttgggatcttcactactaatatctggttgaaactgcgcgacagctacactcagatgtgcgaccaccgattaatgtccgccgctattaaagacagcaaggcggtgcacgccgatatgggctactggatcgagagcgagaaaaacgagacgtggaagctagcccgcgcctcattcatcgaggtaaagacctgcatatggcccaagtcccacacgctgtggagcaacggcgtcctggagtccgaaatgatcatcccaaagatatacgggggcccgaccagccagcacaattaccgccctgggtacttcacccagaccgccgggccctggcacctggggaagttggagctcgatttcgacttgtgcgaaggcacgactgtggtggtggatgagcactgcggctaccgcgggccgtcactgcggaccaccacggtgactggtaagatcatccacgagtggtgctgccgctcttgtaccctcccgcccctgcgtttccgcggggaagacggctgctggtatggcatggagatccggcccgtcaaggaaaaggaggagaacctggtccgctccatggtgagcgcgggatccgcggaggtggacagcttcagcttggggatactgtgcgtttccatcttaatcgaggaggtaatgcgcagcagatggtctcggaagatgctcatgactggaacgctggccgtgttcctgcttctgatcatgggccagctgacctggaacgacctcatccgcctgtgcatcatggtcggcgccaacgcgagcgatcgcatgggaatggggaccacctacctggcgctcatggccacgtttaaaatgcggccaatgtttgccgtggggctgttgttccgcaagctcacctccagagaggtgcttcttttgaccataggccttagcctggtcgcgtccgtggagctccctaactcccttgaagaacttggggacggcttggccatggggatcatgatgctaaaattgcttaccgacttccaaccgcaccagttgtggacgaccctgctgtccctgactttcatccgaactagcttaagtctcgactatgcgtggaagactatggccatggcactcagcatcgtctcgctgttcccactctgcctgtcgaccacatcccagaagaccacgtggctgccggtcctcctgggcagcttcggatgtaaacctctgaccatgttcctcatcacagaaaacaagatatgggggcggaagtcctggcccatcaacgaaggtattatggcagtagggatcgtaagcatcctgttatcgagcttactgaagaatgacgtgccactggcgggtccgctcattgccgggggcatgctgatagcctgctacgtgataagcggctcatcggccgacctgtccctcgagaaggccgcggaagtctcttgggaggaggaagccgagcactccggtacttcccacaacatcctggttgaggtgcaggacgacggcactatgaagataaaggacgaggagcgcgacgacactttaaccattctcctgaaggccaccctcctcgccgtaagcggggtgtacccaatgagcatccccgccacactgttcgtgtggtacttctggcagaagaagaagcaacggagtggcgtcctgtgggacacgcccagtccacccgaggtcgagcgagccgtgctggacgacgggatctatcgtatcctccagcggggcctgctcggccggtcccaggtaggggtaggcgtgttccaggacggggtcttccacaccatgtggcacgtgacccgcggagcggttttgatgtaccaggggaaaagactggaaccgagttgggcctctgtcaagaaggatcttatcagctacggcggcgggtggagattccagggctcatggaacaccggcgaggaggtgcaagtaatcgccgtcgagcccggcaaaaaccctaagaacgtgcagacgacccccgggaccttcaagaccccggagggagaggtcggcgcgatcgcgttagacttcaaacctggaacgagtggctccccgattgtgaaccgcgagggtaagatagtgggcctctacggcaacggagtggtcaccacaagcggaacctacgtgtcagctatcgcccaggctaaggcgtcacaagaggggcccttgcccgagatcgaggacgaagtattcaagaaacgcaatctcacaattatggacctacacccgggtagcgggaagacgcggcgctacctgcccgcgatcgtccgagaggccatcaagcgcaaactccggaccctaatcctggccccaacccgcgttgtggcctcagaaatggcggaggccctcaaaggcatgccaatccgctaccagacgaccgccgtcaagagcgagcacaccggccgggagatcgtggacttgatgtgccacgcgacctttacgatgcgcctgttatccccggtacgggtccccaactataacatgattatcatggacgaagcccacttcaccgacccagcgagtatagccgcaaggggatacataagtacgcgggtgggcatgggtgaagccgccgcgatctttatgaccgcgacgcccccggggtcagtggaagcctttccgcagagtaacgccgtgatccaggatgaggagcgcgacattcccgaacgcagctggaacagtggatacgactggatcacggattttcccggcaagaccgtttggttcgtgccgagcatcaaatctggcaacgacatagcgaactgtctgcggaaaaacgggaagcgagtaatacagctatcgcgcaaaaccttcgacacagagtatcagaagacaaagaacaatgactgggactacgtggttaccactgacatctccgagatgggcgctaacttccgtgccgaccgcgtcattgacccccggcgctgtttgaagcccgtgatcctgaaggacggtcccgagcgggtgatcctggccggcccgatgccagttactgtggcctctgcggcccagcgccggggacggatcggccggaaccagaacaaggagggcgatcagtacatctatatggggcaacccctcaataacgacgaggaccacgcgcactggaccgaggccaagatgttgctggacaatatcaacacccccgagggcatcatcccggccctctttgagcccgaacgcgaaaagtctgcggcaatcgacggcgaataccgcttacggggcgaggcacgcaagacctttgtagagctgatgcggcgcggggacctaccggtatggctgagctacaaggttgcttccgaggggtttcagtacagcgaccgaagatggtgtttcgacggcgaacgtaacaatcaggtgcttgaagaaaacatggatgtggaaatctggacgaaggaaggcgagcgcaagaagctccggccacgctggctggacgcacggacatattctgaccctttagcactccgcgagttcaaggagttcgctgccggccggcgctcagtgagcggggacctaatccttgaaatcggcaaactcccccagcacctgaccctgcgggcccaaaacgccctcgataacctggttatgctgcacaactcggaacaaggcgggaaggcataccggcatgccatggaggagctcccagacaccatcgagaccctgatgctgctcgccctgatcgccgtgctgacaggaggagtcacactcttctttctaagtggtaaggggctgggcaaaacctccatcggcttactgtgtgtcatggcgagcagtgccctgttatggatggcctccgtggaacctcactggatagcggcctccataatcctggagttcttcctgatggttctcttgattccagagcccgatcggcagcgcacgccgcaggacaaccagctggcgtacgtcgtgatcggactcctgtttatgatcttaacggtggccgccaatgagatgggcctcttggagaccactaaaaaggacttgggtatcgggcatgtggcagctgagaaccaccaccacgcgaccatgctggacgtggacctgcggcctgccagcgcctggacgctgtacgccgtggccaccacggtcattacccccatgatgcgccatacgatagagaacactacagcgaacatctcgctcactgcgatcgctaaccaggccgcgatcctgatggggctggataaaggatggcccatcagcaagatggacatcggtgttcctctcctggcgctggggtgttattcacaggtgaacccgctcacgctgaccgccaccgtcctgatgctcgtggctcattacgccatcatcggccccggactgcaggcgaaggccacccgggaagcgcagaagcgcacggccgcgggcataatgaagaaccctaccgtggatgggatcgtcacgatcgacctggatcccgtcgtctacgacgcgaagttcgagaaacagctcggtcagatcatgcttctgattctctgtacctcacagatcctgctcatgcgcacgacatgggccctgtgtgagtccatcaccttggcgaccggccctctgacgaccctctgggagggcagtccaggtaagttttggaataccaccatcgccgtctcaatggcaaatattttccggggcagctacctggcgggcgccggcctggcattctctcttatgaagagtctcggtggcgggaggcgggggacgggggctcagggcgaaaccttaggagaaaagtggaagcgccaattgaaccaactttccaagtcggagtttaacacctataagaagtcagggatcatggaggtggacagatcggaagccaaagagggcttaaagcggggagagactaccaagcacgcagtgagcagaggtaccgctaaacttagatggtttgtcgagcggaacctcgtgaagcccgaggggaaggtgatcgatctcggttgcggccgcggcggatggtcctactactgcgcaggcctgaagaaggtcactgaggtgaagggatacaccaagggcggtcccggccacgaggagcccatcccgatggcgacgtacgggtggaatctcgtgaagctgcactccggcaaggacgtcttcttcacaccgcccgagaagtgcgacacactgctatgcgacatcggggagtcaagcccgaaccctaccattgaggaggggcggaccctgcgtgtactgaagatggtggagccatggcttcgagggaaccagttctgcatcaaaatcttgaacccgtacatgccctccgtcgttgagacgctggagcagatgcaacgcaagcacggcggcatgctcgtgcgaaatcccctgtctagaaattccacccatgaaatgtattgggtatcatgcgggaccggcaacatcgtgagcgcggtgaatatgacctctcggatgctactgaaccgctttacgatggcccatagaaagcccacatatgagcgcgacgtcgacctgggagccggcacccgccatgtggccgtagaacccgaggtcgccaacctcgacattattggccagaggatagagaatattaaaaacgaacacaagagcacctggcactacgatgaggacaacccgtacaaaacgtgggcgtaccacgggtcctatgaggtgaagccctccggcagcgcatcaagcatggtgaacggtgtggtgcgcttgctgaccaaaccctgggatgttatccccatggtgacccaaatcgccatgaccgacacgaccccgttcggacagcaacgcgtattcaaagagaaggtcgacaccagaacaccccgcgcgaagcgcgggacggcgcagataatggaggtcaccgcgaagtggttgtggggctttctgagccgtaacaaaaagccccgcatctgcacccgggaggagttcacgcgcaaggtgcggagcaatgccgccatcggcgccgtcttcgtggatgagaatcagtggaacagcgccaaggaggcggtggaggatgagcgcttttgggacctggtccacagggagcgcgagctgcataagcaagggaagtgcgccacgtgcgtgtacaacatgatgggcaagagagagaagaagctcggggagttcggcaaggctaagggctcccgggccatctggtacatgtggctgggcgcacggttcctggagttcgaggccctcggattcatgaacgaggaccactggttctctcgcgagaactccctgagcggggtcgagggcgaggggctgcacaaactgggttacatcctgcgagacatctccaagataccaggcgggaatatgtacgccgacgataccgccgggtgggacactagaatcaccgaggacgacctgcagaacgaggccaaaatcacggacatcatggaacccgaacacgcccttttagccacaagcatctttaaactgacctatcagaacaaggtcgtgcgagtccagaggcccgctaagtcaggcacggtgatggatgtgattagtcgcagagaccagcgcgggagcggccaagtgggcacttatggcttaaacacgttcaccaatatggaggtccaactgatccgccagatggagagcgaagggatcttctcccctagcgagctggaaaccccgaatctcgccaagcgcgtcctggattggctggagaaacacggcgctgagcgtttaaaaaggatggcgatctccggggacgactgtgtggtcaagcccatcgacgaccgttttgccacagccctgaccgccctgaacgacatgggcaaggtgagaaaggacatcccccaatgggaacccagcaaggggtggaacgactggcagcaagtgccgttctgctcccatcactttcaccaactcattatgaaggacggaagagacattgtcgtgccctgccgcaaccaggacgaactggtgggacgggcgcgcgttagccaaggcgcaggctggtccctgcgggagactgcctgcctcggtaagtcttacgcacagatgtggcagctgatgtactttcacaggcgggacctgcgcctcgccgccaatgccatctgcagtgccgtgcccgttgactgggtacccacctctcggaccacgtggagcatccatgcccaccaccagtggatgaccaccgaggacatgctatccgtgtggaatcgcgtgtggatagaggagaacccttggatggaggataagacccacgtctcttcttgggaggaggtcccctacttaggcaaaagggaggatcagtggtgcgggtccttaatcggcttaacggcccgcgccacttgggccacgaacatccaggtcgccattaatcaggtccgccggctgatcggcaacgagaattacttagactacatgaccagtatgaagagattcaaaaacgagagtgaccccgagggggccctgtggtaa

SEQ ID NO: 23770 - RNA, 9879 nt, synthetic construct
  misc_feature 1..9879: note = derived and/or modified CDS sequence (opt11) from DENV-1__FJ850087__SS-prME
  source 1..9879: mol_type = other RNA
agcgtgaccatgctgctaatgctgttgcccaccgcgttagcattccacctcaccacccgtggcggggaaccccatatgatagtgagcaagcaggaacggggcaagagcctgttgttcaagacgagcgtgggggtcaacatgtgcaccctgatcgccatggacctgggcgagctctgcgaggacacgatgacctacaagtgcccccgcatcacggaggccgagcccgacgacgtagactgttggtgtaacgcaacggacacttgggtgacatacgggacctgcagccaaactggcgagcaccgccgcgacaagcggagcgtggccctggcgccccacgtaggcctggggctcgagacgcgaacggagacgtggatgagctccgagggcgcgtggaagcagatccaaaaggtggaaacctgggcgctgagacaccccgggttcacagtgatcgctctgttcctcgcacatgcgatcggcacctcaatcacacagaaggggatcatcttcattctgttgatgctcgtcacacccagcatggccatgcgctgtgtggggatcggcaaccgggacttcgtggaagggctgagcggcgccacctgggtcgacgtcgtgctggagcacgggtcctgcgtcaccaccatggccaagaacaagccgaccctcgacatcgagctgctgaagactgaggtgaccaaccccgccgtcctccgcaaactgtgtatagaggcgaaaattagcaacaccaccacggactcccgatgccccacccagggcgaggccacgctggtagaggagcaggacgccaacttcgtgtgtcgccggacgttcgtagaccgggggtgggggaacggctgcggcctcttcggcaaggggagcctgctgacgtgcgcgaagttcaagtgcgttaccaaattggagggcaaaatcgtgcagtacgagaatctgaagtacagcgtgattgtgacggtgcacaccggcgaccagcaccaggtcggtaacgaaacaaccgagcacgggaccatcgccaccatcacgcctcaggcccccacaagcgagattcagctgacagattacggggccctcactttggactgtagcccccgaaccggcctcgatttcaacgagatggtgctcctgacgatgaaggagaagtcctggcttgtgcacaagcagtggttcttggacctgccgctgccctggacctctggggcaagcacttcgcaggagacctggaaccgacaggacctcttagtcacgtttaaaaccgcacacgctaagaaacaggaggtggttgtactgggttcccaggagggcgctatgcacaccgccctcaccggcgccaccgagatccagaccagcggcaccaccaccatattcgcggggcatctgaagtgccggctgaagatggacaagctcactttgaagggaatgtcctacgtgatgtgtaccgggagcttcaagctggagaaagaggtggccgagacccagcacggcaccgttctggtccaggtgaagtacgagggcaccgatgccccctgcaaaattcccttcctcacccaagacgagaaaggggttacccagaacggtcgcctgattacggccaatcctatagtgacagacaaggagaagcccgtgaacatcgagaccgagccgccgttcggtgagagctacatagtggtgggcgccggcgaaaaggctctgaagctctcatggttcaaaaagggttcctccatcggcaagatgtttgaggcgacggcccgcggggcgcgccgtatggccatcctcggcgatacggcctgggactttgggtcgatcggagggctgttcaccagcgtggggaagctcatccaccaggtctttggcaccgcgtacggggtgctgttcagcggcgtgagctggacgatgaagatcggcatcggcatcttgctcacgtggcttggcctaaattcccggagcaccagtctcagcatgacctgcatcgctgtcgggatggtgaccctgtacctgggcgttatggtccaggcagattccgggtgcgtgattaactggaagggccgcgagctcaaatgtgggagcggcatattcgtcacgaacgaggtccacacctggaccgaacagtacaagtttcaagccgactcaccgaagcggctgagcgccgcgataggcaaggcctgggaggagggggtgtgcggcatacgcagcgcaacccggttggagaacatcatgtggaagcagatctccaacgagctcaactacattctgttagaaaatgatatgaaattcaccgtggtcgtaggtgacgtcaacgggatcctcgcccaggggaagaagatgatccggccccagcccatggagcacaagtatagctggaagtcctggggcaaagccaagataattggcgcggacatccagaacacgaccttcatcattgacgggcccgatacgccggagtgccccgacgaccagcgggcctggaacatctgggaggttgaggactacggcttcggtatcttcactacgaacatctggttaaagctgcgcgacagccatacccagatgtgcgaccatcggctcatgtccgccgccatcaaggacagcaaggcggtgcacgccgatatgggctattggatcgagtccgaaaagaacgagacttggaagctcgcccgcgctagcttcattgaggtgaagacatgtatctggcccaagtcccacacgctgtggagcaacggcgtactcgaatccgagatggtgatccccaagatctatgggggtccaatcagccaacacaactaccggccggggtatttcacccagacggccggaccctggcacctgggcaagttagagctagactttgatctgtgcgaaggcaccacggtggtcgtggacgaacactgtggctaccgcgggccgtctctgcggaccaccaccgtaacgggtaagatcatccacgagtggtgctgtcgcagctgtaccctcccgcccctgcggttccgcggggaggacggttgctggtacgggatggagataaggccggttaaggagaaagaggagaacctggtgaggtccatggtgagtgcgggatcaggcgaggtcgacagcttcagccttgggatcctgtgcgtgtccattttgattgaggaggtgatgcggagccgttggtcccggaagatgctcatgaccggcaccctggtcgtgttcttactcctcatcatgggacagctgacgtggaacgacctcattcgcctgtgcatcatggtaggtgccaatgcctcggaccgtatgggtatgggcaccacataccttgccctcatggccacgttcaagatgcggcccatgttcgcggtcggcctgctgttccgccggctcacaagtcgggaagtgttactgctcaccgtcgggctgagcctcgtggcctcggtggagctccccaacagcctggaggagctgggggacgggcttgccatgggcatcatgatgctgaagctgttgaccgatttccagccccaccaactgtggacaacgctgctctccctgaccttcattcggactagcctgtccctcgactacgcgtggaagacgatggccatggcgctttcgattgtctccctgttccccctctgcctgagcacgacatcccagaagaccacctggctgccggtgctccttgggagcttcggatgtaagcccctgacgatgttcctcatcaccgagaataaaatctggggccgcaagtcctggcccatcaatgaggggatcatggcggtgggaatcgtctccattcttctgtccagccttttaaagaacgacgtgcccctggccggccccctcatcgccggtggaatgcttatcgcgtgttacgttattagcgggtccagcgccgacctgtccctcgagaaggcagccgaagtcagctgggaggaggaggccgagcactccggcacgtcacacaacatactggtggaagtgcaggacgacgggaccatgaagattaaggacgaagagagggacgacaccctgacgatcctcctaaaggcgaccctgctcgcggtttccggcgtgtaccccatgtcgattcccgccaccttattcgtgtggtacttctggcagaagaaaaagcagcgctctggtgttctgtgggacacccccagcccgcccgaggtggaacgggccgtgctggacgacggcatttatcgcatcctccagcggggcctgctggggaggtcccaagtgggcgtgggtgtcctccaagatggcgtcttccacacgatgtggcacgtgacccgcggcgccgtgctgatgtaccagggcaagcgcctggaacccagttgggcttccgtaaagaaagatctcatctcatacggcgggggctggcggttccaaggatcctggaacacgggagaagaggtccaggtgatagccgtcgaacccgggaaaaacccgaagaacgtgcaaaccactcccggcaccttcaagacccctgagggcgaagtgggggcaattgccttggatttcaagcccggaacctcaggatccccgatcgtgaaccgcgagggaaaaattgtcggactgtacggaaacggcgtggtcacgacaagcgggacctacgtttccgccattgcgcaggctaaagccacccaggaaggccccttgcccgagatagaggacgaagtgttcaagaagcggaacttgacgataatggacctgcatccagggagcggaaagacccgccggtacttgcccgccattgtccgcgaggccatcaagcggaaactgaggacactgattctcgcgcccacccgggtggtggctagcgagatggccgaggccctgaagggaatgcctatccgctatcagacgaccgcggtgaagagtgagcacaccgggcgcgaaatcgtggacctgatgtgccacgcaacctttacgatgcggctcttgtccccggtgcgggtccccaactacaatatgatcatcatggatgaggcccactttactgatcccgcgtccatcgccgcgcgtggctacatcagcacgagggtggggatgggcgaggccgctgccatcttcatgaccgcaacacccccagggtccgtggaggcgttcccccagtcaaacgccgtcattcaggatgaggagcgggacatacccgagcgcagctggaatagcggctacgactggatcacggacttccccggtaagaccgtgtggttcgtaccctccatcaagagcgggaacgacatcgcaaactgcttacggaagaacggcaagcgcgtcattcagttgtcgcggaagacctttgacacggagtatcagaagaccaaaaacaacgactgggactatgtggtgaccacggatatcagcgagatgggggccaactttcgcgccgaccgggtcatcgatccccgaagatgcttaaagcccgtaatcctaaaggagggccccgagcgcgtcatcctcgcagggcccatgcctgtgaccgtggcctccgcggcccagcgtcggggccggatcgggcgcaaccagaacaaggagggggaccaatacatttacatgggccagcccctgaataacgacgaggatcacgcgcactggaccgaggccaaaatgctcctcgataatatcaacacccccgaggggatcatcccggcgctgttcgagcccgagcgcgagaagtccgcagccatagacggcgagtaccggctgcgcggagaggcacgcaagaccttcgtcgagctaatgcgccgaggcgacctgcccgtgtggctgtcctacaaggtggcctcggaaggcttccagtactcggacaggcgctggtgcttcgacggcgagcggaacaaccaggtcctcgaggagaacatggacgtggagatctggacgaaggagggcgagaggaagaagctgcgcccacggtggctggatgctcgaacctacagcgacccgctcgccttacgcgaatttaaagagttcgcggcgggacgccggtctgtgagcggcgacctgatcctcgagattgggaagctgccccagcacctgaccctccgcgcccagaacgccctggacaacctggtcatgctgcacaacagcgaacagggcgggaaggcctaccggcatgcaatggaagaactgcccgacaccattgaaaccctgatgctcctggctttgattgccgtgctcaccggcggggtgaccctcttcttcctgtcggggaaagggcttggcaaaaccagcatcgggttactgtgcgtcatggcctcctccgccctgctgtggatggcgtccgtggagccacactggatcgcggccagcatcatcctggaatttttcctcatggtgctgctcataccggagcctgaccgccagcggacaccccaggataaccagctagcctatgtcgttatcggcctgttatttatgatattgacggtggccgcgaacgaaatggggctgctggagacgaccaagaaggacctcggcatcgggcacgtcgccgtcgagaatcaccaccacgccaccatgctggacgtggacctgcgcccggcctccgcctggacgttgtacgcggttgccaccaccgtgatcacccccatgatgcggcatacaattgagaacactaccgccaacatcagcttgaccgcgatcgcgaaccaggcggccattcttatgggcctcgacaagggctggcccatctccaagatggacatcggggtgcccctgttggccctcggatgctacagccaggtcaaccccctgaccctgaccgccgctgttttgatgcttgttgctcactacgccatcatcgggcctgggctgcaggcgaaagcaacccgcgaggcgcaaaagaggaccgccgccggaatcatgaagaatcccacggtagacggaatcgtgacgatcgacctcgaccccgtggtctacgacgccaagttcgaaaagcagctgggccagatcatgctgttaatcctgtgcacgagccagatcctgctcatgcggaccacttgggccctgtgtgagagcatcactctggcgaccgggccattaaccacgctatgggagggcagtcccggtaagttttggaacaccaccatagcagtgagcatggctaacatattccgcgggtcctacctggctggcgccgggttagcgttttcactgatgaaatccctgggcggagggcggcgcggcaccggcgcccagggcgagacgctcggggagaagtggaagcggcagttaaatcagctgagtaagagcgagttcaacacatacaagaagtcaggcatcatggaagtcgaccgtagcgaggccaaggaggggctgaagaggggcgaaaccacaaagcacgcggtctcccgcggtacggccaagctccggtggttcgtggagaggaacctcgtgaagccagagggcaaggtcatagacctgggctgtggcagagggggttggagctactactgcgcggggctcaaaaaggtgaccgaagtaaaaggatatacgaaaggcggtcccgggcacgaggagccgattccaatggccacctacggctggaacctggtcaagctgcactccgggaaggacgtcttctttacgccgcccgagaagtgcgacacactcctgtgcgatataggcgaaagctcccccaaccccacgatcgaagaggggaggaccctgcgagtcctcaagatggtagagccctggctgcgcggcaaccagttctgtatcaagatcctgaacccatacatgcctagcgttgtggagaccctagaacagatgcagaggaagcatggcggcatgctagtcagaaaccccttatcccggaacagcacgcacgagatgtactgggtctcctgtggtaccgggaacatagttagcgccgtcaatatgacctcgcggatgctcctcaaccggttcaccatggcccatcgcaagcctacgtacgagcgcgatgtggatctcggagcgggcacccgacacgtggccgtcgagccggaggtggccaacctcgacatcatcgggcaaaggattgaaaacatcaagaacgaacacaagagcacctggcattacgacgaagacaacccctacaagacctgggcctatcacggctcgtatgaggttaagcccagcgggtccgccagctccatggtgaacggcgtggtccggctgctgacgaagccgtgggacgtcatccccatggtaacccaaatagcgatgactgacaccactccgttcgggcagcagcgcgtcttcaaggaaaaggtggacacccggacgccccgggcgaagcggggaactgcccagatcatggaggtgacagccaagtggctctggggcttcctatcacgcaataagaagccccggatctgcacccgcgaagagtttacccggaaagtccgctccaacgccgcgatcggggccgttttcgtggacgagaaccaatggaactcggccaaagaggccgttgaagacgagcggttttgggacctggtgcaccgcgagcgggagttacacaagcagggaaagtgcgcgacttgcgtgtacaacatgatggggaagagagagaagaagctgggcgagttcggcaaagcaaagggcagccgggccatctggtacatgtggctgggcgcgcggttcctcgagttcgaggccctggggtttatgaacgaggaccactggttctccagggaaaatagcctatccggcgtcgagggggagggccttcacaaactggggtacatcctgcgcgacatcagcaagatcccgggcggcaacatgtatgcggacgacacagccgggtgggacacccggattaccgaggacgacctccagaacgaggccaagatcaccgacatcatggagcccgaacacgctctgctggccacgagtatcttcaagctcacctaccagaacaaggtggtccgcgtccagcgccccgctaagtcgggcaccgtgatggacgtgatctcccggcgggaccagcgcgggagcggccaggtcggcacctacgggctgaacacgttcaccaacatggaggtacaactgattcgccaaatggagtcagagggtatcttcagcccctccgagctcgaaaccccaaacctggccaaaaaggtgctggactggctcgaaaagcacggggccgaacggctgaagcgcatggccatttctggcgacgactgcgtcgtgaaacccatcgacgaccggttcgccaccgcgcttactgccctcaacgacatgggcaaggtgaggaaggacatcccgcagtgggagccctccaaggggtggaatgactggcagcaggtcccgttctgcagccatcacttccatcagctcatcatgaaggacggccgggagatagtggtgccatgtcgcaaccaagacgagctggtcgggcgcgctcgggtgtcacagggcgccgggtggagcctccgggagaccgcctgcctggggaaatcctacgctcagatgtggcagcttatgtacttccaccgtcgagacctgcgccttgccgccaacgctatatgcagcgccgtgcccgtagactgggtgcccaccagccggaccacctggtctatacacgcgcaccaccaatggatgacgaccgaggacatgctgtcagtgtggaaccgcgtctggatcgaggagaacccatggatggaggacaagacccacgtgagcagctgggaggaggtaccctacctcggaaagcgggaggaccagtggtgcggctcactgataggattgaccgcgcgcgccacttgggccaccaacatccaggtcgctataaaccaggttcgcagattaattgggaacgagaactacctggactacatgaccagcatgaagcgattcaagaacgagtccgaccccgagggcgccctctggtaa

SEQ ID NO: 23771 - RNA, 9879 nt, synthetic construct
  misc_feature 1..9879: note = derived and/or modified CDS sequence (opt11) from DENV-1__FJ850090__SS-prME
  source 1..9879: mol_type = other RNA
agcgtgacaatgctgcttatgctgctgcctacagcgttagcttttcacctgaccaccaggggtggagaaccccatatgattgtgagcaagcaagaacggggaaagagcctcctcttcaagaccagcgtgggggtgaacatgtgcaccctgatcgcgatggatttaggcgagctttgcgaagacaccatgacctacaagtgcccacgcattacagaggttgagcccgacgacgtcgactgctggtgcaacgccactgacacctgggtgacttacgggacctgcagccagaccggcgaacacagaagagataagcgaagtgtcgccctggcgccacacgtgggcctggggctcgagacgcgcaccgagacctggatgagctccgagggcgcgtggaagcaaatccagaaggtggagacctgggcgctgcggcatccagggttcacagtgatcgccctgtttcttgcccacgccatcggcacctctattactcaaaaggggatcatattcatcctactgatgcttgtgaccccatcgatggcgatgcgctgtgttggcatcggcaaccgggacttcgtcgaggggttatcaggcgcaacgtgggtggacgtggtcctggagcacgggtcctgcgtgaccaccatggccaagaataagccaaccctcgacatagaactgctgaagacggaggttacaaaccccgccgtcctccgcaaactttgcatagaggccaagatctctaacacgaccacggactcccggtgccccacccagggcgaagcgaccctagtggaggagcaagacgcaaatttcgtgtgccggagaaccttcgtcgaccgcggctggggcaacggctgcggcctcttcggcaagggttccctcttgacgtgtgccaaattcaagtgcgtgacaaagttagaaggcaagatcgttcaatatgagaacctgaagtactccgtcatagtgacggtccacaccggagaccagcaccaggtggggaacgagacgaccgaacacggaaccatagctaccataacgccccaagcccccacgtcggagatacagctgactgactacggggccctaacgctggactgtagcccccggaccggcttagacttcaacgagatggtgctcctgacaatgaaagagaaatcctggctggtccataagcagtggttcctggacctgccgctgccatggacctccggggctagcacatcccaggagacctggaaccgccaggacctcctggtgacgttcaagaccgcccatgccaagaagcaggaagtggtcgtactgggctcccaggagggcgcgatgcataccgcgctcaccggggccacggagatccagaccagcggcaccaccacgatcttcgccggtcacttaaaatgccggctgaagatggataagctcaccctgaagggcatgtcatacgttatgtgcacaggcagcttcaagctggagaaggaggtcgccgagacccaacacggcacggtgctggtgcaggtcaagtatgagggtaccgacgcgccctgtaagatcccctttctcactcaggacgagaaaggggtcatccagaacggccgacttatcaccgcaaacccgatcgtgacggacaaagaaaaaccagtaaacatcgagacggagcctccattcggggaatcttacatcgtggtgggtgcgggagaaaaagcactgaaacttagctggttcaaaaaggggagcagcataggcaagatgttcgaagccaccgcccgcggagcccggcggatggccatcttgggcgacaccgcttgggatttcgggagcattgggggcctgtttacgagtgtcgggaaacttatccaccaagtattcggcaccgcctacggggtactcttctcgggcgtcagttggaccatgaagatcgggatcggcatcctgctcacctggctaggattaaactcacgctcgaccagcctctcgatgacttgcatcgcggtgggcatggtgaccctatacctgggcgttatggtacaggccgattccgggtgcgtgataaattggaagggtcgagagctcaagtgtggcagcggtattttcgtcaccaacgaagtgcacacgtggactgagcagtataagttccaggccgactccccgaagcgtctcagcgctgcaatcggtaaagcctgggaggaaggggtgtgcggcatccgcagtgccacacggctagagaacatcatgtggaagcagatctccaacgaactaaactatatcctccttgagaacgacatgaagttcaccgtcgtagtgggggatgccaacggcattctcactcagggcaagaagatgatccgccctcagcctatggagcataaatacagctggaagtcctggggaaaggcaaagatcattggcgcggacatccagaacactacattcatcatagacgggcctgataccccggagtgccctgacgatcaacgggcctggaatatctgggaagtagaggactacggattcgggattttcaccacgaacatttggttaaagttgcgcgacagccacactcagatgtgcgatcacaggctaatgtccgccgctattaaagactccaaggcagttcacgcggacatgggttactggatcgagagcgagaagaacgagacctggaagctcgcccgagccagcttcattgaggtgaagacctgcatctggcccaagtcgcacacgctatggtcgaacggcgttctcgagtccgagatgatcatacccaagatttacgggggcccaacctcccagcacaattaccggcccggctacttcacccagacggccggcccctggcacctggggaagctggagttagatttcgacctgtgcgaggggactacggtggtggtagatgagcattgcggataccgcggtccgtccctgcggaccactacggtgacaggcaagatcattcacgaatggtgctgtagaagctgtaccctgccgccgctgcggttccgtggggaagacgggtgttggtacggtatggagatcaggcccgtaaaggagaaggaagagaacctggtccgctccatggtaagcgcaggctccggtgaggtcgacagcttctcgcttgggatcctgtgcgtcagcattctgatagaggaggtgatgcgtagccgctggtcccggaagatgcttatgaccggtacgctagcggtattccttctactgataatggggcagttaacctggaacgacctcattcgcttatgcatcatggttggcgccaatgccagcgatcgaatgggcatgggcaccacgtaccttgccctcatggccacgttcaaaatgcgcccaatgttcgcggtcgggctgctgttccgcaaattgaccagtcgtgaggtgctgctcctcacgatcggactgtccctagtggccagtgtggaactcccaaacagtcttgaggagctaggcgatggtctagcaatgggcatcatgatgctgaaactgttgaccgattttcagcctcaccagttgtggacgacactgctctccctgacattcatcaggaccagcctgtcgcttgattatgcctggaagacaatggccatggcgctgagcatcgtgtctctgtttccactctgcctgagcaccacctcccagaagactacgtggttgccggtgctcctgggcagcttcggttgcaagcccctgaccatgtttttgattacggagaacaagatctggggccggaaatcctggcccatcaatgagggtatcatggccgtgggaatcgtcagcatcctgctatcaagcctccttaagaacgacgtgcccctagctggtccgttgatagcgggcggcatgctcatagcatgctacgtgatctctgggtcctccgcggatctgagcctcgagaaggccgccgaagtatcctgggaggaggaggccgagcactcaggcacctcccacaatatcctggtggaggtacaagacgacggaacgatgaagatcaaggatgaagagagagatgacacgctgaccatcctcctgaaggcaaccctgctggctgtgtccggcgtctaccccatgagcatacccgccaccctgttcgtgtggtacttctggcagaagaagaagcagcggtccggcgtcctttgggacacgcccagcccgcccgaggtggaacgcgccgttctggatgatggcatctaccggatcctgcagcgcgggttattgggtcggtcccaagttggtgtgggcgtcttccaggacggcgtcttccacaccatgtggcacgtgacccgaggggccgtgctcatgtatcaggggaaacgactggaacccagctgggcgtccgtcaagaaggacctgatcagttacggcggcggctggcgcttccaggggagctggaacaccggtgaagaggtccaggttatcgccgtcgagcccggtaagaatcccaagaacgtccagacgacgccaggcaccttcaagacccccgaaggcgaggtgggggccatcgctttggacttcaaacccggaactagcgggtccccgatcgtgaaccgggaagggaaaatcgtagggctgtatgggaacggcgtggttacgactagcgggacatacgtgtccgcgatcgcgcaggccaaagccagccaggaggggcccctgcccgagatcgaggatgaggtatttaagaagcgcaacctgacaataatggacttacacccagggtcaggcaaaactcggcgctaccttcccgcgatcgttcgggaggctataaagcgtaagctacggacccttatcctagcccccactagagtggttgcctccgaaatggctgaagccttaaagggcatgcccatccgctaccaaactaccgctgtcaagagcgagcacacaggacgggagattgtggatctgatgtgccatgccaccttcacgatgcgcctgttgtcccccgtgagagtcccaaactacaacatgatcatcatggacgaggcccatttcaccgaccctgccagcatagcagcccgcggctacatttccacacgcgtggggatgggagaggccgccgccatcttcatgacggccacgccgccagggtctgtggaggcattcccccagtccaatgccgtcattcaggatgaggagcgggacattccggagagatcatggaactccggctacgactggataaccgactttccgggcaaaaccgtctggttcgtcccgagcataaagtccgggaatgacatcgccaattgccttcgcaagaacggaaagcgagtgatccagctaagcaggaaaaccttcgacaccgagtaccagaaaacaaagaacaacgactgggactacgtggtcacgactgacatttccgagatgggcgcgaacttccgtgccgaccgagtaattgacccccggaggtgcttgaagccggttatcctgaaggacggccccgagcgtgtaatccttgcgggaccgatgcctgttacggtggccagtgctgcgcagcgccggggccgcatcggcaggaatcagaacaaagagggggaccagtacatctacatgggccaacccctcaacaacgacgaggaccacgcgcactggaccgaggccaagatgctcttggacaacatcaacacccccgagggtatcattccggccttgtttgaacccgagcgcgagaagtccgcggccatagacggcgagtaccgcttgcgcggtgaagctcgaaaaaccttcgtcgagcttatgaggcgcggcgacctgcccgtatggctgtcttacaaggtggcaagcgaaggcttccagtattccgatcggcgttggtgtttcgacggtgagaggaataaccaagtcctggaggagaatatggacgtggagatatggactaaggagggtgagcgtaagaaattacgccctcgctggctggacgcccggacatactccgaccctctagccctcagagagttcaaggagttcgcagcggggcggagaagcgtgtcgggcgacctgatcctggaaatcggcaagctcccccagcatctaaccctgcgggcccaaaacgcgctcgataacttggttatgttgcacaactcggagcagggcgggaaggcttaccgccacgctatggaggagctgccagacaccatcgagaccctgatgctgctcgcgctgatcgcggtgctgaccggcggggtgacactcttctttctgtccgggaaaggactgggaaagacctccatcgggctgctgtgcgtcatggcgagttccgccctgctctggatggccagcgtggagccccactggatcgctgcttccataatattggagttcttcctgatggttcttctgatcccggagcccgatcggcaacgcacgccccaggataatcagctggcatacgtcgtaatcggcctattattcatgattctgacagtggcggccaacgaaatggggctgttggagaccaccaagaaggacctgggcatcgggcacgtcgccgctgaaaaccatcatcacgcgaccatgctcgatgtggatttgcggccagccagtgcttggacattatacgccgtggccacaactgtcataacccccatgatgcgccatactattgagaacacaactgccaacatcagtctcactgccatcgccaaccaggccgccatactgatgggcttggacaaaggctggcccatctccaagatggacattggggtgcccttactagctcttggatgctattcccaagtgaaccctctcacgctgaccgcgacggtgctgatgttagtcgcacactatgccatcatcgggcccggcctgcaagctaaggccacccgggaggcgcagaagcgcacggctgccgggatcatgaagaaccccaccgtggacggcatcgttacgatagacctggatcccgtggtgtacgacgcgaaattcgagaaacagctcggacagataatgctgctgatactgtgcactagccagatcctgctgatgcgcacaacctgggccctatgcgaaagtatcaccctagcgaccgggcctctgaccaccctctgggaggggagccctggcaagttctggaacaccaccatcgccgtgtccatggctaacattttccgagggagctaccttgcgggcgcagggctggcgttttccctaatgaagtcactgggagggggccggcgggggacgggggctcagggcgagaccctgggggagaagtggaagcgccaactcaatcagctgagcaagtcggaatttaacacctacaaaaagagcggcatcatggaagttgatcggtcagaggctaaggaggggttaaagcgcggagagaccaccaaacacgcagttagccggggtaccgcaaagctgcggtggttcgtagagcggaacctagtgaagcccgagggcaaggtgatcgacctggggtgcgggcgaggcggttggtcctactactgcgcaggcctaaagaaggttacggaggtgaaagggtataccaaaggcgggcccggccacgaggaacccatccccatggcgacctacggctggaacctcgtgaaactccacagcgggaaggatgtgttctttacgccgccggagaagtgtgataccctgctatgcgacatcggggagtcctcaccgaaccccacaattgaggagggtcgcacccttagagtgcttaagatggtagagccatggctccgggggaaccagttctgcatcaaaatcttgaatccctacatgccctccgtagtggaaacgttagagcagatgcaaagaaagcacggcgggatgcttgtccgtaacccactgtctcgcaattcaactcatgagatgtactgggtcagctgcggcacggggaatatcgtgtctgccgttaacatgacctcgagaatgttactcaaccgcttcacgatggcccaccggaagcccacctacgagcgcgacgtcgacctgggcgctggcaccaggcacgtagcggtggagcccgaagtcgcaaacctcgacatcataggtcaacgcatcgaaaacataaagaacgagcacaagtcgacctggcactacgatgaggacaatccgtacaagacgtgggcctaccacggcagctatgaggtaaaaccttccgggagcgcttcgagcatggtaaatggtgtggtgcgcctcttaaccaagccctgggacgtcatcccaatggtcacgcagatcgcgatgacggacactacgccttttgggcagcagcgtgtatttaaggagaaggttgacacccgcacgccccgggccaagcgcggcactgcccaaataatggaggtgaccgccaagtggctgtgggattttctctcacggaacaagaagccgcgcatctgcacccgggaggagtttactcgcaaagtgcggagcaacgcagcgatcggtgccgtcttcgtggacgagaaccaatggaactccgccaaggaggcagtggaggatgagagattctgggatttagtacaccgggagcgggaactgcataaacagggtaagtgtgccacttgcgtatacaacatgatggggaagcgcgagaagaaacttggggagtttggcaaagcgaagggtagccgcgccatatggtacatgtggctaggcgcccgcttcctggagttcgaggccctcggcttcatgaatgaggaccactggttcagccgcgagaactccctgtctggggtggagggggagggcttgcacaagctcggctatattctgcgggacatctccaagatacccggcgggaacatgtacgcagacgataccgccgggtgggacacccgcattaccgaggacgacttacagaacgaggccaagatcacggacatcatggagcccgagcacgcccttctcgccaccagcatcttcaaattaacgtaccagaacaaggtggtacgggtgcaacgccccgcaaagagcggcaccgtcatggacgtgatctcgcgccgggatcagcgcggatcaggtcaggtgggcacgtacggtctcaacacgtttaccaacatggaggtccaactgatcaggcagatggagtcggaggggatcttcagccccagcgagctcgagactccgaatctcgccaagcgtgttctggactggttggagaagcatggtgccgagcgactcaaacgcatggccatctcaggtgacgactgtgtggtcaaacccatcgacgaccggttcgccacagcgttaactgccctgaacgacatgggaaaggtgcggaaggacatcccccagtgggaaccctcaaaggggtggaacgactggcagcaggtcccattctgctcccatcatttccaccagttgatcatgaaggatggccgggacatcgtcgtgccatgccgtaaccaagatgagctggttggccgggcccgcgttagtcagggggcgggctggtccctccgggagactgcctgcctcgggaagtcgtacgcccagatgtggcagctgatgtattttcaccgccgagatttgaggctcgccgccaatgcaatctgttcggccgtgcccgttgattgggtccccacttcccggaccacgtggagcattcacgcgcatcaccaatggatgacaaccgaggatatgctttccgtgtggaacagagtatggatcgaggagaacccctggatggaagataagacccacgttagctcgtgggaagaggtgccctacctgggcaagcgcgaggaccaatggtgcgggtcgctcatcggtctgaccgctcgcgccacctgggccactaacatccaggttgccattaaccaggtgcgccggctgataggcaacgagaactacttagattatatgacgtccatgaagcgctttaagaacgaaagcgaccccgagggggcgctgtggtga

SEQ ID NO: 23772 - RNA, 9879 nt, synthetic construct
  misc_feature 1..9879: note = derived and/or modified CDS sequence (opt11) from DENV-1__FJ850093__SS-prME
  source 1..9879: mol_type = other RNA
agcgtgacgatgctcctcatgctgcttcctacggccctcgccttccacctgacgacgaggggcggcgagccccatatgattgtgtcgaagcaggagcgtggcaagtcgctgctgttcaagacaagtgccggggtgaacatgtgcaccttgatagcgatggatctcggcgagctctgcgaagacacaatgacctacaagtgccctcgcatcaccgaggccgagcccgacgacgtcgactgctggtgcaatgccactgacacttgggtcacctacgggacctgcagccagaccggcgaacacaggagggacaagcggtcagtggcactggcgccccatgtaggcctggggctcgagacccgaaccgagacctggatgagcagtgaaggcgcctggaagcagattcagcgggtcgagacctgggcactgcgccaccccgggtttacggtcatcgcccttttcctcgctcacgcgatcggcacgagtatcacacagaaggggattattttcatccttcttatgcttgtaaccccctccatggcaatgcggtgcgtaggcatcggtaaccgcgacttcgtggaggggctatccggcgccacgtgggtggacgttgtccttgagcacgggtcctgcgtcaccactatggcgaaaaataagcccaccctcgacatcgagctgctgaaaacggaggtcaccaacccagcggtgctccggaaactgtgcatcgaggccaaaatcagcaacaccaccacagattcccgctgcccgacccaaggagaggcgaccctcgtggaggagcaggacgccaatttcgtttgtcggcgcacgttcgtggaccggggttgggggaacggctgcggtcttttcggcaaggggagcttgctcacgtgcgctaagtttaagtgcgtgaccaagctcgagggaaagatagtccaatacgagaacctgaagtactcagtgatagtgaccgtccacaccggcgaccagcatcaggtggggaacgagacgacagagcacggcaccatcgcaacgataacgccccaggcccccactagcgagatccagttaaccgactacggtgcgctgacccttgattgcagcccccgcaccggcttggacttcaacgagatggtgcttctgacgatgaaggagaagtcctggttagttcacaagcaatggttcctcgacctgccgctgccatggacctccggggcgagcaccagccaggagacttggaaccgacaagacttactggtgacgttcaaaaccgcccacgctaagaagcaggaggtcgtcgtgctgggctcccaagagggcgccatgcacaccgccctcaccggtgccacggagatccagaccagcggaaccaccacgattttcgcgggccacctaaagtgccgccttaagatggacaagctcacgctgaaaggcatgtcctacgtcatgtgcacagggagcttcaagctggagaaggaagtggcggagactcagcacggcacggtgcttgtccaggtgaagtacgagggtacagacgctccctgcaaaattcccttctccacccaggacgagaagggggtgacgcaaaacggcagactcattaccgccaacccgatcgtcacggacaaagagaagcccgtgaacatcgagaccgagccgcccttcggcgaatcatatatcgtagtcggcgccggcgagaaggccttgaaacttagctggttcaaaaagggtagctcaatcggcaagatgttcgaggccactgcccgcggggctcggcgaatggctatccttggcgatacggcttgggattttgggagcatcggcggcgttttcacgtccgtggggaagctggtccatcaggtgttcggcacagcctacggggtattgttcagcggcgtgtcctggacgatgaagatcggtatagggatcctcctgacgtggttaggactcaacagtcgatccaccagcctatccatgacctgcatcgcggtggggatggtgacactgtatctaggcgtcatggtgcaggccgacagcggctgcgtgatcaactggaagggccgggagctgaagtgcgggtctggtatcttcgtcaccaacgaggtacacacctggaccgagcagtacaagttccaagccgacagcccgaagcgtctctccgcggccatcggcaaggcctgggaggagggggtgtgcggcatcagatccgccacccgcttggaaaacatcatgtggaagcaaatcagcaacgagttgaaccatatcctgcttgagaacgacatgaagtttaccgttgtggtgggggacgcaaacggcatactggctcaggggaagaagatgattcggccacaacccatggagcacaagtactcctggaagtcctggggcaaagccaagatcatcggcgccgatatccagaacacgacgttcatcatcgacgggcccgacacgccggagtgccccgacggccagcgcgcctggaacatttgggaggtcgaagactatgggtttggtatcttcacaacgaacatctggctgaaacttcgggactcctacactcagatgtgcgaccaccgcttaatgagcgcagccatcaaggactccaaggctgtgcacgcggacatgggatactggatcgaatccgagaaaaacgagacctggaagctggcccgggcgtcattcatcgaggtgaagacctgtacgtggcccaaaagccacaccttatggtccaacggagtcctggaaagcgagatgattatccccaagatttacgggggacccatctcccagcacaactaccgcccagggtacttcacccagaccgccgggccatggcatctgggtaagctcgagctggacttcgacctgtgcgagggcaccacagtagtggtcgacgagcactgcgggaaccggggcccgagcctgcgcactaccacggtgaccgggaagatcatccacgaatggtgctgccggtcctgtacgctgcctcccctgcgcttccgaggtgaggacggatgctggtatggtatggagatacggcccgtgaaggaaaaggaggagaacctcgtccgtagcatggtctcagccggcagcggggaagtggacagcttcagcctcggcatcctgtgcgtcagcatcatgattgaagaggtgatgcgcagtcggtggagccgcaaaatgctgatgactgggacgctggccgtgttcctgctcctgatcatgggccaactgacctggaatgacctcatccgcctgtgcatcatggtcggggccaatgcgagcgaccggatgggtatgggaaccacccacctggccctgatggccacgtttaagatgcgcccgatgttcgccgtagggctgctgttcaggcgcctcacctccagagaagtgctgctgcttaccatcggtctcagcttgatggccagcatggagctccccaactccctggaggagttgggtgacggcctcgctatgggcatcatgatgctaaagttgctcaccgagttccagccccaccaactgtggacgacgctgctctcgctgaccttcgtcaagaccacgctgtcgctcgactacgcttggaagaccaccgctatgatcctgagcattgtgtcccttttccccctctgcctgagcacgacgtcgcagaagaccacctggctaccagttctcctggggtctttcggatgcaagcccttaaccatgttcctcatcaccgagaacaagatctgggggcgcaagtcctggcccctaaacgaaggcattatggccattgggatcgtgagcatcctgctctccagcctgctgaagaacgacgtgcccctcgcgggtcctctgatcgcaggcggaatgctgatcgcctgctatgtgatcagcggctccagcgcagaccttagtctggagaaagccgccgaagtgagctgggagcaagaggccgagcacagcggggccagccacaacatcctggtggaggtacaggatgacggcacgatgaagatcaaagacgaggagcgcgacgacactctcaccatcctcctgaaggccaccttgctggccgtgtccggggtgtaccccatgagcatccccgcgacgctgttcgtatggtacttctggcagaaaaaaaagcagcgctccggcgtgctgtgggacacaccctccccgccggaggtggagcgggccgtcctggacgacggcatctacaggattctgcagcgggggctgctcggtcggtcacaagtgggagtgggcgtcttccaggacggggtgttccacaccatgtggcacgtaacccgaggcgccgtcctgatgtaccagggcaaacgcttggagcccagctgggcctccgtgaagaaggatctcatctcctatgggggcgggtggcggtttcagggctcctggaacacgggggaagaggtgcaagtcatagcggtggagcccgggaagaaccctaagaacgtccagaccacccccggcaccttcaagacacccgagggggaggttggtgcgatcgccctggacttcaagccaggtacctctggcagcccgatcgttaatagggagggtaagatcgtggggctgtacggcaacggggttgtgaccacatctggcacgtacgtgtcagccatagcccaggccaaggccagccaggaaggcccactccccgagattgaggacgaggtcttcaagaagcggaacctgacgatcatggacctgcatccgggctcaggcaagacccgccggtatctccctgccatcgtaagggaggccatcaagcggaagctgcgcactctgatcctcgcccccacgcgcgtggtcgcgtccgagatggccgaggccctgaaaggcatgcccatcagataccagacgaccgccgtcaagagcgagaccacggggcgcgagatcgtggacctgatgtgccatgcgaccttcacaatgagactgctgagtcctgttcgagtgcccaactacaacatgatcatcatggacgaggcgcacttcaccgaccctgccagcatcgccgcccgggggtacatctccacgcgcgtcggcatgggggaggccgcggccatctttatgacggccacgccacccggtagcgtcgaggcgttcccccaatccaacgccgtgatccaggacgaggaacgggacatccccgagcggagctggaacagtggttacgactggattaccgacttcccagggaaaacggtctggttcgttccctcaattaaatccggcaacgatatcgcgaactgcctgcggaagaacggcaaacgcgtgattcaattgagtcggaagaccttcgacaccgaataccagaagaccaagaacaacgactgggactacgtggtcacgacggatatctccgagatgggcgccaacttccgcgccgaccgggtgatcgatccccgccggtgcctgaagcccgtcattctgaaggacggtcccgagcgcgtgatccttgcgggtcccatgcccgtgaccgtggcgagcgctgcccaacgacgcggccggatcgggcgcaaccagaacaaggaaggcgatcagtacgtctacatggggcagcccctgaacaacgacgaggaccacgcccactggactgaggccaagatgctgttagacaacatcaacacccccgagggcattatcccggcgctgtttgagccggagcgcgaaaagtccgcagctatagacggcgagtaccgtttgcgcggcgaggcccggaagacctttgtagagttaatgcgccggggcgacctgccggtctggttgagttacaaggtggcgtcggagggcttccaatactcggaccgccggtggtgcttcgatggcgagcgcaataaccaggtgctcgaggagaacatggacgtcgagatctggaccaaagagggagagcggaagaaactgcgcccgagatggctggacgcgcgcacctactccgacccgctcgccctacgggagttcaaggagttcgccgccggcagaaggagcgtgagcggcgatctaatcttggaaatcgggaaactgccccagcatctgacactacgcgcccagaacgcgctggacaacttagtcatgttgcacaacagcgagcagggcggtaaggcctatcgtcacgccatggaagagctccccgacaccatcgagaccctgatgctcctagccctcatcgctgtcctcaccggcggggtaaccctgttcttcttgtcgggcaaggggctcgggaagacctccatcggcctgttgtgcgtgaccgccagctccgcgctgctctggatggccagcgtcgagccccactggatagccgcgtccataattttagaatttttccttatggttctgctgatcccggagcccgacaggcagcggacgccccaggacaaccagctcgcctacgtggtcattgggctgctgttcatgatcttgaccgtggccgccaacgagatgggcttgttggagacgaccaagaaggacctcgggatcggatatgtagccgcggaaaaccaccagcacgccaccatgctggatgtcgacctgaggccggccagcgcctggaccctctacgccgtcgcgacgaccgtcatcacccccatgatgcggcacacaatcgagaatacgaccgccaacatctccctcaccgccatcgccaaccaggccgcgatcttgatgggcctcgacaaagggtggcccataagcaagatggacatcggcgtcccgctgctcgctctggggtgctactcccaggtcaatccgttaacactcacggccgccgtgctaatgctggtcgctcactacgccataatcgggcccgggctgcaagccaaggccacccgcgaggcgcagaagcgaaccgcagcgggaatcatgaagaatccgaccgtggatggcatcgtggcaatcgacctcgatcccgtggtgtatgatgccaagttcgagaaacagctggggcagatcatgctgctcatcctgtgcacgagtcagatactactgatgcggaccacctgggcactatgtgaatccatcaccctggctacggggccgctcaccacgctgtgggaagggagcccgggcaaattctggaacaccacaatcgccgtgtccatggccaacatctttcgcggcagttacctggccggggccggcttggctttcagtctgatgaagtccctcgggggcggacggcgcgggaccggagcgcagggggagaccctaggcgagaagtggaagcggcagctgaaccagctgagcaagagcgagtttaacacctacaagcgcagcggaatcatggaggttgaccggtccgaggccaaggagggccttaagcgcggggagactaccaagcacgccgtaagccgaggcaccgcgaagctgcggtggttcgtggagcggaatctggtcaagccagagggcaaggtgatcgacctggggtgcggtcgcgggggctggtcctactactgcgccgggctgaaacgggtgaccgaagtcaagggctacactaagggaggacccggccacgaagagccgatccctatggccacgtacggttggaacctggtgaagctgcacagcggcaaggacgtgtttttcatgccgcccgaaaagtgcgacactttgctctgcgacatcggggagtccagcccgaaccccaccatagaggaggggagaaccctgagggtcctcaagatggtggagccctggcttaagggcaaccagttctgtatcaagattctgaatccttacatgccgtccgtggtcgaaacgctcgaacaaatgcagcgcaagcacgggggcatgctggtgagaaaccccctgtctcgcaattccacccacgaaatgtactgggtgtcttgcgggaccgggaacattgtatccgccgttaatatgaccagccggatgctcctgaaccgattcactatggcccaccggaagcccacctacgagcgggacgtggacctgggcgctgggacccgacatgtagccgtggagcccgaagtggccaacttggacatcatcggccagcggatcgagaacatcaagaacgagcataagtccacctggcattacgatgaagacaacccgtacaagacctgggcataccacgggagctatgaggtcaagccctccggcagcgcctccagcatggtaaatggggttgtccgcctactaaccaagccatgggacgtgatcccaatggtaacgcagatcgctatgaccgacacgaccccgttcgggcaacagcgggtgtttaaggagaaagtggacactcgcacgcccagggccaaacgcggcacgacccagatcatggaggtcaccgccaagtggctctggggattcctgtcccggaacaagaagcctcgcatctgcacccgggaggagttcacgcgcaaggtccggagcaacgccgccattggcgcggtgttcgttgatgagaaccagtggaacagcgccaaggaggccgtagaggatgaacgcttctgggacctggttcaccgggagagggagctccataagcaggggaagtgcgcgacttgcgtttacaacatgatgggcaagcgggagaagaagctgggggagttcgggaaggccaaaggctcccgcgccatctggtacatgtggctaggggcccggttcctcgagttcgaggccttgggcttcatgaacgaagatcattggttcagccgcgagaactcactgagcggggtggaaggcgagggcttgcacaagctgggctacatcctgcgtgacatctccaagatcccgggcggtaacatgtacgccgacgataccgcagggtgggacacccgcattacggaggacgacctccagaacgaggccaagattaccgacatcatggagccggagcacgccctgctggccacatctatcttcaagctaacctaccagaacaaggtggtccgcgtgcagagacccgccaagaatgggacggtaatggacgtcatctcccgccgggaccagcgcggcagcggccaggtggggacctacgggcttaacaccttcacgaatatggaggtgcaactgatccggcagatggagagtgagggcatcttcctccccagcgagttagagacgccgaatctggcggaacgcgtcctcgactggctggaaaaacacggggccgagcggctgaagcgcatggccatctcgggggatgactgcgtggtgaagcccattgacgacaggttcgccaccgccttaacggcgctgaacgacatgggcaaggtccgcaaggacatcccccaatgggaacccagcaagggctggaacgattggcagcaggtccccttctgctcccaccatttccaccagcttatcatgaaagacgggcgggagatcgtggtcccgtgccgcaaccaggacgagctcgtcggtcgggcccgcgtgagccagggggccggttggagcctgcgggagactgcttgtctggggaaatcctatgctcaaatgtggcaactcatgtacttccaccgccgggacctgcgcctggcggccaacgccatctgctctgcagtaccggtggattgggtgccgacaagtcggacgacctggagcattcacgcgcaccatcagtggatgacaacagaggatatgctctccgtctggaaccgcgtgtggatcgaagagaacccgtggatggaggacaagacgcatgttagctcctgggaggaggtcccgtacttaggcaagagagaagaccaatggtgcggctctctgattggcttaaccgcccgggccacctgggccaccaacatccaagtcgccatcaaccaagtccgacgcctgatcggcaacgagaattatctggactacatgacatccatgaagcgattcaagaacgagagcgaccccgagggggcgctttggtga

SEQ ID NO: 23773 - RNA, 9879 nt, synthetic construct
  misc_feature 1..9879: note = derived and/or modified CDS sequence (opt11) from DENV-1__GU131863__SS-prME
  source 1..9879: mol_type = other RNA
tcggtcaccatgctgctcatgctgctgccaacagccctcgccttccaccttaccaccaggggcggggagccccatatgatcgtgagcaaacaagagaggggcaagagcctcctcttcaagacctccgtgggggtgaacatgtgtaccctgatcgcgatggatctgggcgagctctgtgaagacacgatgacctacaagtgtccccggattacggaggcagagccggacgacgttgactgctggtgcaacgcaacagacacctgggtgacctacgggacctgctcgcagaccggcgagcatcggagggacaaacgttccgtggccctcgcaccccacgtgggcctggggctcgagacgcgcaccgagacctggatgagctccgagggcgcatggaagcagattcagaaggtagagacctgggccctccggcaccccgggttcactgtgatagcattgttcctcgcccacgcgatagggaccagcatcacgcagaaagggattatttttatcctgttgatgctggtcaccccttccatggccatgcgctgcgtgggcataggcaaccgggacttcgtggaggggctttcaggcgctacctgggtagacgtggtgctcgaacacgggtcctgcgtcacaactatggccaaaaacaagcccactctcgacatcgagcttctgaagacggaagtgaccaaccccgccgtactgagaaagctgtgtatcgaggcgaagatcagcaacaccaccaccgactcccggtgccctacacagggcgaagccactctggtcgaggaacaagacgccaactttgtatgtcgcagaaccttcgtagatagaggctgggggaatggctgcggcctcttcggcaaggggagcctgctgacgtgtgctaagttcaagtgtgtcacgaagctcgagggcaagatcgtgcagtatgagaacctgaagtactccgtcatcgtcaccgtgcacactggcgaccagcaccaggtcgggaacgagacgaccgagcatggtacaatagccaccatcacgcctcaggctcccacttcggagatccagttgactgactacggtgccttgaccctggactgtagcccgcggaccggcctcgactttaacgagatggtgctcctgacgatgaaggagaagagttggctggttcataagcagtggttcctcgatctaccgctgccctggacctcaggtgcctcgaccagccaggagacctggaatcgccaagatctgttggtcacgttcaagaccgcccatgccaagaaacaggaagttgtggtcctgggctcccaggagggcgcgatgcacaccgccctcaccggggctacggaaatccaaaccagcggcaccaccacaatctttgccggacacctgaagtgcagactgaaaatggataagctcactctgaagggcatgagttatgtcatgtgcaccgggtcgttcaaactggagaaggaggtcgccgagacccagcacggcactgtcctggtccaggtgaagtacgagggcaccgacgcgccctgcaagatccccttcctcacccaagacgagaagggggtcacacagaacggccgacttatcacagctaacccgatcgtcaccgataaggagaagcccgtgaacatcgagaccgagccccctttcggggagtcttatattgtcgtgggagccggcgaaaaggccctaaaactcagctggtttaagaaggggtccagcatcggaaagatgttcgaggcgaccgcacgcggggcacgccgcatggcgatcctgggcgacacagcttgggacttcgggtctatcggcggactgttcacctcggtggggaaactaatccaccaagtcttcggcaccgcgtacggggtgttattctccggcgtgtcgtggacgatgaagatcgggatcggcatcctgctcacgtggctcggtttaaactcgcgcagtaccagcctcagcatgacctgtatcgccgtcgggatggtgaccctttacctcggcgtaatggtccaggccgattccgggtgcgttatcaactggaagggccgagagctcaagtgcggcagcggaatcttcgtgacgaacgaagtccacacctggaccgagcagtacaaattccaggccgactcaccgaagcggctgagcgccgcgatcggcaaagcctgggaggagggtgtgtgcggcatccggagcgccacaaggctcgagaatatcatgtggaagcagatcagtaacgaactcaactacattctcttggaaaacgacatgaagttcaccgtggtggtaggagacatcaacggcatactcgcccaggggaagaagatgatccgcccccagccaatggagcacaagtacagctggaaatcctggggcaaagccaaaatcatcggagccgacatccagaacacgaccttcatcatcgacgggcctgacaccccggagtgccccgatgaccagcgggcctggaacatctgggaagtggaggactacgggttcggaatcttcactacgaacatctggctgaagctgcgggacagtcacacccagatgtgcgaccaccggctcatgagcgccgctataaaggacagcaaggcggtccacgccgacatgggctactggatcgaatccgagaaaaacgagacctggaagctggcccgcgccagcttcatcgaagtgaagacctgcatatggcccaagtcccacaccctgtggagcaacggcgtgctcgagtccgagatggtcatccctaagatatacgggggccccatatctcaacacaactatagacctgggtatttcacccagaccgcaggcccctggcacctggggaagctggagcttgacttcgacctgtgcgagggcacgactgtggtggtcgacgagcattgcggttaccgcgggccttcgttaagaacgaccaccgttacgggcaagatcatccacgagtggtgctgccgcagctgcacattgccgcctctgcggttccgcggggaagacggctgctggtacgggatggagatccggccagtcaaggaaaaagaggagaatctggtgcgctccatggtgtcggctggctccggtgaagtggacagctttagcctggggatcctgtgcgtgtcaatcctgatagaggaggtgatgcggagccgctggtctcgaaagatgctcatgactggcaccctggccgtgttcctactgctgatcatggggcaactgacgtggaacgacttaatcagactgtgcatcatggtcggcgccaacgcaagcgaccgaatggggatgggcacaacctacctggccttaatggcgacgttcaaaatgagaccgatgtttgccgtgggcctgctattccgccggctgacttcgcgcgaggtgctgctcctcacggtcgggctgagcctggtggcttccgtagagctccccaacagcctggaggagttgggcgacgggctcgcgatgggcataatgatgctcaagcttctcaccgattttcagccccaccagctgtggaccaccctgctctccctgacgttcatccggacctcgctgtctctcgactacgcgtggaagacgatggcaatggccttgtctattgtgtccctcttccccctctgcctgagcacgacgtcccaaaagaccacttggctgcctgtgctcctcggtagcttcgggtgcaaacccctgacgatgttcttgatcaccgaaaacaagatctggggtcgtaagtcctggcccatcaacgaggggatcatggccgtcggcatcgtctctatcctgctgtcctcactcctgaagaacgacgtgcccctggccggtccgctcatcgcaggcggcatgctgatagcttgctacgttatatcaggatccagcgcagacctgtccctggagaaggccgctgaagttagctgggaggaagaggcggagcactccggcacgagccacaacatcctggttgaggttcaggacgacgggaccatgaagatcaaagacgaggagcgggacgacactctgacgattctcctgaaagccaccctgctcgccgtgtccggcgtgtaccccatgagcatccccgcgaccctgtttgtctggtatttctggcagaaaaagaaacagcggtccggggtgctgtgggatacccccagcccacccgaggtggagcgcgctgtcctggacgacggcatctaccgcatcctccaacggggactgctggggcgctcccaggtgggagtgggagtcttccaggatggcgtgtttcacacgatgtggcacgtgacccgcggggcggtcctcatgtaccagggtaaacggctggagcccagttgggctagtgtgaaaaaggacctcatcagctacggcggcggatggcgtttccagggatcatggaacacgggcgaggaggttcaggtaatcgctgtggagcccgggaagaacccgaagaacgtgcagaccacgccaggcaccttcaagacacctgaaggtgaggtcggcgccatagccctcgacttcaagccgggcaccagcggctccccgatcgtgaaccgggagggcaaaatcgttggcctgtacgggaacggagtcgtgacgaccagtgggacatacgtgtccgcgatcgcccaggcgaaggccacacaggagggccccctcccagagatagaggacgaagtattcaaaaagcggaaccttaccatcatggacttgcacccgggaagcggcaagacccgtcggtacctccccgccattgtgcgcgaggcgatcaagcggaagctccgcaccctgattctggcaccaactcgcgtagtcgcaagcgagatggccgaggcgctcaagggaatgcccatccggtatcagacgaccgccgtaaagtctgagcacaccgggcgcgagatcgtagacctgatgtgccacgccacgttcacgatgcggctgctaagcccagtacgcgtccctaactacaacatgatcattatggacgaagctcacttcaccgaccccgcctccatagctgctcggggctatatatcgacccgcgtgggtatgggcgaggccgctgccatcttcatgacagcgacgccccctgggtccgtcgaggccttccctcagtctaacgccgtgatccaggacgaggagcgggatatcccggagcgatcatggaactccggttacgattggataaccgacttccccggaaagaccgtttggttcgtaccatccatcaagagcgggaacgacatcgccaactgcctgcggaagaatgggaagcgcgtgatccaactctcacggaaaaccttcgacacggagtaccagaagacgaaaaacaacgattgggattacgtggtaaccacagacattagcgaaatgggggccaatttccgcgcggatcgggtgatagacccacgccggtgcctcaagccagtcatcttaaaggagggcccagagcgtgttatcctggccggaccgatgcccgtgacggttgcctctgccgcacagcggaggggacggattggccgtaaccagaacaaggagggtgaccagtatatctacatgggccagcctctcaacaacgacgaggaccatgcccactggaccgaagccaaaatgctgctggacaatatcaacacccccgaggggataatccctgcgctattcgaacccgaaagagaaaagtccgccgcgattgatggcgagtaccggttacgcggagaggcccggaaaacctttgtggagctgatgaggcggggcgacttacccgtctggctaagttacaaggtcgcctcggagggcttccagtactccgaccgccggtggtgcttcgatggtgagcgtaacaaccaagtgctcgaggagaatatggatgtcgagatctggactaaggagggggagcggaagaagcttaggcccagatggctcgacgcgcgcacctacagcgatcctttggctctcagagagttcaaggagttcgcggccgggcgccggtccgtgagcggggacctgatcctggagattggcaagttgccccagcatctgaccttgcgcgcacagaacgccctagacaacctggttatgctccacaacagcgaacaaggcgggaaggcctaccgccacgcgatggaggagctgccggataccatcgagaccctgatgttactcgccctgattgccgtgctgaccggcggggtcaccctcttcttcctgtccgggaagggcctgggcaaaaccagcattggtctactgtgcgtaatggcttccagcgccctgctttggatggcctcagttgagccccactggatcgccgcctcgatcatattggagttcttccttatggtcctcctgatcccggagcccgataggcagcggaccccccaggataaccaactggcctacgttgttatcgggctcctgttcatgatcctgacggttgctgccaacgagatggggctgctggagaccacgaagaaagacctgggcatcgggcacgtggcagtagagaatcaccatcacgcaacaatgttagatgtagacctgagaccagcctccgcgtggacgctctacgccgtggcaaccacggtgatcacacccatgatgagacacacgattgagaacactacggcaaacatcagcttgaccgcgatagcgaaccaggctgccattctgatgggactagacaagggctggcccatctctaagatggacattggggtccccctcctggccctaggttgctactcccaggtcaacccgttgacactaaccgccgcggtgctgatgctggtggcacactatgccataattggaccaggcttacaggccaaagcgacccgcgaggcccagaagaggaccgccgccgggatcatgaaaaaccccacggtagacggtattgtgaccatcgatctggaccccgtcgtgtacgacgccaagtttgagaagcaactcggccagatcatgctgttgattctctgcacctcccaaatattgctaatgcgcaccacgtgggcgctgtgcgagtccatcacgctagccaccggtccgctgacaacgctctgggagggcagccccgggaagttctggaacaccaccatcgccgtgtctatggcaaacatattccgcggctcctacttggcgggcgccgggctcgcctttagcttaatgaagtcactgggcgggggccggcgcgggactggcgcccagggggagactttgggggagaagtggaaaaggcaattaaaccagctgtccaagtccgagttcaacacatacaagaagtccggcatcatggaggtcgaccgcagcgaagccaaagaaggactgaaacgtggcgagaccaccaaacacgcggtttcacgcgggactgcgaaactccggtggttcgtggaaagaaacttagtcaagcccgagggcaaagtgatagacctaggttgcgggcggggcgggtggagctactactgcgccggattaaagaaggtgaccgaagtcaaggggtacaccaagggcggccccgggcacgaggagccgatcccaatggccacctacggatggaacctcgtcaagctgcactcaggaaaggacgtgttcttcacgcctcccgaaaagtgcgacaccctactttgcgacataggggagagctccccgaatcctaccatcgaggaagggcgcaccctaagagtcctaaagatggtcgaaccctggttacgtggtaaccagttttgcataaaaattctgaacccctatatgccgtcagtggttgaaacgctggagcagatgcagcgaaaacacggggggatgctggtgcgcaaccccctatcccggaacagcacgcacgaaatgtactgggtaagctgtggcaccgggaatatcgtgtccgccgtaaacatgacctcccgaatgctgctaaaccggttcactatggcgcaccggaaacccacgtatgagcgcgacgtggacctgggcgccggcacgcggcacgtcgcagtggagcctgaggtggcgaacctcgacatcatcgggcagcgtatcgaaaacatcaagaacgaacataagagcacttggcactacgatgaggacaacccgtacaagacatgggcttaccacggctcctacgaggtaaagccctccgggtccgcgagctccatggtgaacggagttgtgagacttctgacgaagccctgggacgttatacccatggtaacccaaatcgccatgaccgacacgacgccgtttgggcagcagcgtgtgtttaaggagaaggtggatacgcggactcctcgagccaagcggggcacagcacagatcatggaggtaacggccaagtggctatggggttttctcagccgcaacaaaaagccgcggatatgcacccgtgaggagttcactcggaaagtgcgttccaacgccgccatcggagctgtgttcgtagacgaaaaccagtggaattctgctaaggaggccgtggaggatgagcggttctgggaccttgtgcacagagagcgcgagcttcacaagcaaggcaagtgcgcgacctgcgtctataacatgatgggaaagcgggagaaaaaactaggggagtttgggaaagcaaaaggcagcagagccatctggtatatgtggctgggggcccgcttcctggagttcgaggctttaggattcatgaacgaggatcactggttctcaagagagaacagcctgagtggagtagagggtgagggactgcacaaactgggatatatcctccgtgacatcagcaagatcccgggcggcaacatgtacgccgacgacacagccggatgggacacccgaattaccgaagatgacctacagaacgaggcaaagatcaccgacatcatggagcctgagcacgccttattagcgacgtccattttcaaactgacgtaccagaacaaggtggtccgagtgcaacgccccgccaagagcggaaccgtgatggacgttatctccaggcgcgaccaacggggctcaggacaggtgggcacgtacgggctcaacacattcacaaacatggaggtgcagctgatccgccagatggaatccgagggtatattcagcccgtccgagctggagaccccgaacctcgccaagaaggtcctggattggttagagaaacatggggccgagagactcaagcgcatggcgatcagcggggacgactgtgtcgttaagcccatagacgaccgctttgcgaccgccctgacggccctgaacgacatggggaaggtccgcaaggacatcccccagtgggagccttccaagggctggaacgattggcagcaagtcccgttctgttcccaccacttccaccagctcatcatgaaggacggccgggaaatcgtggtaccctgccggaaccaggacgagctggtggggcgtgcccgcgtgtcccagggagcggggtggagcttgcgagaaaccgcttgcctcggcaagtcatacgcgcagatgtggcagctgatgtacttccaccgtcgagacctgcgactcgccgccaatgccatctgcagcgccgtcccggtcgattgggtgcctaccagccggaccacctggtcgatccacgcacaccatcaatggatgacgaccgaagacatgctgagcgtttggaacagagtgtggatcgaggaaaacccttggatggaggacaaaacacacgtgtcatcatgggaggaagtcccataccttgggaagcgggaggatcagtggtgcggctccctaattggcctgaccgcacgggccacatgggcgaccaacatccaagtggcaattaaccaggtgcgccgtctgatcgggaacgagaactatctggactacatgacctctatgaagcgcttcaaaaacgagtctgatcctgagggtgccctgtggtag

SEQ ID NO: 23774 - RNA, 9879 nt, synthetic construct
  misc_feature 1..9879: note = derived and/or modified CDS sequence (opt11) from DENV-1__GQ868559__SS-prME
  source 1..9879: mol_type = other RNA
tcagtgacaatgctgctcatgctgcttcccaccgctttggccttccacttaaccacccgcggcggtgagccccacatgatcgtgagcaagcaggagcggggcaagtccctgctgttcaagacgagcgcgggcgtgaacatgtgcaccctgatcgctatggacctgggcgagctctgcgaagacacgatgacctacaagtgcccccgaatcactgaggccgaaccagacgacgtggactgctggtgcaacgctaccgacacttgggtgacgtacgggacctgcagccaaaccggcgagcatcggcgagacaagcggagcgtggccctggcgccccacgtgggcctggggcttgagacccggaccgagacatggatgagctccgaaggtgcgtggaagcagattcagagagtcgagacctgggccctgcgacaccccgggttcacggtgatagccttattcctcgctcacgccatcgggacaagcatcacccagaagggaatcatctttatcctgctgatgttagtgacccccagcatggcgatgcgatgcgtcggcatcggcaaccgtgacttcgtggaggggctgagcggcgccacgtgggtggacgtcgtactggaacacggctcctgcgtgactaccatggcaaagaacaagccgaccctcgacatcgaactgctgaagacggaggtaacaaaccctgcggtgcttcggaagctatgcatcgaagccaagatcagcaacacaaccacggactctcgctgtccgacgcagggcgaggccaccctggtggaggagcaggatgccaacttcgtgtgccggcgcacctttgtcgaccggggctgggggaacggctgcggcctgttcggcaaagggagcctgctgacgtgtgccaaattcaagtgcgtaactaagctcgagggcaagatagtccaatacgaaaacttgaagtattcggtgatagtcaccgtacataccggcgatcagcatcaagtgggcaacgagacgaccgagcatggtactatagcgaccatcacgccccaggcccctacgagtgagatccagctgaccgactacggggccctcaccctggactgctctccccgcaccggacttgacttcaacgagatggtcctcctgacgatgaaggagaagtcctggctggtgcacaagcagtggttcctcgatctgccgctgccctggacctccggggccagcacctcccaggagacctggaaccggcaggacctcctggtgacgtttaagacagctcatgcgaagaagcaggaggtcgtggtgctgggctcccaggagggcgcgatgcataccgccttaaccggggccacggagatccagacgagcggcacaaccacgatcttcgccggtcacctgaagtgccgcctcaagatggacaagctcactctgaagggcatgtcttacgtcatgtgcacggggagcttcaagctggagaaggaggtggcggagacccaacatggcacggtcttggtccaggtaaagtacgagggtaccgacgccccctgcaagatccccttcagtacccaggacgagaagggtgttacccagaacggcaggttgatcacggccaacccgatcgtgactgataaggagaagccggtgaacatcgagaccgagccgccgttcggggaatcttatatcgtggtcggcgccggcgaaaaggctctgaagttgtcctggtttaaaaaggggtcctccatcggcaagatgtttgaggccacggcccgtggggcccggcgcatggccatcctcggcgacacggcgtgggactttggttctatcgggggcgttttcacctccgtggggaagcttgtccaccaggttttcggcaccgcctacggggtgctcttcagcggagtctcctggaccatgaagatcggaatcgggatcctcctgacgtggctgggactcaacagccgttccacaagcctgtccatgacctgcatcgccgtggggatggtgaccctatacctcggcgtcatggtacaggctgacagcgggtgcgttattaattggaagggccgggagctgaagtgtgggtccggcatcttcgtcacgaatgaggtgcacacctggaccgagcagtacaagttccaggccgatagcccgaagcgcctgagcgcggcgatcggaaaggcctgggaggagggggtgtgcggcatccggtccgccacccgcctcgagaacatcatgtggaagcagatcagcaacgagctgaaccatatcctgctcgaaaacgacatgaaattcaccgtcgtggtcggggatgccaacggcatcttggcgcaggggaagaagatgatccgcccccagcccatggagcacaagtactcctggaagagctggggcaaagcaaagatcatcggtgccgacattcagaacacgaccttcatcattgacgggcccgacaccccggagtgccccgatggccagagggcctggaacatctgggaagtcgaggactacgggttcggtatttttaccacgaacatttggctgaagctccgggactcctacacccaaatgtgcgaccatcgcctgatgagcgcggcaatcaaggattcaaaggccgtgcacgccgacatgggctactggatcgagagcgagaagaacgagacgtggaagctggcgcgggcgtccttcatcgaggtgaagacctgcacgtggcccaagagccataccctctggtccaacggcgtcctggagtccgagatgatcattcccaagatctacggtgggccgatatcgcaacacaactaccgccccggctactttactcagaccgccggcccctggcatctaggcaaactcgaactggacttcgacctctgtgagggcacgaccgtggtcgtcgatgagcactgcgggaaccggggcccgagcctccgcaccaccaccgtgaccgggaagatcatccatgagtggtgctgccggtcctgtacactacctcctcttcggttccggggagaggacgggtgctggtacgggatggagatccgcccagtcaaggagaaggaggaaaacctcgtccggtctatggtatccgccggcagcggggaggtagacagcttctccctgggcatactgtgcgtcagcattatgatcgaagaggtgatgcgctccagatggagccggaaaatgctcatgactggtacgctggccgtcttcttattactgatcatggggcagctcacctggaacgacctcatccgcctgtgcatcatggtcggggctaacgcatccgaccgaatgggcatgggcacaacctatctcgccctcatggcgacgttcaagatgaggccaatgttcgccgtaggtctcctgtttcggcgcctaacctctcgggaggtgctgctgctgaccatcgggctgtccctggtggcaagcgtggaactccccaactccctggaggagctgggggatggcctcgcgatgggcattatgatgttgaagctgttaaccgagtttcagccacatcagctgtggacgaccctgctcagcctgaccttcgtaaagaccacgctgtccctcgactacgcctggaagaccaccgccatggtattaagcatcgtatccctgttcccgctctgcctgagcaccacgtcccagaagaccacctggctgccggtcctcctgggcagcttcggctgtaagcccctgaccatgttcctcatcaccgagaacaagatctgggggcgcaagtcctggcccttaaatgagggcatcatggccataggtatcgtgagtatactgctctccagcctgcttaagaacgacgttcccctcgcgggcccgctgatagccggcgggatgctcatcgcctgctacgtcatcagcggctccagcgccgacctctccttggagaaggccgcggaggtcagctgggagcaggaggccgagcactccggggccagccataacatcttggtggaggtccaggacgatggcacgatgaagatcaaggatgaggaacgggacgacacgttgaccatcctcctcaaggcgaccctcctcgccgtgtccggtgtgtatcccatgagcatcccggcgacgctgttcgtctggtatttctggcagaagaagaaacaacgctcaggcgttctctgggacacccctagcccgcccgaggtggagcgtgccgtcctggatgacggcatctaccgtattctgcagcgtgggttacttggccgctcccaggtgggggtgggcgtgttccaggacggggtgttccacaccatgtggcacgtgacacggggcgcagtcctgatgtatcagggcaagcgcctggagcccagctgggcctccgtgaagaaggacctcatcagctatgggggcgggtggagattccaggggtcctggaacacaggtgaggaagtgcaggtcatagcggtagagcccggcaaaaacccgaagaacgtccaaactacccccggcaccttcaagactccggagggtgaagtcggcgcgatcgccctggacttcaagcccgggacctccggctccccaattgtgaaccgcgagggcaagattgtgggcctgtatgggaacggggtcgtgaccaccagcggcacatacgtttccgccatcgcgcaggccaaggcgtcacaggaggggccccttcccgagatcgaggacgaggtcttcaagaagagaaacctaacgatcatggatctgcatccgggcagcggcaagacacgccggtacctccccgccatcgtgcgcgaggccatcaagcgaaagctgcgcacccttatcctcgctcctacgcgcgtagtcgcgtccgagatggccgaggccttgaagggaatgcccatacgataccagaccaccgccgtcaagagcgagcacactggccgggagatcgtggacctgatgtgccacgctacgttcacgatgcggctcctgagtcctgtccgcgtgcccaactacaacatgatcatcatggacgaggcgcacttcaccgaccccgctagcatcgcggcccgggggtacatctccacccgcgtaggcatgggggaagccgccgcgatctttatgacggccacgccccccggatccgtcgaggccttcccccagagtaacgctgtaatccaagacgaggagcgggacatccccgagcgcagctggaactctggctacgactggatcaccgacttccccgggaaaaccgtgtggtttgtcccgagcatcaagtctggcaacgacatcgcgaattgcctgcggaagaacggcaagcgtgtgatccagctcagccgtaagacgttcgacaccgagtaccagaagaccaagaataacgactgggattacgtcgtcaccacggatatctccgagatgggcgccaacttccgcgctgatagagtgatcgatccccggagatgcctgaagcccgtgatcctgaaggacgggcccgagcgcgtcatcctcgccggcccgatgccagtaaccgtcgcgagcgccgcccagcggcgcggcaggatcgggcgaaaccagaacaaggagggcgaccagtacgtgtatatggggcaaccgctgaacaacgacgaggatcacgcccactggaccgaggcaaagatgctgctcgacaacattaacacccccgagggcatcatcccggcgctgtttgagcccgagcgcgagaagtccgccgccatcgacggggagtaccggctgcgcggcgaggcgcggaagacgttcgttgaactcatgcgacggggcgacctgccggtctggttgagctacaaggtggcctccgaagggttccagtacagcgaccgtcggtggtgttttgatggcgagcgcaacaaccaggtgctcgaagagaacatggacgtcgagatctggaccaaggagggggagcggaagaagttgcgcccccggtggctggacgctcgcacctacagcgacccgctcgccctgagggagttcaaggagttcgcggccggcagacggagcgtgtcgggcgatctgatactcgagatcgggaagctgccccagcacttaacattgcgcgcccagaatgcactggacaatctggtgatgctccacaactccgagcagggcgggaaggcgtaccgtcacgcaatggaggagttgcccgacactattgagacgttgatgctcctcgcccttatcgcggtcctcaccggcggagtgaccctgttcttcctgagcggcaagggcctgggaaagacctccatcggcctgctgtgtgtgacagccagcagcgccctcctgtggatggcctcggtagaaccccattggatcgccgcgtccatcatcctggagttcttcctcatggtgctgctgatcccggaacctgaccgccagcggacgccccaggataaccagctcgcctacgtggtcattgggctgctattcatgatcctcaccgtggcggccaacgagatgggcctgctagagactacgaaaaaggacctcggaatcggctacgtcgccgcggagaatcaccagcacgccactatgttggacgtcgacctgcgcccggccagcgcctggactctgtacgcagttgcgaccactgtgatcacccccatgatgcggcacacgatagagaacaccacggcaaatatttctctgaccgccatcgccaaccaggccgcgatcctgatgggccttgacaaagggtggcccattagcaagatggatatcggggttcccctgctggccctcggctgctactcccaagtcaacccacttaccctgaccgccgccgtgttaatgctggtcgcacactacgctatcatcgggcccgggctacaggcaaaagccacgcgcgaggcccagaagcggaccgcggcgggaatcatgaagaaccccaccgtggatggcatcgtggccatcgacctcgatccggtcgtgtacgacgccaagtttgaaaagcaactggggcagattatgctgctcatcctttgcaccagccagatactgctcatgcggacgacctgggccctttgcgagtccatcaccctggcaacgggcccgctcacgaccctgtgggaggggagccccggcaaattctggaataccactatcgccgtgtccatggccaacatcttccgcggcagctacctggccggggcgggcctagcgttctccctgatgaaatccctcgggggcgggcggagagggacgggcgcccaaggggagaccctcggagagaaatggaagcggcagcttaatcagctgagtaagagtgaattcaacacctacaagcgcagtggcatcatggaggtcgaccggagcgaagccaaggaggggctcaagcgcggggagactacgaagcatgccgtgagccgcggcaccgctaagctgaggtggttcgtggaacgaaacttagtcaagcctgagggcaaagtgatcgacctggggtgtggccgtggtggctggtcctactattgcgcagggctcaagaaggtgaccgaggtcaagggctacacgaagggcgggcctgggcacgaggagccgatcccgatggccacctacgggtggaacctggtgaagttacatagcggcaaggacgtgttctttatgccccccgagaagtgtgatactctcctgtgcgacatcggggagtccagcccgaacccaaccatcgaggagggccggaccctgcgcgtcctcaagatggtggagccctggttgcggggcaaccaattctgcatcaaaatcctgaatccctacatgccttccgtggtcgagaccctcgaacagatgcaacgcaagcacgggggcatgctagtgcggaacccccttagccgcaactccacgcacgagatgtactgggtgagttgtggaaccggtaatatcgtcagcgccgtgaacatgaccagccggatgctcctgaaccgctttacaatggcccatagaaaacctacatacgagcgagatgtcgaccttggggcggggacacgccatgtcgccgtggagcccgaggaggccaacctcgacatcataggccagcggatcgagaacataaagaacgagcataagtccacctggcactacgacgaagacaacccttacaagacctgggcctatcacggtagctacgaggtgaagccctccggcagcgccagtagcatggttaacggggtggtccgcctgctgacgaagccgtgggatgtcatccccatggtcacccagatcgcgatgaccgacaccacaccgttcggccagcagcgggtctttaaggagaaggtggacacccgcacgccccgggctaagcgcggcaccacgcaaataatggaagtgaccgccaagtggttgtgggggttcttgagtcggaacaagaagccgcgcatctgtacccgggaggagttcacacgcaaagtccggagcaatgccgccatcggcgcggtgttcgtggatgagaaccagtggaacagtgcaaaggaagccgtggaggacgagcgcttctgggatctggtgcaccgggagcgcgagctccacaagcagggcaagtgcgccacgtgcgtgtataacatgatgggaaaacgggagaagaaactgggcgagttcggcaaggcaaagggttcccgcgccatctggtacatgtggttaggggcccggttcctcgagttcgaggccctgggtttcatgaacgaggatcattggttcagccgcgaaaactccctgagcggggtggagggcgaggggctccacaagctggggtacatactgcgggatatctccaagatcccgggcgggaacatgtatgccgacgacactgccggttgggatactcgcatcacggaggacgacctccaaaacgaggccaagattacggatatcatggagcccgagcatgcgctactagccaccagcatctttaagctcacctaccagaacaaagtggtgcgcgttcagcggcccgccaagaacggaaccgtgatggacgttatctcccgccgggaccagcgcggcagcggccaggtcgggacgtacggtctaaacaccttcaccaacatggaggtgcagctgatcaggcagatggagtccgaggggatcttcctcccgagcgagctggagaccccgaatctggcggagcgcgtgctcgactggctggagaagcacggcgcagagcggctaaagcgaatggccatctccggggatgactgcgtcgtaaagcccatcgacgaccggttcgccaccgcattaaccgcgttaaacgacatgggcaaggtgcgcaaggatataccccaatgggagccgtccaagggatggaacgactggcaacaggtcccgttctgctcccaccacttccaccagctgatcatgaaggatgggcgggaaatcgtggtgccctgccgcaatcaggacgagctcgtcggacgggcccgagtaagccagggggccggctggtccctgcgggagaccgcctgcctgggcaagtcctacgcccagatgtggcagcttatgtacttccaccggcgggacttacgcctggcggctaacgccatctgctccgccgtccccgttgactgggtgcccaccagccggaccacgtggagcatccacgcgcatcatcagtggatgaccaccgaggacatgctgagtgtgtggaacagagtctggatcgaggagaacccctggatggaggacaagacccacgtgagctcttgggaggaggtgccctacctgggcaagcgcgaggaccagtggtgcggctcactgatcggtctcacagcccgggccacctgggcgaccaatatccaggtcgccattaaccaggtgcgccggctgatcggaaacgagaactacctggactacatgacctccatgaagcgcttcaagaacgagagcgaccccgagggggcgctttggtaa

SEQ ID NO: 23775 - RNA, 9879 nt, synthetic construct
  misc_feature 1..9879: note = derived and/or modified CDS sequence (opt11) from DENV-1__GQ868560__SS-prME
  source 1..9879: mol_type = other RNA
agcgtgaccatgctgctcatgctgctccccaccgctctcgccttccacctgaccacccgcggcggggaaccccacatgatcgtgagcaagcaagaacgtggcaagagcctgctgttcaagactagcgcgggggtgaacatgtgtaccttgatagccatggacctgggggagctatgcgaggacaccatgacgtataagtgcccccgcatcacagaggccgagcccgacgacgtggactgctggtgcaacgccaccgatacctgggtgacctacgggacatgcagccagaccggcgagcaccggcgcgacaagcgctccgtcgccttggcgccacacgtgggcctgggcctcgagacccgcaccgagacctggatgagctccgagggcgcctggaagcaaatacagcgggtcgagacctgggcactgaggcaccccggctttacagtaatcgctcttttcctggcgcacgctatcgggaccagcatcacccagaaggggatcatctttatcctgctaatgctcgtgaccccttcaatggcgatgcgttgcgtcggcatcggcaaccgcgacttcgtggaggggttgagcggcgccacgtgggtagatgtcgtcctggagcatgggtcctgcgtaaccaccatggccaagaataagcccaccctcgacatcgagctgctgaagacggaagttaccaaccccgcggtgttacggaaactttgtatcgaggcaaagatctcaaacacgaccacggactcccgctgcccaacccagggcgaagccaccctggtggaggagcaggacgccaacttcgtctgccggaggacgttcgtggaccggggttgggggaacggctgtggactcttcggcaaggggtcactgcttacgtgcgccaagttcaagtgcgtgaccaagctcgagggcaaaatagtccagtatgagaacctgaagtactccgttatcgtcaccgtccacacgggcgaccagcaccaggttgggaacgaaacaaccgagcacgggaccatcgcgaccatcacgccccaggcccccacgtccgagatacagctgaccgattatggggcactaacactggattgcagcccccgcaccgggctggactttaacgagatggtactcctgaccatgaaggagaagtcctggctggtgcacaagcagtggttcctcgaccttcccctaccttggacctccggggccagcacctcgcaggaaacctggaaccggcaggatttgctggtgacgttcaaaactgcccacgcaaagaaacaagaggtcgtcgtactgggctcccaggagggcgcaatgcacaccgccctcaccggtgccaccgagatacagacaagcggcaccaccacgattttcgccgggcacctgaaatgccgtttaaagatggacaagctcaccctgaagggaatgtcctacgtcatgtgtaccggtagcttcaagctggaaaaggaggtggcagagacccagcacggcacggtcctggtacaggtgaagtatgagggcactgacgccccctgcaaaatcccgttttccacacaggacgagaaaggggtgacccagaatggccgtctcatcacggccaaccccatcgtgacggacaaggagaagcccgtcaacatagagaccgagccgcccttcggggagagctacatcgtggtcggcgcaggcgagaaggctctgaagctgtcctggtttaagaaagggagctccatcggcaagatgttcgaagcgaccgcccgcggagcccggcgcatggccatattaggcgacacggcgtgggacttcgggagcatcggcggagtgttcacatccgttgggaaactggtccaccaggtgttcggcaccgcctacggggtgttattctctggagtctcctggaccatgaagatcgggatcgggatacttctgacgtggctaggcctcaattcccgctccaccagcctatccatgacatgtatcgccgtggggatggtgacgctgtacctaggcgtaatggttcaggccgacagcgggtgcgttatcaactggaagggtagagagctaaagtgcgggtcgggcatcttcgttacaaacgaggtgcacacgtggactgagcagtacaagttccaggccgatagcccgaagcgactgagcgcggcgattggaaaagcgtgggaggagggggtttgcgggatccggtccgccacccgcctcgaaaacatcatgtggaagcaaatcagtaatgagctaaaccacatcctgctcgagaacgacatgaaatttacggtggtggttggggatgctaatggcatcctggcgcaggggaagaaaatgatccggcctcagccaatggagcacaagtactcctggaagtcctggggcaaggcgaagatcattggggccgatatccagaacacgacctttattatcgatgggccggacactccggagtgccccgacggccagcgcgcctggaacatctgggaggttgaggactacggattcggtatcttcaccacgaacatttggttaaagctccgggattcttacacccagatgtgcgaccaccggctgatgagtgcagcaatcaaggattccaaagccgtacatgcagacatgggctactggattgagagcgagaaaaatgaaacctggaagctggcccgggcgtccttcatcgaggtgaagacctgcacgtggcccaagagccacaccctctggagcaatggggtactcgagtccgagatgataatccccaagatttacggcggtccgatttctcagcacaactaccgccctggctacttcacccagactgcagggccctggcacctgggtaaacttgagttggacttcgatctttgcgagggcacgaccgtggttgtcgacgagcactgtgggaaccgcggcccgagcctccgcaccaccacagtgaccgggaaaatcatacacgagtggtgctgccggtcgtgcaccctgccgcccctgcgcttcagaggcgaagatgggtgctggtacggcatggaaattcgccccgtcaaggagaaagaggaaaatctggtgcggagcatggtgagcgccggtagcggcgaggtggatagcttctcactgggcatcttgtgcgtctccatcatgatcgaggaggtgatgcgcagccggtggagccgcaagatgctcatgactgggacgctggccgtgttcctgctcctgatcatgggtcagctgacctggaacgacctgatacgtttgtgtattatggtaggggccaacgcgtccgaccgtatgggcatgggcaccacttacctggccctcatggcaacgttcaagatgcgccctatgttcgccgtggggctgctgttccggagactcaccagccgcgaggtgctgctgctgaccattggcctgtcgctggtcgcctctgtggagctccccaactccctggaggagctgggggacggactcgcgatgggcatcatgatgctgaagttgctcaccgagttccagccccaccagctgtggacgacgctgctctcgctgaccttcgtcaagacaacgttgtccctcgactacgcatggaaaaccaccgccatggtgctgagcatcgtgtcactgttccccctctgcctgtcaaccacgtcccagaaaaccacgtggctgccagtcctcctggggtctttcggttgcaaaccgctgaccatgttccttattacggagaacaaaatctgggggcgcaagtcctggcccttaaacgagggcataatggcgatcgggatcgtgtcgatcctgctctcctccttgctgaagaacgatgtacccctagcgggccccctgatcgccggcgggatgctgatcgcctgctacgtcatttccggcagcagcgccgatctctccttagagaaggctgcggaagtgagctgggagcaggaggcagagcactccggggcctcgcataacattctggtcgaagtccaagatgacggcacgatgaaaatcaaagacgaggagcgggacgacaccctaactatcctgttaaaggccaccctcctggctgtatccggggtttacccgatgagcatcccagcgacgctgttcgtatggtacttttggcagaagaaaaagcagcgctccggtgttctctgggacaccccctccccgccggaggtggagcgcgccgtcctggacgacggaatctatcggattctgcagcgggggctgttgggccgtagtcaagtcggggtaggcgtgttccaggacggggtctttcataccatgtggcacgtgacgcgaggtgcggtcctgatgtaccagggcaaacgcctggagccgagctgggcctccatcaagaaggaccttatctcttacggaggagggtggcggttccagggctcctggaacacgggagaagaggtccaggtcatcgccgtagaacccggcaagaacccgaagaatgtgcagaccacccccggcactttcaagactcccgaaggtgaggtgggcgctatcgcgctggacttcaagcccgggacctcgggctcccctatagtcaaccgcgagggaaaaatcgtcgggctgtatgggaacggggtggtcacgaccagcggcacctacgtttccgccatcgcacaggccaaggcgagccaggaagggcctctccctgagatcgaagacgaggtgttcaagaagcggaacctgaccatcatggacctgcacccgggctcaggcaaaacccgccggtacttgccggcaatcgtccgcgaggctattaagcggaagttgaggaccctgatcttggcccccacgcgagttgtggcgtcagagatggccgaggccctgaagggaatgccgattcggtatcagaccaccgccgtcaagagcgaacacacgggccgcgaaatcgtggacctgatgtgccacgctacgttcaccatgcggctcctgtccccggtgcgtgtcccaaactacaacatgatcatcatggacgaggcgcacttcaccgatccagccagcatagcggcccgggggtacatctccacccgcgtcggcatgggggaggcagcggccatcttcatgacagccacgccgcccggcagcgtggaggccttcccgcagtccaacgcggtcatacaggacgaggagcgtgatatccccgaaaggtcctggaactccggctacgactggatcaccgacttccccggaaagaccgtgtggttcgtgccgtcaatcaaatccggcaacgacatcgcgaactgcttaaggaagaacgggaagcgtgttatccagctcagccggaagacgttcgacaccgagtaccagaaaaccaagaacaacgattgggactacgtggtcaccacggacatatccgagatgggtgcgaacttccgcgccgaccgggtcattgacccccgccgctgcctgaagcctgtcatactgaaggacggacccgagcgcgtgatcctcgcaggcccgatgcccgtcactgtagccagcgccgcacagcggcgtggaaggatcgggcgcaatcagaacaaagagggcgaccagtacgtctatatgggacagcccctgaacaatgacgaggaccacgcccactggaccgaggctaaaatgctccttgataacatcaacacccccgagggcatcatccccgcgctgttcgagccggaaagagagaagtccgctgccattgatggggagtaccggctacgcggcgaggctcggaagaccttcgtggagctcatgcgccggggcgacttgcccgtgtggttatcctacaaggtcgcgtccgaagggttccaatactcggaccgccggtggtgtttcgacggggaaaggaacaaccaggtcctcgaggagaacatggacgtggagatatggacgaaagagggggagcggaagaagctgcgacctcggtggctggacgcgaggacctactcggacccgctagcgctgcgggagttcaaggagttcgccgccgggcgccggagcgttagtggcgacctaatcttagagatagggaagctgccccaacacctgaccctccgcgcccagaacgcgctggataacctggtaatgctccacaattccgagcagggcggcaaggcgtaccggcacgctatggaagaactgcccgacaccatagagactctgatgctcctcgccctgatcgcggtgctcactggcggggtaaccctgttcttcttgagcggcaaggggctcggaaagaccagcatcggcctgctctgcgtgacggccagctccgccctcctgtggatggcctctgtagagccccactggatcgcggcgagcataatcttggagttcttcctaatggttttactgataccagaacccgaccgccagcggacgccccaagacaaccagttggcgtacgttgtgattgggctactcttcatgatcctcaccgtagccgccaacgagatgggcctgctggagaccactaagaaggacctcggaatcggctacgttgcggcggagaaccaccagcatgccaccatgcttgacgtggacttacgcccggccagcgcctggactctttacgccgtcgctaccacggtgataacccccatgatgcggcacaccatcgaaaacaccacagccaatatttccctgaccgccatcgcgaaccaggccgcgatcctgatgggcttagacaaggggtggcccatttcgaagatggacatcggcgtgcccttgctcgctctcgggtgctattctcaggttaacccgctaaccctgaccgccgcggtactcatgctggtggcccactacgccatcatcggacccgggctgcaggccaaggctacgcgcgaggcccagaagcgaaccgcggccggcatcatgaagaaccccaccgtcgatggaattgtggcaatcgatctcgatcccgtggtctacgacgcaaagttcgaaaagcaattagggcagatcatgctgctcattctatgcaccagccaaatattactcatgagaacgacctgggcgctgtgcgaatcgataaccctggctaccggcccactcaccactctttgggaggggagccccggaaagttctggaacaccaccatcgccgtcagcatggccaacatattccgcggcagctaccttgcaggcgcaggcctcgctttctcgctcatgaagtccctcgggggcgggcggagaggtacgggcgcccagggcgagaccctcggggaaaagtggaagcggcagctaaaccagctgagcaagtcggagttcaacacttacaagcgcagcgggataatggaggtcgaccggtccgaggccaaggagggactcaaacgcggggagaccacaaagcatgccgtaagccggggcaccgctaagctgcgctggttcgtggaacgtaacctggtgaagcccgagggcaaggtcatcgacctggggtgcggccgcgggggctggtcctactattgcgccggactcaagaaggtgacggaggtgaagggctacacaaagggcgggcccggtcacgaggaaccaatccccatggccacctacggttggaacctggtcaagctgcactccggtaaggacgtgttctttatgccgcccgaaaagtgcgacacgctcttatgcgacatcggggagtccagcccgaaccccaccatcgaagaaggccgaaccctgcgcgtgctcaagatggtcgagccctggttacgcggcaatcaattttgcatcaagatccttaacccctacatgccgagtgtggtggagaccctcgagcaaatgcagcgcaagcatgggggcatgctggttcggaaccccctgagccgaaacagcactcacgagatgtactgggtaagctgcgggaccggcaacatcgtgagtgccgtcaacatgaccagccggatgctcctgaaccgcttcactatggcccaccgcaagccaacgtatgagcgggacgtagacctgggcgcgggaacccgtcacgtggccgtcgagcccgaggaggccaacctcgacatcatcggccagcggattgagaacatcaagaacgagcacaaatccacttggcactacgatgaggacaatccatacaagacctgggcataccacgggagttacgaagtgaagccctccggcagcgcatccagcatggtgaatggagtcgttagactgctgacgaaaccgtgggatgtcatccccatggtgacccagatcgccatgaccgacaccacgccgttcggccagcagagagtgttcaaggagaaggtcgacaccagaacgccccgggccaagcgcggcaccacgcagatcatggaggtaaccgccaagtggctctgggggtttttgtctcggaataaaaagcctcgcatctgcacccgggaggagttcacacgcaaagttcgctcaaacgccgccatcggggctgtcttcgtcgacgagaatcaatggaacagcgctaaagaggccgtggaggacgagcgcttttgggacctggtccaccgggaacgcgagctccacaagcaagggaagtgcgccacctgtgtgtacaacatgatgggcaagcgggagaagaaacttggcgagttcggcaaggccaaaggttcccgcgcaatctggtacatgtggctgggtgcccggtttctagagttcgaggcgctgggctttatgaacgaagaccactggttctcacgcgagaacagcctgagcggggttgagggcgaagggctccacaagctgggctacatattacgggacatctccaagatcccgggtggcaacatgtacgccgacgacacagcgggctgggatactcgcattacggaggacgaccttcagaacgaggcgaagataacggatatcatggagccagaacacgccctgttggccaccagcatcttcaaactgacctaccagaacaaggtcgtgcgcgtgcagcggcccgccaaaaacgggaccgtcatggacgtgatctcccgccgggaccagcgaggcagcggccaggtggggacgtacggcctgaacacctttaccaacatggaggtccagctgattaggcagatggagtcagaggggatcttcctgcccagcgaacttgagaccccaaacttagcggaacgtgtgctcgactggctggagaaacacggcgccgagcgtctgaagcgcatggccatctcgggggacgattgcgtggtcaagcccatcgatgatcggttcgcgacggccctcaccgcgctgaacgacatgggcaaggtccgcaaggacatcccccagtgggagcccagcaagggctggaacgactggcagcaggttcccttctgctcacaccactttcaccagctaatcatgaaggacggacgcgaaatcgtcgtgccctgccgaaaccaggacgagctcgtgggcagagcccgcgtctctcagggtgccggatggtccctgcgggagaccgcctgcctgggcaagagctatgcccaaatgtggcagctaatgtatttccaccgccgggacctgcgcctggctgccaacgccatctgctccgccgtgcccgtggactgggtacccaccagccggaccacgtggtcgatccatgcgcaccaccagtggatgaccacggaagacatgctttccgtgtggaaccgcgtgtggatcgaggagaacccatggatggaagacaagacccacgtatcatcgtgggaggaggtaccgtatctgggcaagcgtgaggatcagtggtgcggcagtctgattgggctcacggcacgggccacctgggcgaccaacatccaggtggctattaaccaagtccgccggctgatcggcaatgagaactacatcgactacatgacctccatgaagcgcttcaagaatgagagcgacccggagggggcgctgtggtaa

SEQ ID NO: 23776 - RNA, 9879 nt, synthetic construct
  misc_feature 1..9879: note = derived and/or modified CDS sequence (opt11) from DENV-1__GQ868561__SS-prME
  source 1..9879: mol_type = other RNA
tcggtgaccatgctgttgatgctgttacctaccgcgctcgcctttcacctgaccacccgcggaggggagccccacatgatcgtgtcgaagcaggagcggggcaagtccctcttattcaagacaagcgccggggtgaatatgtgcaccctgattgccatggacctcggcgagttatgcgaagacaccatgacctacaagtgcccccgcattacagaggcagagccggacgatgtagactgctggtgtaacgcaaccgacacctgggtcacctacgggacctgcagccagacaggcgaacacagacgcgacaagcggtccgtggccctggctccccatgtgggattgggtctcgagacccgcaccgaaacctggatgagctccgagggagcatggaagcagattcagagagtcgaaacctgggctttgcgccaccccgggttcacggtgatagcgttcttcctggcgcatgccatcggcaccagcatcacccagaaggggatcatcttcattctcctgatgctggtgaccccctcgatggccatgcggtgcgttggcatcggcaaccgcgatttcgtagaggggctcagcggcgccacgtgggtagacgtcgtgctggagcacgggtcctgcgtgaccaccatggcaaagaacaagcccaccctggacatcgagctcctgaagacggaggtaacgaaccccgcggtgctgcggaagctctgcattgaggctaagatcagcaacaccacaacagactctcgctgcccgacccaaggcgaggcaaccctggtggaggagcaggatgccaacttcgtctgccggcgtacattcgtggatcggggctggggtaacggctgcggcctgttcggcaagggcagcctcctgacgtgcgccaaattcaagtgcgtgaccaaactggaggggaagatcgtccagtacgagaacctcaagtactccgttatcgtgaccgtccacacgggcgaccagcaccaggtgggcaacgagacgaccgagcacggtactatcgccaccatcacgcctcaggctcccacgagcgaaatacagttaaccgattacggggcgctaaccctcgactgcagcccccgcactggcctggacttcaacgagatggtcctgttgacgatgaaggagaagtcctggcttgttcacaagcagtggttcctggacctcccgctgccgtggacctccggagccagcaccagccaggagacctggaacagacaggacctcctcgtgacgtttaagaccgcgcacgctaagaagcaggaggtggtggtgctgggtagtcaggagggggcaatgcacaccgccctgaccggggccacggagatacagaccagcggtacgaccacgatctttgcaggtcatctcaagtgccgcctgaagatggacaagctgaccttaaaaggtatgtcctacgtcatgtgcaccgggagcttcaagctggagaaggaggtcgcggagacccagcacgggacggtgctggttcaggtgaagtacgagggcaccgacgccccgtgcaagatccccttctcaacacaggacgagaagggggtgacccaaaacggccgactcatcacggccaacccgatcgtgaccgataaggagaagcctgtcaacatagagaccgaaccgcccttcggggaatcgtacatagttgtcggagccggcgagaaagcgctcaaactgtcctggtttaagaaagggagttccataggcaagatgttcgaggcaaccgctcgcggggcccggcgcatggccatcctgggcgatacggcgtgggattttgggagcataggaggcgtgttcacatccgtcggaaagctcgtccatcaggtgttcggcaccgcctacggggtgctgtttagcggtgtctcgtggactatgaagatcggaatcggcatcctgttaacgtggctgggcctaaacagccgctcgaccagcctcagtatgacgtgcatcgcggtggggatggtgaccctctacctgggagtcatggtgcaagcagacagcgggtgcgttattaactggaaaggtcgggagttaaagtgcgggtccggcatcttcgtcacgaacgaggtacacacttggaccgagcagtacaagttccaggccgacagcccgaagcgcctaagcgcggccatcggcaaggcgtgggaggagggggtgtgcggcatccggtcagctacccgcctggagaacattatgtggaaacagattagcaacgagcttaaccatattttactggaaaacgatatgaaattcaccgttgtggtgggggacgccaacggcatcctcgcgcaggggaaaaagatgatacggcctcaacccatggagcacaagtactcttggaagtcctggggcaaagcaaagatcatcggcgccgacatccagaacacgacgttcatcattgatggcccggacacgccggagtgccccgatggccagcgcgcctggaacatctgggaggtcgaggactacgggttcggcatcttcaccacgaacatctggctgaagctgcgcgactcctacacccagatgtgcgatcaccgcctcatgagcgcggcgatcaaagactccaaggccgtgcacgcagacatgggctattggatagagtcggagaaaaacgagacctggaaactggcccgggcgtcatttatcgaggtgaagacgtgtacgtggcccaaaagccatacgctttggtccaacggggtcctcgagagcgagatgattatccccaagatctacggcgggccgatctcccagcataactaccgccccggctacttcacccagaccgcagggccgtggcacctgggcaagctggagcttgacttcgatctgtgcgaggggacgaccgtggtagtggatgagcactgcgggaaccgggggccgagcctgcgcactactacggtgaccgggaagatcatccacgagtggtgctgccggtcctgtaccctgccgcccctgcgcttccggggagaggacgggtgctggtatggcatggagatccggcccgtgaaggaaaaggaggagaacctggtacggagcatggtgtccgccgggagcggcgaagtcgactctttttctttgggcattctctgcgtcagcatcatgatcgaagaagtaatgcgcagccggtggtcgcgcaagatgttaatgaccgggacgctcgccgttttcctgctgctcatcatgggccagctgacctggaacgacctgatccgcctctgtatcatggtcggcgccaacgcttctgacagaatgggcatgggcaccacgtacctggccctgatggcaacgtttaagatgcgtccgatgtttgctgtcgggcttcttttccggaggctaaccagcagagaggtgttgctgctgaccataggcctctccctggtagcctctgtggagctgcccaactccctcgaggagttgggggacggcctggcgatgggcataatgatgctcaagctgttaaccgaattccagccccatcagctctggaccaccctgctgtcactcaccttcgtcaagaccactctgtccctggactacgcctggaagaccacggccatggtgctcagcatcgtatccctgttccccctgtgtctcagcaccacgtcccagaagaccacctggctgccggttctgctagggagcttcggatgcaagcccctgaccatgttcctgataaccgagaacaagatctgggggcgaaagtcatggcccctcaacgaaggcatcatggctatcgggattgtgagcatactgctgtcctcgctcctaaagaatgacgtgcccctggcgggcccgctcatcgccggagggatgctgatagcctgctacgtcattagcggctcgagcgccgacctgtccctcgagaaggccgcggaggtgagctgggagcaggaagccgagcactcgggggccagccacaacatcctcgtagaagtccaggacgacggcacgatgaaaatcaaggacgaggagcgggacgacacgctgaccattctcctgaaggccaccctgctcgccgtatccggtgtgtaccctatgtcgatccccgcaacgctgttcgtctggtacttctggcaaaagaagaaacagcgctccggcgtgctgtgggataccccctcaccgcccgaggtggaacgggccgtcctcgacgacggcatctaccggatcctgcagcggggactgctgggccgcagtcaagtaggcgtgggcgtcttccaggacggggtgttccacaccatgtggcacgtgacccggggcgccgtcctcatgtaccagggaaagcgcctcgagccctcatgggcctccgtgaagaaagacttaatcagctacgggggcgggtggcggttccagggctcctggaacaccggggaagaggtgcaggtcatcgccgtcgagccgggcaagaaccccaaaaacgtgcagacgacccccggcacgtttaagactccggagggggaggtaggcgcgatcgccttggacttcaagccagggactagtggctccccgatagtgaaccgcgagggaaagatcgtggggctgtacggcaacggggtcgtgaccaccagcggcacgtacgtgtccgccatcgcccaggccaaggcgtcgcaggaagggcccctgcccgaaatagaggacgaggtcttcaaaaaacggaacctcaccatcatggacctgcacccgggcagcggcaaaacccgccggtacctgcccgcgatcgttcgagaagccatcaagcggaagctccgcaccctgatattagccccaacgcgcgtggtcgcgtccgagatggccgaggcactcaaggggatgccaatccggtaccagaccacagcggtaaagtctgagcacaccggccgtgagatcgtcgacctgatgtgccacgccaccttcaccatgcggcttctgtccccggtccgcgtgcccaactacaacatgattatcatggacgaggcgcacttcaccgaccccgccagcatcgccgcccgggggtatatctccacccgtgtcggcatgggagaggccgcagcaatcttcatgacggccaccccgcccggcagcgtcgaggctttcccccagtccaacgccgtaattcaagacgaggagcgggatatccccgagcgcagttggaactcgggctacgactggatcaccgacttcccaggcaaaaccgtctggtttgtgcccagcatcaagtcgggaaacgatatcgcgaattgccttcggaagaacgggaaacgcgtgatccagctctcacggaagacgttcgacaccgagtaccaaaagaccaagaataatgactgggactacgtggtcaccacggacatctccgaaatgggcgccaacttccgcgccgaccgggtgatcgacccccgccgttgcctgaagccggtgatactgaaggacgggcccgagcgcgtcatcctggctggcccgatgcccgtgaccgtcgcgagcgctgcccaacggcgcggccggatcgggcgtaaccagaataaggagggcgaccagtacgtgtacatgggccagcccctcaacaatgacgaggaccacgcccactggaccgaagccaagatgctgctggataacatcaacacacccgagggaattatcccagccttgttcgagcccgagagagagaagtccgccgccatcgacggggagtaccgcctgcgcggcgaggcccggaaaacatttgtagagctgatgcgccggggcgacctccccgtctggcttagctataaggtggcatccgaggggttccagtatagcgaccgccggtggtgcttcgacggggaacgtaataaccaggtgctggaggagaacatggacgtcgagatctggactaaagagggggaacggaaaaagctccgaccgcggtggctagacgcgcgaacctactccgacccgctcgccctccgggagtttaaggagttcgccgccggccgacggagcgttagcggcgatctcatactggaaatcggtaagctcccccagcatctgacgctgcgcgcccagaacgcgctcgacaacctggtgatgttgcacaactccgagcagggcggcaaggcataccggcacgccatggaggagctccccgacaccatagagacgctgatgctgttggccctgattgcggtcctgactggcggcgtgaccctcttcttcctgagcggcaaggggctgggcaaaacctccatcggcctactgtgcgtgacggccagctccgccctgctatggatggctagcgtcgagccccattggatcgccgcgtccatcatccttgagttctttctgatggtgctcctgatcccggagcctgaccgacagcggacgccccaggataaccagctggcctacgtggtcatcgggctcctgttcatgatcctaaccgtggccgccaacgagatgggccttctggagaccacgaagaaggacctggggatcggctacgttgcggcggaaaaccaccaacacgccaccatgctcgacgtcgacctgcgtcccgcctccgcctggaccctgtacgccgtggcgaccaccgtgataacccctatgatgcggcacaccattgaaaacaccacggccaacatctccctcaccgccatcgctaaccaggcagcgatcctgatgggcctggacaagggatggcccatcagcaagatggatatcggcgtcccgctcctggccctcgggtgctactcccaggtgaatccgctcaccctgactgccgctgtgctgatgctcgtcgctcactacgccatcatcggccccgggctgcaggctaaagctacgcgcgaagcccaaaagcgcacggcggccggcatcatgaagaaccccaccgtggatgggatcgtggccatagacctggaccccgtcgtgtacgacgccaagttcgagaagcaactcgggcagatcatgctgctgatcctttgcaccagccagatcctactgatgcgcacgacctgggctctctgcgagtccataacactggcgaccggccccctgacgaccctctgggagggtagcccgggcaaattttggaacaccaccatcgcagtgtccatggctaacatctttcggggcagttacctggccggggccggactggccttctccctaatgaagtccctcgggggcgggcgccgcggcacgggcgctcagggggagaccctgggcgagaaatggaaacggcagctcaaccaactgtccaagagcgagttcaacacttacaagcgcagcgggatcatggaggtcgacagatccgaggctaaggagggtctaaagcgcggggagaccacgaaacacgccgtcagccggggtaccgcgaagttgcgctggttcgtagaacggaacctggttaagcccgagggcaaggtgatcgacctggggtgcggccgcgggggctggtcctactactgcgccgggctgaagaaggtgaccgaggtcaagggctacaccaaaggagggcccggccacgaggagccgatcccaatggccacgtatgggtggaacctcgtgaagcttcacagcggcaaggatgtgttcttcatgccgcccgagaagtgcgacactctgctctgcgacatcggggaatccagcccgtccccaaccatcgaggagggccggactctgcgcgtcctgaagatggtggaaccctggctccggggcaatcagttctgcatcaagatcctgaacccatacatgccgagcgtggtcgaaaccctggaacaaatgcagcgaaagcacgggggcatgctcgtaagaaaccccctgtcccgcaacagcacacacgagatgtactgggtatcgtgcgggaccggcaacatcgtcagcgccgtgaatatgacttcacgtatgctgctcaaccgcttcaccatggcacaccgcaagccgacttacgagcgggacgtcgacttaggcgcggggactcggcacgtcgccgtggaacctgaagtggccaacctggacatcatcggacagcgcattgagaacatcaagaacgagcacaaatcaacctggcactacgacgaggacaatccgtacaagacctgggcctaccacgggtcatacgaagtcaagcccagcggttccgccagctccatggtaaacggggtcgtgcgactcctgacgaagccgtgggacgtgatccccatggtcacgcagatcgcgatgaccgacaccacgccgttcggccagcagcgggtgttcaaggaaaaggtggacacccgaacgcccagggccaagcgcggcacgacgcaaatcatggaggtcaccgccaagtggctgtgggggttcctcagccggaacaagaagccccgcatctgcacccgcgaggagtttacgagaaaggtgcggagcaatgccgccatcggcgcggtgtttgtggacgagaatcagtggaactccgccaaagaggccgtggaggacgaacgcttctgggacctcgtgcaccgggagcgcgaactgcacaagcagggaaagtgtgcaacgtgcgtctacaatatgatgggcaagcgggaaaagaagctcggcgagttcggcaaggcgaagggcagcagggccatatggtatatgtggctgggggcccggttcctggagttcgaggccctcggcttcatgaacgaagaccactggttctcccgcgagaacagtctgtccggggtggagggcgaggggctgcacaagctcggctatatcctgcgtgacataagcaagatcccggggggaaacatgtacgccgacgacacggcgggctgggacacaagaatcaccgaagacgacctgcagaacgaagccaagattacggacatcatggagcccgaacacgccttgctggctacgtccatctttaagctgacctaccagaccaaggtggtccgcgtgcagcggcccgccaagaatgggacggtaatggacgtcattagccgacgcgaccagcgcggctccggccaagtggggacctacggcctcaacaccttcaccaacatggaagtgcaactgatccgccagatggagagcgaggggatcttcctgccgtctgagctcgagacgccgaacctagcggagcgcgtcctggactggctcgagaagcacggcgccgagcggctaaagcgcatggccatctcaggagacgactgcgtagtgaagcccattgacgaccggttcgccaccgccctgaccgcgctcaacgacatgggaaaagtccgaaaagacatccctcaatgggagccgtctaagggctggaacgactggcagcaggtaccgttctgtagccaccacttccaccaactgatcatgaaggacgggcgtgagatagtggtcccctgccgcaaccaggacgagctggttggccgggcccgcgtgtcccagggggccggctggagcctccgggagacagcctgccttggaaaaagttacgcccagatgtggcagctgatgtactttcaccgacgagatctccgcctggcggccaacgccatctgcagcgccgtccccgtggactgggtgcctaccagcaggacaacctggtctatccacgcgcaccaccagtggatgaccaccgaggacatgttgagcgtttggaaccgcgtctggatcgaagagaatccgtggatggaggacaagacgcacgtgtcgagctgggaggaggtcccctacctcggcaaacgcgaggaccagtggtgcggatcgctgatcgggctgaccgcccgggccacttgggccaccaacatccaggtggccatcaaccaggtacgccggctcatcggaaacgagaactacctggactacatgacgtcgatgaagcgcttcaagaacgagtccgaccccgagggggcgctctggtga

SEQ ID NO: 23777 - RNA, 9879 nt, synthetic construct
  misc_feature 1..9879: note = derived and/or modified CDS sequence (opt11) from DENV-1__GU131948__SS-prME
  source 1..9879: mol_type = other RNA
tccgtaaccatgttgttaatgttattgccgactgcactggcgttccacctgaccactcgagggggcgaaccccacatgattgtcagtaagcaagaacggggcaaatcactactgttcaaaacctccgctggcgtgaacatgtgtacgctcattgcaatggatctaggagaactgtgtgaggacacaatgacctacaaatgccccagaataacagaggctgagccagatgacgtggactgctggtgcaacgctactgacacttgggtcacctacggaacctgttcacagacaggggaacataggcgcgacaagcgttcggtcgctctggcaccacatgtgggcctgggactagaaacccgaactgaaacatggatgagtagcgaaggggcatggaaacaaatacagcgagttgaaacctgggccctccgccatccgggattcacggtgatagccttgttcctcgcccacgccataggcacgtccatcacgcaaaaaggaataatatttatactcctcatgctagtgacaccgtccatggccatgcggtgtgttggaatcggcaaccgggacttcgtcgaagggctgagtggggccacctgggtcgatgtcgtgctcgaacacggctcctgcgtcaccactatggccaaaaataagccaacactcgatattgagctactaaagaccgaggtaaccaacccagccgtactaagaaagttatgcatcgaagcaaagatatctaacaccacaacggactcgaggtgccccacgcaaggagaggcaaccttagtagaggaacaagatgccaacttcgtatgcaggcgcacattcgtggatagaggatggggcaacgggtgcgggctattcggcaaaggttccttgctcacctgtgcaaaattcaaatgcgtcacaaagctagaaggcaagatagtgcagtacgaaaatttaaaatacagcgtcatagtcaccgtgcatacaggtgaccagcatcaggtaggcaacgaaaccaccgaacatggaacaatagctacgataacaccgcaagcacccaccagtgaaatccagttaaccgattatggcgccctcacactagactgcagtcctaggacaggcctcgatttcaacgaaatggtgttactaaccatgaaagaaaaatcctggctcgtgcataaacaatggttcttagacctaccactcccgtggacttcaggagccagtacaagccaagaaacgtggaacagacaagacctactcgtcaccttcaaaacggcacatgccaaaaagcaagaagtggttgtgctaggcagccaagaaggggccatgcacacagctctgacgggcgcaacggaaatccaaacgagcgggacgactaccattttcgccggccatctaaagtgccggctcaaaatggacaaattaacgctcaaagggatgagttatgtcatgtgcacgggctccttcaaattggagaaagaggtggcagaaacacagcatggaacagtgctcgtccaagtaaagtacgaaggaacagacgcgccatgtaaaatacccttttcaactcaggacgaaaagggcgtcacacagaatggccgtctaatcaccgccaaccccatagtcaccgacaaggagaaacccgtaaacattgagaccgaacctcccttcggagagtcctacatagtagtaggcgccggtgagaaggcattaaagctaagctggttcaagaaagggtcatccatcgggaagatgttcgaagccacagccagaggagcaagacgcatggcgatcttgggggatacggcatgggattttggctccataggaggggtcttcacatctgtgggaaagctagtacaccaggtctttgggacagcgtatggcgtcctattcagcggcgtaagctggactatgaagatagggataggaatactactgacgtggctcgggctcaacagccgatcaaccagcctaagcatgacatgtatagcggtcggaatggtgactctctacctcggcgtaatggtgcaggcagactccggctgcgtaataaactggaagggacgagagctaaaatgcggcagtggcatattcgtaaccaatgaagttcacacgtggaccgagcagtacaagttccaagcggactcgccaaagagactgtcagccgctatcgggaaggcgtgggaggagggcgtatgcgggatcagaagcgcaaccagactcgagaacatcatgtggaagcagatctcaaacgaattaaatcacatcctactagaaaatgacatgaaatttaccgtcgtagtcggagacgcaaatgggatattggcacaagggaagaaaatgataagaccacaaccgatggaacacaagtactcctggaaatcatggggcaaggccaagataatcggagccgatatacagaataccactttcatcatcgacgggccggacacacccgaatgtcctgacggccagcgagcctggaacatctgggaagtagaagactatgggttcggcatcttcacaacgaatatctggttgaaacttcgagatagttatacgcaaatgtgcgaccaccgcctaatgtccgcagccatcaaggactccaaagcagtccacgccgacatggggtactggatagaatccgagaaaaacgaaacctggaaattagccagagcatcgtttatagaggtcaagacatgcacgtggccaaaaagccacacattatggagtaatggtgtacttgaatcagaaatgataataccaaaaatttacggcggaccaatctcccaacacaactaccgaccaggatatttcacgcaaacagcgggcccatggcacttagggaaactcgaactagacttcgatttatgcgaagggacgacggtagtcgtagacgagcactgtggtaacagaggaccatcgctcaggacaaccacggtcacgggcaaaataatacatgaatggtgctgccgcagctgcactctgcctcccctccgattccgcggggaagacgggtgctggtacgggatggagataaggcccgtaaaagagaaagaagagaaccttgtacggtccatggtaagtgccggctcaggagaggtcgactccttcagtctcggtatactctgcgtatcaatcatgattgaagaggtcatgagatccagatggagccgaaagatgttaatgacggggacacttgccgtattcctgctgctaatcatgggccagctaacttggaatgacctgatcagactatgtataatggtgggcgcaaatgccagtgacaggatgggtatgggcacgacatacttggccttgatggcaactttcaagatgagacccatgttcgccgtgggactgctattccgccgccttacatcccgcgaaattttgctgctaacaattggcctcagtctcgtggcctcagtcgaacttccgaacagtctggaagaattaggcgatggtctcgcgatgggaatcatgatgctaaagctactcacagaatttcaaccgcaccaactctggactacgctactaagcctaacattcgtaaaaaccacactcagcttagactacgcttggaaaacaacagccatggtgctgtcaatcgtatcactgttcccactatgcctcagtaccacatcccaaaagacgacatggttgcccgtactcctcggatcgtttggctgtaaaccattgaccatgttcctcataacagagaacaaaatatggggacgtaagagttggccgctgaacgaaggaataatggcaatagggatagtaagtatactactgagctcacttctcaaaaatgatgtgccactagccggtccactgatcgcaggcgggatgctaatcgcatgttacgtaatatccggctccagtgcagacctatccctagaaaaggccgctgaagtctcatgggagcaagaagccgaacattcgggtgcttcccacaacattctagttgaagtccaagacgacgggacgatgaaaattaaagacgaagaacgcgacgatacactaacaatcctcctgaaggcgacgctacttgctgtcagcggcgtataccccatgtccattccagcaaccctcttcgtttggtacttctggcagaaaaagaaacaaaggtcaggggttctgtgggacacgcccagtcccccggaggtcgaacgagccgtgcttgacgacggcatataccgaatattgcagagaggcctattagggagaagccaggtaggtgtcggagttttccaggacggcgtcttccacacgatgtggcacgttacgaggggagcagttctcatgtaccagggcaaacgcctggaaccctcatgggcgtcggtgaagaaagacctaatctcgtatgggggcggatggcggttccaagggagttggaacacaggagaggaagtacaagtcatagcggtagaacccggcaaaaatcccaaaaacgtacaaaccacgcccggaatcttcaaaacgcctgaaggggaggtaggtgcaattgcactcgatttcaaaccgggtacgagcgggagccccatagtcaaccgagagggaaaaatcgtaggcctgtatggtaatggagtggtcacaacatccggaacatacgtctcggcaatcgcccaggccaaggcgtcacaagaaggacctctcccagaaatagaagacgaggtgttcaaaaagcgaaacctgaccatcatggatctgcacccagggagcggcaaaacacgccgatacctcccggcaattgtacgagaggcgataaaacgcaaactccgcacccttatactcgctccgacacgagtcgtcgcttccgagatggcagaggccctgaaaggcatgcccataagataccaaacaacagccgttaagtccgagcacacaggccgtgaaatcgttgacctaatgtgccacgcgacattcacaatgcgactcttgtccccagttagagtacccaattataacatgataatcatggatgaggcccatttcaccgacccagcgtctatagcggcaagaggttacatatccacacgcgtgggcatgggcgaagcggccgcaatattcatgaccgccactcccccgggaagcgttgaggcgttccctcagagcaatgcagtcatacaggacgaagagagagatataccagagcggagctggaacagcggctatgactggataaccgacttcccaggaaaaacagtctggtttgtcccatctatcaaaagtggcaacgacatcgcaaactgtcttcggaagaatggcaaaagagtaatccagctttcgcggaagacattcgatacagagtatcagaaaacaaagaataacgactgggattatgtagtcacaacagacatttcggaaatgggagcaaatttcagggcagatcgggtgatcgacccgcggagatgtctaaagccggtaatactcaaagacggtccggaacgcgttatattagccgggcctatgccggttacagtagcctccgccgcccaaagacgaggccgcataggccgtaatcagaataaggaaggagaccaatacgtatacatggggcagccgctaaataacgacgaagaccacgcacactggacagaagcaaagatgcttctggacaatatcaacacgcctgagggcataataccagcgttattcgagccggaacgcgaaaagtccgccgccatagacggggagtatcgactcaggggcgaggcgaggaagacgttcgtcgaactgatgcgaagaggcgacctgcccgtctggctgagttacaaagtagcaagcgagggctttcaatattccgaccgacggtggtgtttcgacggagagaggaacaaccaagtcctggaagagaacatggacgtggaaatatggacaaaggaaggcgagcgaaagaaactgaggccgaggtggctagacgcgagaacgtattcagacccactagctctccgcgagttcaaagagttcgctgccggcaggaggagtataagcggcgacctgatactagaaatcggcaaactgccacagcacctaacactacgagcccaaaacgcgctggacaacctagtaatgctgcataacagcgaacaagggggcaaagcgtatcgtcacgcaatggaagaactaccagacaccatagaaacgctaatgctgctggcactaatagcagtattaactggtggcgtgacactcttcttcctaagcggaaagggtctcggaaagacgtcaataggactactttgcgtaacggccagctccgcattgctgtggatggccagcgtagaaccccactggatcgccgcaagcataattctggagttctttctaatggtactcttgatccccgaacctgatcgccagagaacaccgcaggacaaccagctcgcctatgtagtcataggcctcctattcatgatcctgacggtagcggccaacgaaatgggcctattagagactacaaagaaggacctgggcatcgggtacgtggcggcggaaaatcaccaacacgcaacgatgttagacgtcgacttgcgaccagccagtgcatggacattatatgccgtcgcaactacggtaatcacaccgatgatgcgacacactatagaaaacaccacagcaaacataagcctaacagctatcgcaaatcaggccgccatcctaatgggactggacaaaggatggccgatcagcaaaatggatatcggcgttccgcttctagctctagggtgttacagtcaggtaaacccgcttacactgacggccgcagtgctaatgctagtagcacattatgccattattggtccaggactacaagcaaaagcaacccgcgaggcacagaaaagaacggcggcggggataatgaagaacccaaccgtagatgggatcgtagccatcgacctcgaccccgttgtgtatgacgccaagttcgagaagcagttaggacagatcatgttgttaatcctgtgcacaagccagatcctcctcatgcgaacaacttgggcactatgtgaatccataacacttgcgacaggccctctcaccacactgtgggagggatctcccggaaaattctggaacacgacaatcgcagtcagcatggcgaacatattccgcggatcgtatctagccggcgccgggctggcttttagcctcatgaaatctctaggaggaggccgtagaggcaccggagcacaaggggagacactaggcgaaaagtggaaaagacagctcaaccaattatcaaaatccgaatttaacacttataaaagaagcggcataatggaagtcgaccggagtgaggcaaaggaaggcctaaaaagaggggagaccaccaagcacgcagtgtcaagaggtacagcgaagctccgatggttcgtcgaaaggaatttggtgaaaccagaaggcaaggtcatcgacctaggctgcggacggggcggatggagctactactgtgcaggactaaagaaagttacagaagttaaagggtacaccaaaggcggccctgggcacgaagaaccaataccaatggcgacctacggctggaacctagtgaaactgcactcaggtaaggacgtcttcttcatgccaccagaaaagtgcgacacgctcctctgcgacatcggagaaagcagtccaaacccgaccatcgaagaaggaagaacgcttagggtacttaaaatggtagaaccatggctacggggcaaccagttttgcatcaagatcctcaacccgtacatgccaagcgtagtagaaactctcgagcaaatgcaacgcaaacacggcggaatgctcgtgcgcaacccactaagcagaaactcgacgcatgagatgtactgggtaagctgtggcaccgggaacatcgtcagcgccgtaaacatgacgtccagaatgcttctgaacagatttacaatggcccaccgaaaacctacgtacgaaagagacgtagacctgggggccgggaccaggcacgtggccgtagaacccgaggtagctaacttagacataatcggacaacggatagagaacatcaaaaatgaacacaagagtacgtggcattatgacgaagataacccgtacaagacatgggcataccacggaagctacgaggtcaagccgagcggaagcgcgtcgtccatggtcaacggggtcgtccgactactaacgaaaccatgggacgtaatccccatggtgacacaaattgcaatgaccgacaccaccccattcggtcagcaacgggtcttcaaagaaaaagtcgacaccaggacaccgagggcaaaaaggggtaccacgcagataatggaagtaacggcgaagtggctgtggggattcctgagcaggaataagaagcccaggatctgtacgcgcgaggaatttaccagaaaggtgcggtctaacgcggcaatcggggccgtgtttgtggatgagaaccaatggaactcggctaaggaggcagtggaagacgagagattctgggatttagtacacagggagcgggaactccacaagcaggggaagtgcgcaacttgcgtgtataacatgatggggaagagagagaagaaactaggtgagttcgggaaagcgaagggttcacgtgcaatatggtacatgtggctgggagcgcgttttctagagtttgaagcgctcggattcatgaacgaagaccactggttcagtcgagagaacagtctcagtggtgtggaaggagaaggactccacaagctcgggtacatacttcgggacatcagcaaaataccaggaggcaatatgtacgcagacgacaccgctggatgggatactaggataaccgaggacgacctacaaaacgaagcgaagataactgacatcatggagccggaacacgccctactagcaacaagcatcttcaaactaacctatcaaaacaaggtcgtgcgcgtgcagcggccggcaaagaacggcacagtaatggacgtcatctcaagaagggaccaaagaggcagcggccaggtcggaacatatggcctcaacaccttcacaaatatggaagtacagctaattcgacaaatggagagcgaaggcatctttctgcccagcgagctggaaacacccaacctggcagagcgcgtgctggattggctagagaaacatggcgcagaaagactcaaacgaatggccataagcggagacgactgtgtagtgaagcccatcgacgacagattcgccacggccctaacagcactaaatgacatggggaaggtaagaaaggacactccgcagtgggaacccagtaagggctggaacgactggcagcaagttccattctgcagccatcacttccaccagttgatcatgaaagacggcagggaaatagttgtcccgtgccgcaaccaggatgagctggtaggacgcgccagggtgtctcaaggagccggctggagtcttagagagaccgcctgcctcggcaagagctatgcacaaatgtggcaactcatgtatttccaccgtagggacctgcgcctcgcagccaacgcgatttgttcagcggtgccggtagactgggtacccacatccagaacgacctggagcatacatgcacaccatcaatggatgacgacggaagatatgctgagcgtatggaaccgggtatggattgaagagaacccgtggatggaggacaaaacacacgtctcttcctgggaggaagtcccctacctcggaaagagagaagatcagtggtgtggcagcctcataggcctcacggcacgagcaacttgggcgaccaacatacaagtggccataaaccaagtccgcagattaatagggaatgaaaactacctagactatatgacctccatgaagagattcaaaaatgagagcgaccctgaaggagcactatggtaa

SEQ ID NO: 23778 - RNA, 9879 nt, synthetic construct
  misc_feature 1..9879: note = derived and/or modified CDS sequence (opt11) from DENV-1__GQ868562__SS-prME
  source 1..9879: mol_type = other RNA
agcgttaccatgctgctcatgctgctgccgactgcattggcctttcacctgaccacccgcggcggggaaccccatatgatcgtgagcaagcaggaacggggcaagagcctgctgtttaagactagcgcgggggtgaatatgtgcaccctgatcgccatggacctcggggagttatgcgaggataccatgacctacaagtgcccccgtatcaccgaggccgagcccgacgatgtggattgctggtgcaatgccacggacacctgggtcacgtacgggacctgcagccagaccggcgagcacaggagagacaagcggtctgtagcactggcgccacacgtgggactggggctcgagacccgcaccgagacttggatgagctccgagggcgcatggaagcagatccagcgggtcgagacctgggccctgcgccatcccgggttcacagtgatcgccctgttcctcgcgcatgccatcggcacatcgattacccagaaagggattatcttcatcctacttatgctcgtgaccccgtccatggcaatgcggtgcgtcggcattggcaaccgcgacttcgtggaggggctgagcggcgccacgtgggtggatgtcgtactcgagcacgggagctgcgtgaccacaatggccaagaataagcccacgctcgacatcgagctccttaagacggaggtcaccaaccccgcggtgctccggaaattatgtatcgaggccaagatcagcaacaccaccacggactcccgctgcccgacccagggtgaggccaccctggtggaggagcaggatgcaaacttcgtctgccggcgcaccttcgttgaccggggctgggggaacggctgcggcttgttcggtaaggggagcctgctgacgtgtgcgaagttcaagtgcgtgaccaaactcgagggtaagatcgtccagcacgagaacctgaagtattccgtgatcgtcacggtccataccggcgaccagcaccaggtggggaacgagacgaccgagcatggcaccatcgcgaccatcacgccccaggcccccacgtcagagatccagctgaccgactacggtgccttaaccctggactgctcgccgcgcaccggcctcgatttcaatgaaatggtcctcctcacgatgaaggagaagtcctggctagtgcacaagcagtggttcttggacctgccgctgccctggacctctggggccagcaccagtcaagagacctggaaccggcaggacttactggtgacgttcaagaccgcccacgccaagaaacaggaagtggtggtgctgggctcccaggaaggcgccatgcacaccgcactcaccggggccacggagatccagacaagtggcaccaccacgatcttcgcggggcacctgaagtgccgcctaaagatggacaagctgacactgaagggcatgtcctacgtcatgtgcaccgggagtttcaagctggagaaggaggtggcggagacccaacacggcacggtgctggtccaggtgaaatacgagggcaccgatgccccctgtaagatacccttcagtacccaggacgagaagggagtgacccaaaacggcagactaatcacagccaaccctatcgtcacagacaaggagaagccagtgaacatcgaaaccgaaccgccctttggtgagtcttatatcgtggtaggcgcgggcgagaaggcgctgaaactctcatggtttaagaaggggagctcaatcggcaagatgttcgaggcaaccgcccgcggggcccggcgcatggcgatcctgggggataccgcgtgggacttcgggagcatcggcggagtgttcacctccgtgggcaagctggtccaccaggtgttcggcaccgcctacggagtgctgttcagcggcgtctcttggacgatgaagatcgggattggcatcctgctgacgtggctgggccttaacagccgctccaccagcctgtccatgacgtgcatcgccgtggggatggtgaccctgtacctcggcgttatggtgcaggccgatagcgggtgtgtgatcaactggaagggccgggagctgaagtgcgggtccggaatcttcgtcacaaatgaggtgcacacctggaccgagcagtacaagttccaggctgacagcccaaagcgcctgtctgcggccattggaaaggcatgggaggagggggtgtgtggcatccggtccgctactcgcctggagaacatcatgtggaagcagatcagcaacgagctgaaccacattctgctcgagaacgacatgaagtttaccgtcgtggtgggcgacgccaatggcatccttgcccagggcaagaaaatgatccggccccagccaatggagcacaagtactcttggaagtcgtggggcaaggccaagatcatcggcgctgacatccaaaacacgacattcatcatcgatgggccagacacaccagagtgccccgacggccagcgcgcctggaacatttgggaggtcgaagattacgggttcggcattttcaccactaacatctggctaaagctccgggactcctacacccagatgtgcgatcaccgcctcatgagtgcggccatcaaggacagcaaggccgtgcacgccgacatgggctactggatcgagagcgagaagaatgagacctggaagctggcccgggcgtccttcatcgaggtgaagacctgcacgtggcccaaatcacataccctatggtccaacggggtcctggaaagcgagatgatcatccccaagatctacggtgggccgatatctcagcacaactaccgtcctggctatttcacccagaccgccggcccctggcacctgggcaagctcgagctggactttgacctgtgcgaaggaacaaccgtagtggtcgacgagcactgtgggaaccggggcccgagcctcaggacgacaacggtgactgggaagatcatccacgagtggtgttgccggtcctgcaccctgcctcccctgcgctttagaggggaagacgggtgctggtacggcatggagatccgccccgttaaggagaaggaggagaacctcgtcaggagcatggtgtccgcgggcagcggagaggtggacagcttctccctgggcatcttgtgcgtcagcatcatgatcgaggaggtcatgcgctcccgatggagcagaaagatgctcatgaccgggacgctggccgtgttcctgctactgattatgggccagcttacctggaatgacctaatccgcctgtgcatcatggtcggggccaacgcttctgaccgcatgggcatgggcaccacccatctggccctcatggccaccttcaaaatgcgcccgatgtttgccgtggggcttctgttccggcgtctcaccagccgagaagtgcttctgctcacgatcgggctgtccttagtcgccagcgtggagctccccaattcactggaagaattaggggacggtctcgcgatgggcatcatgatgctgaaactgttaaccgagttccagcctcaccagctgtggacgaccctgctcagtcttacgttcgtcaagactacgttatcactcgactacgcctggaaaaccacagccatggtgctgagcatcgtgtccctgttcccactgtgcctgtccaccacgtcccagaagaccacctggctgccggtcctcctgggcagtttcggctgcaagccgctgacgatgttcctcatcaccgaaaataagatctgggggcgcaagagctggcccctcaacgagggaattatggctatcgggatcgtgagcatcctgctctccagtttgctcaaaaacgacgtccctctcgcgggaccgctgatcgccggcgggatgctgatagcctgctatgttatatcgggctccagcgccgacttatcccttgagaaggccgctgaggtgagttgggagcaggaggccgagcatagtggggccagccacaacatccttgtggaggtccaggacgacgggactatgaagatcaaggacgaggagcgggacgacaccctaaccatcctgctgaaggctaccctattggctgtgagcggggtataccccatgagcatacccgcgaccctgttcgtctggtacttctggcagaagaagaaacagcgcagtggcgtgttatgggacacccccagcccgcccgaggtggagcgggccgtcctggacgatggcatctaccgcatcctgcagcgagggctcctcggccgctcgcaggtaggggtgggcgtcttccaggacggggtgttccacaccatgtggcacgtgacacggggcgccgtcctgatgtaccaaggcaagcgcttggaacccagctgggccagtgtaaagaaagacctcatcagctacggaggcggctggcgattccaaggttcctggaacacaggggaggaggtgcaggttatcgcggtggagcccggcaagaatccgaagaacgtgcagaccacccccggaaccttcaagacacccgagggggaagtcggcgcgatagctctggacttcaaacccggaacctctggctccccgatcgtgaatcgcgagggcaagattgtgggactgtacggaaacggggtcgtgaccaccagcggcacgtatgtgtccgccatcgctcaagcgaaggcgagccaggaggggcccctgcccgagatcgaggatgaagtcttcaagaagaggaacctgaccatcatggacctgcaccctggcagcggcaagactcgccggtacctccccgccatcgtgcgggaggccatcaagaggaagctgcgcaccctgatcctcgcccccacccgcgtggttgcgtccgaaatggcggaggctctgaagggtatgcccatccggtaccagactaccgccgtcaagagcgagcacaccggccgcgaaatcgtggacctgatgtgtcacgccacgttcacgatgcggctcctgtccccggtccgcgtgcctaattacaacatgatcatcatggacgaagcacattttaccgacccggcctccattgccgcccggggctatatcagcaccagagtaggcatgggggaggccgctgccatctttatgactgccacgcctcccggtagtgtcgaagccttcccacagagcaacgccgtgattcaggatgaggaacgagacatccccgaacgcagctggaactcgggctacgactggataaccgacttccccggaaagaccgtgtggtttgtcccctctatcaagtccggcaacgacatcgcgaactgcctacggaaaaacgggaagcgcgtgatccagctcagccgtaaaacgttcgacaccgaataccagaagacgaagaacaacgactgggactacgtggtgaccaccgatatctccgagatgggcgccaactttcgcgccgacagagtcattgacccccggcggtgcttaaagcccgtgatcctaaaggacgggcccgagcgcgtcatcctcgcaggcccgatgcccgtgaccgttgctagcgccgcccagcggcgcggacggatcgggcgcaaccagaacaaagagggcgaccagtacgtgtacatggggcagcccctgaacaatgacgaagaccacgctcactggaccgaggcaaagatgctgctcgacaacatcaacacacccgagggcattatcccggcgcttttcgaacccgagcgcgaaaagtccgccgccatcgacggggagtaccggctgcgcggcgaagcacgaaagacattcgtggagctcatgcgccggggtgacttgcccgtctggctgagctacaaggtggcgtccgaggggtttcagtatagcgaccgccggtggtgtttcgacggcgagcgcaacaaccaggtgctcgaagagaacatggacgtcgagatctggaccaaggagggggagcggaagaagctccgccccaggtggttagacgcgcggacttactccgacccgctcgcgctgcgggagttcaaggagttcgccgccggcagacggtcggtgtctggcgacctgatcctggagattggaaagctgccccagcacctgaccttacgagcccagaacgcgctggacaacctggtgatgctccacaactccgagcagggcgggaaggcataccggcacgccatggaggaactgcccgacactatcgagacactgatgttattagccctgatcgccgtcctgacgggcggtgctaccctgttcttcctcagcggcaagggccttgggaagacctccatcggcctgctgtgcgtgacggcgagctccgccctcctgtggatggccagcgtggagccccactggatagcggcctccatcatcctcgagttcttcctcatggtcctgctgattccggagcccgaccgccaacgaacgccccaggacaaccaacttgcctacgtggtaatagggctgctgttcatgatccttaccgtcgccgccaacgagatgggcctcctggagaccaccaagaaggacttggggatcggctacgtggcggccgagaaccaccagcacgccacgatgctggacgtggatttgcgaccggcgagcgcctggacgctctacgcggtggccaccacggtgatcacccccatgatgcgccataccatcgagaacactacagccaacatctcacttaccgccatcgccaaccaggcggccatcctgatgggcctcgacaaggggtggccaatcagcaagatggacatcggcgtgccgctgctggccctcggatgctactcccaggtgaatccgctgaccctgaccgccgcggtgctaatgctggtggctcattacgccatcatcggccccgggctgcaggcaaaggccactcgcgaggcgcaaaagcgcaccgccgccggcatcatgaagaacccaaccgttgacggcatcgtggccatagacctcgaccccgtggtatacgacgcgaagtttgaaaagcagctggggcagatcatgctgctcatactgtgcaccagccagatcttactaatgcggacgacctgggcgctctgcgagtccatcaccttggccaccggcccgctcacgaccctgtgggaggggagccccggcaaattttggaacacgaccatagccgtgtccatggccaacatcttccgcggcagctacctggccggagcgggactcgccttctctttgatgaaaagcctcgggggcgggcgacgggggacgggggcacagggtgagaccttgggtgagaagtggaagcggcagctgaaccagctgtccaagagcgagttcaacacttacaagcgcagcgggataatggaggtggaccggagcgaggccaaggagggtctcaagcgtggggagaccacgaagcacgcagtcagccggggcaccgccaagctgcgctggttcgtggagcgtaacctcgtgaagcccgagggcaaggtcatcgaccttgggtgcggtcgaggagggtggtcttattactgcgccgggctcaagaaggtgaccgaggtgaagggttacaccaaaggcgggccgggccacgaggaaccgatccccatggccacctacgggtggaatctggtcaagctgcatagcggcaaggacgtgttcttcatgccgcccgaaaagtgcgacaccctcctgtgtgatatcggggagtccagcccgaaccccaccatcgaggagggccggaccctacgcgtgctcaaaatggtcgagccctggctgaagggcaaccagttttgcatcaagattctgaatccctacatgccgtccgtggtggagacccttgaacaaatgcagcggaaacacgggggaatgctggtccgcaaccccctgagcaggaactccacgcacgaaatgtactgggtgagctgcgggacgggcaacatcgtctccgcagtcaatatgaccagccgcatgctcctgaacagattcaccatggctcaccgcaagcccacgtacgagcgcgacgtggacctgggtgccgggacccggcatgtggccgtcgagcccgaggtggcaaacctcgacatcatcggccagcgtatcgagaatatcaagaacgaacacaaatccacctggcactacgacgaggacaacccgtacaaaacctgggcctaccacgggagctacgaggtgaagcccagcggcagcgcgtccagcatggtgaacggggtggtccggctgcttacgaagccctgggacgtgatcccgatggtaacccagatcgccatgaccgacaccacgccgttcggccagcagcgggtgttcaaagagaaggtggacacccgcacgccccgcgccaagcggggtaccacgcagatcatggaagtaaccgctaagtggctctggggattcctgtcccgcaacaagaaaccccggatctgcactcgtgaagagttcacccggaaggtgcgatctaatgcagcgattggcgccgttttcgtggacgaaaaccagtggaacagcgcgaaggaggcggtcgaggacgagcgattttgggaccttgtgcacagagagcgggagttgcacaagcaagggaagtgcgcgacatgcgtgtacaatatgatgggcaagagggagaagaagctgggggagttcggcaaggccaagggctcgcgggctatctggtacatgtggctaggggcccgcttcctcgagttcgaggccctgggcttcatgaacgaggaccactggttcagccgggagaactcactgagcggggtcgaaggggaggggctccacaaacttggctacatcctgcgcgatatctccaagataccgggcgggaacatgtacgcggatgacaccgctggatgggacacacggatcactgaagacgacctgcagaatgaggcaaagatcacggacatcatggagcccgagcacgcactcttggccaccagcatcttcaagctcacctaccagaacaaggtggtgcgcgtccagcgccccgcgaaaaacgggactgtgatggacgtgatctcccggagagaccagcggggcagcggacaagtcgggacgtatggcctcaacactttcaccaacatggaagtgcaactgatccgtcagatggagtccgaggggatcttcctcccaagcgagctggagacaccgaacctggctgagcgcgtgctcgactggctggagaagcatggcgcggagaggctgaagaggatggccatctcaggggacgactgcgtagtaaagcctattgatgatcgcttcgccacggcgctcaccgctctgaacgacatgggcaaggtgagaaaggatatcccacagtgggagccaagcaagggctggaacgactggcaacaagtcccgttctgctcacaccacttccaccaactgatcatgaaggacgggcgtgagatcgtcgtgccctgccggaatcaggacgagcttgtcggccgcgctcgggtgagccagggagccggctggtccctgcgcgagacggcatgcctgggcaagagctacgcgcaaatgtggcagctcatgtacttccaccggcgcgatctgcggctggccgctaacgccatctgctcggcggtgcccgtcgactgggtacctaccagccgcaccacgtggtctatccacgcccaccaccagtggatgactaccgaggatatgttgtccgtgtggaaccgcgtttggatcgaggagaacccgtggatggaggacaagacgcacgtgtcatcctgggaggaagtaccctacctgggaaaacgcgaggaccagtggtgcggcagcctgatcgggctcacggcccgcgccacctgggccacaaacatccaggtcgcgatcaaccaggtgcggcgcctgattggcaacgagaactacctggactacatgacctccatgaagcggttcaaaaatgagtcagaccccgagggggccttgtggtga

SEQ ID NO: 23779 - RNA, 9879 nt, synthetic construct
  misc_feature 1..9879: note = derived and/or modified CDS sequence (opt11) from DENV-1__GQ868563__SS-prME
  source 1..9879: mol_type = other RNA
agcgttaccatgttactaatgctgcttcccaccgccctcgcgtttcacctgaccacgcgtggcggagaacctcatatgattgtcagcaagcaggaacggggcaaaagcctccttttcaaaacgagcgccggcgttaacatgtgcaccctgatcgccatggacctgggcgaactctgcgaggacactatgacgtacaagtgcccccgcatcaccgaagccgagcccgacgacgtggattgctggtgcaacgccaccgacacctgggtgacctacggtacctgctcccagaccggggaacatcggcgcgataaacgctccgtggcccttgcgccccacgtgggcctggggctcgagacacgcaccgaaacttggatgagctcagagggcgcttggaagcagatacaacgggtcgagacctgggccctgcgccaccctggttttactgtgatcgcgctgttcctcgcgcacgccatcggcaccagcatcacccagaaggggatcatcttcatcctgctgatgcttgtgaccccctccatggccatgcggtgcgtgggcatcggcaaccgtgatttcgtggaagggctgtcaggcgctacctgggtggatgtagtgctggagcacgggtcgtgcgtgactaccatggctaaaaacaagcccaccttagacattgagcttctgaagactgaagttaccaatcctgcagtactccggaagctgtgcatcgaggcaaaaatcagcaacacgacaacggactcgcgctgtcctacgcagggcgaagccacccttgtggaggaacaggacgccaacttcgtctgccggcgcacattcgtggaccggggctgggggaacggctgcggcctgttcggcaaaggaagcctgctaacgtgcgcaaagttcaagtgtgtgaccaagctcgaggggaagattgttcagtacgagaacctcaagtactccgtcatcgtgaccgttcacaccggagaccagcaccaggtcgggaacgagaccaccgagcacggcactatcgccacaatcacgccccaggccccgacaagcgagattcagctgaccgactacggggctctcaccctggactgcagcccacggaccggactggacttcaatgagatggtcctcctgacgatgaaggagaagtcttggctagtgcacaagcagtggttcctcgacctgccgctgccgtggacctccggggcgtcaacctcacaggagacctggaaccggcaagacctccttgtaacgttcaagaccgcacatgctaagaagcaagaggtcgtggtactgggatcccaagagggcgccatgcacacggccctcaccggggcaacggagatccaaaccagcgggaccactacgatcttcgctggtcacttgaagtgtcgcctgaagatggacaagctcactctgaagggcatgtcgtacgtcatgtgtaccggtagcttcaagctggaaaaggaggtggcggagacccagcatggcacagtgctggttcaagtgaaatacgagggcaccgacgctccctgtaagattcctttttccacccaagacgagaagggggtgacccagaacggccggctaatcacggccaacccgatcgtaaccgacaaggagaagcccgtgaacatcgagaccgagccgcccttcggggagagctacatagtggtcggcgccggcgagaaagctctgaagctgtcctggttcaagaaggggtcctccatcggcaagatgttcgaggccaccgcacgaggagcccggcgcatggccatcctaggagacactgcctgggacttcggctcaattggcggagtgttcacctccgtggggaagttagtccaccaggtattcgggaccgcctacggagtgttattcagcggcgtctcctggaccatgaaaatcggcatcggcatcttgctgacgtggctgggcctcaacagccgctcgaccagcttatccatgacttgcatcgccgtggggatggtgaccctttatctgggcgtcatggtgcaggctgacagcgggtgtgtgatcaattggaagggccgtgagctgaaatgcgggtcaggcatctttgtaacaaacgaggtgcacacctggaccgagcagtacaagttccaagccgacagcccgaagcgcctgagcgcggccatcggaaaagcctgggaggagggggtgtgcggcatccggtccgccacacgccttgaaaacataatgtggaagcagatcagcaacgagttaaaccacatacttctcgagaacgacatgaagttcaccgtcgtggtaggcgacgcaaacggcatcctggcgcaagggaagaagatgatcagaccccagcccatggagcacaagtactcctggaagtcctggggtaaggccaaaatcatcggcgccgacattcagaacgccacgttcatcatcgacgggcccgacaccccggagtgccccgacggccagcgcgcgtggaacatctgggaggtcgaggactatgggttcggcatcttcaccaccaatatctggctgaagctccgtgactcctacacgcagatgtgcgaccacagactgatgtcagccgcaatcaaggattccaaggccgttcacgctgacatgggctactggatcgaatcagagaagaacgagacctggaagctcgcgcgcgcttccttcatcgaggtgaagacctgcacctggcccaaaagccacacgctctggagtaacggtgtcctggagagcgagatgatcatccccaaaatttacggcgggccgatttcccagcacaactatcgccccggatacttcacccagacggccgggccctggcacctaggcaaactcgaactggacttcgacttgtgcgagggcaccacggtagtggtggacgagcactgcgggaaccggggcccgagcctccgcaccaccactgtcactgggaaaatcatccacgagtggtgctgccggtcctgcacactgccgcccctgcgcttcaggggcgaagacgggtgttggtacggcatggagattcgaccggtgaaggaaaaggaggaaaacctcgtccggagcatggtatccgctggtagcggtgaggtggacagcttctccctagggatcctctgcgtcagcatcatgatagaggaagtgatgcgctcccgttggtcccgcaagatgctcatgacaggtaccttagccgtgttcctgctactgatcatgggccaactgacgtggaacgacctaaccaggctgtgcatcatggtgggtgcaaacgcctccgatcggatggggatgggcaccacctacctggcgttgatggccacgttcaaaatgaggccgatgtttgccgtggggctgctgttccggaggcttaccagtcgggaagtactactgctcaccattgggctgtcgttggtcgcgagcgtggagctccccaactccctggaggagctgggggacgggctcgccatgggtatcatgatgttaaaacttctcactgagttccaaccccaccagctgtggacgacgctgctcagcctgaccttcgtcaagactacgctgtccctcgattacgcctggaagaccacagctatggttttgagcattgtttccctgttccccctttgcctgagcaccacgtcccagaagaccacttggttaccagtcctgcttggtagcttcggctgcaagcccctgaccatgttcctcatcaccgagaacaagatctgggggcgcaagtcctggcccctgaacgaggggataatggctatcggcatcgtgagcatcctgctaagtagcctgctaaagaacgacgtgccccttgccgggccgcttattgcaggcggcatgttgatcgcgtgctacgtcataagcggctccagcgccgacttgtccttggagaaggcggcagaggtgagctgggagcaagaagccgagcacagtggggcgagccataacatcctggtggaagtccaggacgacggcacgatgaagatcaaggacgaggagcgggacgataccctcaccatactgctgaaggccaccctactggcggtctccggcgtgtaccccatgagcattcccgcgacgctgtttgtttggtacttctggcagaagaagaagcagcgctccggcgtgctctgggacacccctagcccgcccgaggtggagcgggcagtcttggacgacggtatctaccggatcctgcagcgtgggctgctcggccgctcccaggtgggtgtgggcgtcttccaggacggggtgtttcacaccatgtggcacgtgaccaggggagctgtcctgatgtatcagggtaagcgcctggagcctagctgggcctccgtgaaaaaggacctgatcagctacgggggcgggtggcggttccagggcctatggaacacgggggaggaggtgcaggttatagccgtggagcccggaaagaaccccaagaacgtgcaaaccacccccggcacattcaagacacccgagggtgaggtcggcgcaatcgccttagactttaagcccgggacctccggcagcccaatagtcaaccgcgaaggcaagattgtggggctctacggcaatggggtcgtgaccacctccggaacgtacgtgagcgccatcgcccaggcgaaggcctcccaggaggggcctctgcccgagatcgaggacgaagtcttcaagaaacggaatctgaccatcatggacctccacccggggagcggcaagacacgccggtacctgcccgcaatcgtgcgcgaggccatcaagcggaagctgcggaccttaatactggcgccgacgcgcgtagtcgcctctgagatggcggaggcactgaaggggatgcccatccggtaccaaactaccgcggtgaagtccgagcacaccggccgcgagatcgtggatctcatgtgtcacgcgacgttcaccatgcgcctcctgagtccggtccgcgttcccaactacaacatgatcataatggacgaggcacacttcaccgaccccgcctccatcgcagcccgggggtacatcagcacccgcgttggcatgggagaagcggccgccatctttatgaccgccacgccgcccggctccgtcgaagccttcccccagtcgaacgcggtaatccaggacgaagagagagacatccccgagcgcagttggaatagcggctatgactggatcaccgactttcccgggaagaccgtgtggttcgttccctccatcaagagcggtaatgacatcgccaattgcctccgtaagaacgggaagcgcgtgatacagctgtcgcggaagacgttcgacaccgaataccaaaagacgaaaaataacgactgggactacgtcgtgacgacggacatcagcgagatgggcgccaattttcgcgccgatcgggtcatcgacccaagaaggtgcctgaagcccgtgatcctcaaggacgggccggagcgtgtcatactggcgggcccgatgcctgtgacagtcgccagcgccgcccagcgtcgcggccggatcggtaggaatcagaataaggagggcgaccagtacgtgtacatgggacagcccctgaacaacgatgaggatcatgcccactggaccgaagcgaaaatgctcttggacaacataaacacccccgaaggtatcattcctgccctgttcgagcccgagcgcgaaaagtccgcagccatcgacggggaataccggttgaggggcgaggcgcggaagacgttcgtggagctgatgcgccggggcgacctgcctgtttggttatcctacaaggtggcgtcagaagggttccagtactccgatagacggtggtgcttcgacggcgagcgcaacaaccaggtactggaagagaacatggacgtcgagatctggaccaaggagggcgagcggaagaagctgcgcccccggtggttggacgcccgcacctactctgacccgctagccctgcgagagttcaaggagttcgccgccggccgccggtcagtatcaggcgacctcatcctggagatcggcaagctgccccagcaccttacactgcgtgctcagaacgccctggacaacttagtaatgctgcacaactccgagcagggcgggaaggcctatcggcacgccatggaggagctgcctgataccatcgagaccctcatgcttctggcactcatcgccgttctgacgggcggggtgaccctgttcttcctttccggaaagggcctggggaagactagcatcggtctcctctgcgtgacggcctcgagcgccctgctttggatggcatccgtcgaaccccattggattgctgcctcaatcatcctcgagttctttctgatggtgctactcataccggagcccgaccgccagcggacgccacaggacaaccagttagcctatgtggtaatcggtctcctcttcatgatcttgaccgtggccgccaacgagatgggccttctggaaaccactaagaaggaccttgggatcggctacgcggcggccgagaaccaccaacacgccaccatgctggacgtggacctccgcccggcctccgcgtggaccttgtacgccgtggccacgacggtgatcacccccatgatgcgccacaccatcgagaacaccacggccaacatcagcctgacggccatcgcgaaccaggccgccatcctgatgggcctggacaaggggtggcccatcagcaaaatggatatcggcgtgccgctcttagcactggggtgctacagccaggtcaaccccctgaccctcaccgctgccgtgcttatgctggtggcccactacgccattatcggccccgggctccaggcgaaggcaacgcgcgaggcccagaagcgcaccgccgccggcatcatgaagaaccctaccgtcgacggcatagtggccatcgacctcgaccccgtggtgtacgacgcaaagttcgagaagcaactcgggcagatcatgctcttaatcctctgcacaagtcagatcctcctgatgcggacgacctgggctctttgcgagagtatcaccctagccaccggccccctgactaccctgtgggagggatcccccggcaaattctggaataccaccattgccgtgagcatggccaacattttcaggggctcctacctcgcaggggcgggtctggccttcagcctgatgaagtccctcgggggaggccggcgtggtaccggcgcccagggggagacactcggcgaaaagtggaagcggcagctaaaccagctctccaagtccgagttcaacacttataagcggagcgggataatggaagtggaccggagcgaggcgaaggagggcctgaagcgaggtgagaccacgaagcacgctgtctcgcggggcaccgccaagctgcgctggtttgtggagcggaacctggtgaagcccgagggcaaggtcatagacctcggttgcggcagagggggatggtcgtactactgcgcaggactgaagaaagtcaccgaggtgaagggctacaccaagggcgggcccggccacgaggagccaatccccatggccacctacggctggaacctagtaaaattacactctggcaaggatgtgttcttcatgccgcccgagaagtgcgacacgctgctgtgtgacatcggagagagcagtccgaaccccacgatcgaagagggccggactctcagagtgcttaagatggtcgagccttggttacgtggtaaccaattctgcatcaagatcctcaacccctacatgccgagcgttgtggagaccctggagcaaatgcagcgcaagcacgggggcatgctggtccggaaccccctcagccgaaactctacgcacgagatgtactgggtgtcctgtgggacgggcaatattgtcagcgcggtcaacatgacatcccggatgctgctgaacaggttcaccatggcccaccgcaagcctacgtacgaacgggatgtagatcttggagccgggacccgccacgtggccgtcgagccggaggttccgaacctggacatcatcgggcagcggatcgaaaacatcaagaacgagcacaagagcacctggcattacgacgaggacaacccatacaagacatgggcctatcacgggtcctacgaagttaaaccctcgggctccgcgagctcaatggtcaatggcgtggtacgcctgttgacgaagccatgggacgttatcccgatggtgacccagatcgccatgacagacaccacgcccttcggccagcagcgtgtcttcaaggagaaagtggatacccgcacgccccgcgcgaagcgcgggacgacgcaaatcatggaggtgacagccaagtggctgtggggcttcctgagtcggaacaagaaacctcggatatgtacccgggaggagttcactagaaaagtcagatctaacgccgctataggcgccgtgttcgtagacgagaaccaatggaacagcgccaaggaagccgtcgaggacgaacgcttttgggacctcgtgcaccgggagcgcgagctgcacaagcagggaaaatgcgctacatgcgtctacaacatgatgggcaagcgagagaagaaactgggcgagttcggtaaagctaagggcagccgtgcaatttggtatatgtggcttggggcccggttcttagagtttgaggcattgggcttcatgaacgaggaccactggttttcccgcgagaacagcctttccggcgtcgaaggggaggggctgcataagctcggctacatacttagagacatctcgaagataccgggcgggaacatgtacgcggacgataccgccggctgggacacccgtatcaccgaggatgatctgcagaacgaagccaaaataacggacataatggagcccgagcacgccttactcgcaacctccattttcaaacttacgtaccagaataaggtggtgcgcgtccagcggcccgctaaaaatggtactgtgatggacgtgataagccgccgggaccagaggggttcgggtcaggtcggtacgtacggtctgaacaccttcaccaatatggaggtgcagctcatccgtcagatggagagcgagggtatctttctgccttccgagctggagacccccaacctcgcggagcgcgtgctggattggctggagaagcatggcgccgagcggctcaagagaatggcgatcagcggggacgactgcgtcgtaaagcccatcgatgaccggttcgccacggcgttaaccgctctgaacgatatgggcaaagttcgcaaggacatcccccagtgggaaccatccaagggctggaacgattggcagcaagtacccttttgcagtcaccacttccatcagcttatcatgaaggacgggcgggaaatcgtggtgccctgtcgaaaccaggacgagctggtcggtcgggctcgagtgtcccagggggccggctggtcgctccgggagaccgcatgcctcggcaagtcctacgcgcagatgtggcagctgatgtatttccaccgccgggatctgcgcctcgccgccaatgccatctgcagcgcggtgcccgtcgagtgggtgccgacatcccggaccacgtggagcatccacgcgcaccaccagtggatgaccactgaggacatgctgagcgtctggaacagagtatggatcgaggagaatccatggatggaggacaagacacacgtgtccagctgggaggaggtgccctacctgggcaagcgcgaggatcagtggtgcggatccctgatcgggctgactgcccgtgctacctgggctacaaacattcaggtcgcgatcaaccaggtgcgtcggctcatcggcaacgagaattacctcgactacatgacctctatgaaacgctttaagaacgagtccgaccccgagggagccctgtggtga

SEQ ID NO: 23780 - RNA, 9879 nt, synthetic construct
  misc_feature 1..9879: note = derived and/or modified CDS sequence (opt11) from DENV-1__GQ868564__SS-prME
  source 1..9879: mol_type = other RNA
agcgtgaccatgctactcatgctgctgcccaccgctctcgccttccacctcaccactcgaggcggggagccccacatgattgtgagcaagcaggagcggggaaaagcactactgttcaagaccagcgccggggtgaacatgtgcactctgatcgccatggacctgggcgagctgtgcgaggacacaatgacctacaagtgcccccgtatcaccgaggccgagcccgacgatgtggattgctggtgtaatgcgaccgacacatgggtgacctacggcacatgctcccagaccggcgaacatcgcagggacaagcggagcgtggcgctggcgcctcacgtgggcctggggctggagacccgtaccgagacctggatgtcatcagagggcgcctggaaacaaatccagcgggtcgagacctgggcccttcgccaccccggcttcacggtaatcgcattattcctcgcccacgccattgggacctccatcacccaaaaggggataatcttcatcttattgatgcttgtgacccccagcatggccatgcggtgcgttggcataggcaaccgcgacttcgtagaggggctgtctggggctacatgggtggacgtcgtgttagagcacgggagctgcgtgaccacgatggcgaaaaacaagccgaccttagacatagagctacttaagacagaggttactaaccccgccgtgctcaggaagctatgtatcgaggcaaagatctccaataccacgaccgactcacgctgcccgactcagggcgaagctacgctggtagaagaacaggacgccaactttgtctgccggcgtacgttcgttgaccggggctgggggaatggctgcggattatttggcaaggggtctctgctgacctgcgcgaagtttaagtgtgtgaccaagttagaaggtaagattgtccaatacgagaacctgaagtactccgtcattgtgacagttcataccggtgatcagcaccaggtggggaacgagacgaccgaacacggcacaatcgccacaattacgccccaggctcccacctccgagatccagctaaccgactacggggccctcaccctggactgctctccccgaaccgggttggatttcaacgagatggtcctcctgacgatgaaggaaaaatcctggctagtacacaaacagtggtttcttgacctgccattaccatggacctccggggcctccaccagccaggagacctggaaccggcaagacctgctagtgaccttcaaaaccgcgcacgcgaagaaacaggaggtggtcgtgctaggctcacaggagggcgccatgcacaccgccctcaccggggccacggagattcagacaagtggtaccaccaccatcttcgcggggcacttaaagtgccgccttaagatggacaaattgaccctcaaggggatgtcttacgtgatgtgcaccggatcctttaaactggaaaaggaggtggccgaaactcagcatggaacagtgctggtccaagtgaagtacgagggaaccgacgccccatgcaaaatcccgttcagcactcaagacgagaagggggtgacccagaacgggcggctcattacagcaaacccaattgtcacggacaaggagaaacccgtgaacatcgaaactgaaccccctttcggggagtcttatatcgtggttggagcgggcgagaaggctttgaagctgagctggttcaagaagggttccagcatcggcaagatgtttgaggccaccgcccggggtgctcggcgcatggcgatactcggtgacactgcctgggatttcggttccattggaggggttttcacctcagtggggaagctggtccatcaagtgttcggaaccgcttacggggtgctgttttctggtgttagctggactatgaagattgggattggcatcctgcttacgtggctggggctcaactcccgctccacctcgttaagcatgacttgcatcgccgtggggatggtaacactgtatctcggcgttatggtgcaggccgactccgggtgtgtgatcaactggaagggacgggaactgaagtgcggttccggcatcttcgtcacgaacgaagtgcacacttggaccgaacaatataaattccaggctgacagcccgaagcgcctgtccgccgctatcggcaaggcctgggaggagggggtttgcggcatacggagcgccacacgcctcgaaaacataatgtggaagcagatctcgaatgagctgaaccatatcctgttggagaacgacatgaagttcacagtggtggtgggggacgcgaacggcatcctggcccaggggaagaagatgataaggcctcagcccatggaacacaagtacagctggaaaagctggggtaaggcaaagatcataggcgcggatatccagaacacgaccttcatcatcgacgggcctgacacaccggagtgccccgacggccagcgtgcatggaacatctgggaggtcgaagactacgggttcggcatcttcaccacgaacatctggctgaagctacgggatagctacacccagatgtgcgaccaccgcctgatgtccgccgccataaaggacagcaaggccgtgcacgccgatatgggctattggatcgagtccgagaagaacgagacatggaagctggcacgggccagcttcatcgaagtgaagacctgcacgtggcccaagtcccataccctttggagcaatggggtcttggaatccgaaatgataatcccgaaaatctacggcggaccgatcagtcagcacaactaccgccccggctacttcacacagaccgccgggccgtggcacctgggaaagctcgagcttgacttcgacttatgtgaaggcaccaccgttgtggtcgatgaacattgtgggaaccggggtccgagtcttcgaaccacgacggtgacgggaaagatcatccacgaatggtgttgtcggtcgtgcacgcttccgccactgcgcttcagaggggaagacgggtgctggtacggcatggagatacgccccgtgaaagaacgggaggaaaacctagttcgctccatggtgagtgcaggcagtggagaagtggactcgtttagcctgggtatcctgtgcgtatccatcatgatcgaagaggtgatgagatcgagatggtctcgcaagatgctcatgaccggaaccctggccgtgtttttgctcttgatcatggggcagctgacctggaatgacttgaccagactgtgtatcatggtgggagcgaacgcctctgaccggatgggtatgggcaccacctacctggccttgatggctactttcaagatgcgacccatgtttgcggtggggttattgttccggcggctcacctcccgcgaggtcctattactcaccatcggcttatcgctggtggcgtccgtggagctcccaaactctctggaggagcttggggacggtctggccatgggtatcatgatgctgaagctgctcaccgagtttcagccgcaccagctgtggaccaccctgctctccctgaccttcgtcaagacaaccctgagcctcgattatgcctggaaaactactgccatggtgctgagcatagtttccctgttcccattgtgcctgtccacgaccagccagaagaccacctggctaccggtcctattggggtctttcggctgcaagcccctcaccatgttcctcatcacagaaaataagatatggggccgcaagagttggcccctgaatgagggcatcatggcgattgggatagtgtccatactgctcagctccctactgaagaatgatgtgcccctcgccggtccgctgatcgctggcggaatgctgatcgcatgctatgtcatcagtggcagctccgccgacttgagtctagagaaagcggccgaagtatcgtgggagcacgaggccgagcacagcggcgcctcccacaacatcctagttgaggtccaggacgatggcacgatgaaaatcaaggacgaagaacgagacgacacactcaccatcctgttaaaagctgcgctcctggccgtgagcggggtgtaccctatgtccattccggccacgctatttgtctggtacttctggcaaaagaagaagcagcggagcggcgtgctatgggacaccccatccccgcccgaggtggagcgcgccgtgttggacgacggaatataccggattctgcagagaggtctgctcggtcggtcccaggtgggggtcggtgtcttccaggacggggtgtttcacaccatgtggcatgtgacccgcggcgccgtcctgatgtatcaaggcaaacggttggagccctcctgggcgagcgtgaagaaggacctcatatcctatgggggtggctggaggttccagggcagctggaacacaggggaggaggtgcaagttatcgccgtggagccaggaaagaacccgaaaaacgtgcaaacaacccccggcaccttcaagacgccggagggagaagtcggcgcgatcgcgctggactttaaacccggtacgtccggctctcccatcgtcaaccgtgaaggcaagatcgtgggtttatacggcaacggcgtcgtgaccacctccggcacatatgtgagcgcaatcgcgcaggccaaggcttcccaggaagggccactccccgagatcgaggacgaggtattcaagaagcggaacctcaccataatggacctgcacccgggtagtggcaagacccggcggtacttacccgctatcgtgcgggaggcgatcaaacgcaagttgcgaacccttattttagcacccactcgggtggtcgccagcgagatggccgaggccctaaaaggtatgccgatccgctaccagaccaccgcggtgaaatccgagcacaccggccgggagatcgtggacctgatgtgccacgcaacgtttaccatgcgcctgctgagcccggtgcgcgtacccaactacaacatgatcatcatggacgaggcgcatttcacggaccccgcgtcgatagccgcgcgggggtatatcagcaccagggtgggaatgggggaggccgcagccatcttcatgaccgccacgccacctggatccgtcgaggcattcccccagtctaacgccgtgattcaagatgaggaaagggacatacccgagcggtcatggaactcaggttacgactggataaccgatttcccaggcaaaaccgtatggttcgtcccctccatcaagagcggcaatgacattgccaactgccttaggaagaatgggaagagggtgattcagctctcccgcaagacgttcgacacggagtaccagaaaacgaagaataacgactgggactacgtggttaccacggatatctcagagatgggggcgaacttccgagcggatagagtgatagaccctcggcggtgcctgaagcccgtgattctgaaagatgggcccgaacgggtcatcctcgccggcccgatgcccgtcacagtcgcctccgccgcacagcgacgcggacgcatcgggcgcaaccaaaataaggagggagaccagtacgtgtacatggggcagccgctgaacaatgacgaggatcacgcgcactggaccgaggccaaaatgttactcgacaacatcaacacccccgagggcattatcccggccctgttcgaacccgagcgagagaagtccgctgcaatcgatggggagtatcgtctacggggtgaggcgcgcaagacgttcgtggagctcatgcgacgaggcgatctgcccgtctggttgagctacaaagtggccagcgagggcttccagtattccgatcggcgctggtgcttcgacggcgagcgtaacaaccaggtgcttgaggaaaacatggacgtcgagatatggacgaaagagggcgagcgcaagaagctgcgtccccgctggcttgatgctcggacatacagtgaccccttagccctgcgcgagttcaaagagttcgccgcgggccgtcgctccgtcagcggggacctgatcctcgagatcgggaagctgccacagcaccttaccctccgggctcagaacgcccttgacaacctggtgatgctccacaacagcgagcaagggggcaaagcctaccggcacgcgatggaggaactgcccgacaccatcgagacgcttatgctcttggccctaattgccgtcttgaccggcggggtgaccctgtttttcctgtcaggtaaggggctcgggaagactagcattggcctgttgtgcgtaacagcatcctcggctctcctgtggatggcgtccgtcgaaccacactggattgcggcgagcatcatactggagtttttcctcatggtgctcctgatcccggagcccgaccggcagagaacgccgcaggacaaccagctcgcctacgtggttatcgggctgttgtttatgatcctcaccgtggcggcgaacgagatgggtctgcttgaaaccacgaagaaggacttgggcatcggccacgtagccgccgagaatcaccagcacgctaccatgctggacgttgatctccggcccgcttcagcgtggaccctctatgctgtggccaccacggtgattacacccatgatgcgacataccatcgagaataccacggccaacatcagtctgacggccatcgcgaatcaggccgccattctgatgggcctcgacaaggggtggcccatatctaaaatggacataggcgtccctctacttgcgctcgggtgctactcacaggtgaatccgctcaccctgaccgcggccgtcctcatgctcgtcgcccactacgccatcatcggccccgggctacaagccaaggcgacgcgcgaggcccagaaacgtacagccgcgggcatcatgaagaaccccaccgtggacggtatcgtggccatcgacctagatccagtcgtgtacgacgcgaagttcgagaagcaactaggacagatcatgctgctcatcctgtgcacctcccaaatcctgctcatgcgcacaacatgggcactgtgcgagagcatcaccctggccacgggccccctcacgacgctctgggagggctcccctggcaaattctggaacaccacaatcgcagtgagcatggccaacatctttcgtggctcttatctcgcgggggctgggctcgccttctcgctcatgaaatccctcggtggcggacgccgtggcacgggagctcaaggggaaaccctcggcgagaaatggaagcgtcagctgaaccagctgtctaagagcgagttcaacacctacaagcgtagcgggatcatggaagtcgaccgcagcgaggcgaaagagggcctcaaacgcggggagaccactaaacatgcagtatcccgcggaactgccaagctgcggtggttcgtggagcgcaacctggtcaaacctgagggaaaggtgattgatctgggctgcggacgcggaggctggagctactattgcgcgggtcttaaaaaggtgaccgaggtaaaaggatacaccaagggcgggcccggtcacgaggagccgatccccatggccacctacgggtggaacctggtgaagctccactccggcaaggacgtattcttcatgccgcccgagaaatgcgatacgttgctgtgtgatatcggggaaagctccccgaatcccacaatcgaggagggccggactctgcgggtattgaagatggtggagccctggctacgcggtaaccagttctgtataaagatactgaacccctatatgcctagtgtggtcgagaccttggagcagatgcagcggaagcacgggggcatgctggtccgaaaccccctgtcccgaaattccactcacgagatgtactgggtgtcctgcggtaccggcaacatcgtcagcgcggtaaacatgacgtctcgcatgctcttaaatcgcttcactatggcccaccggaagcccacgtacgagagagacgtggacttgggcgcgggaaccaggcacgtcgccgtggagccagaggtcgccaacctcgacataatcggccagcgcatagaaaacataaagaacgagcataagagcacctggcactacgatgaggacaacccgtacaagacgtgggcgtatcacggcagttacgaagttaaaccttccggttccgccagctctatggtgaatggggtcgtgcgtctcctgacgaagccctgggacgtaatccccatggtcacccagatcgccatgactgatactacgccgtttggacagcagcgcgtattcaaagagaaggtggacacccgtacgccccgcgcaaagcgggggaccacccagatcatggaggtcaccgccaagtggctatgggggttcctgagccgcaacaagaagccgaggatttgcacacgcgaggagttcactcggaaggtgcgctccaacgcggcgatcggagcagtgttcgtcgacgaaaatcagtggaatagcgccaaggaagcggtggaggacgaacggttctgggacctggtgcatagggagagagaattgcacaaacaaggaaaatgtgccacgtgcgtctacaacatgatgggcaagcgcgagaagaagctgggggagtttggtaaggccaagggcagccgagcgatttggtacatgtggttaggcgcccgcttcctcgagttcgaagcgctgggattcatgaacgaagatcattggttctccagggagaacagcttgtccggggtggagggcgagggcttgcacaagctgggctacatcctccgcgatatcagcaagattccgggcgggaacatgtatgccgacgacactgcggggtgggatacccgcatcaccgaggatgatctccagaacgaggctaaaatcacagacatcatggagcccgagcacgccctgctggccacctccattttcaaactcacctatcagaataaggtggtccgcgttcagcgccccgccaaaaacggaaccgtcatggatgtcatttctcggcgcgaccagcggggctccggccaggtggggacatatggcctgaacacgttcaccaacatggaggtgcagctgatcagacagatggagagcgaggggatcttcctgccatccgagctcgaaacgccgaacctggcagagcgggtgctcgactggctggagaaacatggcgccgagcgcctgaagcggatggctatcagcggtgacgactgcgtggtgaaacccatcgacgaccgcttcgctacggctctgaccgcactgaatgacatgggcaaggttcggaaggacattccccagtgggagccctccaagggttggaacgattggcagcaggttccgttctgcagccaccacttccatcagctaatcatgaaagacgggcgcgagatagtagtcccctgtagaaaccaggatgagctcgtcggacgcgcccgggtatcccagggggccggctggagcctgcgcgagaccgcgtgcctggggaaaagctatgcccagatgtggcagctcatgtacttccaccggcgcgacctgaggttagccgcaaacgcaatctgcagcgccgtccccgtggagtgggtccccacgtcccgcaccacgtggtccatccacgcgcaccatcaatggatgactacggaagacatgctcagcgtctggaatcgcgtatggatcgaagaaaatccgtggatggaggataagactcacgtgtcgtcttgggaggaggtcccatatctggggaagcgagaggaccagtggtgcggctccctaatagggttgacagcgcgagccacctgggctacgaacatccaagtggccataaaccaggtccggcgactgattggcaatgaaaactacctagactacatgacttcaatgaagcgcttcaaaaacgagtccgatcctgagggcgccctatggtaa

SEQ ID NO: 23781 - RNA, 9879 nt, synthetic construct
  misc_feature 1..9879: note = derived and/or modified CDS sequence (opt11) from DENV-1__GQ868565__SS-prME
  source 1..9879: mol_type = other RNA
tcagtgaccatgctgctcatgctgctgcccaccgcgttggccttccacctgaccacgcgtggcggggagccccacatgatcgtctctaagcaggagcgaggcaagagcttactgttcaagaccagtgcgggggtgaatatgtgcaccttgatcgccatggacctgggcgagctctgcgaggacaccatgacctacaagtgtccccgtatcacggaggctgagcccgacgacgtggactgctggtgcaacgccaccgacacctgggtcacttacggtacctgcagccaaaccggcgagcaccggcgcgacaagcggtccgtggccttggcgccccacgtgggcctgggtttggagacccgaaccgagacttggatgagctccgagggtgcctggaaacagatccagcgggtcgagacctgggccctgcgccatcccgggtttacggttatcgccctgttcctggctcatgccataggcaccagcatcacccagaaggggatcatcttcatcctccttatgctcgtgacaccctcgatggccatgcggtgcgtcggcatcggcaaccgcgacttcgtggaggggctgagcggtgcgacgtgggtggacgtcgtgctggagcacggctcctgcgtgaccacgatggctaagaataagcccaccctcgacatcgagctgctgaagacggaggtaacaaaccccgcggtgctccggaagctctgtatcgaggccaaaatcagcaataccaccacggattcccgctgcccgactcaaggcgaggccaccctggttgaagagcaggacgcgaacttcgtatgccggcgcacctttgtggaccggggctggggtaacggctgtggcctgttcggcaaggggagcctgctaacttgtgccaaattcaagtgtgtgaccaagttggaagggaagatcgtccagtacgagaacctgaagtactccgtgatcgtgaccgtccacacgggcgaccaacaccaagtggggaacgagacaaccgagcacggaaccatcgcgaccatcacgccccaagcccccacgagcgagatccagctgaccgactacggggccctcaccctggactgtagcccccgcaccggcctggactttaacgaaatggtcctcctgacaatgaaagagaaatcctggctggttcacaagcaatggttcctcgacttacctctgccctggacgtccggggccagcactagccaagagacctggaaccggcaagacctcttggtgacatttaagaccgcccacgcgaagaaacaagaggtcgtggtgctgggctcccaggagggcgccatgcatacagccctcaccggggccacagagatccagacatccggcaccacgaccatcttcgccgggcaccttaagtgtcgcctgaagatggacaagctcaccttgaagggcatgtcctacgtcatgtgcaccgggtcgttcaagttagagaaggaggtagctgagacccagcacgggacggtgctggtccaggttaagtacgaaggcaccgacgccccctgtaagatcccctttagtacccaggacgagaagggggttacccagaatggccggctcatcacggccaacccgatcgttaccgacaaggaaaaacccgtcaacatagaaaccgagccgcccttcggggagagttacatcgttgtcggtgccggcgagaaggcgctgaagctgtcctggtttaagaaggggagctccatcggaaagatgttcgaggccaccgcccgcggggcccgccgcatggccattctcggcgatacggcctgggacttcggcagcatcggcggcgtcttcacctcggtggggaagttggtccaccaggtattcggtaccgcctatggagtgctgttcagcggggtctcttggaccatgaagatcggaattggcatactcctgacctggctgggcctgaacagccgcagtacaagcctgtccatgacctgcatcgccgtggggatggtgaccctgtacctcggcgtcatggtgcaggccgattctgggtgcgtgatcaactggaagggccgggagttaaagtgcggctccggcatttttgtcacgaacgaagtgcacacctggaccgagcagtataagtttcaggccgacagcccgaagcgcttgagcgcggctatcggcaaggcctgggaggagggggtgtgcggcattcggtccgccacccgcctcgagaacatcatgtggaagcagatcagcaacgagttaaaccacatcttgctcgagaacgacatgaagttcaccgtcgtggtgggggacgcaaacggcatcctggcccaagggaagaagatgatccggccccagcccatggagcacaagtactcctggaaatcctggggcaaggccaagatcatcggcgccgatatccagaacgctacgttcatcattgacgggccagacacaccggagtgccccgacggacagcgcgcgtggaacatctgggaagtcgaggactacgggttcggaatcttcaccaccaacatatggctgaagctccgggactcctacacccagatgtgcgaccacaggctgatgtctgccgccattaaggactccaaggccgtacacgctgacatgggatactggatcgagagcgaaaagaacgagacctggaagctggcgcgcgcctcgtttatcgaagtgaagacttgcacttggccgaaaagccacacgctctggtccaacggggtgctggagagcgagatgatcatccccaaaatctacggcgggcctatttcccagcacaattaccgccccggctacttcacccagaccgccgggccatggcatcttggcaagctcgagctggacttcgacctgtgtgagggcacaacggtggtggtcgacgagcactgcggtaacaggggccccagcctccgtaccaccaccgtgacgggcaagatcatccatgagtggtgctgccggtcctgtactctgccgcccctgcgatttcgcggggaggacgggtgctggtacggcatggagatccgccccgtgaaagagaaggaagagaacctcgttcggagcatggtgagtgccggatcgggggaggtggattcattctccctgggcatactgtgcgtttccattatgatcgaggaagtcatgcgctcccggtggagccgcaagatgctcatgaccggtaccctggccgtgttcctgctccttataatgggccagctcacgtggaatgacctcactcgcctctgcatcatggtcggggcgaatgccagtgaccggatgggcatgggcaccacctacctggccctcatggcgacgttcaagatgcgcccgatgttcgccgtggggctgctgttccggcgcctcaccagccgggaggtccttctgctcactatcgggctgagtctggttgcgtctgtggagctccccaactccctggaggagctaggtgacggcctcgccatgggcattatgatgctgaagctgctcaccgagtttcaaccccaccagctgtggacgaccttgctcagtttaacgttcgtcaagaccacgctgtccctcgactacgcctggaagaccaccgccatggtgttaagcatcgtgtccctgtttcccctatgcctgtccaccacgtcccaaaaaaccacctggctcccggtcttattaggaagctttggctgcaagcccctgacgatgtttctcattactgagaacaagatctggggacgcaagtcctggcctttaaacgagggcatcatggcgattgggatcgtgagcatcctgctatccagcctactcaagaacgacgtacccctggccggcccgctgatcgccggcggtatgctgattgcatgttacgtcatcagcggctcgagtgccgacctctccctcgagaaggcggctgaggtgtcgtgggagcaggaggccgagcactccggggcctctcataacatcctcgtggaggtccaggacgacggcacgatgaagatcaaggacgaggagcgggacgatacgctcactatcctgctgaaggcgacattactggcagtgtccggggtataccccatgagcatcccagccacgctgttcgtctggtacttttggcagaagaagaagcagcgttccggcgttttatgggacacgcccagcccgcctgaggtggagagggccgtcctggacgacggcatctaccggattctacaacgagggctgctcggtcgctcccaggtgggggtcggcgttttccaggacggggtgttccacaccatgtggcacgtgacccggggcgccgtactgatgtaccagggcaagcgcctggagcccagctgggcctccgtgaagaaggacctcatctcatacgggggcgggtggcgtttccagggcctgtggaacacgggagaagaggtgcaagtaatcgctgtcgagccaggcaagaatccgaagaacgttcagaccacccccggcacgttcaaaacgcccgaaggggaggtgggggccatcgcactcgatttcaagcccggcaccagtggcagcccgatcgtgaaccgcgagggcaagatcgtggggttatacggcaacggggtcgtgaccacatccggaacgtatgttagcgccatcgcgcaagcgaaggcctcccaggaggggcccttacccgaaatcgaggacgaagtcttcaagaagcggaatctgacgatcatggaccttcacccgggcagcggcaagacccgccggtatctgcctgccatcgtgcgggaggcgatcaagcggaaattgcgtaccttaatattggcgcccacgcgcgtggtcgccagcgagatggcggaggccctgaaggggatgcccatcaggtaccagacaaccgccgtgaagtcagagcacaccggtcgcgagatcgtggacctcatgtgccacgcgacgttcaccatgcggttgttaagcccggtccgcgtgcccaattacaacatgatcatcatggacgaggcccatttcaccgaccccgcctccatcgcggcgcgggggtatatcagcacccgcgtgggcatgggggaggcggccgccatctttatgacggccacgccccccggatcagtcgaggccttcccccaaagcaacgcggtgatccaggacgaggagcgcgacatcccagagcgctcctggaactctggctacgactggatcaccgacttccccgggaagaccgtgtggttcgtcccgtcaatcaagagcggcaatgacatcgccaactgcctccggaagaacgggaaacgtgtgatccagctgtcccgaaagacgttcgataccgagtaccagaagaccaagaacaacgactgggactacgtggttaccacggacatcagcgagatgggcgccaacttccgcgccgaccgggtaatcgacccccgccggtgcctcaagcccgtgatcctcaaagatgggcccgagcgcgttatcctggcgggaccgatgcccgtgaccgtcgcctccgccgcccagcggcgcgggcggatcgggcgcaaccagaacaaggagggcgaccagtacgtgtacatgggacagcccctgaataacgatgaggaccacgcccattggaccgaggccaagatgctattagacaacatcaacacccctgagggcatcatcccggccctgtttgagcccgagcgcgagaagtcagccgccatagacggggaatatcggctccgcggcgaggcccggaagacgttcgtggagctgatgcgccggggcgacctgcccgtctggctctcctacaaggtggcgagcgaagggttccaatattccgatcgccggtggtgcttcgacggcgagcgcaataaccaggtgttggaggagaacatggacgtcgaaatctggaccaaagaaggggagcgaaagaagctgagaccccggtggctcgacgcccgcacctacagcgacccgctggccctgcgtgaattcaaggagtttgccgccggccgcaggagcgtcagcggcgacctcatcctggagatcggaaagctgccccaacacttgaccctgcgtgcgcaaaacgccctggacaacctcgtgatgctgcataacagcgagcagggaggaaaggcataccgtcacgccatggaggaactgcccgacaccatcgagacactcatgctgctcgcgctcatcgccgtactgaccggaggtgtcacactgttcttcctctccggcaagggcctggggaaaacctccatcgggctgctgtgcgtaacagcctccagcgccttgctgtggatggcctccgttgagccccactggatcgccgcctctattatcttagagttcttcctgatggtgctgctcatccccgagcccgaccgacagcggacaccccaggacaaccagctggcatacgtggtaatcgggctcttatttatgatcttaaccgtggccgccaacgagatggggctgctcgagaccactaagaaagatctggggattggctacgcggccgcggaaaaccaccagcacgctaccatgctggacgtagatctccgcccggctagcgcgtggaccctgtacgccgtggccaccacggtgattacccctatgatgcggcacaccatcgagaacaccacggccaacattagcctgaccgccatcgcgaaccaggccgcgattctaatgggcctcgacaaggggtggcccatatcaaagatggacatcggcgtgcccctgttggccttggggtgctacagtcaggtcaaccctctgacgctcactgcggccgtcctgatgctggttgctcactacgccatcatcggccccgggctccaggccaaggcgacgcgcgaggcccagaagcgcacagccgcgggcatcatgaagaatcccaccgtcgacggcatagtggccatcgacctggaccccgtggtctacgacgcgaagttcgagaagcagctggggcagatcatgctcctgattctgtgtacctcccagattctcctgatgcgaacaacctgggcactgtgcgaaagcatcaccctcgccacaggtccattgacaaccctgtgggagggatcccccggcaagttctggaacaccacaatcgccgtgagcatggccaacatctttcggggatcctacctggcgggagccggcctggccttctctctgatgaagtccctcgggggggggaggcgcggcacgggcgctcagggggagacattgggcgagaagtggaagcgtcagctgaaccaactctccaagtctgagttcaacacctacaagcgcagcgggatcatggaggtggaccggagcgaggcgaaagaaggactgaagagaggggagaccacgaagcacgccgtgtcccgtggcaccgccaagctgagatggttcgtggagcgaaacttggtgaagccagagggcaaggtcatagatctcggatgcgggcgtgggggctggtcatattactgtgccggcctgaagaaggttaccgaggtgaagggctacaccaagggagggcccggccacgaggaaccgatccccatggctacatacgggtggaacctggtcaagctccactccggcaaggatgtgtttttcatgccgcccgagaagtgcgacaccctgctgtgcgacatcggcgagagctctccgaaccccaccatcgaggagggccgaaccttgcgcgtactgaaaatggtcgagccctggctgcggggcaaccaattctgcatcaagatcctcaacccctatatgccgagcgtggtggagacattggagcagatgcagcgcaagcatgggggaatgttggtccggaatcccctctcacggaatagcacacacgagatgtactgggtgtcctgcgggaccggtaacatcgtcagcgcggttaacatgacctcccggatgttactgaaccgcttcaccatggcccaccgcaaacctacgtatgaaagagacgtcgatctcggcgctgggacacgccacgtggcggtcgagcccgaagtggcaaacttggatatcatcgggcagcgtatcgagaatatcaagaatgagcacaagagcacctggcactacgacgaggataacccgtacaagacctgggcgtaccacgggtcctacgaggtgaagcccagcggctcggccagctccatggtcaacggggtggtccgcctgctcacgaagccctgggacgtgatcccaatggtgacccagatcgcaatgaccgacaccacgccgttcggccagcagcgtgtgttcaaggagaaagttgacaccagaacgccccgggccaaacgcggcacaacgcaaatcatggaggtaaccgccaagtggctgtggggtttcctgagccggaacaaaaagccccgcatctgtacccgggaggaattcacccgcaaggtccgttccaacgccgccatcggcgccgtgttcgtggacgagaatcagtggaacagcgccaaggaggcggtcgaggacgagcgcttctgggacctcgtgcaccgggagcgcgagctgcacaagcaagggaagtgcgccacatgcgtgtacaatatgatggggaaacgggagaagaagctgggggagttcggcaaagccaagggaagccgtgccatctggtacatgtggctaggggccaggttcttagagttcgaggcgctgggcttcatgaacgaggaccactggttctcccgcgaaaactcactctccggggtcgagggcgaggggctgcataagctcggatacatcctccgggacatttccaagattccgggcgggaacatgtacgccgacgacaccgccggctgggacacgcgtatcaccgaggacgacctccagaatgaggccaagataacggacataatggagcccgagcacgcccttctcgccacctccatcttcaagctgacctaccagaacaaggtggtgcgcgtccagcgtcccgccaagaacgggaccgtcatggatgtcatctcaagacgtgaccagcgcggctcaggccaggtcgggacgtacggcctgaataccttcaccaacatggaggtccagcttatccggcagatggagagcgaggggatctttttgccctccgagctggagaccccaaacctcgccgaaagagtgctggactggctggagaaacacggcgccgagcggctcaagcgcatggccatcagcggcgacgactgcgtcgtgaaacccatagacgaccggttcgcaacggccctgacagccttgaatgacatgggcaaagtccgtaaggacatcccccagtgggagccttccaagggctggaatgactggcagcaagtcccgttctgctcgcaccacttccaccagctcatcatgaaggacgggcgggagatcgtggtgccctgtcgcaaccaggacgagctagtaggacgcgctcgcgtgtcccagggggccggctggagcctgcgggagaccgcgtgcctcgggaaatcctacgcccaaatgtggcagctgatgtactttcaccggagagacctgcgcctcgccgcgaacgcgatatgctccgctgttcccgtcgagtgggtgcccaccagtcggaccacatggagcatccacgcccatcaccagtggatgaccaccgaggacatgctgagcgtgtggaatcgcgtttggatcgaggaaaacccgtggatggaggataagacccacgtgtcaagctgggaagaggtgccctatctgggtaagcgcgaagaccagtggtgcggcagcctcatcgggctcacggcccgggccacctgggcaaccaatatccaggtcgccatcaaccaggtgcgacggctgataggcaacgagaactacctcgactatatgacctcaatgaagagattcaagaacgagtccgatcccgagggggccttatggtga

SEQ ID NO: 23782 - RNA, 9879 nt, synthetic construct
  misc_feature 1..9879: note = derived and/or modified CDS sequence (opt11) from DENV-1__GQ868568__SS-prME
  source 1..9879: mol_type = other RNA
agcgtgaccatgctgctcatgctgctgcccaccgccctcgccttccacctgacgacccgcggcggggaaccacacatgatcgtgagcaagcaggagagaggcaagagcctgctcttcaaaaccagcgcgggtgtgaacatgtgcaccctgatcgccatggacctgggcgaactctgcgaagacactatgacctacaagtgccctcgcatcaccgaggccgagcccgacgatgttgactgctggtgtaacgccaccgacacctgggtgacctacgggacatgcagccagactggcgagcaccggcgcgacaaaaggtccgtggcgctggcgcctcacgtgggtctcgggctcgaaaccagaaccgagacttggatgtctagtgaaggtgcctggaagcagatacaacgagtcgagacctgggccctgcgccatccagggttcactgtgatcgcactgttcctagctcacgtgatcggcaccagcatcactcagaagggaatcatcttcatcctgctgatgctcgtcacaccctccatggccatgcgttgcgtgggcattggtaaccgcgacttcgtggaggggctcagcggtgccacctgggtcgacgtggtgctcgagcacgggtcttgtgtcacaaccatggccaaaaataaacctaccctcgacatcgaactgcttaagaccgaggtgaccaaccctgccgtgctccggaagctgtgcattgaggcgaagatcagcaacacaacgacggactcccgctgcccgacgcagggcgaggctaccctggtcgaggagcaagacgccaacttcgtgtgccggcgtaccttcgtggaccggggctggggaaacggctgtggcctgtttggaaaggggagtctgctgacatgcgccaaattcaagtgcgtcacaaagctcgagggcaagatcgtgcagtacgagaatctgaagtactccgtgatcgtcaccgttcacacgggcgaccaacaccaggtaggaaacgaaacgaccgagcatggcaccatagccactatcacgccacaggctccgacatcagagatccagttgaccgactatggagcgctgactttagactgcagcccccgcactggcttagatttcaacgaaatggtgctccttacgatgaaagagaagtcctggctggtgcacaagcaatggttcctcgacttgccgcttccctggacctccggggcgtcgaccagccaggaaacctggaaccggcaggacctcctcgtgacattcaagaccgcccatgccaagaaacaggaagtggtggtcctgggctcccaggaaggcgcgatgcacaccgccctcactggagcaactgaaatccagaccagcggcacaactacgatcttcgccgggcacctgaagtgccgcctgaagatggacaaactcaccctaaaggggatgagctacgtgatgtgcaccgggagcttcaagctggagaaagaggtggccgagacccagcacgggacggtcctggtccaggtgaagtatgaaggcaccgacgcgccctgcaagatccccttttccacccaagacgagaagggggtcacccaaaacggccggctgatcacggccaacccgattgtgaccgacaaggaaaagcccgtgaacattgagaccgagccgccgttcggggagagctacatcgtagtgggtgccggggagaaagccctgaagctgtcctggttcaaaaaggggagctccattggcaaaatgtttgaggcgaccgcccggggggcccggcgcatggccattttaggcgacacggcctgggactttgggtctattggcggtgtgttcacatccgtcgggaagctggtgcaccaggtgttcggcaccgcttacggggtcctgttttcgggcgtatcctggatcatgaagatcggcatcggcatcctcctgacctggttgggccttaacagccgctcaacgagcctgtccatgacctgcatcgccgtgggaatggtcaccctgtacctcggggtgatggttcaggccgacagcgggtgcgtcatcaattggaagggccgggagctcaagtgcggctccgggatctttgtgaccaatgaggtacacacctggaccgagcagtacaaattccaggccgacagcccgaagcgcctttctgcagcgatcggcaaggcctgggaggagggggtatgcggcatcagatccgccactcgcttagagaacatcatgtggaagcagatcagcaacgaactgaaccacatcttactcgagaacgacatgaagttcacggtggtagtcggtgatgccaatgggatcctggcgcagggaaagaagatgatccggccccagcccatggagcacaagtattcctggaagagctggggcaaggcgaagatcatcggtgctgacacccagaacaccaccttcatcatcgacgggccggacaccccggaatgccccgacgggcagagggcctggaacatctgggaggtggaggactacgggttcggcatcttcaccacgaacatatggctgaagctcagggactcctacacgcagatgtgcgaccaccgcctgatgagtgccgcgatcaaggactcgaaggccgtgcacgccgacatgggatactggatagagagcgagaagaacgagacctggaagctggcccgggcctccttcatcgaggtcaagacctgcacatggcccaagagccataccctctggtccaacggggtgctggagtcggagatgatcatccccaagatctacggcgggcccatctcccagcacaactaccgccccgggtacttcacccagaccgcgggtccctggcacctgggtaagcttgaacttgactttgacctgtgtgagggcactaccgtggtcgtggatgagcactgtggtaaccgggggccgtctctgcgcaccaccacggtcacaggcaagatcatacacgagtggtgttgtcggtcctgcacactgccgcccttgcgcttccggggcgaggacgggtgctggtacggcatggagatccggcccgtcaaagaaaaggaagagaacctcgttaggagcatggtgtcagccggtagcggcgaggtcgacagtttctccctgggcatcctgtgtgtgagcatcatgattgaggaagtgatgcgctccagatggagccgcaagatgctgatgactgggacgctggccgtcttcttattgctgataatggggcagctgacctggaacgacctcacccgcctgtgcatcatggtaggggcaaatgcatccgaccggatgggcatgggcaccacgtacctggcgctcatggctaccttcaagatgcgtccaatgttcgccgtggggctgctgttcaggcgcctcaccagccgggaggtcctgctgctcaccatcgggctgtcccttgtggccagtgtcgaactccccaactccttggaagagctgggggacgggctcgccatgggcatcatgatgctgaagctactcacggagttccaaccccaccagctgtggaccacactgctctcgctgacctttgtgaaaaccacgctgtcccttgactacgcgtggaagaccaccgccatggtactgagcattgtctcccttttcccactctgcctgagcacgacatcccagaagaccacctggctgccggtgctcctgggcagtttcggttgtaagcccctaaccatgttcctcattacggagaacaaaatctgggggcgcaaatcttggccactgaacgagggcattatggccatcgggattgtgagcatcttgctctccagcctgctgaagaacgacgtacccctcgccggaccgctgatcgcgggcgggatgctgatcgcatgctacgtgatcagcggcagcagcgccgacctctccctggagaaagccgccgaagtaagctgggagcaagaggcggagcactcgggtgccagccacaatatcctggtcgaggtgcaggacgacggcactatgaagattaaggacgaagagagggatgacaccctcaccatcctgctgaaggcaacgctccttgccgtgtccggggtctaccccatgtctatccccgccacgctgttcgtgtggtacttctggcaaaaaaagaagcagcgctccggcgtgctctgggacacccccagcccccccgaggtcgagcgggcggttctggacgacggcatttaccgcatcttgcagagagggctgctaggccgctcccaggtcggggtcggggtgttccaagacggggttttccacacaatgtggcacgtaacgagaggcgccgtgttgatgtatcagggaaagcgcctggagcccagctgggcatccgtgaagaaagatctaatcagctacggaggagggtggcgattccaggggtcttggaacaccggcgaagaggtccaggtgatcgccgtggagcccggcaaaaacccaaagaacgtccagaccacccccggcacgttcaagactcctgagggggaagtgggagccatcgcgttagatttcaagcccgggacatctggatcccccatcgttaaccgggagggtaagatcgtcgggttgtacggcaacggggtcgtaaccacatccggcacctatgtctccgcgatcgcccaggccaaagcctcacaggaagggccactccccgagatcgaggatgaggtgtttaagaagcgcaacttaaccatcatggacctgcacccgggcagcgggaagacccgccggtacctccccgctatcgtgcgcgaggcgatcaagagaaagcttaggacgctgatcctcgcacccacccgtgtcgtggccagcgagatggcggaggccttgaaggggatgcccatccgataccagaccaccgccgtcaagagcgagcacacgggacgtgagatcgtcgacctgatgtgtcacgccaccttcaccatgcgcctcctgtcgccggttcgcgttcccaactacaacatgatcatcatggacgaggcccacttcaccgaccctgcgtcgatcgccgccagagggtacatatccacgcgcgtcggcatgggagaggcagccgcgatcttcatgaccgcaactccacccggtagcgtggaggcctttccgcagtccaacgcggtaatccaggatgaggagcgggacatccccgagcgcagctggaactccggctacgactggattactgacttccccggtaagacggtctggttcgtgcccagtatcaaatctgggaatgatatcgccaactgcctgcggaagaatgggaagcgcgtgatccagctctcacggaagaccttcgacaccgagtaccagaagaccaagaacaacgactgggactatgttgtgacgaccgatatatccgaaatgggcgcgaacttccgcgccgaccgggtgatcgacccccgccggtgtctgaagcccgttatcctgaaggacgggcccgagcgagtcatcctcgcaggcccgatgcccgttaccgttgccagcgcggcgcagcggcgtggccggatcgggcgcaaccagaacaaggagggcgaccagtacgtttacatggggcagcccctaaacaacgacgaggaccacgcacactggaccgaggccaagatgctgctcgacaacatcaatacccccgagggcatcatcccggccctgttcgagcctgagcgcgagaagtccgcggccgtcgacggggagtaccgattacgcggcgaggcccggaagaccttcgtggagctgatgcgccggggcgacctgcctgtgtggctgtcttataaggtcgcctccgagggtttccagtacagcgacagacggtggtgcttcgatggcgaacgcaataaccaggtgctcgaggagaacatggatgtggaaatctggaccaaggaaggagagcggaagaagttacgaccccgctggctggacgctcgcacctactccgaccccctcgcgttacgagagttcaaggagtttgccgccggccgacggtcggtcagcggcgacttaattctcgaaatcgggaagttgccccagcatctgaccttacgcgctcagaacgctctggacaatctggtcatgctgcacaactcagagcagggcgggaaggcttaccggcacgccatggaagagttgcccgacaccatcgagaccttgatgctcctggcactgatcgccgtgcttactggcggcgtcaccctgttcttcctgagcggcaagggcctcgggaagacgtcgattggcttattgtgcgtgaccgcgagcagcgcgctcctttggatggctagcgtcgaaccccactggatcgctgccagcatcatactggagttcttcctcatggtgctacttatccccgagcctgatcgtcagcggacgccccaggacaatcaactcgcgtacgtggtgatcgggctgctcttcatgatcctcaccgtcgccgctaacgaaatgggcctgctggagacgaccaagaaggatctcgggattggctacgttgccgcggagaaccatcagcacgcgacgatgctcgatgtggacctgcgcccggccagcgcgtggaccctctacgccgtcgctacgaccgtgatcacccccatgatgcgtcacaccatcgagaacacgacggcgaacatctcgctgaccgcgattgccaaccaggccgcaatcctgatgggcctcgataaggggtggcccatctcgaaaatggacatcggcgtgccgctgttagcactcggttgctactcccaagtcaatccgcttaccctgacggctgccgtgctcatgctggtggcccactatgcgatcatcggccccggcttgcaggccaaggccacccgcgaggcccagaagcgcaccgccgcgggcatcatgaaaaaccccaccgtcgacggcatcgtagccatcgacctcgaccccgtagtttatgacgccaagttcgaaaagcaactgggtcagatcatgctgctcatcctgtgcacgagccagatcctgttgatgcggaccacgtgggccctgtgcgagtctatcaccctcgccacaggtccgctcaccacgctgtgggaggggagccccgggaagttctggaacaccacgattgcggtgagcatggcaaacatcttccgcggctcgtacctggccggggcgggcctcgcattctccctgatgaagtccttggggggaggtcggcgcgggaccggcgcgcaaggggaaactttaggcgaaaagtggaagcggcagctgaatcagctgtccaagagcgagttcaacacctataagcgatctgggatcatggaagtcgaccggtccgaggccaaggagggcctcaagaggggggagacgaccaagcacgccgtcagccggggcactgccaagctgcgatggttcgtggaacggaatctggtgaagccagaaggcaaggttatcgatctggggtgtggccgcgggggctggtcttattactgtgcgggactgaaaaaagtgaccgaggtgaagggctacacgaagggcgggcccggccacgaggagccgattcccatggccacctatgggtggaacctggtgaagctacatagcgggaaggacgtgttcttcatgccgcccgaaaagtgcgacaccctcctgtgcgacattggggagtcttccccgaaccctacaatcgaggagggccgcacgcttcgcgtgctaaagatggtcgagccctggttacggggcaatcagttctgcatcaagattctcaatccctacatgccgtcagtcgtggagacgctcgagcagatgcagcgcaaacacggtggcatgctcgtccgtaaccccctgagccgcaactcgacccacgagatgtactgggtgagctgcggcaccggcaacatagtgtccgccgtcaacatgaccagcaggatgctcttgaataggttcacgatggcccaccgcaagcctacatatgagcgggacgttgatctgggcgccgggacccgtcacgtagcggtcgagcccgaggtggcaaacctcgatatcatcggccagcggatcgagaacatcaaaaacgaacacaagtcgacgtggcactacgacgaggacaacccgtacaagacgtgggcctaccacgggtcgtacgaagtcaagccatccggcagcgcctccagcatggttaacggggtggtccgcctgctgaccaagccatgggacgtgatcccgatggtaacccagatcgccatgaccgacacgacaccgttcggccagcaaagggtcttcaaggagaaagtggatacccgcacgccccgggcaaagcgaggcacgacccagatcatggaggtcaccgccaagtggctatgggggtttctgtcccggaacaaaaaaccccgcatctgcacccgggaggagttcacgcggaaggtccggagcaacgctgccataggcgccgtgtttgtggacgagaatcagtggaacagtgcaaaggaggccgtcgaggacgagcgcttctgggacctggtacaccgggagcgcgagctccacaagcaggggaaatgtgcaacttgcgtgtacaacatgatgggtaagcgggagaagaagctgggggagttcggcaaagccaagggctcccgagcgatctggtacatgtggctgggggccagattcctcgagttcgaggcattaggctttatgaacgaagaccattggttttcacgcgagaactccctgtcgggggtagagggggaggggttgcacaagctcggatacatcctgcgggacatatccaagattccgggcgggaacatgtatgccgacgacaccgccggctgggacacccgcatcacggaagacgatctccaaaacgaggccaagatcaccgacatcatggagcctgagcacgccctgctggccacctcaatcttcaagctcacgtaccagaacaaggtggtacgtgtccagaggcccgccaagaatgggacggtgatggatgtgatcagccgcagagaccagcgcggcagcggccaggttgggacctacggcctgaatacattcacaaacatggaggtgcagctgatccggcagatggagtcagaagggattttcttacccagtgagctggagactccgaacctggcggagcgcgtgctcgactggcttgagaagcacggagcggaacggcttaagcgcatggccatatccggcgacgattgcgtcgtgaaacccatcgacgaccgtttcgccaccgctctaacggctctgaacgacatgggaaaggtgcgcaaggacatcccccagtgggagcccagcaaaggctggaacgactggcaacaggtcccgttttgctcccaccactttcaccaactgatcatgaaggacggcagagagatcgtggtgccttgcaggaatcaagacgagctcgtcggccgagcgcgcgtaagccagggggccggctggtccctgagagaaactgcatgcctaggcaagtcttacgcccagatgtggcagctcatgtatttccaccgacgcgacttacgcctggccgccaacgccatctgctcggccgtgcctgtagaatgggtacccacgtcacggactacctggagcatccacgcccaccaccagtggatgaccaccgaggatatgctctccgtttggaaccgcgtctggatcgaggagaatccgtggatggaggataagacgcatgtgagctcctgggaagaggtgccctatctgggcaagcgtgaggaccagtggtgcggctcactgatcgggctcactgcacgggccacctgggctaccaacatccaggtcgccattaaccaggtgcgccggctgatcggcaacgagaactatttagactacatgacttccatgaagcgcttcaagaacgagagcgaccccgagggcgccctctggtga

SEQ ID NO: 23783 - RNA, 9879 nt, synthetic construct
  misc_feature 1..9879: note = derived and/or modified CDS sequence (opt11) from DENV-1__GQ868569__SS-prME
  source 1..9879: mol_type = other RNA
agcgtgaccatgttgcttatgctgcttcccaccgccctcgccttccatctgaccacccgcgggggggagccgcacatgattgttagcaagcaggagagaggcaagagcctcctgttcaagaccagcgccggtgtgaatatgtgcactctgatcgccatggacctgggagaattgtgcgaggacacaatgacctataagtgccctcggatcaccgaggccgagcccgacgatgtagactgctggtgcaacgccacggacacctgggtcacctacgggacatgctcccaaaccggcgagcaccggcgcgacaagcggagcgtggccctggcgccccacgtgggactggggctcgaaacgcgcaccgagacctggatgagtagtgaaggcgcgtggaagcagatacagcgagtagagacttgggccctgcgccaccccgggttcacagtgattgcacttttcctcgcccacgccatcggcacctcaatcacccagaaggggatcatcttcatcttgctcatgctcgtcactccctctatggcgatgcggtgcgtcggcatcggcaaccgcgacttcgtggaggggctctctggcgcgacgtgggtggatgtcgtgctggaacatggctcctgtgtgaccacaatggccaagaacaagcccaccctcgacatagagctgctgaaaacggaggtcgctaaccccgccgttctccggaaactctgcatcgaagccaagatcagcaacaccaccacggactcccgctgcccgacacagggcgaagccaccctggtggaggaacaggacgctaatttcgtctgccggcgcacctttgtggaccgcggctgggggaacggctgcggactgttcgggaagggtagcctgctgacctgtgcgaaattcaagtgcgtgacaaagctcgaaggaaaaatcgtccagtacgagaacctgaagtactccgtaatcgtcaccgtccacaccggggaccagcaccaagtggggaacgagacaactgagcacggcaccatcgccaccatcacaccccaggcccctacaagcgagatccagctgacggactacggggctctcaccctggactgcagcccacgtaccggcctggacttcaatgagatggtcttgctgaccatgaaagagaagtcctggctggttcataagcaatggttccttgacctacctctgccctggacgagcggtgccagcacaagccaagaaacttggaaccggcaggacctccttgtgaccttcaaaactgcgcatgctaagaagcaggaggtggtggtgctgggctcgcaggagggcgcaatgcacaccgctctcaccggggccaccgagatccagacaagcggcaccactaccatcttcgcggggcacttgaagtgccgcctgaagatggacaagctcactttgaaaggcatgtcatacgtcatgtgcaccgggagcttcaagttagagaaggaggtggccgagactcagcacggcaccgtcctggtccaggtcaagtacgaagggacagacgccccttgcaagatccccttctctacccaggacgagaaaggcgtgactcagaatgggcggttaatcaccgcaaacccgatagtcaccgacaaagaaaagcccgtgaacatcgaaacagagccgcccttcggggagagctacatcgtggtcggcgcgggagagaaggcgcttaaactgtcctggtttaagaagggcagctcaatcggaaagatgttcgaggcaaccgcacgaggggcccggcgcatggcgatcctcggcgacacagcctgggactttgggtcaatcggcggcgtgttcacgtccgtggggaagctggtgcaccaggtgttcggcaccgcctacggggttctgtttagcggcgtaagttggactatgaagataggtatcgggatcctcctgacctggctggggctcaacagccgcagcacgagtctgagtatgacatgcattgccgtggggatggtgaccctgtacttaggcgttatggtgcaggccgacagcgggtgcgtgatcaactggaagggtcgggagcttaagtgcggatccggcatcttcgtcaccaatgaggtacacacatggacggagcaatacaagttccaagcggacagcccgaagcgcctgtctgccgccatcggcaaagcctgggaggaaggcgtgtgtggaatccggtccgccacacgtctcgagaatattatgtggaagcagataagcaacgagctgaaccacatcctgctcgagaacgacatgaagttcaccgtggtggtgggggatgcgaacggcatattggcacaggggaagaagatgatcagaccacaacccatggagcacaaatactcctggaagtcatggggcaaggccaagatcatcggcgcagacatccagaatgcgaccttcatcatcgacgggccggacaccccggagtgtcccgacggccagagggcctggaacatctgggaggtcgaggactacgggttcggcatcttcaccacgaacatctggctgaagttacgggactcctacacccagatgtgcgaccaccgcctgatgagcgcagccattaaggactcaaaggccgtgcacgcggacatgggctattggatcgagagcgaaaagaacgagacttggaaactggcccgtgcttcctttatcgaagtcaagacatgcacatggccaaagtcacacaccctctggtccaacggggtcctagagagcgagatgatcatccccaagatctacggcggtccgatttcccagcacaactacagacccggctactttacacagacggccggaccttggcaccttggcaagctcgagctggacttcgacctgtgcgaggggactaccgtggtggtcgacgagcactgcggaaatcgtggcccgagccttcgcacgaccactgtgactgggaagatcatccacgagtggtgctgtcgctcctgcacgctgcctcccttacgcttccggggcgaggatgggtgctggtacgggatggagattcgccccgtgaaagagaaggaggagaatctcgtccggagcatggtgtccgccggcagcggggaggtggacagcttctccctgggtatcctgtgcgtctccatcatgatcgaggaggtgatgcgctccagatggagccgcaaaatgttgatgaccgggacccttgctgtgttcctgctcctgataatgggccagcttacctggaacgacctcacgcgcttgtgcatcatggtaggggccaacgcatccgatcgaatgggcatgggaacaacctacctcgccttaatggccaccttcaagatgcgcccgatgttcgcggtgggtttgttattccggcgactgacaagccgggaggtgctgctgctaaccatcggcctgtcactggtcgccagcgtggagctacccaactccctggaagagctgggggacgggctcgccatgggcataatgatgctgaagctgctcacagagtttcagccccaccagctgtggaccactctgctgtccttaaccttcgtcaagaccaccctttcccttgactacgcttggaaaacgaccgcgatggtgctgagcatcgtgtccctcttccccctctgcctcagcaccaccagccaaaagacgacctggttgccggtccttctggggagcttcggctgcaagccacttaccatgttcctcatcaccgagaacaagatctgggggcgcaaatcctggcccctgaacgagggcatcatggcaatcggtatcgtgtcaatcctgctctccagccttctgaagaacgacgttcccctcgctggccctctgatcgccggcggcatgctgatcgcctgctacgttatctcaggctcctcggctgacctatccctcgagaaggccgccgaggtgagttgggagcaggaggcggagcactccggggccagccataatatccttgtggaggtccaggacgacggcaccatgaagatcaaggacgaggagcgggacgacacgctaaccatactgctaaaagcgaccctcctggccgtttccggtgtgtacccgatgtcgatccccgccaccctgttcgtttggtacttctggcagaagaagaaacagcggtccggcgtgctctgggacacgccaagcccgcccgaggtggagcgagccgtccttgatgacggtatctaccgcatcctgcagcgggggctgctgggccgctcccaggtgggggtgggggtctttcaggacggggtattccacacgatgtggcatgtgacccggggggccgtactgatgtatcagggaaagcgcctggagccgagctgggcgtccgtgaagaaggacctcataagctacggtggcgggtggcggttccagggcctgtggaacatgggggaggaggtgcaggtcatcgccgtggagcccggcaagaacccgcgtaacgtgcaaaccacaccgggcacctttaagacccccgagggggaggtgggcgccatagcactggactttaagcccggaacctccggcagcccgatcgtgaaccgggagggaaaaatcgtggggctgtatggcaacggtgtcgtaacgacctctggcacctacgtttcagccatcgctcaagccaaggcgtctcaggaagggcccctgcccgagatcgaggacgaggttttcaaaaagcgcaatctcacgatcatggacctccacccgggaagcggcaagacgcggcgctatttgcccgccatcgtgcgggaagcgatcaagaggaagctgcgcacccttatcctggcacccacccgggtggtcgcaagcgagatggcggaggccctgaagggcatgcccatccggtaccagacaacggcggtaaagagtgagcacaccggccgggagatagtggacctcatgtgccacgccaccttcaccatgcgcctgctgagcccggtgcgggtgcccaactacaacatgattataatggacgaggcacacttcacagaccccgccagcattgccgcgcgcgggtacatctcaacccgcgtaggcatgggagaggccgccgcgatattcatgaccgccacgccacccggctccgtcgaagcgttccctcagagcaacgccgtcatccaggacgaggagagggatatccccgagcggtcctggaacagcggctacgactggatcacagacttccccgggaagactgtatggttcgtgcccagtatcaagagcggtaatgacatcgcaaactgcctccgcaaaaatggcaagcgggtgatccagctgtctcggaagacctttgacaccgagtaccagaagacgaagaacaacgactgggattacgtggtcacgaccgacatctcagagatgggcgccaactttcgagcggaccgcgtcatcgacccccggcgatgcttaaagccagtgatcctcaaagacggtcccgagcgggtgatcctggcgggccctatgccagttacggtcgccagcgcggcccagcgtcggggccgaatcggcaggaaccagaacaaggagggcgaccagtacgtgtacatgggccagcccctgaacaacgatgaggaccatgcgcactggaccgaggccaaaatgctcctggataacatcaacacccctgagggcatcatcccagccctgttcgagcccgagcgggagaaatccgctgccatcgacggggagtaccgcctacggggcgaggcgagaaagaccttcgtggagcttatgagacgcggcgatctccctgtctggctgtcatataaggtggccagcgaggggtttcagtactccgaccggcgctggtgcttcgacggcgaacgtaacaaccaggtgctggaggagaacatggacgtagagatttggaccaaagagggggagcgcaagaagctccggccccgctggctcgacgcccgcacgtacagcgaccctctggccctccgggagttcaaggagttcgctgcgggccggcgctccgtgagcggcgatctcatcctggagatcggtaagctgccccagcacctcaccctgcgggcccagaacgccctggataacctcgttatgctgcacaacagcgagcagggcgggaaagcataccgccacgcaatggaggaactgcccgatactatcgagaccctcatgttactggccctcatcgccgtcctaacaggcggggtcacgctgttcttcctatccggcaagggcttagggaagaccagcattggcttgctctgcgtgaccgcttctagcgccttgctgtggatggcgtcagtggagcctcactggatagccgcctccatcatcctagagttcttcctgatggtgttgttaatcccagagcccgacagacagcggacgccccaggacaaccaactggcgtacgtggtcatcgggctcttattcatgatcctgacagtggccgcgaacgagatggggctgctcgagaccaccaagaaggacctggggatcggctatgccgctgccgagaaccaccagcacgcgaccatgctggacgtggacctccggccggcgtcagcctggacgctctacgcagtcgcaacgaccgtgatcacccccatgatgcgccatacgatagagaacacaaccgcaaacatcagccttaccgcgatcgccaaccaggcggccatcctcatgggcctggacaagggatggccgatctccaagatggacatcggcgtgcccctgctcgcgctggggtgctatagccaggtaaacccgttaactttgaccgccgccgttctgatgcttgtggcccactacgccataatcggccccgggctccaggcgaaggccacccgtgaggcgcagaagcggaccgccgcgggcatcatgaagaaccccacggtcgacggcattgtcgctattgacctggatcccgttgtttacgatgctaagttcgagaaacagctaggacaaatcatgctcctgatcctgtgcacctcccagatcctcctaatgcggacaacgtgggccctgtgcgagtccatcacgctcgcgaccggcccgctgaccaccctgtgggaagggtcccccggcaaattctggaacactaccattgccgtgagcatggcgaatatcttccggggctcctacctagctggggcaggcctggccttctcgctgatgaagtccctcggcggtgggcgtcgagggaccggcgcgcagggggagaccctgggtgagaaatggaagcgccagctaaaccagctaagtaagtccgagttcaacacttacaaacggtccgggataatggaagtggaccgcagtgaagccaaggagggtctgaagcgcggggagacgactaagcatgccgtctcccgaggcacagccaaactgcggtggttcgtagagcgtaacttggttaagcccgaaggcaaggttatcgacctagggtgtgggcgcggcgggtggagttactactgcgccgggctgaagaaggtaacggaggttaaggggtacaccaagggcggccccggccacgaggagcccatccccatggcgacttacgggtggaaccttgtcaaactccactcgggaaaggacgtgttcttcatgccccccgagaagtgcgataccctgctgtgcgacataggagagtcatccccgaacccgaccatagaggagggccgtacgctccgggtgttgaagatggtcgaaccctggttacggggcaaccagttctgcatcaagatactcaacccgtacatgccgtccgtggttgagaccctggagcagatgcagcggaagcacggtgggatgctggtgcgcaaccccctctcgcggaactcgacgcacgaaatgtattgggtgagttgcgggacgggcaacatcgtcagcgcggtaaacatgacgtcccgcatgctcctgaaccgcttcaccatggcccaccggaagccgacttatgagcgcgacgtggacctaggcgccggcacccgacatgtggccgtcgagcccgaggtggcgaatctagacatcatcggccagagaatagaaaacatcaagaacgagcacaagagcacctggcattacgacgaagataacccgtacaagacctgggcctaccacgggtcttacgaagtgaagcccagcggatcagccagttccatggtcaacggggtggtcaggctgttaaccaagccatgggacgtgataccaatggttacccagatcgccatgacggacaccaccccattcggccagcagcgcgtcttcaaagagaaggtggacacccggacgccccgcgccaagcgcggcaccacccaaatcatggaagtcacagcgaagtggttgtgggggttcctcagccgcaataagaaaccccggatctgcacgcgcgaggagttcacccgtaaggtccgctccaacgccgctataggggcggtgttcgtggacgagaaccagtggaacagcgctaaagaagccgtggaggacgagcggttttgggaccttgtccatcgcgaacgtgaattacacaagcagggcaagtgcgcgacctgcgtgtacaacatgatgggcaagcgcgagaagaagctgggtgagttcggcaaggccaagggcagcagagccatctggtatatgtggctcggagccagattcttagagttcgaagctctgggcttcatgaacgaagaccactggttctcccgcgagaattctctctccggcgtcgagggcgaggggcttcacaaactgggctacatcttacgcgacatcagcaagatccctggcgggaacatgtacgccgacgacaccgccggttgggacacgcgcatcaccgaggatgacctgcagaacgaggcgaagatcaccgacatcatggagcccgagcacgcgctgctagccacctccatcttcaagctgacgtaccaaaacaaagtagttcgggtccagcgccccgccaagaacggtaccgtgatggacgtgattagccgtcgggatcagcgaggtagtggccaggtgggaacatacggcctgaatacgttcaccaacatggaggtgcaactcatccgccaaatggagagcgaggggatcttcctgccctccgagttggagaccccaaaccttgccgaacgggtgctggactggctggagaagcacggagcggagcgcctcaagcgtatggcaatcagcggggacgactgcgtcgtgaagcccatcgacgaccgcttcgccaccgccctgaccgcactgaacgacatgggaaaggtgcggaaggatataccccagtgggagccatctaagggctggaacgactggcagcaggtcccgttttgcagccaccacttccaccagctcataatgaaggacgggcgcgagatagtcgtgccttgccggaaccaggacgagctggtcgggcgcgcccgggtttcccagggggcaggctggagcctgcgcgagacggcctgcctcgggaaatcctacgcacagatgtggcagctgatgtacttccatcggcgcgacctgcggctcgccgcgaacgccatctgcagcgccgtgcccgtggagtgggtgcccacctccagaaccacatggagcatccatgcccaccatcagtggatgacaactgaggacatgttatcggtgtggaaccgggtctggatcgaagagaacccatggatggaggacaaaacccacgtgtcctcgtgggaggaagtgccgtacctggggaagcgggaggaccaatggtgcggctccctcatcggcctgaccgcccgcgcgacttgggccacgaacatccaggtcgctatcaaccaggtgcggcgcctgataggcaacgagaattacctcgattatatgacaagtatgaagcggttcaagaatgaatccgatcccgagggcgccctctggtga

SEQ ID NO: 23784 - RNA, 9879 nt, synthetic construct
  misc_feature 1..9879: note = derived and/or modified CDS sequence (opt11) from DENV-1__GQ868570__SS-prME
  source 1..9879: mol_type = other RNA
agcgtgactatgctgctcatgctgctgcccaccgccttggccttccacctgaccaccaggggcggggagccacatatgatcgtcagcaagcaggagcgcggtaagagcctcctattcaagacaagtgcaggggttaatatgtgcaccttaatcgctatggatctgggcgagctctgcgaggacaccatgacctataagtgcccccgcatcaccgaggccgagccggacgatgtggactgctggtgcaacgccaccgacacctgggtgacctacgggacctgcagccagaccggcgagcaccgtcgcgataagcgcagtgtggcactggcgccccacgtgggtctggggttggagacccgcacggaaacctggatgagctccgagggcgcctggaagcagatccagcgggtcgagacttgggccctgcgccatcccgggttcactgtgatcgccctgttcctggcgcacgccatcggcaccagcatcacccagaaggggataatctttatcctgctcatgctcgtaaccccatcaatggctatgcgatgtgtaggcattggcaaccgcgactttgtggaaggcctgagcggcgccacgtgggttgacgtagtgctggagcacggttcctgcgtcacgactatggcgaagaacaagcccaccctcgacatagagctgctgaaaacggaggtcaccaaccccgcggtcctccggaagctgtgtatcgaagccaaaatcagcaacactacgacggactcccgctgcccgacccagggtgaggccaccctggtggaggaacaggacgccaacttcgtctgccgtcgaactttcgtggacagaggctggggcaacgggtgcgggctgtttggcaaagggagcctgctgacgtgtgccaaattcaagtgcgtgaccaagctcgagggcaagatcgttcagtatgagaacctgaagtactccgtgatcgtcaccgtccacaccggcgaccagcaccaggtggggaacgagacgaccgagcacgggacaatcgcgaccataacgccccaggctcccacgagcgaaatccagctgaccgactacggggccctcactctggactgcagtccccggaccggccttgacttcaacgaaatggtcttgctgacgatgaaggagaaatcctggctggtgcataagcagtggttcttggacctcccgctgccctggacgtctggggccagcaccagccaggagacatggaaccggcaggacttactggtcacgttcaagaccgcccacgcgaagaaacaagaggtcgtggttctgggttcccaggagggtgcaatgcacacggccctcacaggtgccacggagatccagaccagcggcaccaccaccatcttcgccggccacttaaagtgtcgactgaagatggacaaactcacgttaaagggcatgtcctacgtgatgtgcaccgggtcattcaaactggagaaggaggtggcggagacccagcacggtacggtcctcgtccaggtgaagtacgaggggacggacgctccttgcaagatccccttctcaactcaggatgagaagggggtcacccaaaacggccggctaatcacggccaaccccatcgtcactgacaaggaaaagcccgtgaacatcgagaccgagccgcctttcggggaaagctacatcgttgtgggcgccggcgagaaggctctgaagctgtcctggttcaagaaagggagctccataggcaagatgttcgaggccaccgcccgtggggctcggaggatggccatcttaggcgacacggcgtgggactttgggagcatcggaggcgtattcacctccgtggggaagctggtccatcaggtgttcgggaccgcctacggcgtcctgttcagcggcgtgtcctggacgatgaaagtggggatcggtattctcctgacgtggttaggcctaaacagccggtccaccagtctgtccatgacctgcatcgcagtggggatggttaccctgtacctcggcgttatggtgcaagctgacctggggtgcgtcatcaactggaagggcagggaactgaagtgcgggagcggcatttttgtgacgaacgaggtgcacacctggaccgaacagtacaagttccaagccgactccccgaaacgcctcagcgcggccatcggcaaggcttgggaggaaggcgtctgcggcataaggagcgtgactaggctggagaacatcatgtggaagcagatttccaatgagttaaaccacatcctccttgagaacgatatgaagttcaccgtggtcgtgggcgacgccaatggcatactcgcccaggggaagaaaatgatacggccccaacccatggagcacaagtacagctggaagtcctggggaaaggccaaaatcatcggcgccgacacgcaaaatacaaccttcattatagacgggcccgacaccccggaatgccccgacggtcagcgagcctggaacatctgggaggtggaggactacgggttcggcattttcactaccaacatctggttaaagctccgggacagctatacccagatgtgcgaccaccgcctgatgtctgccgcgatcaaggactcaaaggccgtacacgccgacatgggctactggatcgaatccgagaaaaatgaaacgtggaagttagcccgggccagtttcatcgaggtgaaaacctgcacgtggcccaagtcccacaccctgtggagcaatggggtgctggagtccgagatgattatccccaagatttacggcggcccgatctcacaacacaattaccggcccggctatttcacccagacggcggggccgtggcacctagggaaacttgagctggactttgatctctgcgagggcaccaccgtagtggttgacgagcactgcggcaaccggggccctagcctgcgtaccactaccgtcaccgggaagatcatacacgagtggtgctgccggtcctgcaccctcccgcccctgcgatttcggggagaggacgggtgctggtacggcatggagatacgccccgtgaaggagaaggaggaaaatctggtgcggagcatggtcagcgccggctccggcgaggtggacagcttctcactgggcattctctgcgtgtccatcatgatcgaggaagtgatgcgcagccggtggtcccgcaaaatgctgatgacggggacgctggccgtattcctcctgctcatcatgggacagctgacctggaacgacctgatacgcttgtgcatcatggtcggggctaacgcctcggatcggatgggtatgggcaccacgtacctcgccctgatggccacctttaagatgcgcccgatgttcgcagtcgggctcctcttccggcgcctgacatctcgggaagtgctgctcttgaccatcggcctttccctcgtcgcctccgtagagctgcccaatagcctggaagaactcggagacgggctagcgatgggcatcatgatgctaaagctcctgacagagttccagccccaccagctgtggactaccctcctgagcctgaccttcgtcaagacgactctcagcctagactacgcgtggaagaccaccgcaatggtcctgtccatcgtaagcctcttccccctgtgcttatccacgacctctcagaagaccacctggctcccggtgctgctggggagtttcggctgcaagcccctcacaatgttcctgatcacagaaaacaagatttgggggcgcaagagctggcccctgaacgagggcatcatggccatcgggatcgtctccatcctcctgagctccctgttaaagaatgacgtgcccctggccggcccgttgatcgcaggcggaatgctaatcgcctgctacgtgatcagcggcagctccgccgacctgagcctggagaaggctgccgaagtctcatgggaacaggaagcggagcactccggtgcatcccacaacatcctagtggaggtgcaggatgatggtacaatgaagatcaaagacgaggagcgtgatgacaccctgaccatcctgttaaaggccacgctgctggctgtcagcggtgtgtatccaatgtccatcccagccaccctcttcgtgtggtacttctggcaaaagaagaagcagcgcagcggggtgctttgggacaccccctccccgccagaggtggagcgggcggtgttggatgacggcatctaccgcatcctgcaacgggggttgctgggcaggtcgcaggtcggggtgggcgtgttccaggacggggtcttccacactatgtggcatgtgacgagaggtgccgtgctaatgtatcagggcaaaaggctcgagccctcctgggccagcgtgaagaaggacctgatttcctacgggggcgggtggagattccagggctcttggaacactggtgaggaagtccaggtaatcgccgttgaaccgggtaagaacccgaagaacgtgcagacaactcccgggacgttcaagactcccgaaggggaagtgggggccatagcgctagacttcaaacccgggacgtccggcagccctatcgttaaccgcgagggcaagatcgtggggctctacggcaacggggtggtcaccacgtccggaacctatgtcagcgccattgcccaggccaaggcatcccaggaggggcccttgcctgagatagaggatgaggtgttcaagaagcggaacctgactatcatggacctccacccgggctcgggcaagaccagacggtacctaccggcgatcgtccgcgaggccataaagcggaagctacgcacgctcatactagccccgacccgcgtggtggccagcgagatggctgaggcgctgaagggaatgccgatccggtaccaaaccacggcagtcaagtccgagcacacggggcgcgagatcgtcgacttaatgtgccacgccacgtttactatgcgactgctgagcccggtgcgcgtacctaactacaatatgattatcatggacgaggcccacttcaccgaccccgcgagtatcgctgccagagggtacatcagcacgcgcgtgggaatgggggaggcggccgcgatcttcatgactgcaacgccgcccgggtccgttgaagccttcccccagtcgaatgccgtcatacaggatgaagaacgggacatccccgagcgcagttggaactcaggctatgactggatcaccgacttccccggtaaaaccgtgtggttcgtgccctccatcaaaagcggcaacgacatcgccaactgcctccggaagaatgggaagcgcgttatccagttgtcacggaagactttcgacacggagtaccagaaaaccaaaaacaatgactgggactatgtggtgacgaccgacattagcgagatgggcgcgaatttcagagccgaccgggtcatagatcccagacggtgcctgaagccagtcatcctcaaggacgggccggagcgcgtcatcctggccggcccaatgcccgtgaccgtggcgtccgcggctcagcggcgcggccggatcgggcgcaaccagaataaggagggagaccaatacgtctacatggggcagcccttaaacaacgatgaggaccacgcccactggacagaagccaagatgctcctagacaatatcaacacgcccgagggcatcatcccggccttattcgagcctgagcgcgagaaatcagcggctatcgacggggagtaccggctccgcggcgaggcccggaagaccttcgtggagctgatgcggcggggcgacctccccgtttggctctcctacaaggtcgccagcgaggggttccagtactccgaccggcggtggtgcttcgacggcgagcgcaacaaccaagtgctggaggagaacatggacgtggagatctggaccaaggaaggtgagcggaaaaagctgcgcccccggtggctcgacgcccgcacctacagtgatccgctggcgctgcgcgagttcaaagagttcgcggctggccgcaggtccgtcagcggcgacttaatcctggagatcgggaagctgccccaacacctcaccctccgcgcccaaaacgccctggacaacctcgtcatgttgcacaatagcgagcaaggagggaaggcgtacaggcacgcaatggaggaactacccgatacgatcgagacgctcatgctactagctctcatcgctgtgctaaccggaggggtcacgctgttcttcctctccggcaagggccttgggaagacgagcatcggcctcttatgcgtgaccgcgtcatccgccctgctgtggatggccagcgtagaaccccactggatcgcagcaagcataatcctcgagttctttctgatggtcctgctcataccggagccggataagcaaaggacgccccaggacaaccaactggcgtatgtggtcatcgggttactcttcatgatcctggcagtcgccgccaacgagatggggctgctcgagaccacaaagaaggacttggggatcggctatgtggccactgagaaccaccagcatgcgactatgctggacgtagacctccggccggcctccgcctggaccctttacgccgtcgccacgaccgtgattacccccatgatgcgccatactatcgagaacacgaccgcgaacatcagcctgacagccatcgccaaccaagccgccattctcatgggtctggacaaagggtggcccatctccaagatggacatcggggtgcccctgctcgcgctggggtgctacagccaggtcaacccactgactttaacggccgctgttttaatgctggtcgcccattacgctatcataggccccggcctccaggcgaaggccacgcgtgaggcccagaagaggacggccgccggcatcatgaagaaccccacggtcgacggcatcgtggctatcgacctggaccctgtagtctacgacgctaaattcgagaagcagctgggtcagatcatgctcctgatcctgtgtacgagtcagatcttgttaatgcgaactacctgggccctgtgcgagagcatcaccctcgccacgggcccgctgaccacattatgggaagggtcccccggcaaattctggaacaccacgatcgccgtgtcgatggctaacatcttccggggctcctacctcgctggggccggactggccttcagcctcatgaagtccctcggcggcgggcgccggggcactggcgcgcagggagagacccttggcgagaagtggaagagacagctgaaccagctcagcaagtccgagttcaacatctacaaaagaagcggtatcatggaggtggataggagcgaagccaaggaggggctgaaaagaggggagaccacgaagcatgccgtcagtcgcggtaccgccaagctgcggtggttcgtggagcgcaacctcgtcaaacccgagggcaaagtcatcgatctcgggtgcggcagaggcggctggagttactactgcgcgggcctgaagaaggtgacggaagtgaaagggtataccaagggcgggcccgggcacgaggaaccgattccaatggccacttacggctggaacctggtaaagctccacagcggcaaggacgtgttcttcatgccgcccgagaagtgcgacacgcttttgtgtgacatcggggagagctccccgaaccccaccatcgaggagggccgaaccctccgggtgctgaaaatggtcgaaccttggctccgcggcaatcagttctgcattaagatcctaaacccgtatatgccgagcgtggtggaaactctggaacagatgcagcggaagcacggagggatgctagtgcgcaacccactgtcccggaacagcacgcacgagatgtactgggtgtcatgcgggaccggcaacatcgtgtctgccgtcaacatgacctcccgcatgttactgaaccgattcacgatggcccatcgcaagccgacgtatgagcgcgacgtagacttaggcgctgggacgcggcacgtggctgtcgagcctgaggtggccaacctggacataataggccagagaatcgagaacatcaaaaacgaacacaagtcaacctggcactacgacgaggacaacccttacaaaacctgggcctatcacgggtcctacgaggtcaagcccagcgggtccgcctccagtatggtgaacggggtggtccgtctgttaacaaagccctgggacgtgatacccatggtgacacagatcgccatgaccgacaccacgccgtttggccaacagcgcgttttcaaggagaaagtggatacccggactccgcgcgcgaagcggggtacgacgcagatcatggaggtgaccgctaagtggttgtgggggtttctgagccgcaataagaagccacggatctgcacccgcgaggagttcacccggaaggtccgctccaacgctgctatcggagcagtgttcgttgacgaaaaccagtggaactctgcgaaagaggccgtcgaggacgagcggttctgggacctcgtgcaccgcgagcgggaactacacaaacaggggaagtgcgcgacctgcgtttacaacatgatgggcaagcgcgagaagaagctaggggagttcggcaaggccaaaggcagccgggcgatctggtacatgtggctcggggcccgtttcttggagttcgaggccctgggcttcatgaacgaggaccactggttctcccgcgagaatagcctctcgggcgtcgagggagaaggtctgcacaaacttggctacatcttacgagacatcagcaaaatcccgggcgggaacatgtacgccgacgacaccgccggctgggacacccgcatcaccgaggacgacttgcagaacgaggcgaagatcacggatatcatggagcctgagcacgccctgctagccacctccatctttaaacttacttaccagaacaaggtggtgcgcgtccagcgccccgcgaagaacgggaccgtcatggacgtaatcagccggcgcgaccaacgtggctccggccaggtcgggacgtacggcctgaataccttcaccaacatggaagtgcagctcatccgccaaatggaaagcgaggggatcttccttccgtccgaactggagacaccaaacttggcggagcgggtgttggactggctggagaagcacggcgcggagcgactcaagcggatggctattagcggggacgactgtgtcgtgaagcccatcgatgaccggttcgccgccgccctgacggcgcttaacgacatgggcaaggtgcggaaggacattccccagtgggaaccgtccaagggatggaacgactggcagcaagtaccgttctgcagccaccacttccaccagctcatcatgaaggacggacgagagatcgtggtgccgtgcaggaatcaggacgagctggtcggcagagctcgagtgtcccaaggggcaggttggtccctgcgtgagaccgcttgcctcgggaagtcctacgcacagatgtggcagctgatgtacttccaccggcgcgatctgagactcgcggccaatgccatctgcagcgccgtgcccgttgactgggtgcccacctctcgcactacttggtccatccacgcgcaccaccagtggatgacaaccgaagacatgctaagcgtgtggaaccgggtctggatcgaggagaacccgtggatggaagacaagacccacgtgtccagctgggaagaggtaccatatctgggcaagcgtgaggaccagtggtgtggctccctcattgggctaacggcccgcgccacctgggcaaccaatatccaggtcgccatcaatcaagtgcgtcgactgattggtaacgagaactaccttgactacatgaccagcatgaaacggttcaagaacgagtccgaccccgaaggggcactgtggtga

SEQ ID NO: 23785 - RNA, 9879 nt, synthetic construct
  misc_feature 1..9879: note = derived and/or modified CDS sequence (opt11) from DENV-1__KJ189302__SS-prME
  source 1..9879: mol_type = other RNA
agcgtgaccatgttgctcatgctgctccctaccgcgctcgcattccacctgactacccggggcggcgaaccccacatgatcgtgagcaagcaggagcggggaaagagcctcctgtttaaaaccagcgcgggggtgaatatgtgcacgctgatcgccatggacctgggggaactctgtgaggacactatgacctacaagtgcccccgtatcaccgaagccgaacccgacgacgtggactgctggtgcaacgccaccgatacctgggtgacctacgggacctgcagccagactggcgaacaccggcgcgataagcggtccgtggccctggcgccacacgtgggcttagggctcgagacccgcacagagacctggatgagctccgagggcgcctggaagcagatccagcgggtagagacctgggctctgcgccaccccgggtttactgtgattgccttcttccttgcgcacgccattggtaccagcatcacccagaaggggataatcttcatcctcctcatgctggtaaccccctccatggccatgcggtgcgtaggcatcggcaaccgcgacttcgtggaggggctgagcggcgccacttgggttgatgtcgttctggaacatggttcctgcgtgaccaccatggccaagaacaaacccaccctggacatcgagctgcttaagacggaggtaaccaaccccgctgtgctgcggaagctctgcatcgaagccaagatctccaacaccactacggacagccgctgtccgacccagggcgaggcgaccttggtggaggagcaggacgccaatttcgtatgccggcgcactttcgtggaccgtggatggggtaacggctgcggcttgttcggcaaggggagcttgctgacctgtgctaagtttaagtgcgttaccaagctggagggcaagatcgtacagtacgaaaacctcaagtacagtgtgatcgtgaccgtacacacaggcgaccaacatcaggtggggaacgaaacgactgaacacggcaccatcgcgaccatcactccccaggcccccacgagcgaaatccagctcactgactatggggccctgacgctcgactgctcccctaggaccggcctggacttcaacgagatggtcttgctcactatgaaggaaaagtcatggctcgtgcacaagcagtggttcctcgaccttccgctgccttggacatccggcgcgagcaccagccaagagacctggaatcggcaggatctgcttgtgacgttcaagaccgcccacgcgaagaagcaggaggttgtggtactgggctcccaggaaggcgcaatgcacaccgccctgaccggggccacggagatccaaaccagcggtaccaccacgatctttgccgggcaccttaagtgtcgcctgaagatggataagctaaccctcaagggcatgtcctacgtcatgtgtactgggagtttcaaacttgagaaagaggttgcggagacccagcatggcacggtgctggtccaggtgaagtacgaggggaccgatgccccgtgcaaaatccctttctccacccaggacgagaagggagttacgcagaacggccggctgatcactgccaacccaatcgtcaccgacaaggaaaagcccgtgaacatcgaaactgagccacctttcggggagagctatatcgttgtaggcgccggcgagaaggcgctcaagctctcttggttcaagaaggggtcatccatcgggaagatgttcgaggccacagccagaggggcacggcgcatggccatcctcggggacacagcgtgggacttcgggagcatcggtggcgtgttcacctccgtgggcaagctcgtccaccaggtgttcggcaccgcctacggggtgctgttctctggtgtctcctggaccatgaaaatcgggatcggcatacttctcacgtggctgggactgaacagccgatccacgtccctctccatgacctgcattgccgtagggatggtgactctttatctgggtgttatggttcaggccgactcggggtgcgtgatcaattggaagggccgggagctcaagtgcgggtccggcatctttgtcactaacgaggtgcacacctggaccgaacaatataaattccaggccgactctccaaaacgcctgtcagcggccatcggcaaggcctgggaggagggcgtgtgcggcatccgttctgccacccgcctggagaacattatgtggaaacagatcagcaacgagttaaaccacatcctgctcgagaatgacatgaagttcaccgtcgtggtgggggacgccaacggcatcctcgcccagggtaagaagatgatccggccccaaccgatggagcacaagtacagctggaagtcctggggaaaggccaagatcatcggcgcagacattcagaacaccaccttcatcatagacgggcccgacaccccggagtgcccggacgggcagcgcgcctggaacatatgggaagtcgaggactacggatttggcatcttcaccacgaacatatggctgaaattaagggactcttacacccagatgtgcgaccatcggctcatgagcgcggcaattaaggacagtaaagccgtgcacgccgacatgggctactggatcgagagcgagaagaacgaaacctggaaactggcccgggcatccttcattgaagtgaaaacctgcacgtggcccaagagccacaccctgtggtctaacggggtcttggagagcgaaatgatcatcccaaagatatacggcggtcctatctcccagcacaactatagacctggatacttcacccagaccgccggaccctggcatctgggcaagctggagttagactttgatctgtgcgagggcacgaccgtggtggtggacgagcactgtggtaatcggggcccgagcctacgcacaaccacggtgaccgggaagataatccacgagtggtgttgccggtcctgcacgcttcccccgctgcgctttcggggagaggacggttgttggtatggcatggagatccgacccgtgaaagagaaggaggagaacctggtccggagcatggtgtctgccggatcgggcgaggtggacagcttctctctcgggatcttatgcgtctctatcatgatcgaggaggtgatgcgcagtcggtggagccgcaagatgctgatgacgggaacgctcgccgtgttcttgctgctcatcatgggacagctgacctggaacgatttaatccgcttatgcatcatggtcggggccaacgcttctgaccggatgggaatgggcacgacctacctagccctaatggccacattcaagatgcgccccatgttcgccgtgggacttctgttccggcgtctgacctcccgggaggttctattgttaaccatcggcttaagcctggtcgcgagcgttgagctccccaactccctcgaggagctgggtgacggcctggcgatgggtattatgatgctcaagttgctgaccgagttccaaccccaccagctctggaccaccctgctgtctttaactttcgtcaagaccacgctgagcctggattacgcctggaagaccaccgccatggtgctcagcatagtctccctgtttcccctgtgtctctccaccacgtctcagaagaccacctggctgccggttctgctcgggtcattcggctgcaagcccctcaccatgttcctgatcacagagaacaagatctgggggcgcaagtcttggcccctcaacgagggcatcatggcaatcgggatcgtatcgatattgctgtccagcttgttaaagaatgacgtgcccctggcgggcccgctcatcgccggcgggatgctaattgcctgctacgtcatctcgggctccagcgctgacctatccctcgagaaggcggcagaggtaagctgggagcaagaggccgagcactccggggccagccacaatatcctggtcgaggtccaggacgacggcacaatgaaaatcaaggacgaggagcgggacgacaccctgaccatcctcctgaaagcaactcttctggccgtgtccggagtataccccatgtcaatccccgctacgttattcgtatggtatttctggcaaaagaagaagcagcgtagtggcgtgctgtgggacactcccagcccgccagaggtggagcgggccgtactcgacgacggcatctaccgcatcctgcagcgtggcctgctgggaagatcccaggtgggggtaggcgtcttccaggacggagtgttccacacgatgtggcacgtgacgaggggcgccgtcctgatgtaccagggcaagcgcctggagcccagctgggcctccgtcaagaaggacctgatcagctacgggggcgggtggcggttccaggggtcctggaacacgggggaggaggtgcaagtcatcgccgtggagcccggcaagaacccgaagaacgtgcagaccacccccggcaccttcaagacgcccgagggggaggtcggcgcgatcgccttagacttcaagcccggcacaagcggctccccgatcgtgaaccgcgaggggaagatcgtggggctgtatggcaacggggttgtgaccacctcaggcacgtacgtctccgccatcgcgcaggccaaagctagccaggaagggcccctgcccgagatcgaggacgaggttttcaagaagcgaaacctcaccatcatggatctgcacccgggcagcggaaaaaccagacggtacctgcccgccatcgttcgcgaggccattaagagaaagttacgtaccctgatactggcccccacgcgcgtggtcgcgtccgagatggccgaggcactgaaggggatgcccattcggtatcaaaccaccgccgtcaagagcgagcacaccggtcgcgagatcgtagacttgatgtgtcatgccacgttcaccatgcggctgctctccccggtccgcgtgccaaactacaatatgattatcatggatgaagcgcactttaccgaccctgcgagcatcgccgctcgggggtatatatcaacccgcgtgggaatgggggaggccgcggccatcttcatgacggctacaccgcccggctccgtcgaggcgtttccccagagcaacgccgtgatccaggatgaggagcgcgacatcccggagcgcagctggaactcaggctatgattggatcaccgacttccccggcaagaccgtgtggttcgtgcccagcataaagtccggcaacgatatcgcgaactgcctacggaagaacggaaagcgcgttatccagctaagccggaaaacgtttgacaccgagtaccagaagaccaagaacaatgactgggactacgtggtcaccacggacatctccgaaatgggcgccaacttccgggccgatcgggtgatcgacccacgccggtgtctcaaacccgtgatcctaaaggacgggccggagcgcgtcatcctggccggcccaatgcccgtgaccgtagcaagcgccgcccagcggcgcggccggatcgggaggaatcagaataaggaaggcgaccagtacgtgtatatggggcagcctctcaacaatgacgaggaccacgcacactggaccgaggctaagatgctgctggacaacattaacacccccgagggcatcatcccagcactctttgagcccgagagggagaagtccgccgccatcgatggcgagtaccggctgcgcggcgaggcccgtaaaacgttcgtggagctgatgaggcggggcgacctccctgtctggctgagctataaggtcgcctctgaggggtttcagtacagcgacaggcgttggtgctttgacggggaaaggaacaaccaagtgttggaggagaacatggacgtcgagatctggaccaaagagggggaacggaagaagctccgcccccggtggcttgacgcccgcacctactccgacccgctggcgttacgggagttcaaggagttcgccgccggacgccggagcgttagcggtgatctgatactggagatcgggaaactcccccagcacctgaccctgcgggcccagaacgcattggacaacttagtgatgctgcataatagtgagcagggtgggaaggcctaccggcacgcaatggaggaactccccgacaccatagagactctgatgctgctagccctgatcgcggtcctgaccggcggggtgaccctcttcttcctgtcaggcaagggactggggaagacatcgatcggactcctgtgcgtgacggcctcaagtgccctgctctggatggccagcgtcgagccacactggatagccgcgtcgataattctcgagttcttcctgatggtgctcctgatccccgagcccgatcgccagcggacgccccaggacaaccagcttgcctacgtggtcatcggtcttctgtttatgattctgactgtggcggccaacgagatgggcttactggagaccacgaaaaaggacctggggatcggctacgtggccgcggagaaccatcagcacgcgaccatgctcgacgtcgacctgcgcccggccagcgcctggactctgtatgcggttgcgacgacggtaatcacccccatgatgcggcacacgatcgagaacaccacggccaatatctccctcaccgccatcgccaaccaagccgcaatcctgatgggcctggacaaggggtggcccatctcgaagatggatatcggcgtccccctactcgccctgggttgctactcgcaggtcaacccactcacactgaccgcagctgtgttgatgctcgtggcgcactacgccatcatcggccccggactgcaggccaaggccacgcgagaggcccagaaacgcaccgcggccggaatcatgaagaacccaacggtggacggaattgtggcaatcgacctggatcccgtcgtgtatgacgccaagttcgagaagcagttggggcagatcatgctgttaatcctgtgcaccagccagatccttctgatgcggacgacctgggctttgtgcgagtccattacactggccactggcccgctgacgacgctctgggaggggagccccggtaagttctggaacaccaccatcgccgtgtctatggcaaacatcttccggggcagctacctggccggggccggcttggcgttttcactcatgaaaagcctcgggggcgggcggcgcggcacgggcgcccagggggagactctgggcgaaaagtggaagcggcaactcaaccagctgagtaagagtgagttcaatacctacaagcgttcggggatcatggaggtcgacagatctgaggccaaagagggcctaaagcgcggggaaaccacgaaacacgccgtctctcggggcaccgctaagctgaggtggttcgtggaaagaaacctggtcaagcctgagggcaaggtgattgacctcgggtgcggaaggggcggctggtcctactactgcgctgggcttaagaaagtcaccgaagtcaagggctacaccaagggcgggcccggccacgaggagccgataccgatggctacctacgggtggaacctcgtaaagctgcactcgggcaaggatgtgttcttcatgccacccgagaagtgcgacaccttgctctgcgatatcggggagtccagcccctcccctaccatcgaggagggccgaaccctgcgcgtcctgaagatggtggagccctggctccggggcaaccagttctgcatcaagatcttaaacccatacatgcctagcgtcgtcgagaccttggagcagatgcaacgcaaacacggagggatgctcgtgcgaaaccccctgtcccgcaacagcacccatgagatgtactgggtgtcgtgcgggaccggcaacatcgtaagtgccgtgaacatgacctcccggatgttactaaatcggtttaccatggcccacagaaagcccacgtacgagcgggacgtggacttgggcgctgggacccgccacgtcgctgtcgaaccggaggtagcaaacttggacatcataggacagcggattgagaatatcaagaacgagcacaagagcacctggcactacgatgaggacaacccgtataagacctgggcctaccatgggagctacgaggttaagcccagtggctccgccagctccatggtgaacggggtcgtgcgcctcctaacgaagccatgggacgtgatcccgatggtcacccagatcgcgatgaccgacaccacgccgttcggtcagcagcgggtgttcaaggagaaggtggatacccgcacaccccgggctaaacgcggcacgacacagatcatggaggtcaccgccaagtggttgtgggggttcctctcccggaacaagaagccacgcatctgcaccagggaggagttcaccaggaaggtgcggagcaatgccgccatcggcgcagtgtttgtcgacgagaaccagtggaactccgcgaaggaggccgtagaggacgagcgcttctgggacttggtgcaccgggagcgcgaactgcataagcaggggaagtgcgccacatgcgtctataacatgatgggcaagcgggaaaagaagctcggggagttcggaaaagcgaagggcagccgagctatctggtacatgtggctgggggcccggtttctggagttcgaggcattaggcttcatgaacgaggaccactggttctcccgcgagaactcgttgtccggcgtggagggcgaggggttgcacaagctgggctacatcctgcgggacatcagcaaaatccctggaggtaacatgtacgccgacgacaccgcgggctgggatacccgcatcacagaggatgacctgcagaacgaagccaagatcactgacattatggaacccgagcacgccctactggcaacatccatcttcaagctgacctaccagaacaaggtcgtccgcgtgcagcgccccgccaagaacgggacagttatggacgtcattagccgccgggaccagcgcggctccggccaggtggggacgtatggcctcaacaccttcaccaatatggaggtgcagctgatccggcagatggagagcgaggggatctttttacccagcgagctcgaaacccctaatctggcggagcgcgtcctagactggctcgagaagcacggggcagagcggctgaagcgtatggcaatcagcggggatgactgcgtggtgaaaccaatcgatgaccggttcgccacagccctgaccgcgctcaacgatatgggcaaagtccgcaaggacattccgcagtgggagccctccaagggctggaacgattggcaacaggtgcccttctgtagccaccactttcaccagctaatcatgaaggacgggcgggaaatcgtcgtcccctgtcgcaaccaagatgagctggtgggccgggctagggtgtcccagggggctggctggagcttgcgtgaaaccgcatgcctcgggaaatcctacgcccagatgtggcagctgatgtacttccaccggcgggacctccgcttagcggccaacgcgatttgcagtgccgtgcccgtggactgggtgccaaccagccggaccacatggtcaatacacgcgcatcatcagtggatgaccaccgaggacatgctgagcgtctggaaccgcgtgtggatcgaagagaacccgtggatggaggacaagacgcacgtgtccagctgggaggaggtcccttacctcggcaagcgcgaggaccagtggtgtgggtccctcatcgggctgacggcacgggccacgtgggccacgaacatccaggtcgctattaaccaggtgcgacgccttatcggcaatgagaactacctagactacatgaccagcatgaagcgctttaagaacgagtccgaccccgagggggcgctatggtga

SEQ ID NO: 23786 - RNA, 9879 nt, synthetic construct
  misc_feature 1..9879: note = derived and/or modified CDS sequence (opt11) from DENV-1__KJ189303__SS-prME
  source 1..9879: mol_type = other RNA
tccgtcaccatgctcctaatgctactgcccactgctctagcgttccatcttaccacgagaggaggcgaaccacatatgatagtgtcaaaacaagaaagaggtaaatcattactatttaaaactagcgcaggcgtgaatatgtgcacgttaattgctatggatctcggggaactgtgcgaggacactatgacctacaaatgcccgaggatcaccgaagcagaacccgatgatgtagattgctggtgcaacgcaacggacacctgggtgacatatggaacctgtagccaaaccggtgaacaccggcgcgacaaacggtcagtcgccctcgcaccccacgtcgggcttggactggagacgcggaccgaaacatggatgtcatctgaaggcgcatggaaacaaattcaacgcgtagagacctgggcactaagacaccccggcttcacagttatcgcactattcctcgcacacgtcatcggaaccagcataacccaaaaagggataatattcattcttctcatgctagtaaccccaagcatggctatgcgttgtgtcgggatcggaaaccgggacttcgtcgagggactgagcggagcgacgtgggtcgatgtagttctagagcacgggtcatgcgtaacgaccatggccaaaaacaaacccacccttgacatagagctattgaaaacagaggtcacaaatcccgcagtactcaggaaactgtgcattgaagcgaaaatctccaacacgaccacagacagtcgttgtcccactcaaggagaagccacactcgtggaagaacaagatgccaacttcgtctgccggcgaaccttcgttgaccgagggtggggaaacggatgcggcctatttggcaagggctccctgcttacatgcgccaagtttaaatgcgtaactaagctcgaaggcaagatagtacaatacgaaaaccttaagtacagcgtcatcgtcacggtccacacaggcgaccaacaccaagtaggtaatgaaaccacggagcatgggactatcgcaactattacgccacaagcacccacgtccgaaatccagctcacggactatggcgcattaacactcgactgctctcctcggacgggcttagatttcaatgagatggtcctcctcacgatgaaagagaaaagttggttagtccacaagcagtggttcctagacctaccactaccgtggacctcaggggcatcgacttcacaagagacttggaaccgacaggatctcctcgtcacattcaagacggcgcacgccaagaaacaagaggtcgtcgtcctgggctcccaagagggagccatgcacacggccctgaccggcgcaaccgaaattcaaaccagcggaaccacaacaattttcgctggccacctaaaatgccgtttaaaaatggacaaactcacactgaaaggtatgtcgtacgtgatgtgcacagggagctttaagctcgagaaagaggtagcagaaacccagcatggcactgtgctagtgcaagtcaagtacgaggggacagatgcaccatgcaaaataccattcagcactcaggacgaaaaaggagttacacaaaacggacgactaatcacagcaaatccaatcgtaacagacaaagaaaaaccagtcaatatcgagacggaaccaccattcggggagtcatacatcgtcgtcggcgcgggagaaaaagctctaaaattgagctggtttaagaaaggatcgtctatcgggaaaatgttcgaagccacggcgcgcggtgcgagacgaatggccatactgggcgacaccgcctgggacttcggctcgatcggcggcgtgttcactagcgtgggtaaattggtccaccaggtcttcggtacagcatacggtgtcctattttcgggggtgagctggaccatgaaaatcggcataggcatcctgctaacatggcttgggcttaactcaagaagcacgtcactaagcatgacctgtatcgccgtaggtatggtaacactctacttaggggtaatggtacaagcagattccggctgcgtcataaactggaaaggacgcgagctaaaatgcggctccggaattttcgtaaccaacgaagttcacacatggaccgaacagtataagttccaggccgacagtccaaaacgactcagcgcggctattggcaaggcctgggaagaaggagtctgtggaataagaagcgccaccaggctagaaaacatcatgtggaagcagatctcgaacgagctaaaccacatcctgctcgaaaacgacatgaagttcacggtggtggtcggagacgcaaacgggatcttagcccaaggcaagaagatgatccgccctcaacctatggaacacaaatattcatggaaaagctggggcaaagcgaaaataatcggggcagatactcagaacactacgtttataattgacggccctgacacgccagaatgcccagacgggcaaagggcgtggaacatctgggaggttgaagattatggattcgggatcttcacaacaaacatctggctcaagctaagagacagctacacacaaatgtgtgatcacaggctcatgtccgccgcgattaaggacagcaaggcggtacatgcggacatgggctactggatcgagtcggagaaaaacgagacctggaaattagctcgcgcatcattcatcgaagtcaaaacgtgcacatggccgaaaagccacaccctatggagtaacggagtgctggaaagcgaaatgatcataccaaaaatttacggaggaccgatttcacaacacaactaccggcctggatacttcacccagacagcagggccatggcacctaggaaaactcgaactcgatttcgacctctgcgagggaacgaccgtcgtagtagacgaacattgtggcaacaggggaccctcattacgaacgaccaccgttacgggaaaaatcatacacgaatggtgctgccgttcctgcacccttcccccgctgcgcttccgcggcgaagacggctgttggtatggcatggaaatccgcccggtcaaagagaaagaagagaacttggtacgatcaatggtgtccgcaggaagtggcgaggtagacagcttctccctaggcatcctgtgtgtttcgatcatgatagaggaggtgatgcggtcgaggtggagccgaaaaatgttgatgaccggcactctagccgtgttcctcctactcattatgggacaattaacgtggaatgacctaacgcgtctttgtataatggtaggagcaaacgcatcagacagaatgggcatggggactacgtatctcgcactcatggcaaccttcaagatgcggcccatgttcgcagttggactactctttcgccgcctaaccagtagagaggttctgcttttaaccatcgggctcagtttagtcgcgtccgtcgaactgccaaatagcctagaggagctaggggatggcctcgcaatgggaataatgatgttgaagctactcacagaatttcagccccaccaactctggacaacattgctctcattaacttttgtcaagacgaccctaagcctagattacgcgtggaaaaccacagcgatggtactctcaatagtctccctattcccactttgtttatccaccacaagccagaaaacaacgtggttgcctgtgctgctgggctcgttcggctgtaaacctctgaccatgttcttaataacggaaaacaaaatatggggacgaaagagctggccccttaacgaaggaatcatggctataggaatcgtgagtatcctcttatcctcgctccttaaaaacgacgtcccgctcgcgggtccactaattgcaggaggcatgctaatagcgtgctacgttataagcggaagtagcgctgatcttagcctggaaaaggccgccgaagtgtcatgggagcaggaagccgaacattccggcgcgagccataacatcctggttgaggtacaggatgacggtacgatgaaaataaaggacgaagaacgagacgatacgcttacgatcctcctgaaggcaactctgctagccgtcagtggggtgtacccgatgagcatcccagctaccctctttgtgtggtacttctggcagaagaagaaacaacgctccggagtcttgtgggacacgccatcaccgcccgaagtagagcgggcagtattagacgatggtatttacagaatcctacaacgagggctactgggcaggtcccaggtcggtgtaggagtgttccaagacggagtattccacacgatgtggcacgttacacgcggcgcggtcctaatgtaccaaggtaaaaggctagagcccagctgggcaagcgtcaagaaagacctgatctcgtacggagggggctggcgcttccaaggatcctggaataccggagaggaagtccaagtaatcgccgtcgagccgggtaaaaacccgaaaaatgtacaaaccacaccaggaacgttcaaaacgccagaaggcgaagtcggcgcaatagcgctcgacttcaagccaggaacgagcggatcacccatcgtaaacagggaagggaaaatagtggggctgtacggcaacggggtcgtcacaaccagcggcacgtatgtgtcagctattgcacaggcgaaagcaagccaagagggtccgttaccggaaattgaagacgaggtcttcaagaaacgcaatctgaccattatggatttacatcccggaagtggaaagacgcgacggtacttgccggccattgtgcgcgaagcaatcaagcgaaaactaagaaccctgatactggcaccgacccgcgtagtggcttcagaaatggcagaagcactcaaaggcatgccgataaggtatcagacaaccgctgtcaagtcggagcacacaggacgagaaatcgtagacctcatgtgtcacgccacattcaccatgcgcctcctaagtcccgtgagggtgcctaactataatatgataataatggacgaggctcacttcacagatccagcctcgatcgcagcaagaggatacataagcacaagggtgggcatgggggaagccgcagccatatttatgacggctactccgccggggagcgtcgaggcgtttcctcagagcaacgcagtaatacaagacgaagagagagatatcccggaacgctcgtggaacagcgggtacgactggataacggactttcccgggaaaaccgtatggttcgtaccatcgataaaaagtggcaacgacatcgcaaactgcctcagaaagaacggcaaacgcgtcatccaattgagcagaaaaacattcgacaccgaataccaaaagacgaaaaacaacgactgggactacgtcgtcaccacggatatatcggagatgggagcgaactttcgcgccgatagagtcatcgaccccagacggtgcctgaaacccgtgatattgaaagatggcccagaacgcgtaatcctagcgggccccatgcccgtcacggttgcgagcgccgctcaaagacgaggacgaataggccgcaaccagaacaaggaaggcgatcagtatgtttatatgggtcagccactgaataacgatgaagaccatgctcactggacagaagccaaaatgcttttggataacatcaacaccccagagggaataatcccggccctttttgaacccgagagggagaaaagcgcagccgtcgatggcgagtaccgacttcgcggggaagcaaggaagacattcgtagagctcatgcgtcgcggtgacctcccagtctggctcagctacaaagtagcgtcagagggcttccagtatagtgacagacgctggtgcttcgacggagagagaaataaccaggtcctcgaagaaaacatggacgtagaaatttggactaaagaaggcgaacgtaagaaattgcgcccccgatggctagacgcaagaacttacagcgacccgcttgccctcagggagtttaaagagttcgccgcagggagaaggagcgtgagcggagacctcatcctcgaaataggaaaactcccgcagcacctaacactgcgcgcacagaacgccctggacaatttagtcatgctccacaactcggaacaaggaggtaaggcatatcgccacgcaatggaagaactacccgacacaatcgagaccctgatgttactcgccctcatcgccgtcttaacaggaggcgtaacactcttcttcctatccgggaaaggcctaggcaagactagcataggcctattgtgcgtaacggcctccagcgcgcttttgtggatggcaagcgtggagccgcactggattgcagcttccataatcctcgagttcttcttgatggttcttctgattccagaaccagacagacagcgaacgccccaggataaccagcttgcgtacgtagtcatcggattactattcatgatcttaaccgtggcagccaacgaaatggggctgctagagacaaccaagaaagaccttgggatagggtacgtggcggcagaaaatcatcagcacgccacaatgctagacgtcgacctccgaccagcctccgcatggactctatacgcagtggctacaactgtgataacgccgatgatgagacataccatagaaaatacaacagccaacatcagtctgacagccatcgcaaaccaggccgcaatacttatggggctagataaaggctggccaatatcgaagatggatattggagtaccgcttttggcactaggatgttacagccaggtgaacccactcacgttaacggcagcggtactcatgctcgtagcccactatgcaataatcggaccaggcctccaagcgaaagcgacccgagaagcccagaagcggaccgcagccggaataatgaaaaacccaacagtagacggaatcgtcgcaatagacctcgatccggtggtctacgacgcgaagtttgagaaacaactggggcaaataatgcttctaattttatgtacaagccagatcctcctgatgcggacaacatgggcattatgcgagtcaatcaccctagcaaccggaccgctgactacattatgggaaggatcacccgggaaattctggaacacaacaatagcggtgtcaatggccaacatctttagaggcagctacttagcaggcgcaggactagccttctccctcatgaagtccctcggagggggtcggcgcggaacaggtgcgcagggggaaaccctgggtgaaaagtggaaaaggcagctcaatcaactgtctaagagcgaatttaacacctacaaacgatcggggataatggaagttgaccgatctgaggcaaaagagggactgaaaagaggggaaacgactaaacatgcagtctcacgcgggacagcgaaactcagatggttcgtggaacggaacctcgtaaaacccgaaggcaaagtgatagacctcggttgcggtagagggggttggagttactattgtgcaggccttaagaaggtcacagaagtcaagggatatacgaaaggcggccccgggcacgaagaaccaatcccaatggcgacctacggttggaaccttgttaagctccattcgggtaaggatgttttctttatgcctcctgagaaatgcgacacacttctatgcgacatcggcgaatccagcccgaatccaaccatcgaggaaggtcgaactctacgcgtcctgaagatggttgagccgtggcttcgcggaaaccagttttgcataaagatattaaatccctatatgccctccgtagtggaaactcttgaacaaatgcaacgaaaacacggagggatgctggtccgaaacccgttgagtcgaaactccacccacgaaatgtactgggtcagctgcggtacgggaaacatcgtgagcgccgtaaacatgacaagtcgcatgctcctaaatcgctttacaatggcccaccgcaaaccaacctacgagagggatgtagacctcggggcgggaacgcgtcatgtagccgtagaacccgaagtagccaacctagacatcataggacaacgaatcgagaacattaaaaacgaacacaaatccacatggcactacgacgaggataacccatataaaacatgggcctatcacggcagctacgaggtaaagccctcagggtcggcaagctcgatggtaaatggggtagtcaggttactcacgaagccatgggatgtgatacccatggttacccaaatcgcgatgacggacaccaccccattcgggcaacaaagagtcttcaaagaaaaagtagacacccgaacaccaagagcgaagcgcggaaccactcaaatcatggaagtaacggccaaatggctgtggggctttttgtcgcggaacaaaaagccacgaatatgcacacgtgaagaatttactcgcaaggtgagatcaaacgcagcgatcggtgctgtctttgttgatgagaaccaatggaacagtgccaaagaggcggtcgaagacgagcgcttctgggacctggtccacagagagcgagaactccataaacaagggaaatgcgcaacgtgtgtctacaatatgatgggaaagcgcgagaaaaagctcggcgagttcggcaaagccaagggctcccgcgcaatatggtacatgtggctgggagcacgattccttgaatttgaggccctcggctttatgaacgaggaccactggttctcgcgagaaaactcactctccggcgtagaaggggaagggctccacaagttgggttacatactcagagatataagcaaaatcccgggcggcaacatgtacgccgacgacacggctgggtgggacacacgaataacagaagatgacttgcagaatgaagcaaaaattaccgatatcatggaacctgagcacgcactcctcgccacaagcatattcaagttaacctaccaaaacaaagtcgtacgcgttcaaaggccggccaaaaacggcacagtcatggacgtaatcagccgaagagaccagcgggggagcggacaagtaggtacctatggactaaataccttcacaaacatggaagtgcagctgatccgccaaatggagtcggagggcatcttcctgccctccgagctggaaacaccaaacctagcagagcgtgtgcttgactggctagaaaaacacggagccgaacggctaaaaaggatggcgatatccggcgacgactgcgtcgtgaagcccatcgacgaccggtttgcaacggcgttgacggcactgaacgacatgggcaaggtacgcaaagacataccccaatgggaaccttcaaaagggtggaatgattggcaacaagtgcccttctgctcccaccattttcaccagctaatcatgaaggacgggcgagagatagtagtaccatgcagaaaccaggatgagttggtgggacgtgcccgagtgagccagggagcagggtggtccttgagggaaacagcatgcctcggaaaaagctatgcacagatgtggcaactgatgtactttcaccgacgagacctgcgccttgcagccaatgctatatgttcggctgtacctgtagagtgggtgcccacctcaaggaccacctggtccatccacgcccatcaccagtggatgacaaccgaagacatgctctccgtatggaacagagtctggatagaagagaatccatggatggaagacaagacccacgtatcttcctgggaagaggtaccatacctcggaaaacgggaggaccaatggtgcgggtccttaatcggcctcaccgccagagcaacctgggcgaccaatattcaagtagccataaatcaggtaaggaggctgatcgggaacgagaactacctagattatatgacaagcatgaagaggttcaagaacgaatcggacccggagggtgcactatggtga

SEQ ID NO: 23787 - RNA, 9879 nt, synthetic construct
  misc_feature 1..9879: note = derived and/or modified CDS sequence (opt11) from DENV-1__KR028435__SS-prME
  source 1..9879: mol_type = other RNA
agcgtgactatgctgctcatgctgatgcccacagccctggccttccacctgactacccggggcggtgagcctcacatgatcgtgtccaagcaggagcggggtaagtctctcctgttcaaaacctccgcaggggtgaatatgtgcaccttgatcgccatggacctgggcgagctatgcgaagatacgatgacctacaagtgcccccgtatcaccgaggccgagcccgacgacgtcgactgctggtgtaacgccaccgacacgtgggtgacctacgggacctgcagccaaaccggcgagcatcgtcgcgacaagcgttccgttgccctggcgccgcatgtgggcctgggcctggagacgcggaccgagacgtggatgagctcggagggggcctggaagcagatccagagagtcgagacctgggccctccgccaccccgggttcacggtaatcgctctgttcctggcgcacgcaatcggcaccagcatcacccagaagggtataatcttcatcctcctgatgttggtgacccccagcatggcgatgcgttgcgtcggcatcggtagtcgcgacttcgtcgaggggctctccggggccacgtgggtggacgttgtgttggagcacgggagctgtgtgaccaccatggccaaggacaagcccaccctggacatcgagctcctgaaaacggaggtcaccaacccggcagtgctccgtaagctctgcatcgaggcaaagatctccaatacgaccacggactcgcgatgcccgacgcaaggtgaggccacgttggttgaagagcaagacgctaacttcgtctgccggcgcacattcgtggaccggggatggggtaatggctgcgggctgttcggcaaggggtccctcataacgtgcgcgaagttcaagtgcgtgacgaaacttgaagggaagatcgtccagtacgaaaacctgaagtacagcgtcatcgtaacggttcataccggcgaccagcatcaggtggggaacgagtccacggagcacggcaccaccgccaccatcacaccccaggccccaactaccgagatccagctaaccgactacggggccctgacccttgattgctcgccccgaactggattggacttcaatgaaatggtactgctgaccatgaaggagaagtcctggctcgtgcacaagcagtggttcctcgatctgccgctaccctggactagcggggccagcacctcccaggagacgtggaatcggcaagatctcctggtaaccttcaagaccgcccacgcgaagaagcaggaagtggtagtgctcgggtcgcaggagggcgccatgcacactgccctgacgggggccacagaaatccagacctcaggtactacaaccattttcgccgggcacctgaagtgccgcctcaagatggacaaactgaccctgaagggcatgagctatgtcatctgcaccggctccttcaagctcgaaaaggaggtcgcagagacacagcatggcaccgttctggtccaaatcaagtacgagggcaccgacgctccgtgcaagatccccttttcgacacaggatgagaagggggtcacgcaaaacgggagactgattaccgccaatccgatcgtgaccgacaaggagaagcccgtgaacatcgaggccgagccgcccttcggggagagctacatagttatcggcgcgggcgagaaggcactgaagctcagctggttcaaaaaggggtcgagcatcggaaagatgttcgaggccaccgctcgcggagcccggcgcatggcgatccttggagacacggcatgggatttcgggtccattggcggggtgttcaccagcgtcggaaagctggtgcaccagatcttcggcaccgcctatggcgtgcttttctccggcgtaagctggaccatgaagattgggatcggcgtgttgctgacgtggctcgggttaaattcccgcagcacctccctgtcgatgacctgcatagcagtcgggctcgtgaccctgtatctaggcgtaatggttcaagccgactccgggtgcgtcatcaactggaagggtcgtgagctcaagtgcggaagcggcatcttcgtgacgaatgaggtacacacctggaccgaacagtacaaattccaggcggacagcccgaagcgcctgtccgccgccatcggcaaagcctgggaggagggggtctgtggaatccggagcgcaacccgtctggagaacatcatgtggaagcagatttccaacgagctcaaccacattctgctggagaacgacatgaagttcactgtagtagtcggagacgtggcggggatcctggcccagggcaagaaaatgatccggccgcagcccatggagcacaagtacagctggaagtcctggggcaaggccaagatcataggcgccgatgtgcagaacacgacgttcatcatcgacgggccgaacaccccggagtgccccgatgaccaacgtgcctggaacatctgggaggtagaggactacggattcggaatcttcaccacgaacatctggctgaaactgcgggacagctatacccaggtgtgcgatcaccgcctcatgtcggcggccataaaggacagcaaagccgtgcacgccgacatggggtactggattgagtcggagaaaaacgagacctggaaactggcgcgggcctcttttatcgaggtcaaaacgtgcatctggcccaagtcccacactctgtggagcaacggcgtgctcgagtccgagatgataatccccaaaatctatgggggtccgattagccaacacaactaccgccccgggtatttcacccagaccgctggcccctggcacttgggcaaactggaattggacttcgatctgtgcgagggcactaccgttgtcgttgacgagcactgtggcaaccgtgggccgtccctgcgcaccaccaccgtgacgggcaagatcatacacgagtggtgctgccgtagttgcaccctgccgcccctccgtttccgcggtgaggacggttgttggtacgggatggagatccgacccgtaaaggagaaagaggaaaatctggttaagtccatggtgagtgccggcagcggcgaggtcgactccttcagcctcggcctcctgtgcatctccatcatgattgaggaggtaatgcggagccgctggtcccggaagatgttgatgaccggcaccctggccgtgttcttcctactaatcatggggcaactgacttggaacgacctgatccgcctctgcatcatggtaggcgcgaacgccagcgatcgcatggggatgggaaccacctacctagccctgatggccacctttaagatgcggcccatgttcgccgtaggacttctcttccggaggttaacctcccgcgaggtgctcctgctgacaatcgggctcagcctggtcgcgtccgtggagctgcccaacagcctcgaggagctcggcgacgggctggccatgggtataatgatcctaaagctgctgaccgacttccagtcccaccagctctgggccaccctgctgtcgctgacgttcattaagactactttctccctgcattacgcatggaagaccatggcgatggtactcagcatcgtttccctcttccccttgtgcctgagcactacctctcagaagaccacctggttgcccgttttgctggggagcctagggtgcaagccactgacgatgttcctgattgcggagaacaagatctggggccggaagtcatggccgctcaacgaagggataatggccgtcggcattgtgagtatcctgttatcctccctcctgaagaacgacgtgcccctggccgggcccctcattgctggcggcatgctgatagcgtgttacgttatcagcgggagtagcgctgacctgtccctcgaaaaggccgccgaggtgagctgggaggaggaggccgagcactccggcgctagccacaacatcctggtggaggtacaggacgacggtaccatgaagatcaaggacgaggagcgcgatgacactctgaccatcctcctgaaggccactctactcgccatctccggcgtatacccgcttagtatccccgctacgctgttcgtctggtacttctggcagaagaagaaacagcggagtggggtactctgggacacccccagcccacccgaggtggagcgtgcggtactggacgacggcatctaccggatcatgcagcgcggcctgcttgggcggagccaggtaggcgtaggggtatttcaggagaacgtctttcataccatgtggcacgtgacccgcggcgcagtgctcatgtaccaggggaagcggctcgaacccagctgggcgtccgtcaagaaggacctgatcagctacggcggcgggtggcgcctccaggggagttggaacactggggaggaggtccaggtgatcgccgtggagcccggcaagaacccaaagaatgtgcagaccgcccccgggacgttcaagacccccgagggcgaagtaggcgcaatcgcgctggacttcaagcccgggacgtctggctcccccatcgtcaaccgggaagggaagattgtgggcctgtacggcaatggggtggtaaccaccagcggaacctacgtaagcgcaatcgcccaggccaaggcctcccaggaggggccgcttccagagattgaagacgaggtgttccgtaagcgcaacttgacgattatggacctgcaccccggctcggggaaaacccgccgttacctcccggccatcgttcgcgaggccataaaacggaagctgcgaaccctgatcctcgctcctacccgagtagttgcctccgagatggcggaggccctgaaggggatgcccattcggtaccagacgacggccgtcaagagcgagcacactggcaaggagattgtggatctaatgtgccacgcgaccttcacgatgcgcctcctgtccccggtgcgcgtaccgaactacaacatgataatcatggatgaggcccacttcaccgacccaagctcaattgcggcccgtgggtacatcagcacccgggtgggaatgggggaggctgccgccattttcatgaccgcgacgccgcctggctccgtggaggccttcccacaaagcaacgccgtaatccaggatgaggagggcggcatatccgagcgctcgtggaactccggctatgagtggatcaccgacttccccgggaagaccgtgtggttcgtgccttcaatcaagtccggcaacgatattgccaactgcctgcggaagaacgggaaacgcgtcatccagctttcgcggaagacattcgacaccgagtaccaaaagaccaaaaacaacgattgggactacgtggtgactaccgatatttccgagatgggcgcgaacttccgcgcggaccgggtgatcgacccccgccggtgtctgaaaccggtgatcctaaaggacgggcccgagcgcgttatcctggccggtccaatgccggtcacggtggctagcgccgcgcagcggcgcggccggatcgggcgcaaccacaacaaagagggtgaccaatatatctatatgggtcaaccgcttaataacgacgaagaccacgcccactggaccgaggccaaaatgctgctagacaacatcaacacccctgaagggatcatccctgcactgtttgagcctgagcgggaaaagagtgccgccatcgacggggagtaccgcctgcgcggtgaggcgcgaaagacctttgtggagctaatgcgccggggcgatctcccggtgtggctgtcctacaaggtggcaagcgaagggttccagtattccgaccgacggtggtgcttcgatggcgaacgcaacaatcaggtcctcgaggaaaacatggacgtggagatctggacgaaggagggggagcggaagaagctacgaccccggtggctagacgcccgcacatacagcgacccgctcgccttacgtgagttcaaagagttcgccgctggccgccgttccgtgagtggagacctgatcctagagattgggaagctgccacagcacctaacccagcgcgcccaaaatgccctcgacaaccttgttatgcttcacaactccgagcagggcgggcgggcttaccgccacgcaatggaggagctccctgacacgatcgagacgctgatgctgttggccctgatcgccgtgcttacaggcggagtgaccttgttctttctgtcgggccgcggcttagggaagacttccataggcctactatgcgtcatggccagctccgtgctgctctggatggcgagcgtggagccccactggatcgccgcctccataatcctggagttcttcctgatggtacttctcatccccgagcccgatcgccaacgaaccccgcaggacaaccagctggcctacgttgtgatcgggttattattcatgatcctgacggttgccgcgaacgagatgggcctcctggagaccaccaaaaaggacctggggatcggacacgtagctgtggagaaccaccaccacgcgacaatgctcgacgtcgacctgcatcccgcaagcgcctggacgctgtatgcggtggccaccaccatcattacacccatgatgcgccacacgatcgagaacaccacagcgaacatctcccttaccgccatagccaaccaagcggccatccttatgggcttggacaaggggtggcctatcagcaagatggacatcggcgtgccgctcctggccctagggtgctactcccaagtaaatcccctcacactgacagccgcggttctgatgctcgtggcccattacgccatcatcggacccggtctgcaggcaaaggccacacgggaagcacagaagcgcaccgctgccggcatcatgaagaacccaacggtggacggcatagtggccatcgacctcgaccccgtggtgtacgacgccaagtttgaaaagcagctcgggcagatcatgctcctgatcctctgcaccagccagatcctgctgatgagaactacctgggcgctatgcgagtccattacactagccaccggcccccttacaaccctctgggaggggtctcctggcaagttctggaacacgactattgcggtgtccatggcgaacatcttccggggcagctacttagccggggcgggcctggcgttctctctcatgaagtccctcgggggcggacgccgtgggaccggcgcccagggagaaacactgggagaaaagtggaagcgccagttaaaccagctgtcgaagtccgagttcaacacgtacaagcggagcgggatcatggaagtggaccgctccgaggccaaggagggcctgaaacgcggagagaccaccaaacacgcggtcagccgcggtaccgccaagctcagatggttcgtggagcgcaacctggtcaagccggaaggcaaggtcattgacctggggtgcggtagggggggatggtcctactactgcgccgggctgaagaaagtaacggaggtgaagggctacactaagggcggtcccggccacgaggagcccatccccatggccacctacgggtggaacctcgtcaaactgtacagcggcaaggacgtcttcttcatcccgcccgagaagtgtgacaccctgctctgcgacataggagagtccagccctaatcccactatcgaggaaggtcgcaccttaagagtgcttaagatggtagaaccgtggctccgcggcaaccagttctgcatcaagatcctgaacccctacatgccatccgtagtggagaccctcgagcaaatgcagcggaagcacggcggcatgctcgtccgcaaccccttgagccggaactccacccatgagatgtactgggtcagctgcgggactggcaacatcgtctccgcagtcaacatgacgagccgcatgttactcaatcggttcaccatggcgcacaggaagccgacctacgagcgcgatgtggacttgggcgccgggacccggcacgtagctgtcgagcccgaggttgcaaacctagacatcatcggccagcggatcgagaacatcaagcacgaacacaaatccacgtggcactacgacgaggacaacccctacaaaacctgggcgtaccacgggagctacgaggtgaagccaagtggcagcgcgagctccatggttaacggtgtggtcaagctcctgaccaagccatgggacgtgatccccatggttacccagatcgcgatgacggacaccacccccttcgggcaacagcgagtgttcaaggaaaaggtggatacccgcacgcccaaggcgaagcgtggcacagcccagatcatggaggtaaccgcccgctggctgtgggggttcctcagccggaataagaagccgcggatttgcacccgggaggaatttacgaggaaggtccggtccaacgcggccatcggcgccgtcttcatcgacgagaaccaatggaactcggcaaaggaggcggtggaggatgagcgcttctgggatctggtccaccgggagcgtgagcttcacaagcaagggaagtgcgcgacctgcgtatacaacatgatgggcaaacgggagaagaaactcggggagtttggcaaagccaagggctcgcgcgccatctggtacatgtggctgggggcccggttcttagagtttgaggctctcggcttcatgaacgaagatcattggttcagccgggagaactcgctgagtggggtggagggcgaggggctgcacaagctcggctacatcctgcgggatatttccaaaattcccggagggaacatgtacgcagacgacacagccggctgggacacccgcatcacggaagacgacctgcagaatgaagccaagatcaccgatatcatggaacccgagcacgccctcctagctaaggccatcttcaagttgacctaccagaataaagttgtacgtgtgcagcgccctgccaagaacgggacggttatggacgtgatcagccgccgagaccagcgggggtccggccaagtgggtacgtacggcctcaacaccttcaccaacatggaggcccagcttatccggcagatggagtctgaggggatcttctccccgagcgaactggaaacccccaacctcgccgagcgcgtcctggactggctggagaagtacggcgtggagcgtctcaagcgcatggcgatcagtggggacgattgcgtggtcaaacctatcgatgaccgatttgccactgcattaaccgccctgaacgacatgggtaaagtgcgaaaggacataccgcagtgggaaccgtccaaggggtggaacgactggcagcaggtccccttctgttcccaccacttccatcaactaatcatgaaggatgggcgggagatcgtcgtgccctgccgcaaccaggacgagctggtggggcgggcacgcgtcagccagggcgcgggctggagcctgcgggagaccgcctgtttgggtaagtcctacgcacagatgtggcagctgatgtacttccacaggcgggatctgcgcctcgccgcgaatgccatctgtagcgccgttccggtggactgggtccccacctcccggacgacgtggtcaatccacgcgcaccaccagtggatgaccaccgaagacatgctgtcggtgtggaaccgcgtgtggatagaggaaaatccctggatggaggataagacgcacatcagctcttgggaggacgtcccctaccttggcaagcgggaggatcagtggtgcggctctctcatcggcctgaccgcccgcgcgacctgggccaccaacatccaggttgcaatcaaccaagtgcgccggttgataggcaacgagaactacctcgactatatgacgtccatgaagcgttttaagaacgaatcagacccggagggtgccctgtggtga

SEQ ID NO: 23788 - RNA, 9879 nt, synthetic construct
  misc_feature 1..9879: note = derived and/or modified CDS sequence (opt11) from DENV-1__JQ922548__SS-prME
  source 1..9879: mol_type = other RNA
tctgtgaccatgctgctcatgctgctgcccacggccctcgccttccacctcaccacccggggcggggagccgcacatgatcgtgagcaaacaggagcggggcaaaagcctcctttttaagacctctgccggggtaaacatgtgcactctgatcgctatggatctgggcgagctctgtgaggatacgatgacctacaagtgcccgcgaatcaccgaggccgagccggacgacgtggactgttggtgtaacgccactgacacctgggtcacctacgggacctgcagccagaccggcgagcaccggcgggacaaacggagtgtggcccttgcccctcacgtgggcctggggctcgagacgcggaccgaaacatggatgagctccgagggcgcgtggcggcagatccaaaaggtcgagacctgggccctgcgccacccgggcttcacggtgatcgccttgtttctcgcgcacacaatagggacctctatcacccagaaggggataatcttcattctgctgatgttggtgacgccctccatggccatgcggtgcgtcggaatcggcaacagggacttcgtggaggggctgtcgggcgcgacctgggtggacgtagtgctggaacacggctcctgtgtcaccacgatggcccggaacaaacccactctcgacatcgagctgctgaaaaccgaagtcactaaccccgctgtgctcaggaagctgtgcatagaagcgaagatcagcaacacaacgacagactcccggtgtccgacgcagggcgaggccaccctcgtcgaggagcaggatgccaatttcgtctgccgccgcacgtttgtggatcgcggctgggggaacggctgcggtctgttcggcaaggggagtctcctaacctgcgcaaagttcaagtgcgtcaccaagctggagggcaagatagtccagtacgaaaatctgaaatactctgtaatagtgaccgtccacaccggcgaccagcaccaggtggggaatgagactactgagcacggcaccatcgccacaatcacgccccaggcgcccatgagcgagatccagctgaccgactacggggcgctcaccctggactgcagcccgcggaccggcctggacttcaacgagatggttctactgacgatgaaggaaaagagctggctagtgcacaagcagtggttcctcgacctgccccttccctggacctcaggggcctcaaccagccaggagacctggaaccgccaggacctcctggtgacgttcaagaccgcacaggccaagaagcaggaagtagttgtgttgggctctcaggaaggcgctatgcacacggccctcaccggggccacggagatccagaccagcggcaccaccacaatgttcgccgggcatttgaagtgccgactgaagatggacaagctcaccctgaagggcgcctcatacgtaatgtgcaccgggcccttcaagttggagaaagaggtggcggagacccaacacggaacggtcttagtccaggtgaagtacgagggcaccgacgccccctgtaagatcccgttcagcacccaagacgaaaagggggtgacccagaatggccgcctcatcacggccaaccccatcgtaaccgacaaggagaagcctgtgaacatcgagacggagcccccgttcggtgagagttacattgtgatcggcgcgggagagaaggcgctgaagctgagctggttcaagaagggttcctcaatcgggaagatgttcgaggcaaccgccaggggagcccgccgaatggccatcctgggcgatacggcgtgggacttcgggtctatcggcggcgccttcaccagcgtcggaaaactggtgcaccaggttttcggcaccgcctacggtgtcctattctcgggcgttagctggacgatgaagattgggataggcatcctcctgacgtggttaggcctcaacagccgcagcacctcactgagcatgacctgcatcgcagtggggatggtcaccctatatctcggcgtgatggtgcaggccgactccgggtgtgtaataaactggaagggccgcgagctgaagtgcgggtctgggatcttcgtgacaaatgaagtgcacacctggaccgagcagtacaagttccaggcggactcccccaagcgcctgtctgccgccatcggcaaggcctgggaagagggagtctgcggtatccgcagcgccacccgtctcgagaacatcatgtggaagcaaatctccaatgagttaaaccacatcctactcgaaaacgacatgaagttcactgtggtagtcggtgacgcgaacggaatcctgacgcagggtaagaagatgatccgccctcagcctatggagcacaagtacagctggaagagttggggcaaagccaagattataggcgcggacgcccagaacacaaccttcatcatagacggtccggacaccccagagtgccccgatgaccaacgagcgtggaacatctgggaggtagaagactacggcttcggcatcttcacgaccaacatctggctgaagttacgcgactcgtacactcaaatgtgcgaccaccggctgatgtcggccgccatcaaggactccaaagccgtgcacgccgacatgggttattggatcgagtccgagaaaaacgaaacatggaaactgacgcgcgcgagcttcatcgaggtcaagacctgcacgtggccgcggtcccacacactctggagcaacggggtgctggagagtgaaatgatcataccaaagatctacgggggccccattagccaacacaattaccgccccgggtatttcacgcagaccgccggcccgtggcacttagggaaactcgagctggacttcaacctgtgcgagggaaccaccgtggtcgtggacgaacactgcggaaacgggggcgcctcgctcgggacgacaaccgtgactggcaagatcatccacgaatggtgctgtcggagctgcacgctaccgcccctgaggttcctaggcgaagacggctgctggtacggcatggagatccggcccgtcaaggagaaggaggagaacctgttccgctccatggtaagcgccggatccggcgaggtagactcattcagcctgggtctcttatgcgtctccatcatgatagaggaggtgatgcggtcgcgctggtcccggaagatgctgatgaccggcaccctagctgtgttctttctgctcatcatggggcaactcacttggaacgaccttatccgcttgtgcatcatggtcggcgcgaacgcgtccgacaggatcggcatggggacgacctatctcgccctgatggccacgttcaaaatgcgccctatgttcgccgtgggcctcctgttcagacggctgacttctcgcgaggtgcttcttctaactattgggctgagcctggtcgcgtccgtggagcttcccaacagcctggaggagctgggcgacggtctggccatggggatcatgatgctgaagctcctcaccgacttccagtcccaccagttgtggacgacactcctgagcctgacgtttattaaaaccaccctgtccctggactacgcctggaaaaccatcgctatggtgctgtcgatcgtgtccctcttccccctgtgtctttctactacctcccagaagacaacttggctcccagtgctactgggcagcttcggttccaaacccttaaccatgtttctgatcactgagaacaaaatctggggccgcaagagctggcccctgaacgaggggatcatggcagtcggcatcgtgtccatcttactgagcagcctgcccaaaaatgacgtacccctcgccggacccctgatcgccggagggatgctgattgcctgctatgtaatctccgggagctcggccgacctctcactggagcgggcggccgaggtgtcctgggaggaggaggccgagcattctggcgcctcccacaacatactggtcgaggttcaggatgacggtaatatgaagatcaaggatgaggaacgggacgatagcctgacgatcttactcaaggccaccctgctggcggtgtccggagtgtaccccatgagcatccccgccaccctgttcgtctggtacttctggcagaagaagaagcaacgctccggcgtgctctgggacacgccgtcacctcccgaagtggtccgggccgtgctggatgacgggatctaccgcatactgcagcggggactgctcggccgctcccaggtgggggtcggtgtgtttcaggacggcgtgtttcacacaatgtggcacgtcacccggggcgccgtgctcatgtaccaggggaagcgcttggagcccagctgggcgtccgttaagaaagacctcatatcgtacggcgggggctggcggttccaggggtcatggaataccggcgaggaggttcaggtgatcgcggtggagcccggaaagaacccgaagaacgtccagacgacgcccgggaccttcaagacacccgaaggcgaggtgggagctatcgcgctagacttcaagcccggcacgagcggctcaccaatcgtgaaccgcgaggggaagatcgtcggtctgtacggcaacggggtggtgacgaccagcgggacctatgtcagcgccatcgcccaggcgaaggcttctcaggagggccccctgcctgagatcgaggacgaggttttcaagaagcgcaacctgacgattatggacctccacccgggcagcgggaagacacgccggtacttgccggccatcgtgagagaggccatcaaacggaaattacgcaccctgatccttgcgcccacccgcgtcgtggcctccgagatggccgaggccttgaaggggatgcccatacgataccagacgacggccgtcaagagcgagcacaccgggcgcgagatcgtcgacttaatgtgccacgcgaacttcacgatgcggctcctatcccccgtgagagtgcccaactataatatgatcatcatggacgaggcccacttcacggaccccgcgagcatcgccgcgcggggttacatcagcacgcgcgtagggatgggcgaagcagccgccatcttcatgaccgctacgccgccgggctcggtggaggccttcccccagtccaacgcggtgatccaagacgaggagcgtgacattcctgaacgtagctggaacagtgggtacgattggatcacggacttccccggcaaaacagtttggttcgtgccgagcatcaagtctgggaacgacatagccaactgtctgcgtaagaacgggaagcgcgtgatacagttaagccgaaagacattcgacaccgagtaccagaagactaagaacaacgactgggactacgtcgtgacgaccgacatcagtgagatgggagcaaatagccgaaccgaccgcgtgatcgaccccaggagatgcctgaagcccgtcattcttaaggacggccccgagcgcgtgatcctcgccggcccgatgccggtgacggcggcctccgccgcccagcggcgcgggcggatcggccgtaaccagaacaaagaaggggaccagtacatctatatgggtcagccccttaacaacgacgaggatcacgcccactggacagaggcgaaaatgctcctcgataatataaacacccccgagggaatcatccctgcactcttcgagccagagagagaaaagtccgccgccatcgacggcgagtaccgtctgaggggcgaggcccggaagacattcgtcgagctcatgcgcaggggcgatctgcccgtgtggctgtcctacaaggtcgcgagtgagggcttccagtacagcgacagaaggtggtgttttgacggggagcgaaacaatcaggtgctcgaggagaacatggacgtggagatctggacgaaagagggcgagcggaagaagttacgcccccgttggctggacgcccgcacatacagtgacccgctcgccttgcgggagttcaaggagttcgcagctggccgccggagcgtgtccggggacctgattcttgaaatcggcaagctgccccagcacctgaccttacgcgcgcagaacgccctggataacctggtgatgctccacaacagcgagcaaggcgggaaggcttatcggcatgccatggaggagctgcccgacaccatcgaaaccctgatgctcctagcgctgatagccgtgctcacaggcggtgttaccttgttcttcctgtccgggaaggggctcgggaagaccagcataggtctgttatgcgtgatggcctccagcgttctcctgtggatggcctccgtagagccacactggatcgccgcgagcatcatacttgagttcttcctcaaggagctcctgataccggacgccgacggccagcgcacgcctcaggataaccaactcgcctatgtggtaatcgggttgctgttcatgattcttacggtagccgcgaacgagatgggcctgctggaaactaccaagaaaaacttgggaatcgggcatgtcgtcgcagaaaaccaccatcacgccaccatgctggacatagaccttcaccccgcctccgcatggacgctctacgccgtcgccacaaccatcattaccccgatgatgcggcacacgatcgagaataccacggccaacatctctctgaccgccattgccaaccaggctgctatcctgatgggcctcgacaaggggcgccccatctccaaaatggacatcggtgtgcccctgctggccctcggttgctacagccaggttaatcccttgacgctgactgccgctgtcctcatgctggtggcgcactacgccatcataggtccaggcctgcaggccaaggccactcgtgaggcacaaaagagaaccgcggctgggctcatgaaaaacccgacagtggacggcatagccgcaattgacctagaccccgtcgtttacgacgccaaattcgagaaacagctcgggcagatcatgttattaatcctctgcacttcccagatcctcctgatgcgcacaacctgggcgctgtgtgaatccatcacgctcgccaccgggcccctaaccaccctgtgggagggctccccgggcaagttctggaacacaaccatagccgtgagtatggcgaacatctttcgcggctcctacctcgcgggggcgggcctggccttcagcttaatgaagtccctcggaggcggcagaaggggtaccggcgcacaaggggaaaccttgggcgagaagtggaagcgtcagctgaaccagctcagtaaaagcgagttcaacacatacaagcggtcggggatcatggaggtcgacagaagcgaggcaaaggagggcctgaagcggggcgagacaaccaaacacgcggtgtcccgcgggacggccaagctgcggtggttcgtggaaaggaatctggtcaaacccgagggtaaggtgatcgacctcggctgcggtcgcgggggctggagctattactgcgccggcctgaagaaggtcacggaagtcaaggggtataccaagggcgggcccgggcacgaggagcccatcccgatggccacctacgggtggaacctggtgaagctgcactcagggaaggacgtcttcttcacgccgcccgagaagtgtgataccctgctgtgtgatattggcgagagctcccccaatcccacgatcgaggaggggcggaccctccgtgtactgaagatggtggaaccctggctgcgcggcaaccagttctgcatcaagatcctgaacccctatatgccatcagtcgtcgaaaccctggagcagatgcagcgtaagcacgggggcatgttggtgagaaaccctctctcccggaacagcacccacgagatgtactgggtgagttgcgccacggggaacatcgtgagcgcggtgaatatgaccagtcgtatgctgttaaaccggtttactatggcacatcgcaagcccacctacgaacgcgacgtggatctcggggccgggactcggcacgttgccgtggagccagagattgcgaacctggacatcatcgggcagagaatcgagaatatcaagaacgagcacaagagcacctggcattatgacgaagataacccctacaagacgtgggcgtaccacggcacatatgaggtcaaaccgtccgggagcgcctcctcgatggtcaacggcgtagtgcgactcctcacgaagccctgggacgtcatccccatggtgacccagatcgccatgaccgacaccacgccctttggccagcagcgcgtattcaaagaaaaggttgacaccagaacgccccgccccaagcgagggaccgcccagatcatggaggtgacggccagatggctgtgggggtttcttagccgaaacaagaagccccgcatctgtacccgggaggagttcacccgcaaggtccggtccaatgcggccatcggggctgtgttcgttgacgagaatcagtggaacagcgctaaggaagcggtcgaggacgagcgcttctgggatctcgtgcatcgcgaacgcgagctgcacaagcaaggcaagtgcgcgacgtgcgtgtacaatatgatggggaagagagagaagaaacttggcgagttcggcaaggcgaagggcagcagggcgatctggtacatgtggctcggagcccggttcctcgagttcgaagcgttggggttcatgaacgaagaccactggttcagcagggaaaattccctctcaggcgtcgagggtgagggtctgcataagctgggctacatcctccgcgacatctccaagattccagggggcaacatgtacgcggacgacacggccgggtgggacacgcgcattaccgaagacgaccttcagaacgaggccaagatcacggacatcatggaacccgagcacgccttactggcgaccagcatcttcaagctaacctaccagaacaaggtggtgcgcgtacaacggcccgccaaatccggcacagtgatggacgtgattagccgccgcgatcagcgcggctccgggcaggtaggaacctatgggctgaacacgttcaccaacatggaggtgcagcttatccggcagatggaaagcgagggaatctttagcccgagcgagttagaaaacagtaacctggccgagcgcgccctcgactggctggagaagcatggggtggagaggctgaagcgcatggccattagcggagacgactgcgtcgtgaagccgaccgacgaccggttcgccaccgccctcacggcgttgaacgacatgggcaaagtgcgcaaggacatcccccagtgtgaaccctctaaggggtggaacgattggcaacaagtccccttctgcagccaccattttcaccagctgataatgaaggacggcagggagatcgtggtgccgtgccgcaatcaggatgagctcgtcggccgtgccagagtgtcacagggggcaggctggagcctacgtgagaccgcgtgcctgggcaaatcatatgcgcagatgtggcagctcatgtacttccaccgccgggacctgcgcctggcggctaacgcaatatgctccgccgtgcccgtcaactgggtgccaaccagccgaacgacctggtccatccacgctcaccatcagtggatgacgaccgaggacatgctcagcgtctggaaccgcgtgtggatcgaggagaacccctggatggaagataagacacacgtgtccagctgggccgacgtcccctacctaggcaaacgcgaggaccagtggtgcgggtctctgatcggcctcgccgcccgggccacctgggccacgaacatccaggtcgccctcaaccaggtgcgtcggctgattggtaatgaaaactacctcgactacatgacctcaatgaagcgcttcaagaacgagtccgacccagagggtgccctgtggtga

SEQ ID NO: 23789 - RNA, 9879 nt, synthetic construct
  misc_feature 1..9879: note = derived and/or modified CDS sequence (opt11) from DENV-1__JQ922544__SS-prME
  source 1..9879: mol_type = other RNA
agcgttactatgctcctcatgctcctgcctaccgcccttgcattccacctgacaacccgtggcggggaaccccatatgatcgtgtcgaagcaggaacggggcaagagcctcctcttcaagacctccgcaggggtgaacatgtgcaccctgattgccatggacctgggcgagctctgcgaggacacgatgacctacaagtgtccccggattaccgaggcagagcccgacgatgttgactgttggtgcaacgccaccgacacatgggtaacctacgggacctgctcgcagaccggcgaacaccggagggacaagcggagcgtggccttggcgccccacgtgggcctagggctagagacgcgcaccgagacgtggatgtcatgcgagggcgcctggaagcagattcaaaaggtcgagatatgggccctgcgtcaccccgggttcacggtgattgctttatttctcgcgcatgccatcgggactagcattacccagaaagggatcatttttatcttactcatgcttgtaaccccctcgatggccatgcgctgcgtcggcataggcaaccgggagttcgttgagggtctctccggagccacttgggtcgacgtcgtgcttgagcacggcagctgcctccacacgatggcccagaataagcccaccctggacatcgagctgctcaaaacggaggtgaccaatcccgctgtccttcgcaaactgtgtatagaggcgaagatctccaacacgaccaccgactcgcgttgccccacgcaaggagaggcaacgctcgtggaagaacaagacgccaacttcgtatgccgccggacattcgtcgaccggggctgggggaacggctgcgggctgtttggcaaggggtccctgctgacctgcgcaaagtttaagtgcgtgactaaattagagggaaagatcgtgcagtacgagaatctgaaatatagcgtcatcgtgacggtacacaccggcgaccagcaccaggtcgggaatgagactactacccatggcaccatcgcgacaatcacgccgcaagccccgacttccgagatccaactcacggattacggggccttgactctcgattgttccccgcggaccggcttagacttcaacgagatggtgctgctgacgatgaaggagaagtcgtggttggtccacaaacagtggttcctggacctgcccctcccctggactagcggggcctccaccagccaggagacctggaaccgccaagacctgctggtgaccttcaagacagcccacgcgaagaagcaggaggtggtcgtgctcggatcgcaggagggggccatgcataccgccctgaccggggcaaccgagattcagacgtccggcaccactaccatcttcgccggtcacttgaagtgccggctcaagatggacaaattgacgctgaaagggatgagctacgtgatgtgcaccgggtccttcaagttagagaaagaagtcgcggagacccagcatggcaccgtgcttgtgcaggtcaagtatgaaggcacagacgcaccctgcaagatccccttcagcacccaggacgagaagggagtgacccaaaatggccgacttatcacagcgaacccgatagtgacggacaaggagaagcctgtcaacatagaggccgagccaccctttggggagtcatacatcgtagtcggcgcgggcgagaaggccctgaagctctcgtggtttaagaaggggtcctccatcggcaagatgttcgaggctacggccagaggggcgcgccggatggcaatcctgggcgacacggcctgggatttcgggtccatcggaggggtctttactagcgtggggaagctggtgcaccaggtcttcggcacagcatatggggttctcttctccggggtgtcctggataatgaagattgggatcggcatcttgctaacgtggctcgggctgaactcccgcagcacctccttaagcatgacctgcatcgccgtcggtatggtaacgctctacctgggcgttatggtccaggccgacagcgggtgcgtgataaactggaagggccgcgaactgaagtgtgggagcggcatttttgtgacaaatgaagtccacacctggacagagcagtacaagttccaggcggatagcccgaagaggttaagcgccgccatcggcaaggcctgggaggaaggggtctgcggcatacgcagtgcgactcgactggagaacatcatgtggaagcaaatcagcaacgagctgaaccacatcctgctggagaacgacatgaagttcacagttgtcgtgggggacgcgaacgggatcctggcccaggggaagaagatgatccgaccccaacccatggagcacaagtacagctggaagtcgtggggcaaggccaagatcatcggcgccgacatccagaacaccactttcatcatcgatgggcccgatacaccggagtgccccgacgaccagcgggcgtggaacatctgggaagtagaggactacggcttcgggatattcactaccaacatctggctaaagctgcgcgacagctacacgcagatgtgcgaccacaggttgatgtccgccgccatcaaggacagcaaggccgttcacgccgacatgggatactggatcgagtctgagaaaaacgagacctggaagctcgctcgagccagcttcatcgaagtgaaaacctgcatctggcccaaatcacacaccctgtggagcaatggcgtgcttgagtcggaaatgattattcccaagatttacggagggccgatcagccagcacaactatagacccgggtacttcacccagaccgccggcccctggcacctcggcaagctggagctggactttgatttgtgcgagggcacgaccgtcgtggtcgaggaacactgcgggaaccgcgggccatccctaaggaccaccacggtcaccggcaagattatacatgagtggtgctgccggagctgcacactgccgccattgcgcttcaagggagaggacggctgctggtatgggatggagataaggcccgtgaaagagaaagaagagaacctggtgcgttccatggtgtcagccggaagcggcgaggtggacagcttcagcctcgggttattgtgcgtgtccatcatgatcgaggaggtcatgcgaagccgttggtctcgcaagatgctgatgaccggaacgctcgccgtgttcttgctgctcatcatggggcagctcacctggaacgacctgatccgactatgcataatggtgggcgcgaacgcttcagaccgaatgggtatgggcaccacctatctggccctgatggctacgttcaagatgcgtccgatgttcgcggttggcctcctgtttcgacgattgactagccgtgaggtgctcttgctgaccatcgggctgagcttagtggcgagtgtagagctgcccaacagcctcgaagaactgggcgatgggctggccatgggcattatgatgctcaagctgctgaccgactttcagtcgcaccaactctggactaccctgctgagcctcaccttcataaagaccacgctgtcgctagactacgcctggaagaccatggccatggtattaagcatcgtatcactcttccctctgtgcctcagcaccacctcccagaagacgacttggttgccggtattgctcggcagcttcggttgcaagccgctgactatgttcctcattaccgagaacaaaatctggggccgcaagtcctggcccctcaacgaagggatcatggcggtgggaattgtcagcatcttactgtcgagcctcctaaagaatgatgtgcccctggcagggccattaatcgccggcggcatgctgatcagtttcttcgtgatctccggtagctcagccgacctatcactcgagaaggccgcggaagtctcctgggaggaggaggcggagcacagcggtacctcccacaacattctggtggaggtgcaggacgacgggacgatgaagatcaaggacgaggagagggacgacaccctgactatccttctgaaggccaccctgttggctgtcagcggcgtgtacccgatgtccataccagccacgctgttcgtatggtatttctggcaaaagaagaagcaaagatctggggtcctatgggacactcccagtccgcccgaggtggagcgggcggtattagacgacggcatatacaggatcttgcagcgggggctgctggggcgctcccaggtgggcgttggtgtcttccaagatggcgtctttcacaccatgtggcatgtgacacgcggagccgtgttaatgtaccagggcaagcgtctggagccctcctgggccagcgtcaagaaagacttgatcagttacggcggtggctggcggttccaggggtcgtggaatacgggggaagaagtccaggtgatcgccgtggagcccgggaaaaaccccaagaacgtgcaaaccacccccggtaccttcaagacgcccgaaggggaggtgggggcgatcgcgctcgacttcaagccaggcacgtccgggagccccatcgtcaaccgcgagggcaagatcgtcggcctctacgggaatggtgtggtgaccacatcggggacgtacgtgtcggccatagctcaggcgaaagctagccaagagggcccgctgcctgagatcgaggacgaggtattccgcaagcgcaacctcacgatcatggacttacacccagggagcggcaagacacggcggtacctgcctgcgatcgtccgggaggccataaagcgaaaactccgtaccttaatactagccccgacgcgcgtagtagcctcagaaatggcggaggcccttaagggcatgcccatcagatatcagacaaccgcggtcaagtcagaacacacagggcgtgagatagtggacctgatgtgccacgccacgttcaccatgcgcctgctcagccccgtgcgagtccctaactacaacatgatcataatggacgaggcccactttactgatcccgcctccatcgcagcgcgcggctacataagcacccgggtgggcatgggcgaggccgccgcgatcttcatgacagccacacctcccgggtccgtggaggcttttcctcagagcaacgccgtcatccaggatgaggagcgtgacatccccgagcgatcctggaacagtggctacgactggatcaccgacttcccgggtaagacagtgtggttcgtcccctcgatcaagagcgggaacgacattgcgaactgcctgcgcaagaacggcaaacgggttatccagctgtcccgcaagacgttcgacacggagtaccagaagacaaagaataacgactgggactatgtggtgactacggatatcagcgaaatgggggcgaacttccgggctgaccgggtcatcgacccgcggcgctgtctcaagcccgtgatcctgaaggatggacctgaacgggtgattctggccgggcccatgccggtcaccgtggcctccgcggcccagcgccggggcagaatcggccgaaatcagaataaggaaggggatcagtacgtcaacatgggccagcccctcaacaatgacgaggatcatgcccactggaccgaggccaagatgctgctggataacatcaacacccctgagggcatcatccccgcactcttcgagccggaacgcaaaaagtcagcggccgtggacggggaatatagactgcgcggggaggcccgcaagacgttcgtggagctgatgcggcgtggtgatctccccgtctggttgtcctataaggtcgccagcgagggattccagtatagcgacagacgctggtgcttcgacggggaacgaaacaaccaggtgctggaggagaacatggacgttgaaatctggacgaaggagcgcgagcggaagaagctccgaccccggtggctggacgcccgaacctacagcgacccactcgccctccgggaatttaaggagttcgccgccggccgccggtccgtctccggggacttgatcctagagataggaaagctcccgcagcacctgacccttcgtgcccaaaatgccctcgacaacctggtgatgttgcacaactcagagcagggcgggaaagcgtaccggcacgccatggaggagctcccggacactatcgagaccctgatgctgctcgcccttatcgccgtcctgaccggcggcgttacactattcttcttgtccggcaagggcctgggcaagaccagtatcggcctcctgtgcgtgatggccagcagcgcactgctctggatggccagcgtagagccccactggatcgcggccagcatcatcctggagttcttcctgatggtgctcctgatccccgagccggaccggcagcgaacgccccaggacaaccagctagcgtacgtcgtcatcggtctcctattcatgattctcaccgttgccgccaacgagatgggtctcctggagacgaccaagaaggacctcggcattggacatgttgcagctgaaaaccaccaccatgcgacgatgctcgacgtagaccttcgccccgcatccgcctggaccctgtacgccgtggccaccaccattataaccccgatgatgaggcacaccatcgagaacaccactgccaatatttctctcacggcgattgccaaccaggctgccatcctgatgggcctggacaagggttggccaatttccctcatggatatcggcgtgcccctgctagcgctcgggtgctactcccaggttaaccctctgaccctgacagccgccgtgctcatgctggtggcccactacgcgatcatcggtccggggctgcaggccaaggccacccgcgaggctcagaagcgcacagccgcgggtatcatgaagaaccctaccgttgacgggatcgttgccatcgacctcgaccctgtggtctacgacgccaagttcgaaaagcagttaggccaaatcatgttgctcatcctgtgcacctcccagatcctgctcatgcggaccacttgggccctgtgcgagagcatcacgctggctaccggccccctaactacactgtgggaaggaagtccgggtaaattctggaacacgaccatcgctgtcagcatggccaatatcttccgcgggtcctacctggccggcgcaggccttgccttcagcctgatgaagtccctcggaggagggagacgcgggaccggtgcgcagggcgagacgctaggcgagaagtggaagcgacagcttaaccagctgtccaaatcagagttcaacatctacaagagatccgggatcatggaagtggaccggagcgaggcaaaggagggtctgaagcgcggggagaccaccaagcacgccgtctcccggggcactgccaagctgcgttggtttgtcgagcggaacctggtgaaaccagaaggaaaggtgatcgacctgggctgcggcagagggggctggagctactactgcgcggggctcaagaaggtgacggaagtgaagggctacaccaagggcgggcccggccacgaggagcccatccccatggccacctacgggtggaacctggtcaagctgcactccggaaaggacgtgtttttcacaccacccgaaaagtgcgacacactcctgtgtgacatcggtgagtcatcccctaacccgacgatagaggaaggccggacgttaagggttctcaagatggttgaaccctggctccgggggaaccagttctgcattaagatattgaatccctacatgcccagcgtggtggagaccctcgagcagatgcagcgcaaacatggcggcatgctggtacggaatcccctttcacgcaacagcacgcacgaaatgtactgggtgtcttgtggaacgggaaacatagtgagcgcagtgaatatgacctcccgaatgctcctgaaccggttcaccatggcccacaggaaacctacctacgagcgggacgtggaccttggggcgggcacgcgccatgtcgcggtcgagcccgaggtcgccaacctggacattattggccagcggatcgagaacatcaagaacgagcacaaaagcacctggcactacgacgaagacaacccctacaaaacatgggcctatcacgggtcctacgaggtgaagccaagcggctccgccagctctatggtcaatggggtggttaggctgctgactaaaccctgggacgtgattcccatggtgacacagatcgccatgaccgacaccaccccgttcggccagcagcgggtattcaaggagaaggtggacacccgcaccccgcgggcgaagcgcggtaccgcccagataatggaggtgacagctaagtggctctggggctttctgtcccggaacaagaagccccgcatttgcacgcgggaggagttcacccgcaaggtccggagcaacgccgccatgggtgcggtgttcgtggacgagaaccagtggaactccgccaaggaggccgtcgaagacgagagattttgggacctggtgcaccgggaacgcgagctccacaaacagggtaaatgtgcaacctgcgtgtacaacatgatgggcaagcgggagaagaaactgggggagttcggtaaagcaaaggggtcacgcgccatctggtacatgtggcttggcgcccggttcttagagttcgaagccctgggcttcatgaatgaagaccactggttctcccgcgagaacagcctctccggggtcgaaggcgaggggcttcataagctgggttatatcctgcgcgacatcagcaaaattcccggaggaaacatgtacgcagacgacaccgcgggctgggacacgaggataaccgaggacgacctccagaacgaggccaagatcacggacataatggagccggaacacgcgctgctggcgacctccattttcaagctcacgtaccagaacaaggtagtgcgcgtccagcggcccgccaagagcggaactgtgatggacgtgatctcccgccgggaccagcgcggcagcggacaggtgggcacctacggcctgaacaccttcacaaacatggaggtgcaactgatccgccagatggagtccgaggggattttcttacctagcgaacttgagacacccaacctcgcggagcgcgtgctggactggttggagaaacacggagccgagcggctgaagcgcatggcaatctccggggacgactgcgttgtgaagccgattgacgatcggtttgccacggccctcacagcactgaacgacatgggcaaggtgaggaaggacataccccagtgggagcccagcaaagggtggaacgactggcagcaggtacccttctgttcccaccacttccaccaacttatcatgaaggacgggagagagattgtggtgccgtgccgcaaccaggacaagctcgtcggacgggcacgtgtgtcgcagggtgccggttggagtctgcgggagacggcctgcctgggcaagagctacgcacagatgtggcagctcatgtacttccaccgcagagacttgaggctggcggcaaacgccatctgcagcgcggtgcccgtcgactgggtccccacatcccggacgacgtggagcatccacgcccatcaccagtggatgaccacagaggacatgctctcagtatggaacaaagtttggatcgaagagaatccctggatggaggacaagacccacgttagctcctgggaagacgtgccgtacctgggtaagagggaggaccagtggtgcggaagcctgatcggcctcactgcccgcgccacatgggccacgaacatacaggtcgcaataaaccaagtaaggaggcttatcggcaacgaaaactaccttgactacatgacctcaatgaaacggttcaagaacgagagcgaccccgagggggcgttatggtga

SEQ ID NO: 23790 - RNA, 9879 nt, synthetic construct
  misc_feature 1..9879: note = derived and/or modified CDS sequence (opt11) from DENV-1__JQ922546__SS-prME
  source 1..9879: mol_type = other RNA
agcgtggctatgctgctaatgttgctacccaccgcgttggccttccatctcaccacccggggcggtgaaccccacatgatcgtgagcaagcaggaacggggaaagagcctgctgtttaagacgtccgccggggtaaatatgtgcacactgatcgcaatggacctcggggaattatgtgaggacactatgacgtacaagtggccccgaataaccgaggcggaacccgacgacgtggactgctggtgcaatgccacagacacctgggtcacatacgggacctgctcgcagaccggcgaacaccggcgggacaagcgatccgtggctctggcaccccacgtaggcctggggttggagacccggacggagacatggatgtcaagcgaaggcgcctggaaacagatccagaaggtcgaaacctgggcactgcggcaccccgggttcaccgtgatcgcccttttcctcgctcacgccattggcacatctatcacgcagaaggggatcatctttatcctgctaatgctcgtaacgccctctatggccatgcgttgtgtgggcatcgggaaccgggacttcgtcgaagggttaagcggcgccacctgggtggacgtggtgctggagcatggttcctgcgtgacaaccatggcaaagaacaagcctactctggatattgaactcttgaagaccgaggtcacaaaccccgctgtgttacgcaagctgtgcatcgaggccaagatatcaaacacaaccacagactcccggtgtcccacgcagggcgaagccacactggtggaggagcaggatgccaacttcgtctgccgccggacttttgtggaccgcggctggggtaacgggtgtggcttattcggcaaggggtctctgctgacctgcgccaagtttaaatgtgtgacgaagctcgagggcaagatcgtccagtatgagaacctgaaatactcagtgatcgtgaccgtccacaccggcgaccagcatcaggtaggcaacgagactaccgagcacggtaccatcgccatcatcacgccccaggcccccacctcggagatccagttgaccgattacggggctctcacgctggactgcagcccccgcaccggcttagactttaacgagatggtcctcttaaccatgaaagagaagtcgtggctagtccacaagcagtggttcctcgacttaccgctgccctggacttccggggccagcacgagccaggaaacctggaacagacaggacctcctagtcaccttcaaaactgcacacgccaagaaacaagaggtcgtagtcctgggctcacaggaaggcgcaatgcacacggccttaaccggggctacagagatccagacctccggcaccaccaccatcttcgcggggcatctgaagtgtcgtttaaagatggacaagctcaccctgaagggcatgtcctatgttatgtgcacggggagctttaaactagagaaggaagtggccgagacccagcacgggaccgtgctggtccaggtgaagtatgaggggaccgacgcaccctgcaagattcccttctccattcaagatgaaaagggggtgacacagaacggccggctcatcacagccaacccgatcgtcaccgacaaggagaaacccgtgaacatcgagacggagccgccttttggggagagctacattgtagtcggcgctggcgagaaagcactgaagctgtcctggttcaagaagggcagctccattgggaagatgttcgaggccacggcccgcggggcccgccgaatggccattctcggagacaccgcctgggacttcgggagcattgggggcgtgttcacctcggtggggaagctagtgcaccaggtgttcggcaccgcctacggggtcctgttcagcggcgtctcctggacgatgaagatcgggataggaatcctcctgacctggctgggcctcaacagccgctccaccagcctgtccatgacctgcatcgccgtgggaatggttaccctgtacctcggcgtgatggtgcaggctgacagtggttgcgtgataaactggaagggacgcgaactgaagtgcgggtccggcatcttcgtcaccaacgaagtccacacctggacggagcagtacaagtttcaggctgacagccccaagaggctaagcgccgcaatcggcaaggcatgggaggagggggtatgtggtatcagatcagcaacgaggctcgagaacgtcatgtggaagcaaatcagtaacgaattaaaccacatcctactagaaaacgacatgaagttcaccgtggtggtgggagatgtgaacggtatcctggctcaggggaagaagatgattcgcccccagcccatggagcacaagtacagctggaagtcatggggcaaagccaagatcatcggcgccgacatccagaacaccacgttcatcattgacgggcccgatacaccggaatgcccagatgaccagcgcgcctggaacatctgggaagttgaggattacggcttcgggatcttcacaaccaacatctggctgaaacttcgagattcctacacccaagtatgcgatcacaggcttatgagcgcggccatcaaggactccaaggcggtgcacgccgacatgggttactggatagaaagcgaaaagaacgagacctggaagctggctcgcgcgtccttcattgaggtcaaaacatgcacctggcccaaatcgcacaccctctggtccaacggcgtcctggagtcagagatgatcattcccaaaatctacgggggccctatatcccaacacaactaccgtcccgggtatttcacccagacggctggcccctggcaccttgggaaacttgagttggactttgacctatgcgaagggactaccgtggtagtggacgagcactgcggcaaccgcggaccaagcctccggaccacgactgtcaccggcaagattatccatgagtggtgctgccgtagttgcaccctgccgcccttacggttcaagggagaagacggttgttggtacgggatggaaatccgccccgtgaaagagaaggaagaaaacctcgtacggagcatggtttccgcaggcagcggcgaggtagacagcttcagtttaggtctgctttgcgtaagcatcatgatcgaagaggtaatgcgctccagatggagccggaagatgctaatgacgggcacgttggctgtgttctttctcctaattatggggcagttgacgtggaacgatctcttccggctgtgcataatggtcggtgccaacgcgtcagaccgcatggggatggggaccacttatctcgccctgatggccaccttcaagatgcgcccgatgttcgccgtagggctgctgttcagacgactcacatcgcgggaggtcctactgctcaccatcgggctctcgcttgtggccagcgtggagctgcccaattcgctggaggaactcggcgatgggttagccatgggcataatgatgctcaagctgctaacggatttccagagccatcagttgtggaccaccttgctcagcctgaccttcatcaaaacgactttgagcctcgactacgcatggaaaaccatggccatggttctgtccattgtgtcgttgagcccgctatgcctgagcactacgtcccagaagaccacctggctgccggtgttgctgggctcattcggttgcaaacccctgacgatgttcctcattacggaaaataagatttggggccgcaagtcctggcccctgaacgaggggatcatggccgtcggtatcgtgagcatcctactgagctcccttctcaaaaacgacgtgccgctcgcgggaccgctgatagctggcggcatgctgatcgcatgctacgttatcagcggatctagcgccgacctcagcctggagaaggccgcggaggtgtcgtgggaggaggaggccgaacactcaggcgccagccacaacatcctggtggaggtccaggatgatgggaccatgaaaatcaaggacgaggagcgagacgatacactcactatcctgctgaaggcttccctactggccgtcagcggcgtgtatcctatgagcatacctgcgacgctgttcgtctggtacttctggcagaagaagaagcaacgatcgggggtgctctgggacacacctagtccccctgaggtggaacgggccgtactggacgacggtatttaccgcatactgcagcggggcttgctagggcggagccaggtgggcgttgggatcttccaggacggcgtcttccacaccatgtggcatgtgacacggggtgccgtcctcatgtaccaaggcaagcgcctggagccctcctgggccagtgtcaagaaagacttgatttcctacggcggagggtggcgatttcaggggtcttggaacaccggagaagaggtccaggtgatcgccgtcgagcccgggaagaaccccaagaacgtccagacgacccccggaatttttaagactcccgaaggcgaagtgggggctatcactctggacttcaagccagggacgtccgggagtcccatcgtcaaccgcgagggcaagatcgtaggcctgtacgggaacggcgttgtcaccacgtcggggacttacgtatccgccattgcgcaggctaaggcaagccaggagggaccgctgcccgagatagaggacgaggtgtttcgtaaacgcaacctgacgatcatggacctgcaccccgggagtgggaagacccggcgctacctcccggcgatcgtcagggaggccatgaagcgcaagctgcggactctcatactcgcgcctacgcgcgttgtagccagcgagatggcggaggccctgaagggcatgcccatcaggtaccaaaccactgccgtgaaatccgagcacacagggcgggagatcgtggaccttatgtgtcacgccaccttcacaatgagattactgtcccccgtgcgggtcccgaactacaacatgatcataatggacgaggcccacttcactgaccccgcgtccattgccgcacgcggatacataagcactcgggtagggatgggcgaggccgctgcgattttcatgaccgccacccctccaggttcagtggaggcatttccgcagagcaacgccgttatccaggacgaggaacgagacatccctgagcggtcttggaacagcggctacgactggataaccgacttccccggcaagacagtgtggttcgtgccttccataaagagcgggaacgacatagccaactgcctgcggaagaacggcaagcgggtcattcagctctcccgcaaaacttttgatacggaataccagaagaccaagaacaacgactgggactacgtcgtaacaacagacatatcagagatgggggcgaacttccgggccgaccgcgtcattgacccgagacgatgcctgaagcctgttatcctgaaggagggccccgagcgtgtgatcctggccgggcctatgccggtgacggtcgcctccgcggcccagcgccggggccgcatcggccggaaccagaataaggagggcgaccagtacgtatacatggggcaacccttgaacaacgacgaagaccacgcccactggaccgaagccaagatgctgctagaccatataaacacacccgaggggatcatccccgcactcttcgagcctgagagggagaaatccgcggcgatcgacggcgagtaccggttacgaggggaggcccgtaagacgtttgttgaactcatgcggcgcggtgacctgcccgtgtggctgagctacaaagtcgcaagcgagggcttccagtacaccgaccgccgatggtgcttcgatggggagcggaacaatcaggtgctcgaggagaacatggacgtggagatctggatggaggagggcgaaaagaagaaaattcgaccccggtggttagagatcgagaaatactcggaccccttggcccttcgcgagttcaaagagttctccgctaagcgcaaaagcgtcctgggggacttaaagctggagatcggcaagctgcctcagcacctgaccataaaggcccgcaacgccttagacaacttggtgatgctgcacaatagtgagcagggcggcaaagcctaccggcacgccatggaggagctccccgacaccatagagaccctgatgagattaggcctcatagcagtgatgaccggaggggtcaccctgttcttcctgtctgggaaggggcttggcaagacttccaacgggctgctctgcgtgatggcaagctcggtgctcttatggatggcctccgtcgagccgcattggatcgccgcatccataattctggagttcttcctcatggtgctgcttattcccgagccggataggcagcggacgccccaggataaccagctcgcctacgttgtcattgggctacttttcatgattctcacggtggccgctaatgagatgggcctgcttgaaactaccaaaaaggacctcggaatcgggcacgtggtggccgaaaaccaccaccacgcgacgatgctggacgtggacctgcaccccgccagcgcctggaccttgtacgccgtggctacgaccatcataacgccgatgatgagacacaccatcgagaatacgactgccaacatttcactgactgccatcgctaaccaagccgccatcctgatgggccttgacaagggatggcccatcagcaagatggacatcggggtccccctactggcattaggctgttacagccaggtgaaccccctgaccctgacggccgccgtgttgatgctggtcgcccactacgccatcatcggcccgggcctgcaagcgaaggccacccgcgaggcccagaaacgcaccgcgccccagatcatgaagaaccagatcgtcgacgggatagttgccgtcgacttagatcccgtcgtctacgacgccaaattcgagaagcagctgggccaaataatgctactcatcctgtgcactagccagatcttactcatgcggacgacctgggctttgtgcgagtcaatcaccctggccaccggaccccttactaccttgtgggaggggagccctgggaagttctggaataccactattgccgtgtccatggccaacatttttcgggggagctacctggccggcgcgggcctggccttctccctcatgaagtccctcgggggagggcgccgcgggaccggtgcccagggcgaaaccctaggcgagaagtggaagcggcagttgaaccagctgagtaagtccgagttcaatacctacaagaggtcggggatcatggaagtggaccggagcgaggcaaaggaaggcctcaagcgcggcgagacaacgaagcatgccgtgagcagaggcaccgccaagctgcgctggttcgtcgagcggaatctggtcaagcctgaaggaaaggtgatcgacctcggctgtggccgcgggggctggtcctactattgcgccgggctgaagaaggtcaccgaggtgaagggctacaccaaaggagggcccggtcatgaggaaccaatcccgatggccacgtacggctggaatctggtgaagctgcacagcggcaaggacgtcttcttcacaccgcccgagaagtgcgacacgctcctatgcgacatcggtgagtccagccccaatccgaccatcgaagaaggtcggacgttacgagtgctcaaaatggtggagccctggctgcgcgggaaccagttctgtataaaaatcctgaacccatacatgccctccgtcgtcgagaccctcgagcagatgcagcgcaagcacggcggaatgctggtgcggaatcctctgagccgcaactccacccacgagatgtactgggtcagctgtgggactgggaacatcgtgtccgcggtgaacatgaccagccggatgctactgaatcgcttcacgatggctcaccggaaacccacgtacgaacgcgacgttgacttaggagctggtacccggcacgtggccgtcgagcccgaggtggcgaatttggatatcatcggccagcgcatcgagaacattaagaacgagcataaatccacatggcactacgacgaggataacccctataaaacctgggcctaccacgggagctatgaggttaagccgtccggtagcgcctccagcatggtcaacggggtggtgcgccttctgactaagccctgggatgtcatccccaccgtgacgcagattgcgatgactgacaccacccccttcggtcagcagcgagtgttcaaggagaaggtcgatacccgcacaccgaaggcgaaacgggggacagcacagatcatggaagtgaccgcaaattggctttgggggttcctgagccgcaataagaagccccggatctgcacccgcgaagagttcacgcggaaggtgcgatccaacgccgctattggagccgtgtttgtggacgagaaccagtggaactctgcgaaagaggcagtggaggacgagcggttctgggacctggtccaccgcgaacgggagcttcacaagcaggggaagtgcgcgacatgcgtgtacaacatgatgggcaaaagggagaagaagctgggtgagttcggcaaagccaaggggtccagggccatctggtatatgtggctaggggcgcgcttcttggagttcgaggccctgggcttcatgaacgaggatcactggttttcgagggagaactccctgagcggagtggagggcgaggggctccacaagctgggctacatcctgcgcgacatctcaaagatcccagggggcaatatgtacgccgacgacaccgccgggtgggacactcggataacggaggacgatctgcaaaatgaggcgaagatcacggacatcatggagccagagcacgctctgctagccactagcatcttcaagttgacctatcagaacaaagtcgtccgggtgcagcgacccgccaagtccgggactgttatggacgtaatttcacgccgggatcagcgcggctccgggcaggtcggaacctacggcctgaacaccttcaccaacatggaagtccagttaatccgtcagatggagagcgaggggatcttccttcccagcgagctggagacgcccaacctggccgagcgagtactgaattggttggagaagcacggggtggagcgcctgaaacggatggccatttccggcgatgactgcgttgtgaagccgaccgacgacagatttgccaccgccttaaccgctttgaacgacatgggaaaggtgcggaaggacacgccgcagtgggagccctcgaagggttggaacgattggcagcaggtcccattctgttcacatcattttcatcaactgatcatgaaggacggccgcgagatcgtggtaccttgccggaatcaggacgagctcgtcggcagggcccgtgtgagccacggggcgggctggagcctgcgcgagaccgcctgcctgggcaagagctacgcgcagatgtggcagctgatgtacttccaccggagggacctgcggcttgccgccaacgccatctgctcggccgtaccggtcgattgggtaccaaccagcaggaccacctggtcgatccacgcccaccatcagtggatgaccaccgaggacatgttgagcgtgtggaaccgggtctggatcgaggaaaatccgtggatggaggacaagactcatgtgtcaagttgggaggacgtgccgtatctgggtaagcgagaggaccagtggtgcgggagcattatcggcttgaccgcccgggccacgtgggcgaccaacattcaggtcgccattaaccaggtccgccggctcataggcaacgagaactacctggactacatgacaagcatgaagcgctttaagaacgagtccgatccagagggggccctatggtga

SEQ ID NO: 23791 - RNA, 9879 nt, synthetic construct
  misc_feature 1..9879: note = derived and/or modified CDS sequence (opt11) from DENV-1__JQ922545__SS-prME
  source 1..9879: mol_type = other RNA
tcggtgaccatgctgttaatgctgctgccaaccgcattggcattccacctgactacccggggaggggagccacacatgatcgtcagcaagcaagagcggggcaagagcctactgttcaagacctctgctggggtgaacatgtgcaccctgatagcgatggacttgggcgagctttgtgaagacacaatgacctataagtgcccccgcatcacggaagccgagcccgacgacgtagattgctggtgcaacgcgaccgatacgtgggtgacatacgggacctgctctcaaaccggggaacatcggcgcgataaacgaagcgtcgctctagcgccacacgttggcctcgggctcgaaacgcgtaccgagacttggatgtcaagcgagggggcgtggcggcaaatccaaaaggtcgagacctgggccttacgccaccccgggttcacggtgatcgccttgttcttagcgcataccatcggtactagcattacccagaagggcatcatatttattctgttgatgactggggcccccatcatggccatgcggtgcgtgggcatcggcaaccgcgactttgtggagggtctcagcggcgctccctgggtggacgtagtcttagaacacgggagctgtttaagtaacatggcgaagaataagccgaccctggacatcgacttctttaagacagaggtcactaaccccgcagtgctgcgcaagctgtgcatcgaggctaaaatcagcaacacgaccacggattcccgctgccccacgcagggcgaggccacgctcgtggaggaacaggatgccaatttcgtgtgtcggcgcaccttcgtcgatcgcggatggggcaacgggtgcggcctgttcgggaagggctcattattaacgtgcgccaagttcaaatgcgtcacgaaactggagggcaagatcgtccagtacgagaatctaaagtactctgtgatcgtcaccgtccatacgggggaccagcaccaggtaggaaatgagactacagagcacgggacgatcgcgaccatcacgccgcaagccccgaccagcgaaatccaactgaccgactatggcgctctaacgttagactgttccccgcgcaccggactcgacttcaacgagatggtcttactgacaatgaaggagaagtcctggctcgttcataaacaatggttcctagatttacccttaccttggacatccggggccagcacgtcgcaggagacgtggaatcggcaagaccttcttgtcaccttcaagacggctcacgcgaagaaacaggaggtggttgttctcggctcacaggaaggggccatgcacacagcgttgacaggtgccaccgaaatccaaatgagcgggaccactaccatctttgccggccatttaaagtgtcgccttaagatggacaagttaacgttgaagggggtgagttacgtcatgtgcaccggtagcttcaagctcgagaaagaggtcgctgagacgcagcatggtactgtcctggtacaggtcaaatatgaaggaacggacgcgccctgcaaaatcccgttctccacccaggatgagaaaggcgtgactcagaacgggcggttgataaccgccaaccccattgtgactgacaaggagaagcccgtcaacatcgagaccgagcccccgtttggcgaaagctacattgttatcggcgcgggggaaaaggcgttgaagctctcctggttcaagaagggcagctccatagggaagatgttcgaggcgacggcccgtggcgcgcggcgcatggccatcctgggggacaccgcgtgggacttcggcagcattggcggtgtcttcacctcagtcggaaaactcgtgcaccaggtgttcggaaccgcgtatggcgtcttgttcagcggggtatcgtggacaatgaagatcggaatcggcattctgctgacgtggctcgggttaaacagcagatccaccagcctgtccatgacctgcatagcggtgggcatggtaacgctctacctgggcgtgatggtgcaggccgacagcggctgtgtcatcaattggaaagggcgggaattaaagtgcggctccggcatcttcgtgaccaacgaagtgcacacctggaccgaacagtataaatttcaggctgactctccgaagcgcctgagcgctgccatcggtaaggcttgggaagaaggtgtctgcggcatacggagtgccacgtgcctagagaacatcatgtggaagcaaatttcaaacgagctgaatcacatcctcctcgagaacgacatgaagtttaccgtggtggtcggcgacgccaacggaatcctgacccagggcaagaagatgatacgcccccagccaatggaacacaagtactcctggaagtcctggggcaaagcgaagatcatcggggccgacatccagaacacgacttttatcattgacggaccggatactccagaatgtccggatgatcagcgggcatggaacatctgggaagtggaggattacgggttcggtatatttaccaccaacatctggctcaagctccgcgactcctacacccaaatgtgcgatcaccggttgatgagcgccgcgatcaaagacagcaaagctgtgcacgcagacatgggctactggatcgagagcgagaagaacgagacctggaagctagctcgagcatccttcatcgaggtcaagacctgcatctggccccggagccacaccctttggagcaacggggtgcttgagagcgaaatgatcatcccgaaaatctacggcgggcccatctcccagcacaactaccgtcccggctatttcacccagaccgctgggccatggcacctcggcaagctggagcttgacttcgacctctgcgaggggaccacggtggtcgtggatgagcactgcgggaatcgaggacctagcctgcgcactacgaccgtgaccggcaagatcatccacgaatggtgctgccgatcgtgcaccctgcctcctctgcgcttcaaaggagaggacggatgctggtacggtatggagatccgtcctgtcaaggagaaggaggagaacctcgtgcgctcaatggtgtctgccggcagcggggaagttgattcattttccctgggactcctgtgcgtaagcattatgatcgaagaggttatgcgctcccgctggtcccggaagatgctaatgacgggcacgttggctgtcttctttttgctgataatggggcaacttacctggaatgacctgatacgtctgtgtattatggtgggggcgaacgtgtccgataggatgggcatgggtacaacgtacctagcccttatggccaccttcaagatgcgtccaatgttcgcggtagggttgttattcagacgtcttacctcgcgcgaggtgctcctcctgacgattgggctgtccctcgtggcctctgtcgaattgcctaacagcctggaggagctcggggatggactagccatgggcattatgatgctgaagctccttactgacttccagagccaccagctgtggaccaccctcctctccctgacctttattaaaacaacactctccctggactatgcctggaaaaccatcgcaatggttctgtccatcgtgagcctcttcccactgtgcctctccacaacgagtcagaagacaacctggctcccggttctcttggggtccttcgggtgcaagcctcttaccatgtttctgatcacggagaacaagatctgggggcgaaaatcttggcccctcaacgagggcatcatggccgtgggaatcgtctcgatcctcctgagctcactgctgaagaacgacgtccctttagccggcccactgattgcgggcgggatgctcattgcatgctacgttatctcagggtcttctgccgacctgagcctggagaaagccgcagaggtctcctgggaagaggaggcgcagcactctggggcatctcacaacatccttgtggaagtacaagacgacggcactatgaagattaaggacgaggagcgggacgacaccctgacaatattactgaaagccacgctcctggccgtcagcggggtgtaccccatgtccatccccgcgacgctctttgtgtggtatttctggcagaagaaaaagcagaggtcaggcgtgttatgggataccccctcaccgcccgaggtggagcgcgccgtactggacgacggtatctaccgaatcctccagcgcgggctgctgggacggtcccaggtcggggtaggcgtgtttcaagacggtgtctttcacaccatgtggcatgtgacccggggcgcggtgttaatgtaccaaggcaagcggctcgagcccagttgggctagcgtcaagaaggacctgatttcctacggcggcgggtggaggttccagggctcgtggaacaccggtgaagaggtccaagtgatagcggttgagcccggtaaaaaccctaagaatgtgcaaacgacccccggcacatttaagacgcccgagggggaggtgggcgccatcgccctggatttcaagccagggacatcaggcagcccgatcgtaaaccgcgaggggaagatcgtgggtctctacggcaacggggtggttaccacctccggcacgtacgtgtctgcgatcgcccaggccaaagctagccaagaggggcccctccctgagatagaagacgaagtattcaaaaagaggaacttaacaatcatggacctccaccctggctctgggaagacccggcgctacctgcccgccatagtccgggaggcgatcaagcgcaaacttcgcaccctcatactggccccgaccagagtcgtcgcctcggaaatggccgaagcgctgaaggggatgccaatccgctaccagacgacagctgtcaaatccgagcacaccggcagagagatcgtggacctcatgtgccacgccacctttactatgcgcctgctgagcccggttagggttccaaactacaatatgatcatcatggacgaagcacactttaccgaccctgcctcgatcgcagctagaggttacattagcacacgggtgggcatgggggaggccgcagccatattcatgacagcgacgcccccaggaagcgtagaggccttcccacaaagcaacgccgtgattcaagacgaggagcgggacattccagagcggtcctggaatagcggctacgactggatcacggacttcccagggaagacggtgtggttcgtgccttccatcaaatccggatccgacatagccacggtcctcgagaggtcacgcgaaccggtgatccaattgtcccgcaagactttcgacaccgagtaccagaagacaaagaacaacgattgggattacgtggtcacgaccgacataagtgagatgggcgctaacttccgggcagaccgcgtgatcgacccccggagatgcctgaagcccgtgatccctaaagacggcccagagcgggtgatattggccgggcccatgcccgtaacggtcgcctccgccgcccagcgccgaggccgaatcggcagaaaccaaaacaaagaaggggaccaatacatatacatgggccaaccgctaaataacgatgaagaccacgcccactggaccgaggccaagatgctgttggataacataaacacgcccgaagggatcatccccgctctgttcgagcccgagcgtgaaaaatcagccgcgatcgacggggagtatcgccttagaggggaggcgcgcaagacattcgtggaactgatgcggcgcggagacctgccggtgtggctgagctacaaggtcgcgagtgagggcttccagtacagcgacagacgatggtgctttgatggtgaacggaacaatcaggtgctcgaggaaaatatggacgtggagatctggacaaaggagggcgagaggaaaaagctgcggccccgctggctggacgcccgtacctactccgatccgcttgcactgcgcgagttcaaagagtttgcggccggtcgacgcagcgtcagcggggacctcatcctcgagatcgagaaactcccccagcacctcacgctccgggcccagaacgccctggacaacctggttatgttacacaacagcgagcaaggcggaaaagcataccgccacgcgatggaggagctgccagacaccatcgagacgctaatgctcctagctctgatagccgtgctcaccggcggcgtgaccttatttttcctgtccgggaagggtctgggaaagacgagcatcggccttctgtgcgtgatggcatccagcgtgctcctgtggatggcgtcagtagagccgcactggatcgctgccagcatcatcctggagttcatcctcatggtcctactgatcccggagccggaccgacagcgcacgcctcaggataaccagctcgcctacgtcgtaatagggctgctttttatgatcctcacggtagcagcgaatgagatgggcctgctggaaactacgaaaaaggacctagggatcggccacgttgtggcagagaaccaccatcacgcgaccatgctggacatcgatcttcaccctgcctccgcctggaccctctacgctgtggccacgacgataatcacacctatgatgcgtcacacaatagagaacacgacggctaacatatctctgaccgccatcgccaaccaggctgcaatactgatgggccttgacaagggctggccgatctccaagatggatattggagttccgttactggctttagggtgttactcacaagtcaatccactcaccctaaccgccgcggtgctcatgctcgtggcgcactacgccatcatcgggcccgggctacaagccaaggccacacgcgaggcgcagaaacggaccgccgcaggcatcatgaagaacccaaccgtcgacggcattgtggccatcgacctggaccctgttgtctacgacgctaagttcgaaaagcagctgggccaaatcatgctgctgatcctgtgcacctcccagattcttctcatgcgcactacgtgggcgctttgtgagagcatcacactggccacgggccctctcacaacgttatgggagggatcccctggaaaattctggaacaccaccatcgcagtcagcatggcaaacatattcagagggtcctacctagccggtgcgggcctcgcctttagcctgatgaaatcgctcgggggtgggcgtagagggacgggggcccaaggcgagaccctcggtgaaaagtggaagcggcaactgaaccagctgtccaaatctgagttcaacacgtacaagcgctccgggataatggaagtggaccgttcggaggccaaggaaggccttaagcgcggcgaaaccactaagcacgctgtctcccggggcaccgcgaaactgcgttggttcgtggaacggaaccttgttaagccagaggggaaggtcatcgacctcggatgcggtagaggcggctggtcctactattgtgcgggcctgaagaaagtcaccgaagtgaagggttacaccaagggcgggccaggacacgaggagcccatcccgatggctacgtatggctggaatctagtaaaacttcactccggaaaagacgtgttcttcacaccaccggagaaatgtgacaccctactttgtgacatcggcgaaagctccccgaatcccaccatcgaggagggccggactctgcgcgtgctaaagatggtcgaaccatggcttcgggggaaccagttctgcataaagatactgaacccctatatgcccagcgttgtggagacgctcgagcagatgcagcgtaaacacggtggcatgctcgtgaggaaccctctctcccgtaatagcacgcacgaaatgtactgggtgtcctgtgggacaggcaacatcgtgagcgccgtcaacatgacatcccggatgttactgaatcgcttcacgatggcgcaccggaaaccaacttatgagagagacgtggacttgggggcaggcacgcgccacgtagcagtcgagcccgagatcgcgaaccttgacatcatcggccaacgtatcgagaacatcaagatcgggcataagtccacgtggcattacgacgaagacaacccctacaaaacgtgggcctaccacggctcctacgaggttaagccctctgggtccgcgtcctccatggtgaacggtgtcgtgcggctactgacgaagccgtgggacgtaatacccatggtgacccagatagcgatgaccgacacgacccccttcggtcagcagcgggttttcaaggaaaaggtcgatactcgcaccccgcgacccaaacgcggtacggcccagattatggaggttaccgccaagtggatgtggggcttcctcttccggaaccggccgccccgcatatgcaccagggacgagttcgctagaaaggtgagatcttctaccgccaacggcgccgtcttcgtcgatgaaaatcagtggaactccgccaaggaagccgtggaagacgagcggttttgggacctggtccatcgagagagagagctgcataaacagggcaagtgcgcgacatgcgtgtataatatgatggggaagagagagaaaaagctaggtgagttcgggaaggcgaagggcagcagggccatttggtacatgtggctgggcgcccgcttcctggagttcgaagcattgggtttcatgaacgaggaccactggttctcccgggagaacagcctgtccggggtggagggggaaggtcttcacaagctcgggtacattttgcgcgacatctcaaagataccgggcgggaacatgtatgcggacgacaccgccgggtgggacacccgcattacggaggatgactctagcaacgaggccaagattatcgagctgatgcgtccggagcacgcactcctggccacgtccatctttaagctgaccttccagatctcagttgtgcgcgtccagcgtccagccaagagcggtaccgtcatggagtgcatcagcaggcgggaccagaagcgcagcggacaggtggggacctacggcctcaatacattcaccaacatggaggtgcagctcatccgtcagatggagagcgaaggtatcttttccccgagcgagatggaaaacagcaacctggccgaacgcgtcttagactggctcgagaagcatggagtggagcgactgaaacgcatggccataagcggggatgattgcgtggttaagccgactgacgatcggttcgcgaccgctctcacggcattgaacgacatgggaaaggtccgcaaagacatcccccagtgggagcccagcaaggggtggaatgactggcaacaggtcccgttctgttcccaccacttccaccagctcatcatgaaagacgggcgggagattgtggttccctgccgtaaccaggacgagttggtgggccgggcccgcgtatcacagggggcaggctggagtctgagggagacggcctgcttgggcaagtcctacgcacagatgtggcagctgatgtacttccaccgacgagacctgcgcctggcggccaacgccatatgctccgccgttcctgtagactgggtgcccacgtcgcggacgacttggtctatccacgcccatcaccaatggatgaccaccgaggacatgctcagcgtgtggaaccgggtctggatcgaagagaacccctggatggaggacaagacccacgtttcaagctgggaggacgtgccgtacttaggcaaacgcgaggaccagtggtgtgggtcccttatcggccttaccgcacgggccacgtgggccacgaacatccaagtagccatcaaccaagtccgccggctgatcggcaacgaaaactatcttgattatatgaccagcatgaagcgtttcaagaacgagtccgacccagagggagcgctgtggtag

SEQ ID NO: 23792 - RNA, 9879 nt, synthetic construct
  misc_feature 1..9879: note = derived and/or modified CDS sequence (opt11) from DENV-1__GU131887__SS-prME
  source 1..9879: mol_type = other RNA
agcgtgactatgttactcatgctgatgcccaccgcgcttgcctttcacctaactacccgcggcggggagccccacatgattgtgtcgaaacaggaacggggtaagagcttgctgttcaagacaagcgccggggtgaatatgtgcacactcatcgccatggacctcggagagctgtgcgaggacaccatgacctacaagtgcccccgcatcaccgaggccgagcccgacgacgtggactgttggtgcaacgccaccgatacgtgggttacatacgggacctgctcacaaactggcgagcaccggcgcgacaagcggtccgttgcgctcgctcctcacgttggtctggggctggagacgcgcaccgagacctggatgagctccgagggcgcctggaagcagatacagcgggtcgagacctgggccctccgtcacccggggttcacggtgatcgccctgttcctggcccacgccatcggaaccagcatcacccagaaggggatcattttcatattactgatgctggtcacgccctccatggccatgagatgcgtcggcatcggcagccgcgacttcgtggaggggctatccggcgccacgtgggttgacgtcgtactggagcatgggagctgcgtgacgacgatggccaaggataagcctaccctcgacatcgaactcctgaaaacggaggtaacgaacccagcgattctacggaagctctgcatcgaggcaaagatctccaacacgaccacggactcccgctgccccacccaaggagaggctaccctggtggaggagcaggacgcgaacttcgtctgccggcgcacgttcgtggaccgtggctgggggaacggatgcggactgttcggcaaggggtctctcataacgtgcgccaaattcaaatgcgtgaccaagctggagggcaagatagtgcagtacgagaacctgaaatactccgtaatcgtcacggtgcacacaggcgaccagcaccaggtagggaacgagtctacggagcacgggacaaccgcgacaataacgcctcaggcccccacgactgagatacagctcaccgattacggggccctgacgttggactgtagcccccgcacgggcctcgacttcaatgagatggtactgctgactatgaaggagaagagttggctcgtccataagcagtggttcctggatctgcccctcccctggaccagcggggccagcacctcccaagagacgtggaaccggcaggacctgctggtgaccttcaagacagcccacgcaaagaagcaggaggttgtcgtcctcggcagccaggagggcgccatgcataccgccctgacgggggccacggagatccaaaccagcggcaccacaacgatcttcgccgggcacctgaagtgccgccttaaaatggacaagctgaccctgaagggcatgagctacgtgatgtgcaccgggtcctttaagctcgagaaagaggtggcggagacgcagcacggcaccgtgttagtccagatccggtacgaaggcaccgacgccccctgcaagattcctttcagcacccaagacgagcgcggggtgacgcagaacggcaggctaatcaccgccaacccgatcgttacggacaaagagaagcccgtgaacatcgaagccgagccgcccttcggcgagtcctatattgtcattggcgccggggagaaggccttaaagctcagctggttcaagaagggctccagcattggcaagatgttcgaagccactgcgcgcggggctcgccggatggcgatcctgggtgacacggcatgggacttcgggagtattggcggcgtgtttaccagcgtagggaagctggtccaccagatcttcggcaccgcctatggagtcctcttttccggcgtatcctggaccatgaagatcgggatcggcgtcctgctgacgtggctagggctgaatagtcgctctacctccttttcaatgacctgcattgcggttgggctggtcaccctctacctgggcgtcatggtgcaggcggatagcggctgcgtgatcaactggaagggacgggaactgaaatgtgggtcaggtatcttcgtcacgaacgaggtgcacacctggaccgagcagtacaagttccaggcggacagccctaagcgtctctccgccgctatcggcaaggcctgggaggagggggtgtgcggcatccggagcgccacccggctggagaacatcatgtggaagcagatctcgaacgagttaaaccacatcctcctggaaaatgacatgaagttcacggtcgtggtgggagatgtggcgggtatcctggcccaggggaagaagatgatcaggccccagcccatggagtacaaatactcttggcgctcctggggcaaggctaagatcatcggcgccgacgtgcagaacacgaccttcataatcgacgggcccaacacacctgaatgccccgacgaccagcgggcctggaatatctgggaggttgaagactacggcttcggcatatttaccaccaacatctggctcaagctgagagacagctacacccaagtctgcgaccaccgcctgatgtccgccgccatcaaggacagcaaggccgtccacgccgacatggggtattggatcgagtccgagaagaatgagacctggaaactagctcgcgccagcttcatcgaggtgaagacatgcatatggccaaagtctcacacgctgtggagcaacggcgtcctggagagtgagatgatcatcccgaagatctacgggggtcctataagccagcataactaccgacccgggtactttactcagacggccggaccttggcatctggggaagttagagctggacttcgatctctgcgagggcaccacggtagtcgtcgacgagcactgcggcaaccgcgggccgagcctgcggacaaccaccgtgactggcaaaatcatccacgagtggtgttgtcgcagctgcaccctgccgcccctccggttccggggcgaggacggctgctggtacgggatggagatccgccccgtgaaggagaaggaggaaaacctagtcaagagtatggtcagcgccggctcgggggaggtagattccttcagcctggggttactgtgcatctccatcatgatcgaggaggtgatgcgcagccgttggtcccggaagatgctgatgaccggcactctcgccgtgttcttgctcctcatcatggggcaactgacgtggaacgacctcatcaggctgtgcatcatggtcggcgcgaacgccagtgaccggatggggatgggcactacctacctggccctgatggcgaccttcaagatgcgaccgatgttcgccgtagggctcctgttccggcgcctaacgtcccgggaggtgctcctcctcaccatagggttgtcccttgtggcgtccgtagagctgcccaacagcctcgaggagcttggcgacgggctggccatgggcatcatgatactcaagctgctgacagacttccagtcacatcagctctgggccaccctgctgtcactcacgtttatcaagaccaccttctccctacactatgcctggaagaccatggccatggttctgagcattgtctcacttttccccctgtgcctgagcacgacctcccagaagaccacatggctccccgtgctactgggctcactcgggtgcaagcccctaacgatgttcctcatcgccgaaaacaagatctggggtcgaagatcctggcccctcaacgagggtataatggcggtgggcatagtcagcattctgttaagctcccttctgaaaaatgacgtgccgttagccgggcccctcatcgccggcggcatgctgatcgcctgctacgtgatcagcggatccagcgccgacttgagtctcgagaaagcggccgaggtctcctgggaagaagaggccgagcatagtggcgcgagccacaacattctggtggaggtgcaggacgacggtaccatgaagatcaaggatgaggagcgcgacgacacgctgaccatcctcctaaaggctaccttgctcgcagtatcgggtgtctaccctctgtctattcccgccacgctgttcgtgtggtacttctggcagaagaagaagcagaggagtggggtactatgggacaccccttctccaccagaggttgagagggccgtgctagacgacggcatctaccggatcatgcaacgcggcctgctggggcggtcccaagtcggggttggggtgttccaggagaacgtattccacaccatgtggcacgtaacacgcggcgcggtgcttatgtaccagggaaagagacttgagcccagctgggccagtgtcaagaaggatctgatctcatacggcggtgggtggcgcctgcagggctcctggaacacgggggaagaagtccaagtgatagccgtcgagcctggaaagaaccccaagaacgttcagaccgcccccgggaccttcaaaacccccgagggcgaggtgggcgccatcgctctggacttcaagcccggtacatcaggctcccccatcgtcaaccgcgaggggaagatcgtggggttgtatggaaacggggtagtcaccaccagcgggacctacgtgtccgccatcgcacaggccaaggcttcccaggaagggcccctccctgagatcgaggacgaggttttcagaaagcggaacctgacaatcatggacctgcaccctggcagcgggaagaccaggcgctacctcccggccatcgtccgcgaagccatcaagcgcaagttgcggaccctgatcctcgcgcccacccgcgtggtggcttcggagatggcggaggctctgaagggaatgccaatccgatatcagacgacggccgttaagagcgaacacaccggcaaggagatcgtggacctgatgtgccacgccaccttcacgatgcgcttgctgtcccccgttcgcgttccgaactacaacatgatcatcatggacgaagcgcacttcaccgaccccagctcgatcgcggcacgcggctacattagtacccgggtgggcatgggtgaggccgccgccatcttcatgacagcgactccgcccggctccgtggaggccttcccgcagagcaacgccgtcatccaggacgaggagagggacatacccgagagatcctggaacagcgggtatgagtggataaccgactttcccggaaagaccgtgtggttcgtcccctccatcaagagtgggaacgatatcgccaactgcttacgtaagaacgggaagagagtcatccaactctcccgcaagaccttcgacacggagtaccagaagaccaaaaacaacgactgggactacgtggtgaccaccgacattagcgagatgggcgcaaactttcgggccgaccgcgtcatagacccgcgtcgctgcctgaaacccgttatattgaaggacgggcccgaacgggtgattcttgccgggcccatgcctgtcacggtggcttccgccgcgcagcgccgagggcgtatcggccgcaaccacaacaaggagggcgaccaatacatttacatggggcaacccctgaataacgacgaagaccatgcacattggacagaggccaagatgctgctcgacaatataaacacccctgaaggaatcatccctgccttgttcgagcctgagcgggagaagtccgccgcgatcgatggagagtaccgcctgcggggcgaagcccgcaaaactttcgtagaactcatgcggcgcggggacctgcccgtgtggctgtcctataaggtggccagtgagggttttcaatatagcgaccggcgctggtgtttcgacggcgaacggaacaaccaggtccttgaagaaaacatggacgtggagatctggactaaggagggggagcgtaaaaagttacggccccgctggcttgacgcccggacctattccgatcccctcgccctgcgcgagttcaaggagtttgcggccgggcgcagaagcgtgtccggagatctgatcctcgagatcggcaagctgccgcagcacctgactcagagagcccagaacgcactcgacaacctggttatgctgcacaatagcgaacaaggcggccgggcgtaccgacacgcgatggaagagctgcccgacaccatcgagaccctgatgttattggcccttatcgccgcactaaccggcggggtgaccctcttcttcttatccggccgcgggttaggcaagacatcaatcggcctcttatgtgtgatggcgtccagcgtgcttctatggatggcctcggtggaaccgcactggatagccgccagtatcatccttgagttctttctgatggtgttacttatccccgagccggaccggcaacggacgccccaagataaccagttagcttacgttgttatcgggctcctgttcatgattctgacggtggcggctaacgagatgggcctcctggagaccaccaagaaggacctaggcatcgggcacgtcgccgtgggaaatcaccatcacgccgccatgctcgatgtggacctgcaccccgcttccgcctggaccctatacgccgtggccacgaccataatcaccccgatgatgcgccatacaatcgaaaacacgaccgccaacataagcctcaccgcgatagccaatcaggccgctattctgatgggcctggacaagggttggcccatctccaagatggacattggggtgccgctcctggcgcttgggtgctacagtcaggttaatccgttgacgctgaccgccgccgtcctgatgctcgtcgcccattatgccatcatcgggccgggcctgcaggcgaaggccaccagggaggcccagaagaggactgccgccggtatcatgaagaaccccaccgtggacggcatcgtggcgatagaccttgaccccgtggtatatgacgccaagttcgagaaacagctcggccagattatgctgctaatcctttgcacgtcccagatcttactgatgcggaccacctgggccttatgtgagagcatcaccctggccaccgggccattaaccacactctgggagggctcgccgggtaagttctggaatacgaccattgccgtcagcatggcgaacatcttccgcggctcctatctggccggcgctgggctcgcgttcagcctcatgaagtccctaggtggggggcggcgcggcaccggtgcgcaaggcgagacactgggcgagaaatggaagcggcagctgaaccagctgtccaagtcagagttcaatacctataagaggtccggcatcatggaggtggaccggagtgaggctaaggaaggcttaaagcgcggtgagatcacgaaacacgcagtgtcccgggggactgccaagctccgctggttcgtcgagcggaatctggtcaagcccgagggcaaggtgatcgacctgggttgcggacgcggcgggtggagctactactgcgcaggcctgaagaaggttaccgaggtaaaaggatacaccaagggcggcccagggcacgaggagccaatcccgatggcgacgtacggctggaacttagtgaaactgcactccgggaaggacgtcttcttcgtcccgccggagaaatgcgacacgttactttgcgacatcggagagtcgtcccccaacccgacgatagaggagggccggaccctgcgcgtgctcaaaatggtcgaaccctggctccggggcaaccagttctgcatcaagattctgaacccctacatgcccagcgtggtggagacgctcgaacagatgcagcgcaagcacggcgggatgctcgtgagaaacccgctcagtcgaaacagcacccacgagatgtattgggtgtcctgtggcaccgggaacatcgtgagcgctgtcaacatgacctccagaatgctgctcaatcgattcaccatggctcacagaaagcctacgtacgagcgggacgtggacctgggagctggcactcgccacgtggccgtcgagcccgaggtggccaacctggacatcatcggtcagcggatcgagaacatcaagcacgagcacaagagcacctggcactatgacgaagacaacccgtacaagacgtgggcctaccacgggtcctacgaggtgaagccgagcgggagtgccagcagtatggtcaacggggtggtaaagctcctaacgaaaccctgggatgtgatccccatggtaacccagatcgccatgaccgacacaacgcctttcgggcagcagagggtcttcaaggagaaggtggataccaggaccccgaaagccaagcgcggaacggcgcagatcatggaggtcacggctaagtggctgtggggcttcctatctcggaacaagaagccccgcatatgtacccgggaggagtttaccagaaaggtccgatctaacgccgcgatcggagcggtgtttgtagacgagaaccagtggaactccgccaaggaggccgtcgaagacgagcgcttctgggatctggtgcaccgggaacgcgagctgcataaacagggtaaatgtgctacctgcgtatacaacatgatgggtaagcgggagaagaagctgggcgagtttgggaaggccaaggggagccgcgcgatttggtacatgtggctgggcgcccggttcctagaattcgaagccttagggttcatgaacgaggatcattggttctccagggagaacagtctgtccggtgtggaaggggaaggccttcacaagctcgggtacatcctgcgcgacattagcaagatccccggcggcaacatgtacgcggacgatacggccggatgggacacccggattaccgaggatgacctgcaaaacgaggcccgcatcaccgatatcatggagccggagcatgccctcctggccaagtccatcttcaagctcacttatcagaataaggtggtgcgggtccagcgccccgccaagaacggcacagtaatggacgtgattagccggcgcgaccagcgggggtccggccaggtcggcacctacggtctaaacaccttcacgaacatggaggctcagctaatccgccagatggagagcgagggcatattctcccccagcgagttggagacccccaacctcgcggagcgggtactggactggctggagaagtacggggtggagcgcctcaagcggatggccatctccggcgatgactgtgttgtgaaaccaatcgatgaccgctttgccaccgcgctcaccgcccttaacgatatgggcaaggtccggaaggacatcccccagtgggagcccagcaagggttggaacgactggcagcaggtccccttctgttcccaccacttccaccagctcattatgaaagacggtcgcgagatcgtagtaccgtgccgaaatcaagatgaactggttgggcgcgcgcgggtcagccagggcgccggttggagcctgcgtgagacggcctgcctcggcaagtcctacgcccagatgtggcagctgatgtacttccaccggcgcgatttgcgtctcgcggccaacgccatctgcagcgcagttcccgtcgattggatccccacctctagaaccacctggagcatccacgcccaccaccagtggatgacgacagaagacatgctgtcggtgtggaatcgggtttggatcgaggagaacccctggatggaagacaagacccacatcagctcctggggggacgtcccgtacctgggcaagcgggaagatcagtggtgcggcagcttaatcgggctgaccgcgagggccacgtgggccaccaacatccaggtggccataaaccaggtgcggcgcctaatcggcaacgagaattacctcgactacatgacctccatgaagcggttcaagaacgaaagcgaccccgaaggagccctgtggtga

SEQ ID NO: 23793 - RNA, 9879 nt, synthetic construct
  misc_feature 1..9879: note = derived and/or modified CDS sequence (opt11) from DENV-1__GU131888__SS-prME
  source 1..9879: mol_type = other RNA
agcgtcaccatgctgctcatgctgatgcccaccgccctggccttccacttaaccacccggggcggggaaccgcacatgatagttagcaagcaggagcggggtaagtctctgctgtttaagaccagcgcgggggtgaacatgtgcaccctcatcgccatggacctgggtgaactgtgcgaggacacaatgacgtacaagtgcccccgaatcaccgaggccgagcccgatgatgtggactgctggtgcaatgccaccgatacctgggtgacctatgggacatgtagccagaccggcgagcaccggcgcgacaagcggtccgtcgccctcgcgccacacgtgggcttggggctggaaacgcgcaccgagacctggatgagctccgagtccgcctggaagcagatacaacgggtcgagacctgggccctccggcaccctggcttcactgtgatcgccctgttcctggcgcacgcgatagggacctccattacccagaagggcatcatcttcatacttctaatgctggttacccccagcatggccatgcggtgcgtcggcatcggcagccgcgacttcgtcgagggcctctcgggcgccacgtgggttgacgtcgttctggagcacggctcctgtgtgaccacgatggccaaggacaagcccactctagacatcgagctcctgaaaacggaagtgaccaatcccgcgatactgcggaaactctgcatcgaggccaagattagcaacaccaccacggattccagatgccccacgcagggggaggccaccctggtggaggagcaggacgcaaatttcgtgtgccggcgcaccttcgtcgacaggggctggggcaacgggtgcggcctattcgggaagggcagcctcatcacgtgtgccaagttcaagtgcgtgaccaagctggaggggaaaatcgtgcaatacgaaaacttgaagtacagtgtcatcgtgaccgtgcacaccggcgaccagcaccaggttggcaatgagagcacggagcacgggaccactgcaaccatcacgccgcaggcccccacgaccgagatccagttgaccgactatggcgccctgaccctggattgcagcccccggacggggctagactttaacgagatggtgctgctgactatgaaggagaaatcatggctcgtccacaagcagtggtttctggacctgccgcttccctggactagcggcgcgtccacctctcaggaaacttggaaccggcaggacctgctggttactttcaagaccgcccacgcgaagaagcaggaggtggtagtgctcgggtcccaggagggcgccatgcacaccgccttaacaggcgccaccgagatacagacaagcgggactacgaccatcttcgccggccacctgaagtgtaggctcaagatggacaagctgaccctgaaggggatgtcctacgttatgtgcaccggctccttcaagctcgagaaggaggtcgcggagacgcagcatgggaccgtgctggtgcagatcaagtacgagggcaccgacgccccctgcaagatccctttcctgacccaagacgagaagggcgttacgcagaacgggcggctgatcaccgccaacccgatcgtaacggacaaggagaagcccgtaaacatcgaggccgagccacccttcggcgagtcctacattgtcatcggggctggcgaaaaggccctcaagctgtcgtggtttaagaaaggttccagcatcgggaagatgttcgaggccaccgcccgcggcgcgcggcgcatggcgatcttgggggacacagggtgggacttcggatccataggcggcgtgttcaccagcgtgggtaagctcgtccaccagatctttggcaccgcctatggagtgcttttctccggcgtctcttggaccatgaagatcggaatcggcgtattgcttacgtggctgggcttgaattcccgcagcacctcactcagcatgacctgtatagctgtggggctggtgaccctgtacttaggcgtcatggtacaggcggattccggctgcgtcatcaactggaagggccgggagctgaagtgcgggtcaggcatcttcgtcacgaatgaggtgcacacttggaccgagcagtacaagttccaggctgacagcccgaaacgcctgtccgcggccatcggcaaggcctgggaggagggggtgtgcggaatccggtctgccacccgcctcgaaaacatcatgtggaaacagatatccaacgaactgaaccatatcttactcgagaacgatatgaagttcaccgtcgtggtcggggacgtcgccggtatcctggcgcaggggaagaagatgatccggccccagcccatggagtataagtacagctggaaatcctggggtaaggccaagatcatcggcgccgacgtccagaacacaaccttcataatcgacggtcccaataccccggagtgccccgacgatcagcgggcttggaatatctgggaagtggaggactacggcttcgggatctttacaacgaacatctggttaaagctccgggatagctacacccaggtctgcgaccaccgccttatgtccgctgccataaaggacagcaaggccgtgcacgccgacatgggctactggattgagtccgagaagaacgagacatggaagctggcccgggcgagcttcatcgaggtgaagacgtgcatctggccaaagtcccacactctctggtcaaacggcgtcctggagtccgaaatgatcatccccaagatatacgggggcccgataagccagcacaattaccgccccggatacttcacacagaccgctggcccttggcacctggggaagctcgaactggacttcgacctatgtgagggcaccacggtggttgtagacgagcactgcggaaaccgggggccgagtctccgcaccaccaccgtgacgggcaagatcatacacgagtggtgctgtagaagctgcaccctaccgcccctgcggtttcgcggggaggacggctgctggtacgggatggagatccgccccgtgaaagagaaggaagaaaacctcgtcaagtccatggtgagcgccggcagcggcgaggtggactcctttagcctggggctgctctgcatctccatcatgatcgaggaggtcatgcggtctcgctggtcccgtaagatgctcatgaccggaacactggccgtgttcctccttctgatcatggggcaactcacgtggaacgacctgatacgcctgtgcattatggtgggcgcgaacgcgagcgaccgcatgggcatgggaaccacctacctcgccctgatggcaaccttcaagatgcgaccgatgttcgccgtagggctcctgttccgccgtctgacgtcccgggaggtgctgctcctgaccatcgggctgagcttggtggcctccgtagagctacccaacagccttgaggagttgggcgacgggctggcaatgggcatcatgatcctgaagctcctgaccgactttcagtcccaccagctgtgggccaccctcctgagtctgactttcatcaagaccaccttttccctccactacgcctggaagaccatggcaatggtgctgagcatcgtctccctgttccccctttgcctgagcactacctcacagaaaaccacctggctgcccgtgctccttggcagccttgggtgcaagccactcacgatgttcctgatcgcggagaacaagatctggggtagaagatcctggcccctaaacgaggggattatggccgtgggcatcgtgagcatcctcctgagctcgctcctcaagaacgacgtgcccttggctgggcccctcatcgccggcggcatgctcatcgcctgctatgttatcagcgggtccagcgcggacctgtctctggagaaggcagccgaagtcagctgggaggaggaggccgagcacagtggggccagccacaacatcctcgtggaggtgcaagacgacgggccgatgaaaatcaaggatgaggagcgggacgacacgctgaccatcttgctcaaggcgaccctcctggccgtctccggcgtataccccctcagcatccctgccaccctgtttgtgtggtacttctggcagaagaaaaaacagcgctccggggtcctgtgggacacgcctagcccgcccgaggtggagcgtgccgtgcttgacgacggcatctaccgcatcatgcagcggggcctactggggcgctcgcaggtgggcgtcggtgtgttccaggagaacgtcttccacaccatgtggcacgtgacccgaggtgccgtgctgatgtaccagggcaagcgcctcgagcccagctgggcgtcagtcaagaaggacctgatcagctatggcggaggctggcggctgcagggctcctggaacaccggggaggaggtccaggttattgccgtcgagcccggcaaaaacccgaagaacgtgcagacggcccccgggacctttaaaacccccgagggcgaggtgggcgccatcgccttagatttcaagccggggaccagcgggtccccgatcgtcaaccgagaagggaagatagtgggcctgtacggtaacggggtggttacgacaagtgggacctacgtaagcgcgatcgcccaggccaaggcctcacaagagggccccctgcccgagatcgaggacgaggtgttccggaagagaaacctcaccatcatggatctgcatccaggcagcgggaagacgcggcgatacctgcccgccattgtacgggaggccatcaagcgcaaactccgcacgctgatcctggcccccacccgggtggtagcgagtgagatggccgaggcgttgaagggcatgcctatccgctaccagaccacggccgtcaagagcgagcacactggtaaggagatcgtggacctgatgtgtcacgccaccttcaccatgcggctgctctcaccggtgcgcgtccccaactacaacatgatcatcatggacgaggcccatttcacggacccctcgtccatagccgcgcgggggtacatcagcacccgcgtgggcatgggcgaagccgcagccatttttatgaccgccacgccgcccggctccgtggaggctttccctcagagcaacgccctgatccaggacgaagagcgggacatccccgaacgctcctggaactcggggtatgagtggatcacggatttccccggcaagacggtatggtttgtgccctccattaagagcggcaacgacatcgccaactgtctgcgaaagaacgggaaacgagtgatccagctctcgagaaagaccttcgacaccgagtaccagaaaacgaagaacaacgactgggactacgtcgtgacaaccgacatcagcgagatgggcgccaacttccgcgcggaccgggtgattgacccgcgacgttgcctgaagccagtcatactaaaggatgggcctgagagggtgattctcgccggtccgatgcccgtgaccgttgcctccgccgcccagcggcgagggcggatcggccgcaaccacaacaaagagggcgaccagtacatttacatggggcagcccctgaacaacgacgaggatcacgcgcattggaccgaggccaaaatgctgctcgataacatcaacaccccagaaggcatcatcccggccctgtttgagcccgaacgcgagaagtccgccgccattgacggggagtaccggctgcgcggcgaagcgcggaagaccttcgtggagctcatgagacgcggggacctgccagtctggcttagttacaaagtagccagcgagggcttccagtactcagaccgccggtggtgtttcgacggcgagcgaaacaaccaggttctcgaggagaacatggacgttgagatctggaccaaggagggggagcggaagaagctgcgcccccgatggctggacgcccgcacgtactccgacccgctggccctacgggagttcaaggagttcgccgcgggccgccgttcggtgtcaggggacttgatactcgaaatcggtaagctgccccagcacctgacacaaagagcccagaacgccctcgacaacctggtgatgctgcacaacagcgagcagggcgggcgggcctaccggcatgcgatggaggagctccccgataccatcgagaccctgatgctgctcgccctgatcgccgtcctgacgggcggggtgacgctcttcttcctgtccggcagggggctgggcaaaaccagcattgggctcctgtgtgttatggcctcctcagtcctgctctggatggcctcggtggagccccattggatcgcggccagcatcatcctggaatttttcctgatggtgttactcatccctgagccggaccgccagcggacgccccaggacaaccagctggcatacgtcgtgatcgggctgttgttcatgatcctgaccgtggccgccaatgagatgggcttactcgagacgaccaagaaggacctggggataggccacgtcgcagtggggaaccaccaccatgccgccatgctcgacgtggacttgcacccggcctccgcctggaccctgtacgcggtcgccaccacgataatcacccccatgatgcgccacaccatcgagaataccacggccaacatcagcctcacagcaatcgcaaaccaggcggctattctgatgggcctggataaggggtggcccatctccaagatggacataggagtccccttgctggctctgggctgttacagccaggtgaacccgctcaccctgaccgcagccgttctgatgctcgtggcgcactatgccatcatcgggccaggcctgcaggctaaggccacgagggaggcccagaagcgtacagccgccggcatcatgaagaatcccaccgtggacggaatcgtcgccatcgacctggaccccgtggtgtacgacgccaagttcgaaaagcagctcggccagatcatgctgctgatcctctgcacctcccagatcctgctgatgcgcacgacctgggccctctgcgaaagtatcactctggccactgggcccctgacgaccctctgggagggctcccccggcaagttctggaacaccactatcgccgtcagcatggccaatatcttccggggatcttatctggccggggcagggttagctttctcgttgatgaagagtctgggtggcggccgccgggggacgggcgcccaaggagagactctgggggagaaatggaagcggcaactcaaccagctgtccaagagtgagtttaacacgtacaagcggagtggcatcatggaggttgaccgcagcgaggctaaggaggggctgaagcggggagagaccacgaagcatgcggtgtcccgggggaccgccaagcttcggtggttcgtcgagcgcaacttggttaagcccgagggcaaggtgattgatctgggctgcgggagaggcggttggagctactactgcgccggtctgaaaaaggtaaccgaggtgaaggggtacaccaagggcggacctgggcatgaggagcctatccctatggccacgtacggctggaacctcgtgaaattgcactccgggaaagacgtcttcttcatcccgccggagaagtgcgacactctgctctgtgacatcggcgagagctctccgaaccccaccattgaagaggggcgcaccctgcgggtcctgaagatggtggagccgtggctccgtggtaatcagttttgcattaagatcctgaacccctacatgcccagcgtcgtggagaccctcgagcagatgcagcgaaagcacggcgggatgctcgtgcgcaatcctctctcccggaacagcactcacgagatgtactgggtctcctgcggcaccggtaacatagtgagcgccgtgaacatgacctccagaatgttactcaaccggttcaccatggcacaccggaaacccacgtacgagagagacgttgacctgggcgccggtacgcggcacgttgccgtggagcccgaggtcgccaacctggacatcatcgggcagcgcattgagaacataaagcacgagcacaagagcacctggcactacgacgaggacaacccatacaagacctgggcctaccacggctcctacgaggtgaaaccaagcgggtccgcgagcagcatggtaaacggcgtcgtgaagctcctgacgaagccttgggacgtcatccccatggtaacccagattgccatgaccgacacaacgccgttcggacagcagcgggttttcaaggagaaggtcgatacccgaacccccaaggccaagcggggcaccgcccagatcatggaggtgacggctaagtggctgtggggtttcctctcgcgcaacaagaagcccaggatctgtacccgcgaggagttcacccgaaaagtgcgtagcaacgcggccatcggtgccgtcttcgtggacgagaaccagtggaattccgccaaggaggctgtcgaggacgagaggttctgggatctggttcaccgagaacgggagctgcataagcaggggaagtgcgctacctgcgtgtacaatatgatggggaagcgcgaaaagaagctcggcgagttcgggaaggccaagggcagcagagccatctggtacatgtggctgggcgcgcgcttccttgaattcgaggcgctcggtttcatgaacgaagaccactggttctcccgggaaaacagtctgtccggcgtggagggggagggcctacataagctcgggtacatcctgcgcgacatcagtaagattccgggaggcaatatgtacgccgacgatacggcagggtgggacacccgcatcaccgaggacgacctgcagaacgaggctcgcatcacggacatcatggagcccgagcacgccctcttagcgaagtccatcttcaagttgacctaccagaacaaggtcgtgagggtgcagcggcccgccaagaacggcaccgtcatggacgtgatctcccgcagggaccagcgtggttctggccaggtgggcacctacgggctcaatacgttcactaatatggaggcccagctgatccggcagatggagtccgagggcatcttctctcccagcgagttggagacccccaacttggcggagcgcgtcctggactggttggagaagtacggggtggagaggctgaagcgaatggccatctccggcgacgattgcgtggtcaagcccatcgacgacagatttgcgaccgccttgaccgcgctcaacgacatggggaaggtgcgcaaggatataccacagtgggagccaagtaagggctggaacgactggcagcaggtaccgttctgtagtcaccacttccaccagctcatcatgaaggacggccgggagatcgtcgtcccctgccgcaaccaggacgagctggtgggccgggcccgcgtcagccagggcgccgggtggagcctacgggagacggcatgcctgggcaagtcctacgcccagatgtggcaactgatgtacttccatcgacgcgacctgcgcttggccgcaaacgcgatctgcagcgccgtgcccgtagactggatccccacctcccggaccacatggagcatccacgcgcaccaccagtggatgacgaccgaggacatgctatctgtctggaaccgcgtgtggatcgaggaaaacccgtggatggaggacaagacccacatcagctcctggggggacgtgccctacctgggcaagagagaggaccagtggtgcggcagcctcatcggactgaccgcccgagccacgtgggcgaccaacatccaggtggctatcaaccaagtgcggcggctgatcggcaacgagaactatcttgactacatgacctccatgaaacgcttcaagaacgagtcggaccccgagggggccctgtggtga

SEQ ID NO: 23794 - RNA, 9879 nt, synthetic construct
  misc_feature 1..9879: note = derived and/or modified CDS sequence (opt11) from DENV-1__GU131892__SS-prME
  source 1..9879: mol_type = other RNA
tcagtgaccatgctgcttatgctgatgcccaccgcactggctttccaccttactacccgcggcggagaaccccatatgatcgtgagcaagcaagaaaggggcaagagcctgctgtttaagacctccgcgggtgtgaatatgtgcaccttgatcgccatggacctcggcgagctgtgcgaggatactatgacctacaagtgcccccggatcaccgaagctgagcccgacgacgtggactgctggtgcaacgcaacggacacttgggtgacctacgggacttgtagccaaaccggcgagcaccggcgcgacaaacgatccgtggccctcgctccccatgttggccttgggcttgagacgcggacggaaacctggatgagctctgagggtgcctggaagcagatacagcgcgtggagacttgggctctcaggcaccccggtttcacggtgatcgccctcttcttagcgcacgcaattggcaccagcatcactcagaagggtattatcttcatcctgctgatgctagtaaccccctcaatggccatgcggtgcgtgggaatagggagccgtgactttgtggagggattaagcggagcaacctgggttgacgtcgtgctggagcacgggtcttgcgtgacgacgatggccaaggataagcccaccctggacatcgagctactgaagacagaggtcaccaaccccgccatcctgcggaagctgtgcatcgaagcaaagatcagtaacaccaccacggacagccgctgtccgacccagggtgaggcgaccctggtggaggagcaagacgccaacttcgtgtgccggcgcacatttgtcgaccggggatgggggaacggctgcggtctgttcggtaagggatcccttatcacctgcgccaaattcaaatgtgtgaccaagctcgagggcaagatagtgcagtacgaaaacctgaagtatagcgtcatcgtgacagtgcacacgggtgaccagcaccaagtagggaatgaatccaccgaacatggtaccacagcgacaatcactccccaagccccaacgacggagatccagctcaccgactatggggcgctgacccttgactgcagtccccgtacgggtctagatttcaacgagatggtgctactgaccatgaaggagaagtcttggctcgttcataagcaatggtttttagacttaccactcccctggacctcgggggcctctacctcccaggagacgtggaaccgccaggacctgctggtgaccttcaaaaccgcgcacgcgaaaaagcaagaggtggtggtgctggggagccaggagggggccatgcatactgcccttacgggggccacggagatccaaacctccggcacgacgaccatcttcgccgggcatttgaagtgccgtctcaagatggacaagctgacactgaagggcatgagctacgttatgtgtacaggatccttcaagctcgagaaggaggtagcggagacgcagcacggcactgtactagtgcagatcaagtacgaggggacagatgcgccctgtaagatacccttttctacccaggacgagaagggtgtaacgcagaacgggagactgattaccgccaacccgatcgtgaccgacaaggagaagcctgtgaatattgaagccgagcctcccttcggggaatcctacatcgtaatcggagcgggcgagaaggcattaaagctctcctggttcaagaaagggtccagcatcgggaagatgttcgaggcaaccgcccgcggggccaggcgtatggcgatcctgggggacacagcctgggactttggctcgatcggcggcgtgttcacctccgtgggcaagctggtccaccagatcttcggcaccgcgtacggggtcttattctctggggtgtcatggacgatgaaaattggcattggcgtattactgacgtggcttggtctaaatagccgcagcaccagccttagcatgacctgcatcgccgttgggctcgtgaccctgtacctcggcgtcatggtgcaggccgactccggctgcgtgatcaattggaagggccgggagctcaaatgcgggagcggcatattcgttacgaacgaggtgcacacttggaccgagcagtacaagttccaggcggactcaccgaagcgcctgtccgccgccatcggcaaagcctgggaggagggggtatgtggcataagaagcgccacccggctggagaacatcatgtggaagcagatcagtaacgagctaaaccacatcctcctagagaacgatatgaagttcaccgtcgtggtcggagacgtcgcgggaattctagtgcaggggaagaagatgatcaggccccagcccatggagtacaagtacagctggaagtcgtggggcaaggccaaaataatcggcgccgacgtgcaaaatacgacgttcatcatcgatgggccgaacacccctgagtgccctgacgaccaacgcgcctggaatatctgggaggtggaagactacggcttcgggatcttcaccaccaacatctggctcaaattacgggactcatacacgcaggtgtgcgaccacaggttaatgtccgctgccatcaaggacagcaaggccgttcacgccgacatgggctactggatcgagtccgagaagaacgagacctggaagctggcgcgggcctctttcattgaagtcaaaacatgcatctggcccaagtcccatacgctttggtcgaatggcgtgctggagtccgagatgatcatacccaagatatatgggggtccgatttcgcagcacaactatcgccccgggtatttcacccagactgcaggcccctggcacttggggaagctggagctcgacttcgatctgtgcgaaggcactacagtcgtcgtcgacgaacactgcggaaatcgggggccgtccctgagaaccaccaccgtgacgggaaaaataattcacgagtggtgctgccggtcctgtaccctgccgcccctccgctttaggggagaggacggctgctggtacgggatggagatacgcccagtcaaggaaaaggaggagaacctggttaagtctatggtcagcgccgggtccggggaggtcgactccttttctttaggtctgttgtgcatctccatcatgatcgaagaggtgatgcgcagtcgctggtcccggaagatgctcatgacgggcaccctcgccgtgttcctgctgttgattatggggcaactaacctggaacgatctcattaggttatgcatcatggtcggcgccaacgcaagcgaccgcatgggcatgggcaccacgtacctggcgctcatggctaccttcaagatgcggccgatgttcgctgtggggctactgtttcggcgcctgacgagccgcgaggtgctgctgcttacaatcgggttgagtctggtcgccagtgtggagctccccaactcactggaagagctaggcgacgggcttgcgatggggatcatgatcctgaagctgttgaccgactttcaatcacatcagctttgggccaccctactctcattaacttttatcaagaccacattctccttacactacgcctggaagactatggccatggttctcagcatcgtttccctgttccccctatgcctctcaacgaccagccagaagaccacgtggctgccagtgctgctcggctcactggggtgcaagccgcttacgatgttcctcattgcggaaaataagatttggggtcgacgcagctggcccctgaatgaggggattatggccgtcgggatcgtgagcatcctgctcagctccctgctgaaaaacgacgtgcccttggccgggccattgatcgccgggggcatgctgatcgcctgctacgtcatttctgggtcaagcgcggacctctcactagagaaagctgccgaggtgagctgggaggaagaggccgagcactctggcgcctcccacaacatcctggtggaggtgcaggatgatgggaccatgaagattaaggacgaggaaagagacgacacccttaccatcctgctgaaggcgacacttttagcggtatccggcgtgtacccgctgagcatacccgccacactcttcgtgtggtacttctggcagaagaagaagcagagatccggggtgctctgggacaccccgagtccgccagaagtggagcgggccgtcctcgacgatggtatttaccgcatcatgcaacggggcctactggggcgctcccaggtgggagtgggggtctttcaagagaacgttttccacaccatgtggcatgtgacacggggcgccgttctgatgtatcaggggaagcgcctggagcctagctgggcatccgtgaaaaaggacctcatctcttacggtggtgggtggcggctacagggctcctggaacacgggagaggaagtgcaggtcatcgccgtcgaacccggcaagaacccaaaaaatgtgcagactgctccaggaaccttcaaaacgcccgaaggagaggtgggcgccattgccctggacttcaaacctggaacgagcggctctcccatcgtgaaccgcgaagggaaaatcgtaggcctttatggcaacggggtagtgaccacctcgggcacatacgtgagcgcgatcgcgcaggccaaggcctcgcaggaggggccgctgcccgagatagaggatgaggtcttccggaagcgcaacttaacaatcatggatctgcaccctggctctgggaagacccggcgctacctaccggcgatcgtgcgggaggcaataaaacgcaagttgcgcactctgatcctggctccaactagggtggtcgcctccgagatggccgaggcgctgaagggaatgccgatccgctaccagacgaccgccgtcaaaagcgagcacacaggaaaggagatcgtggatctcatgtgccatgccaccttcacgatgagactgctgtcaccggtccgggttccgaactacaacatgatcatcatggatgaagcacacttcacagaccccagctcgatcgccgcgcgggggtacatcagcacacgtgtcgggatgggggaggccgcagccatcttcatgaccgcaacgccccccggcagtgtcgaggcattcccgcagagcaacgcagtgatccaggatgaggaaagggacatcccagagcgctcatggaattcggggtacgagtggatcacagatttcccaggcaagaccgtctggttcgttccctccatcaagtctggaaatgacatcgcgaactgcttacgtaagaacgggaagcgcgtgatacagctgtcacggaagacgttcgacacggagtaccagaagacaaagaataacgactgggactacgtggtcaccaccgacatctcagaaatgggcgccaacttccgcgcggaccgtgtgatcgacccgcgccggtgcctgaagccagtgatcctcaaagatgggcctgagagagttattctcgcaggcccgatgccggttacggttgcttccgccgcgcagcggcgcgggaggattggccgcaatcacaataaggagggcgatcagtacatatacatggggcagccgctgaataatgatgaggaccatgcccactggaccgaagccaagatgctcctggacaacatcaacaccccggagggcattatccccgccctgttcgaaccggagcgcgaaaagagcgcggccatagacggcgagtaccggctccgcggcgaggcgcggaagaccttcgtggaattgatgcgccgcggtgacctgcccgtgtggctgtcatacaaagtcgctagcgagggcttccagtacagcgaccgccggtggtgcttcgacggagagcgcaacaaccaggtgttggaggagaatatggacgtggagatctggacgaaggagggggagcggaagaagcttcgcccccggtggctggatgccagaacctactccgaccccctcgcactacgggaattcaaagagttcgcggcgggccgccggagcgtctccggggacttgatcttagaaataggcaagctaccccaacacctcacccaacgcgcccagaacgcattagacaacctggtgatgcttcacaacagcgagcaggggggacgggcttatcgccacgcgatggaggagctgcccgacaccattgagacgctcatgctacttgctctgatcgccgtgttaactggcggggtcacgctattctttctgagcgggcggggactcggcaagaccagtattggcctgctgtgcgtgatggccagcagcgtactcctgtggatggctagcgtcgagccccattggatcgcggccagcataatcctggaattcttcctcatggtgttgttaattccggagccggaccgtcaacggacgccacaggacaaccagcttgcttacgtcgtcattgggctgctgttcatgatcctcacagtggcagccaacgagatgggtcttctggagaccacgaaaaaagacctagggattggccacgtggccgtcggaaaccaccaccacgccgcgatgttagacgtcgacctgcatccggcctcggcctggaccttatacgccgtggccacaactatcattacccctatgatgagacataccatcgagaatacaaccgcgaacatcagcctaaccgccatcgccaaccaggcggcaatcctgatgggcctcgataagggctggcccatctctaaaatggacatcggggtccccctgctcgcactcggatgctacagccaagtaaaccccctgactctgacagctgcggtgctcatgctggtcgcacactacgccataatagggccgggcctccaagccaaggccacccgcgaggcacagaagcggaccgcggccggtatcatgaaaaaccctactgttgatgggatcgtggccattgatcttgacccggtcgtgtatgatgctaaattcgagaagcaactgggccagataatgctgctcatcttgtgtacgtctcagatcctgttaatgaggactacctgggctttgtgtgaatcaatcaccttggcgacgggacccctcaccaccctgtgggagggcagtccgggaaaattctggaacacaacgatagccgtatccatggccaacatctttcggggtagttacttggcaggcgcggggctcgcttttagcctaatgaagtcgctaggtgggggcagacggggtaccggagcacagggcgagaccctcggcgagaagtggaagcgccagctgaaccagcttagtaaaagcgagttcaacacctacaagcggtccggcatcatggaggttgacagaagcgaagccaaggagggcctcaaacgaggcgagaccaccaagcacgcggtgtcccgcgggaccgccaagctcagatggtttgtggagcgcaacttggtgaagcctgagggcaaagtgatagacctgggctgtgggcggggaggctggagctactactgtgcgggcctcaagaaggtgacagaggtgaagggttacacgaaaggcggacccgggcatgaagagcccattcccatggcaacgtacgggtggaacctggtgaaactgcattcggggaaggatgtattcttcatcccacccgaaaagtgcgatacgctgttatgcgacatcggcgaaagctcacccaatccgaccattgaggagggccgcacgctgcgcgtcttgaagatggtggagccctggctgaggggcaaccagttctgcattaagattcttaatccctacatgcccagcgtggtggagacccttgagcagatgcaacggaagcacggtggcatgctggtgcgcaacccgctgtcccgcaactccacccacgagatgtactgggtgtcctgcggcaccgggaacatcgtcagtgcagtgaatatgacctcgcgaatgctactgaaccgcttcacgatggctcatcggaaacccacatatgagcgtgatgtcgacctgggcgccggcacgcggcacgtagccgtagagccagaggtagccaatttagatattattgggcaacgaatcgagaacatcaagcacgagcacaagagcacctggcactacgacgaagacaatccttataagacgtgggcctatcacggctcctacgaagtcaagccgtccgggtccgccagcagcatggtcaacggcgtcgttaaactcctgactaaaccttgggacgtgatcccaatggtcacccagatcgccatgacagacacgaccccatttgggcagcagagagtttttaaggagaaggtggacacccgcactccgaaggcaaaacggggcacagcccagatcatggaggtcaccgccaagtggctctggggcttcctgtccaggaacaagaagccacgtatctgtaccagggaggagttcactaggaaggtgcgctcaaacgcggctatcggtgcagttttcgtcgatgaaaaccagtggaactccgcaaaggaagcggtggaagatgagcggttttgggacctggtgcaccgcgagcgtgaactgcacaagcagggcaagtgcgccacttgtgtctacaacatgatggggaaacgcgaaaagaagttgggcgagtttgggaaggccaaaggctcgcgggcaatctggtacatgtggcttggtgcccgcttcctcgagtttgaggcgctgggattcatgaacgaggatcactggttcagtcgggagaatagcttgtccggtgtggagggggagggcctacacaaactggggtacatcctgagggatatcagcaaaatcccgggaggcaatatgtacgccgacgacaccgctggatgggacactcgaatcactgaggacgaccttcagaacgaagcccgcatcacggacataatggagccggagcacgccctgctggcgaagtctatcttcaagctcacctatcaaaacaaggtggtcagggtgcagcggcccgccaagaacggaaccgtgatggacgtcattagccgcagagaccagcgcgggagcgggcaggtcggcacgtatggcctcaatactttcacaaacatggaggcccagctgatcaggcagatggagagtgaggggattttttccccctcggaactcgagacccccaacctggcagaacgcgtattggattggttagagaaatacggggtcgagcggctgaagaggatggcaatttctggcgacgactgcgtcgtgaagccgatcgatgacagattcgcgaccgcactgacagcattaaacgacatggggaaagtacggaaggatataccccagtgggagccaagcaaagggtggaatgactggcagcaggtccctttctgctcccaccattttcaccagttaatcatgaaggacggccgggaaatcgtggtcccatgccgtaatcaggacgaactggtgggccgggcccgagtaagccaaggcgccgggtggagcctgcgggagaccgcatgcctgggcaagtcctacgcccagatgtggcagttgatgtactttcaccgcagggacctccgcctggctgccaatgccatctgtagcgccgttcccgtggattggattcccacctcccggaccacctggagtatccatgcgcaccaccaatggatgaccactgaggacatgctgtccgtgtggaaccgggtatggatagaagaaaatccgtggatggaggacaaaacccacattagctcgtggggtgatgtgccgtacttaggcaaaagggaggaccaatggtgtggcagcctaattgggcttacggcacgtgcaacctgggcgaccaacatacaggtagcaattaaccaggtccgacgcctcataggaaatgaaaactacctagactatatgacctccatgaagcgcttcaagaacgaaagcgacccggagggggccctgtggtga

SEQ ID NO: 23795 - RNA, 9879 nt, synthetic construct
  misc_feature 1..9879: note = derived and/or modified CDS sequence (opt11) from DENV-1__GU131893__SS-prME
  source 1..9879: mol_type = other RNA
agcgtaactatgctgttgatgttgatgcccaccgccctcgccttccacctcaccaccagaggaggggaaccccacatgatcgtttccaagcaggaacggggaaagtcactcttattcaagacgagtgccggggtgaacatgtgtacgcttatcgctatggacctgggggagctgtgcgaggatactatgacctacaagtgcccacggatcaccgaggcagagccagacgacgtcgactgctggtgcaacgccactgacacgtgggtcacctacggaacctgcagccagactggggagcaccggcgagataagcggtccgtggccctagcgccccatgtgggcctggggctggagacgcgcacagagacctggatgagctccgagggcgcctggaagcagatccagcgtgtcgagacgtgggccctccgccacccggggttcacggtgatcgccttgttcctggcgcacgccattggcaccagcatcactcagaaggggattatattcatcttgttaatgctggttaccccctccatggctatgagatgcgtaggcatcggcagccgcgacttcgtggaggggctcagtggcgccacgtgggtcgacgtcgtcttagagcatgggagctgcgtgaccactatggccaaggacaaacctactctggacatcgagctactgaagacggaggtcaccaaccccgcgatcctccgaaaactttgcatcgaggcaaagatttccaacaccacgacagactcacgatgtccgacgcagggtgaagccactctggtagaagaacaggacgcaaacttcgtgtgtcggcgcaccttcgtcgaccggggttgggggaatggctgcgggttgttcgggaaggggtccctgatgacttgtgccaagttcaagtgcgtgaccaaactggaagggaagatcgtgcagtacgagaaccttaaatacagtgttatcgtgacagtgcacaccggcgaccagcaccaagtcgggaacgaaagtacggagcacgggaccaccgcgaccatcaccccacaggcgccgacaaccgaaatccagctcaccgactacggggccctgaccttagactgcagcccccgcacgggcctagacttcaacgagatggtgctgctgaccatgaaggagaaatcttggctcgtccacaaacagtggttcctggacctgccgctaccctggaccagcggggccagcacttcgcaggagacctggaaccggcaggacttgctggtgacctttaagaccgctcacgcgaagaagcaagaggtggtagtactgggtagccaagagggcgccatgcacactgccttaacgggggccaccgagatccagacaagtggcaccacgaccatctttgccggccacctgaagtgcaggctcaagatggacaagctcaccctgaaaggtatgagttacgtcatgtgtaccgggagtttcaagttggaaaaggaagtcgcggagacgcaacacgggaccgtgctggttcagatcaagtacgagggcaccgacgccccctgcaagatccctttctccacccaggacgaaaagggtgccacacaaaacggccgtctgatcaccgccaacccgatcgtaaccgataaagagaaaccggtgaacattgaagcggagccgcccttcggggagagctacattgtgatcggagccggcgagaaagccctgaaactcagttggtttaagaagggctccagcatcggaaagatgttcgaggccactgcacgcggggcgcggcggatggcaatcctgggtgacacagcctgggacttcgggtccattggtggggtattcaccagcgtagggaaattggtacaccagatctttgggaccgcctacggggtcctgttctccggggtgtcctggacaatgaaaatcggcttgggcgtactcctcacgtggctaggcctgaactcccgaagcacctccctcagcatgacctgcatcgctgtagggctggtgaccctgtacctcggcgtgatggtgcaggcggacagtgggtgcgtcatcaactggaagggccgggaactgaagtgcgggtccggcatctttgtcacaaatgaggtgcacacgtggaccgaacagtacaagtttcaagcagacagcccgaagcgcctgtccgccgccataggtaaggcctgggaggagggggtctgcggtatccggtccgcgacgcgccttgagaacatcatgtggaagcagatctccaacgagctgaaccacatcctgcttgagaacgatatgaagttcacggtggtagtaggcgacgtggcaggaatactcgcccaagggaagaagatgatacggccccagcccatggagtacaaatacagctggaagtcctggggcaaggcgaagatcattggggcggacgtccagaacacgaccttcatcatcgacggtccgaacacccctgaatgccccgacgatcaacgcgcctggaacatctgggaggtggaggactacggatttgggattttcacaacgaatatctggctgaagctccgggacagccacacacaggtgtgcgaccatcgcctgatgagcgctgccatcaaggacagcaaggccgtgcacgcagacatgggctactggatcgagagtgagaagaacgagacctggaagctggcccgggccagcttcatcgaggtgaaaacctgcatatggcctaagtcccacaccttatggagcaacggagtgctggagtccgaaatgatcatccccaagatatatgggggccccatcagccagcacaactaccgccccggctatttcacccaaaccgccgggccctggcacctggggaagctcgaactggacttcgacttgtgtgagggcacgacggtagtcgtggacgaacactgcggcaacagagggccttccctccgcaccactactgttacgggcaagatcattcacgagtggtgctgtaggtcctgcacgcttcccccactgcgctttagaggagaggacggttgctggtacggaatggagatcagaccagtcaaggagaaagaggagaatctggtgaaatcaatggtcagcgcgggcagcggagaggtcgattccttcagcctgggcctgttgtgcatatctatcatgatcgaggaggtgatgcgcagccggtggtcacggaagatgctgatgacaggaaccctggccgtattcctcctgctgatcatgggacagctcacgtggaacgaccttatccgactgtgcatcatggtgggcgcaaacgcgagtgatcgcatggggatggggactacctacttagccctgatggccaccttcaagatgcggccaatgttcgccgttgggctcctcttccgccggcttacgtcgcgcgaggtcctactcttaacgatcggcctaagccttgtcgcatccgtggagctccccaacagtcttgaggagttaggcgacgggctggccatgggcatcatgatactgaagctccttacagacttccaatcccaccagctatgggcaaccctcctgtcgctgacgttcatcaagaccaccttctccctccactacgcgtggaagaccatggccatggtgttgtctatcgtgtctctgtttccgctctgcctgagcacgacctctcaaaagacgacctggttacccgtccttttaggctctctggggtgcaagccactcacaatgttcctgatcgccgagaacaagatctgggggcggagatcctggcccttaaacgaagggatcatggccgtgggcattgtgtcaatcctcctaagctccctcctcaagaacgacgtccccctggctggccccctgatcgcgggcggcatgctcattgcctgttacgtgattagcgggtcctctgccgacctatcattggagaaggccgcagaggtgtcctgggaggaagaagcggaacactccggtgccagccacaacatactcgtggaggtgcaggacgacgggaccatgaagatcaaggacgaggaacgggatgatacccttaccattctcctcaaagccaccctgcttgcagtgtccggcgtttacccgttatctattcccgccactctatttgtctggtacttttggcagaaaaagaagcaacgctctggggtgctctgggacacccccagcccgccagaggtcgagagggcggtgcttgacgacggaatctatcgcatcatgcagcgcggcctcctggggcgcagtcaggtgggcgttggcgtattccaggagaatgttttccacactatgtggcacgtaaccaggggcgccgtgctaatgtaccaaggaaagagactcgagccgagctgggcttccgtgaagaaggacctgatcagctacggtggcgggtggcgccttcaaggatcctggaacactggggaggaggtccaggtcatcgccgtggagcccggcaagaaccccaagaacgtccagaccgcccccggtacctttaagacccccgagggagaggtaggcgccatcgccctggattttaagcccgggacttcaggcagcccaatcgtgaaccgcgagggtaaaatagtaggcctgtatggcaacggcgtggtgaccacgtctggcacctacgtaagcgccattgcccaagcgaaggcctcccaagaggggcccctgcccgaaattgaggacgaggtgttccggaaacgcaacctcacgatcatggatctgcaccctggcagcgggaagactcggcggtatttgccagcaatcgtgcgtgaggccatcaaacgcaaactccgcaccttaatcctcgcacccacgcgggtcgtggcgtccgaaatggccgaggcgctcaagggcatgcccatccggtaccagaccaccgccgtcaaaagcgagcacaccggcaaagagatcgtcgacctgatgtgtcacgccaccttcaccatgcggcttctctcccccgtgcgagtgccaaactacaacatgatcatcatggacgaggcacacttcaccgatccaagctccatcgccgcccggggatacattagcacccgcgtcggaatgggggaagcggccgctatcttcatgacagcgacgcccccaggcagtgtggaggctttcccgcagagcaatgccgtaatccaggacgaggaacgggatatccccgagcgcagttggaacagcgggtacgaatggatcaccgacttccccggtaagaccgtctggttcgtgccatcaataaagtctggaaacgacatcgcgaactgcctgcggaagaacggcaaacgcgtcatccagctttccagaaaaaccttcgacacggaatatcagaaaaccaaaaataacgattgggactacgtggtgactaccgacatcagcgagatgggcgccaatttcagggccgaccgtgtgatcgacccgcgtcggtgtcttaagcccgtaatcctaaaagacgggcccgagcgcgtgattttggccggacccatgccggtaaccgtggcgtccgcggcgcaacggcgcgggagaatcggccgcagccacaacaaggaaggcgaccaatacatctacatggggcagcccctcaataacgacgaggaccacgcccactggaccgaagccaaaatgttgctggacaacatcaacactccggagggcataattcccgcgcttttcgagccggagcgcgagaaatcggcggccatagacggggaataccggttgcgcggcgaggcccggaagaccttcgtcgagctaatgcgccgaggggacttgcccgtctggcttagctacaaggtggccagcgaaggcttccaatactcggaccggcggtggtgttttgacggcgagcgcaacaaccaagtgctggaggagaacatggatgtcgaaatctggaccaaggagggggagaggaagaagctgcgcccccggtggctggacgcgagaacctacagcgaccccctggccttacgggagttcaaggaatttgcggcaggccgccgttccgtcagcggagatttaatcctggagatcggtaagctcccgcagcacctgactcaacgcgcgcagaatgcgctggataacctcgtcatgctgcacaactccgagcagggagggcgggcgtaccggcacgcgatggaggaacttcccgacaccattgagacgctcatgctgctggcactcatcgccgtcctgaccggcggggtgaccttattctttttaagcggccgaggtctcggcaagacaagcatcggcctgttatgcgtaatggcgagctccgttctgttatggatggccagcgtggagccccactggattgccgccagtatcatcctggagttcttcctgatggtcttgttaatcccggagccggaccgtcagcggacgcctcaggacaaccagctggcctacgtagtgatcgggctattgttcatgatcttgacggtggcggccaacgagatgggcctgctcgagaccaccaagaaagatttggggatcggccacgtcgccgtgggcaaccaccaccatgccgccatgctggatgtggacctccatccggcgagcgcctggacactgtacgccgtcgcaacaaccattatcaccccgatgatgcgtcacacaatcgagaacacgaccgccaacatcagtctcaccgcgatcgccaaccaagccgccatcctcatgggcctggataagggctggcccatcagtaagatggatatcggtgttcccctgctcgcgctgggctgctactcccaagtgaatcccctgaccctgacagccgccgtactaatgttagtggcccattacgccataatcgggcctgggcttcaggcgaaagccacgcgcgaggcccagaaaagaaccgcggcaggcatcatgaagaatcccaccgtggatggcatcgtcgccatcgacctagacccagtagtctacgatgccaagttcgagaagcagctaggccagataatgctcctgatcctgtgcacgtcccagatcctattaatgcgcacgacatgggccctgtgcgaatccatcaccttagccacgggtcccctgaccaccctgtgggaagggagtccgggaaaattctggaataccacgattgctgtctcgatggccaacatcttccgggggtcatacctcgccggcgccggattagccttctctctgatgaagtccctcggcgggggccgtcgggggaccggcgcccagggcgagaccttaggggagaagtggaagcgccagctgaaccagctctcgaagtccgagttcaacacctacaagcggagcggcatcatggaagtggaccgtagcgaggctaaagaggggctgaaacggggcgagacgaccaagcacgctgtcagccgcggaactgcaaagctgcggtggttcgtcgagagaaatctggtgaagcccgagggtaaggtgatcgacctgggctgcgggcgcggcggttggagctactattgcgccggcctgaaaaaggtcaccgaggtgaaggggtacacgaagggcggccccgggcacgaggagcccatcccaatggcgacatacggctggaacctggtcaaacttcacagcgggaaagacgtcttctttatcccacccgaaaagtgcgacacactgctgtgcgacatcggagagagttctccaaacccgaccattgaggagggacgaacgttacgggtactgaagatggtagaaccatggctgcggggtaaccagttctgcatcaagatcctcaacccttacatgccgtccgtcgtggaaacgttagaacagatgcagcggaagcacggtgggatgttagtgcgcaacccgcttagcagaaactccactcacgagatgtactgggtttcctgcggcaccgggaatatcgtgtccgcggtaaatatgacctcaagaatgctgctgaacagatttacgatggcccaccggaagcccacctacgaacgtgacgtcgacctcggcgcgggcaccagacacgttgccgttgagcccgaggtcgcgaacctggacatcatcggacagagaatcgagaacattaagcatgagcacaagtccacctggcactacgatgaagacaacccctacaaaacgtgggcctaccacggcagctacgaagtgaagccatccgggtcagcaagctcgatggtgaacggcgtcgttaagctgctcaccaagccctgggacgtcatccccatggtgacccagattgcgatgacagatacgacacccttcggtcagcagagggtgttcaaggagaaggtagacacacgcacaccgaaggccaagcggggcacggcgcagattatggaggtgaccgccaagtggctctgggggttcctgtcccgcaataaaaagccccgcatatgcacacgagaggagttcacccggaaggtgcgctccaacgcggccatcggggcagtcttcgtggacgaaaaccaatggaactcggcgaaggaagccgtagaggacgagcgattctgggacctcgtccaccgggagcgggagctgcacaagcaaggcaaatgcgccacgtgcgtatataacatgatggggaagagagagaagaagctgggggagttcggtaaagcgaagggctctcgggcgatctggtatatgtggttgggcgcccggttcctcgagttcgaagccttaggcttcatgaacgaagaccattggttcagccgggagaactccctcagcggcgtggagggtgagggcctgcacaaactagggtatatcctccgcgacatttccaagatccccggcggcaacatgtacgccgacgatacggccgggtgggatactcggattaccgaggacgatctgcaaaatgaagcgagaattacggacattatggagccagaacacgccctgctggccaagagcatcttcaagttgacctaccagaataaggtcgtcagagtgcagcggcccgccaaaaacggcaccgttatggacgtaatctcccgccgggaccagcgcgggagcggccaggtaggaacctacgggctgaacacgttcacaaacatggaggcccagctcatccggcagatggagtctgaaggcatcttcagcccctctgagctggagacgccaaatctggcggaacgtgtcctcgtttggttggagaagtacggggttgagcggttaaaaaggatggccatcagcggcgacgattgcgtcgtaaaaccgattgacgataggttcgccaccgccctcacggcgctgaacgatatggggaaggtgcgcaaggacatcccccagtgggagccctccaaaggctggaacgactggcagcaggtccctttctgcagccatcacttccaccagctgatcatgaaggacggccgtgagatagttgtgccgtgccgcaaccaggacgagttagtcgggcgggcgagagtaagtcagggcgccgggtggtccctgcgggagaccgcgtgcctgggtaagagttacgcccagatgtggcagcttatgtacttccaccgaagagacctacgcctggcggccaatgccatctgttccgccgtgcccgtcgactggatccccacctcgcggactacgtggtccatccacgcacaccaccagtggatgaccaccgaagacatgctcagcgtgtggaaccgcgtctggatcgaggaaaacccctggatggaggacaagacccacatttcatcgtggggcgacgtcccttacctgggcaaacgcgaggaccaatggtgtggctccctcatcgggctcaccgcgagagccacctgggccactaatatacaggtggctatcaaccaagtgcgaagactgatcggcaacgagaactacttagactatatgacctcaatgaaacgcttcaagaacgagagcgatcccgagggggctttgtggtga

SEQ ID NO: 23796 - RNA, 9879 nt, synthetic construct
  misc_feature 1..9879: note = derived and/or modified CDS sequence (opt11) from DENV-1__GU131894__SS-prME
  source 1..9879: mol_type = other RNA
agcgtcacaatgctactgatgttaatgccgaccgccctagccttccatctaacgaccagagggggagaaccccacatgatcgtgagcaaacaagaacgcggaaaaagcctactgttcaaaacctccgccggtgtaaatatgtgcaccttgatagcgatggacctcggtgaactgtgtgaagacacgatgacctacaaatgccccaggatcactgaagccgaaccagacgatgtcgattgctggtgcaacgctactgatacatgggtcacgtacggtacctgtagccagaccggagaacatcgacgagacaaacggtcagtggccctcgcaccacacgtaggactcggccttgaaacacgcaccgaaacctggatgagctcggaaggagcgtggaagcaaatccagagagtagaaacctgggctctacgacaccccggattcacagtaatagcactgtttttggcccacgcgatcggcacgtccatcacgcagaaaggtatcatattcatactactgatgcttgtaaccccgtcaatggctatgagatgcgtagggatcggatcgagggacttcgtggagggattgagtggtgcgacgtgggtagatgtagtactcgaacacggctcctgcgtgacgacaatggcgaaggacaagccgactctagacatagaactcctgaagacagaggtcacaaatccggcgatccttcggaagctatgcatagaagcgaaaattagcaacactactaccgattccagatgccccacacagggagaggcaactcttgtagaggaacaagacgcaaacttcgtttgcagacggaccttcgtcgatagaggatggggtaacgggtgcggcctcttcggtaagggcagcctgataacctgcgccaaatttaagtgtgttactaaactcgaaggaaaaatagtacagtacgaaaatctaaagtacagtgtcatcgtcaccgtacatacaggagaccaacaccaggtgggaaacgaatcaactgaacacggcaccaccgcaacgattacaccccaagcgccaactactgagatccaattaacagactatggagccctgactctcgactgttcaccaaggacagggttagacttcaacgaaatggtcttgctcacgatgaaagagaaaagttggctggtccataagcaatggttcctcgacttaccgctgccttggacgagtggtgcttccaccagccaggaaacctggaatagacaagatctcctagtgacgttcaaaaccgctcacgccaagaagcaagaggtggtcgtactcggcagccaggaaggtgcaatgcacacagcgctgacaggcgccacagaaattcaaacatcggggacaaccacaatctttgcgggccatttaaaatgtagactaaaaatggacaaattaaccctcaaaggaatgtcctacgtcatgtgcacaggcagctttaaattggaaaaagaagtggccgagacacaacacggtacggtgctggtacaaataaagtacgaggggacggacgcgccctgcaaaattccgtttagcacacaagacgagaaaggcgtgacgcaaaatggacgcctcatcacggcaaatccgatcgtaactgacaaagagaaacccgtaaatatagaagccgagccccctttcggggagagctatatagttatcggcgccggagaaaaagcgctcaaacttagctggttcaagaaggggtcaagtatcggcaaaatgttcgaagcgacggcacgaggggcaagacgcatggcgatattaggcgatactgcatgggactttggcagtataggaggcgtcttcaccagcgtaggtaagctagtacaccagatcttcgggacagcgtatggagtcctattctctggtgtatcttggactatgaagatcggcatcggcgtactcctcacctggctaggactaaatagtcgaagcactagcctctccatgacatgtatagcagtcggcctagtgaccctgtatctaggggtaatggtgcaggcagactcaggatgcgtaatcaattggaaagggcgggagttaaagtgtggctcaggaatcttcgtcaccaacgaggtccacacatggaccgagcagtacaaattccaggccgactctccaaagcgcctcagcgcagcgatcggtaaagcctgggaagagggggtgtgcggcatccgaagtgccacgcgcctcgaaaacatcatgtggaagcaaatatcaaacgagctaaatcacatcttactcgagaacgacatgaaattcactgtcgtcgtaggagacgtagcaggaatattggcccagggcaagaaaatgatacgaccccagccaatggaatacaaatattcatggaaatcctggggcaaagccaaaataatcggagcggacgttcaaaacacgacgttcataatagacggccccaacaccccagaatgcccagatgaccagcgggcatggaacatctgggaggtcgaggactatggctttggaatattcacaaccaacatctggctaaaacttcgagactcctacacccaagtatgcgatcaccgccttatgagcgccgccattaaagactccaaagctgtccacgcggacatggggtactggatcgagagtgagaagaacgagacatggaagctagcacgagcctctttcatagaagtcaaaacctgcatctggcccaagtcacatacactgtggagtaacggcgtactagaatcagagatgatcataccaaaaatatacgggggcccaatatctcaacacaactaccgcccgggctacttcacccaaacggcagggccttggcacctaggaaaactggaacttgactttgacctgtgcgaaggaaccacggtagtcgtcgatgaacattgcggcaaccgaggcccatcgctcaggacaacaacagtcacaggcaaaataatccacgagtggtgctgtagaagctgcacgctacccccgctccgcttccggggagaagacggctgctggtacggcatggaaatccggccagtaaaggaaaaagaggaaaacttagtgaagtccatggtgtcagcggggagtggggaagttgactcgttctcacttggactactatgtataagtatcatgatagaagaggtgatgcggtcccgctggtcacgaaagatgctcatgactggaacactcgcagtttttcttctgcttatcatgggacaactaacgtggaacgacctcattagactttgtataatggtaggggctaatgcgtcagacaggatgggcatggggactacatacctagcactaatggcaacctttaaaatgcggcccatgttcgcggtaggactactatttcgcaggctcacctcacgcgaagttttactactaacaatcggcctaagcctggtagcgtcagttgaactcccaaacagcctagaggaattaggggacggcctagccatgggcatcatgatcctgaagctactcacggatttccagagccaccagctgtgggctacgctcctctccctgaccttcataaagaccacgttctcgctgcactatgcgtggaagaccatggccatggttctcagcatcgtgtcactattcccactgtgccttagtacgacctcgcagaaaactacatggttgccggtcctcctcggcagcttaggttgtaaaccgctaacgatgttcctgatagcggaaaacaaaatctggggacgtcggtcctggcccctcaacgaggggataatggcggttggtatcgtaagcatactgctaagttccctactcaaaaatgacgtacccctggccgggcccctgatagcaggcggaatgctgatagcctgctacgtaataagtgggagcagtgcagatctatctctagaaaaagccgcagaggtttcatgggaagaggaggcagaacactctggagcaagccataacatcctcgtggaagtacaagacgacgggactatgaagattaaagacgaggaacgcgacgacaccctgacaatcctactcaaagcaacgctactggcggtttcgggtgtatatccactcagcatccccgcgactctgtttgtctggtacttctggcagaaaaagaaacaacgctccggggtcctctgggacactccaagccctccggaagtagaaagggctgtcctagatgacggcatatacagaataatgcaacgaggcctactcggcagaagccaggtaggcgtaggcgttttccaggaaaacgtattccacaccatgtggcacgtgacacgcggagcagttctaatgtatcaaggcaaacggctggagccgtcatgggcctccgtcaagaaagatctcataagttacggcggagggtggagacttcaaggctcatggaacaccggagaagaggtacaggtcatcgccgtggagccgggaaagaaccccaagaacgtgcaaaccgctcccggcacattcaaaacacccgaaggcgaagtaggggccatagcgttggacttcaaacccggcacctcgggatccccgattgtaaaccgagaggggaaaatcgttggcctctacggtaatggagtggtgactacaagtggcacctacgtatctgccatcgcccaggccaaggctagccaggaaggccctcttccggaaattgaggacgaagtattccgaaaaagaaacctaactattatggacctccacccaggctccggcaagacgcggcgatacctcccagccatagtgcgggaggcaattaaaagaaagctcagaacactcatcctcgccccgacaagggtcgtcgcgtccgaaatggcagaagcgttaaaaggaatgccgatccgataccaaacgacagcggtcaaatccgagcacacgggaaaagaaatagtagacctcatgtgtcatgccacatttaccatgcgtctactatcaccagtaagagtcccaaattacaacatgataataatggatgaagcccacttcacagacccgtcgagcatagcagctcgcggatacataagtacacgcgtaggcatgggagaagcggcggcaatattcatgactgccacacctcccggctcagtcgaagcgttcccccaaagcaacgctgtcatccaggacgaggaacgggacatacccgaaaggagttggaactccggatacgagtggatcaccgacttccccggcaagaccgtgtggttcgttccatcaattaagagcggaaacgacatagcaaactgcctgcgcaaaaatgggaaaagggtcatacaactaagcagaaaaacattcgacaccgaataccaaaagaccaagaacaacgactgggattacgtagtcaccacggatattagcgagatgggagctaacttccgggcggatagagtaatcgacccaagaaggtgccttaagcctgtaatcctcaaggatgggcccgagcgggtaattctagcagggccgatgccggtaacagtcgcctcggcggcacaacgccgtgggaggatcgggagaaaccacaataaggaaggagaccagtacatttacatgggccaaccgctgaacaatgacgaagaccacgcccactggacagaggccaaaatgttgttggacaacataaacaccccagaggggatcatacccgccctattcgagcccgaacgggaaaagtcagcggcaattgacggcgaataccgactcaggggagaggcaagaaaaacattcgtagaactcatgaggcgaggagaccttccagtctggctgtcgtacaaagtcgccagcgaaggatttcaatacagcgaccgacggtggtgtttcgacggcgagcggaataaccaggtcctagaagagaacatggacgtggaaatatggacaaaggaaggagagcgcaagaaactccgaccacgatggttggatgctaggacctactccgacccgctggcgctcagagagttcaaagagttcgccgcgggccggcggagcgtaagcggagacttaattctggaaatcggaaaactaccccaacacctaacacagcgcgctcaaaacgccctagacaacctggtcatgctgcacaactccgaacaaggagggcgagcataccgtcatgcgatggaggaacttccagatactatagagacactcatgctgctcgcgctgatcgctgtcctcacagggggagtgacgctattcttcctcagcggcagagggctaggcaaaacaagcatagggttactttgtgtaatggcaagcagcgtcctactgtggatggcttctgtggagccacattggatcgcagcgtcgataatactggaatttttcctcatggtattgctaataccggagcccgacaggcaaagaaccccacaggataaccaactggcatatgtagttatcggactcctcttcatgatcctcactgtcgcggcaaacgagatgggcttgctagagacgactaagaaggatttgggtattgggcacgtagccgttggcaaccaccaccatgccgcaatgctagatgtagacctccaccccgcatccgcatggaccctgtacgccgtggctaccacgataataactcctatgatgcgtcataccatcgaaaataccacagcgaatatatcactgacagccatagccaaccaggcggccatactgatgggcttggacaagggatggcccatcagcaaaatggatatcggtgtccccctgctggcgttagggtgctattctcaggtcaatccgctaacactaacggcggcagtcctcatgctggtggcgcactacgccatcatcggaccaggactccaagcaaaggcgaccagagaagcccaaaaacggacagcagctggcataatgaagaacccgacagtcgatggaatagtggcaatagatttagaccccgttgtatacgatgcaaagttcgagaaacaactcggccaaataatgctcttgatactatgcacgagccagatactcttgatgaggaccacctgggctttgtgtgaatcaataacgctcgcaacggggccgctcacaacgctctgggaaggatcaccaggcaaattctggaacacaaccatcgcagtctccatggcgaacatcttccgaggatcatacctcgctggagccggactagcattcagcctgatgaaaagcctgggcggcggcaggcggggcaccggagcacagggagaaacgctgggcgagaagtggaagcgccaattaaaccaattaagcaaatcagagttcaacacctacaaacgaagcggcataatggaagtggataggagcgaagcaaaagaaggactaaagagaggcgagaccaccaaacacgccgtgagtcgaggaacggcaaagctgaggtggttcgtagagagaaacctggtgaaacccgagggcaaagtaatagatctaggctgcgggagaggaggctggagttactactgcgcaggacttaagaaagtcacggaagtcaaaggctatacaaaaggcggaccgggacacgaagaacctataccaatggccacttacgggtggaaccttgtaaaattgcacagcggcaaagacgtattcttcataccgccagaaaaatgcgacactctcctgtgcgacatcggagaaagctcccccaacccgactatagaggaaggacgaacattacgcgtgcttaagatggtagagccgtggctccgcggaaatcagttctgcatcaaaatactgaacccatatatgccctcggtagtcgaaaccctcgaacaaatgcagaggaaacacggcggaatgctggtccgcaaccccttgtcgaggaatagcacacatgagatgtattgggtctcctgcgggaccgggaacatcgtttctgcagtcaatatgactagcagaatgcttttaaatcgatttaccatggcacacaggaaaccgacttatgaacgcgacgttgacctcggggcgggcacgcgtcacgttgctgtggagcccgaagtggctaacctagatatcatagggcaacgcatcgaaaacataaagcacgaacacaaatccacctggcattatgatgaagataacccatacaagacgtgggcttaccatggatcatatgaagtcaaacctagcggatcagcgagttcaatggtcaacggcgtggtgaaactactcacgaagccgtgggacgtaatcccaatggtaacccagattgcaatgaccgataccacccctttcggccagcagagagtatttaaagaaaaggtggatacacgaacgccgaaagcaaaaaggggaacagcgcaaattatggaagttacggcgaagtggttatgggggtttctgagtcggaacaagaaaccgcgcatatgcacaagggaggagttcaccagaaaggtacgaagtaacgccgcaattggcgctgtctttgtcgatgagaaccaatggaacagcgcaaaagaagcggtcgaagatgagcgcttctgggatctcgttcataaagagcgggagcttcacaaacaagggaagtgcgcgacctgcgtatacaacatgatgggaaagagggagaagaaacttggggagttcggaaaggctaagggatcacgagcaatttggtatatgtggctcggcgcgcgatttctagagttcgaagccctgggattcatgaacgaagatcattggttttcgcgcgaaaattcactgtctggagttgaaggcgagggcttacacaaactaggttacattctgcgtgatatctccaagatccctgggggcaatatgtacgccgacgatacagcaggatgggatacccgaattacagaggacgatctgcaaaatgaagctaggataacagatatcatggagccggagcatgccctactagctaaatccatctttaaactcacttaccagaataaagtcgtaagagtacagagacccgcaaagaacggcacggtaatggatgtgatatcgcgcagagaccaacgcggatcagggcaagtgggaacgtacggcctcaatacctttacaaatatggaggcacagttaattcgacagatggagtcggaaggaatattcagtccatcagagctagaaacgcctaacctcgccgaacgagtacttgactggctagaaaaatatggagtcgaacgtttaaaacggatggcaatatccggagatgactgtgtagtaaaaccaatagacgaccgctttgccaccgcccttacagcgctcaacgacatgggtaaggtgcgaaaggatataccacaatgggagcccagcaaaggttggaacgactggcagcaggtcccattctgcagtcaccatttccaccaactgatcatgaaagacggacgggagatcgttgtcccctgcaggaaccaggacgaactcgtcggacgggcacgcgtcagccaaggggcaggttggagcctcagggagacagcctgcctaggaaaaagctatgcccaaatgtggcaactaatgtattttcaccgtcgcgacctacgactcgctgcaaacgcaatatgtagtgccgtaccagtggactggacaccaacgtcgcgaacgacatggagtattcacgcacatcatcagtggatgaccaccgaggatatgctatccgtgtggaatagggtctggattgaagaaaacccgtggatggaagacaaaacccatatctcaagctggggagacgttccatacctcggtaaacgagaagaccagtggtgcggctcgctaataggcttgactgcccgcgcgacgtgggcgaccaacatccaagtcgcgatcaatcaggttcgccgtttaatagggaacgaaaattatctggactacatgacatcaatgaaacgtttcaaaaacgagtccgacccagaaggcgccctgtggtaa

SEQ ID NO: 23797 - RNA, 9879 nt, synthetic construct
  misc_feature 1..9879: note = derived and/or modified CDS sequence (opt11) from DENV-1__GU131895__SS-prME
  source 1..9879: mol_type = other RNA
agcgtaaccatgttactcatgctcatgcccactgccctggccttccatctcaccacccggggcggggaaccccacatgatcgtgtccaagcaggagcgtggcaagagcctgctgttcaagaccagcgccggggtgaacatgtgcacactcatcgctatggacctaggcgagctgtgcgaggataccatgacgtacaagtgcccccggattaccgaggccgaacccgatgacgtggactgctggtgtaacgccaccgacacctgggtgacatatgggacctgcagccagaccggcgagcaccggcgcgacaagcggtccgtggcactcgctccccacgttggcctcgggctggagacgcggacggagacctggatgagctccgagggcgcttggaagcagatccagcgggtcgagacctgggccttgcgccaccccgggttcacggtgatcgccctgttcctggcgcacgccataggcacaagcataacccagaagggcataatattcattctcctgatgttggtgaccccctcgatggctatgcggtgcgtcggcatcggcagcagagacttcgtcgaggggctctccggcgccacctgggtggatgtcgtcctggaacacgggagctgcgttaccactatggccaaggacaagcccactctggacatcgagctcctgaagactgaggtcaccaatcccgcgatcctaaggaagctctgtatcgaggcaaaaatctccaacacaaccacggactcgcgctgcccgacgcagggcgaggccaccctggtggaggaacaggacgcgaacttcgtgtgccggcgtacattcgtcgaccgggggtggggaaacggctgtgggctgttcggtaaggggagcctcatcacctgcgccaaattcaagtgtgtgacgaagctggaggggaaaatcgtgcagtacgagaacctgaagtatagcgtcatcgttaccgtacacaccggcgaccagcaccaggtaggtaacgagtccacggagcacggtaccaccgcgaccatcacgccccaggcccccaccacagagatccagctcaccgactatggagccctgaccctggactgttccccccgcacgggcctcgacttcaacgagatggtgctgctgaccatgaaggaaaagtcatggcttgtccataagcagtggttccttgacttacccctgccgtggacctctggagccagcacctcccaggaaacgtggaaccgccaggacctgctcgtgaccttcaaaaccgcccacgcgaagaagcaagaggtggtagtgctcgggagccaggagggggccatgcacaccgccctgacaggggcaacggagatccagacctccggcaccactaccatattcgccgggcacctgaaatgccgactcaagatggacaagcttgcgctgaagggcatgagctacgtgatgtgcaccggttcattcaagctagagaaggaggtggcggagacccaacacggaaccgtgctggtacaaatcaagtacgagggcaccgatgcaccctgtaagatcccctttagcacccaggacgagaagggggtaacccaaaacggcaggctgatcacagccaacccgatcgtgacggacaaggaaaagcccgtgaacatcgaggcggagccaccgttcggggagtcctatatcgtgatcggcgccggcgagaaggctcttaagttgagctggttcaaaaagggttccagcatcggtaaaatgtttgaagcaaccgcacgcggggcgcggcgcatggccattctgggcgacaccgcttgggatttcgggagtatcggcggcgtgttcacgagcgttggaaagctggtccaccagatcttcggcaccgcttacggggtactcttcagtggcgtgagctggaccatgaagatcgggatcggcgtccttctgacatggttgggcctgaactcccgaagcacaagcttgagcatgacctgcatcgccgtggggctcgtgaccctgtatctgggagtcatggtgcaggcggactccgggtgcgttatcaactggaagggccgagagttgaagtgcggaagcggcatctttgtcaccaacgaggtgcacacttggacagagcagtacaaattccaggctgacagcccgaagcgcctgtcagccgccatcggcaaggcctgggaggaaggggtctgcgggatccggagcgcgacgcgcctggagaacattatgtggaagcagatttcgaacgagctcaaccatattctgctggagaacgacatgaagtttaccgtggtggtcggggacgtggccgggatcctcgcgcaggggaagaagatgattcggccccagcctatggagtacaagtacagctggaagtcatggggcaaagccaagatcatcggagcggacgttcagaacaccacgttcattattgacgggcccaacaccccggagtgcccagacgaccagagagcctggaacatctgggaggtggaagactatggtttcgggatcttcaccaccaacatctggctgaagctccgggacagctatacgcaagtctgcgaccaccgccttatgtccgccgccatcaaagacagcaaggccgtgcacgcggacatggggtattggattgagtccgagaaaaacgagacctggaaacttgcccgggccagcttcatcgaggttaagacctgcatctggcccaaaagtcacaccttgtggagcaacggcgtattggagtccgagatgatcatccccaagatatacgggggcccgatcagccagcacaactaccgccccgggtacttcacgcagactgcaggcccgtggcatctggggaagctggagctcgacttcgacctatgcgagggcactaccgtggtggtcgacgagcactgcggcaaccgggggccgagtctgcgcacgaccaccgtgactggaaagatcatccacgagtggtgctgccggagctgcacgctgcctcccctcaggttccgcggggaagatggctgctggtacgggatggagatccgcccagtgaaggagaaggaggagaacctagtcaagtccatggtgtctgccggcagcggtgaggtggactccttctccctcgggctgctgtgcatctccatcatgatcgaggaggtcatgcgcagccgctggtcccggaagatgctcatgacgggcaccctggcggtgttcctgctcctgataatggggcagctgacctggaacgacctcatccgcctgtgcataatggtgggagcgaacgccagcgatcgcatggggatgggcacgacttacctggccttgatggccaccttcaagatgcggccgatgttcgcggtcggactgctcttccgccgcctcacctcccgcgaggtgctgctgttaacgatcggactgtccctggtggcctccgtagaactccccaatagcttggaggagctgggcgatgggcttgctatgggcatcatgatcctgaagttgctcaccgactttcagtcccatcagctgtgggccacgttgttaagtctgaccttcatcaagacgaccttctccctacactacgcgtggaagacaatggccatggtgctgtctatagtttcgctgttccccctgtgcctaagcaccacttcgcagaaaactacttggctgccagtgctgctcggcagcctggggtgcaagccgctgaccatgttcctcatcgccgagaacaagatatggggccggcgctcctggcccctgaacgaggggataatggccgtgggcatcgtcagcatcttactcagctcccttctgaagaacgatgtgcccctagccgggcctctgatcgcgggcggcatgctgatcgcctgctacgtgatctccggatcctcggccgacctctccctggagaaggccgccgaggtcagctgggaggaggaggcggagcactcaggcgccagccataacatcctggtggaggtgcaggacgacgggacgatgaagatcaaagacgaggaacgggacgacaccctcaccattctcctgaaagccacactcctggccgtctccggcgtatacccgctgagcatccctgccaccctcttcgtgtggtacttctggcagaagaaaaagcagcgatccggcgtcctgtgggatacgcccagcccgcccgaagtggagcgagcggtgctggacgacggcatctaccgcataatgcagcggggccttctggggcgctcccaggtaggggtgggagtgttccaggagaacgtcttccacacgatgtggcacgtgacccggggggccgtgttaatgtaccaggggaaaagactggagcctagctgggcctccgtcaagaaggacctcatcagctacggcggtggttggcggctccagggctcctggaacaccggtgaagaggtccaggtgatcgccgttgagcccggtaagaaccccaagaacgtgcagacggcccccgggaccttcaaaacccccgaaggcgaggtgggcgcgatcgccctggacttcaagcccgggaccagcggatcccccatcgtcaaccgcgaggggaagatcgtgggcctctatggcaatggggtagtcacgaccagcggcacatacgtgagcgccatcgcccaggcgaaggcctcccaggaggggcccctgcccgagattgaggacgaagtgttcaggaagcgcaacctgaccatcatggacctccaccccggcagcgggaagacgcggcgctacttaccggccatcgtcagagaggccatcaagcgcaagctgcgcaccctgatcctggccccaacccgggttgtggcgtcggagatggccgaggctctgaagggtatgcccatccgctatcagacgacagccgtcaagagcgagcacaccggcaaggagatcgtggaccttatgtgccacgccaccttcacgatgcgtttactgtctcccgtgcgcgtcccgaactacaatatgatcatcatggacgaggctcacttcaccgaccccagcagcatcgccgcccgggggtacatcagcaccagagtgggaatgggggaggctgcagcgatcttcatgaccgccacgccgcccggctccgtggaggccttcccccagagcaacgccgtcatccaggacgaggagcgcgacatacccgagcgcagctggaacagcgggtatgagtggatcaccgatttcccgggcaagaccgtgtggttcgtcccctccatcaagtctggcaacgacattgcgaactgccttcggaagaatgggaaacgggtcatccagctgtccagaaagacttttgacaccgagtaccaaaagacgaagaacaacgactgggactacgtggtgaccaccgacatcagcgagatgggcgccaatttccgcgccgaccgggtcatcgacccgcgccggtgtctgaagcccgtgatcctcaaggacgggcccgagcgcgtgatcctggccggaccgatgcccgtcacggtggcctccgcggcccagcggcgtgggcggatcggacgcaaccacaataaggagggcgaccagtacatctacatggggcagccactgaacaacgacgaggaccacgcccactggacggaggccaagatgctattggacaacatcaacacccccgagggcatcatccctgccctgttcgaaccggagcgcgagaagagtgcggccatcgacggggagtacagactacgaggcgaggcccggaagaccttcgtcgagctgatgcgccggggggacctgcccgtctggctctcctacaaagtggcaagtgagggcttccagtacagcgaccgcaggtggtgcttcgacggggagcgcaacaaccaggtgctggaggaaaacatggacgttgaaatatggactaaagagggggagcggaagaagctgcgcccccggtggctcgacgcccgcacgtactccgacccccttgcgctgcgggagttcaaggagttcgccgctggccgccggagtgtgtccggggatctcatcctggagatcggcaagctgccgcagcacctcactcagcgcgcacagaacgcgctggacaacctggtcatgctccacaacagcgagcagggcggacgggcctaccgccacgcgatggaggagctgcccgacaccatcgagaccctaatgctactggccctgatcgccgtgctcacggggggggtcaccctcttcttcctgtccggccggggtttaggcaagaccagcatcggcctcttatgcgtcatggcctccagcgtgctcctgtggatggcctccgtggagccccactggatagccgcaagcatcatactggaattcttcctcatggtccttctgatccccgagcctgaccgccagaggacgccgcaggacaaccagctcgcctacgtggtgatcggcctcctgttcatgatcctcactgtcgcggccaacgagatgggcttgttagagacgaccaagaaggacctcggtatcggccacgttgccgtgggaaaccaccaccatgccgccatgctggacgttgatctgcatccggcgtccgcctggaccctatacgccgtggccaccacgattatcaccccgatgatgcgccacaccatcgagaacaccacggccaacatcagcctgaccgcgatcgccaatcaagccgcaatcctaatgggtctcgacaagggctggcccatatccaagatggacattggtgtgcccctgctagcgctcggctgctacagccaggtcaaccccctgacactgaccgccgccgttctaatgctggttgcgcattacgctatcatcgggcctggcctgcaagcaaaggcgacgcgcgaggcccagaagcggaccgcagccgggatcatgaagaaccccaccgtcgacggaatagtggcgatcgatctggaccccgttgtgtacgacgccaagttcgagaaacaactgggccaaatcatgctgctcattctgtgcacctcccagatactgctaatgaggacgacctgggccttatgcgagagcatcaccttggctaccggaccgctcaccaccctgtgggagggctcgcccggcaagttctggaataccacaatcgccgtgtccatggccaacatcttccggggctcctacctggcgggcgctggactcgccttcagcctgatgaaaagtctgggcggtggccgcagagggacgggcgctcagggcgagaccctcggggagaagtggaagcgtcagctcaaccagctttccaaaagcgagtttaatacttacaagcggtccggaatcatggaggtggaccgctcggaggctaaggagggactcaagcggggcgagaccacgaagcacgcagtctcccgcgggaccgccaagctgcggtggtttgtggagcgcaacttggtgaaacccgagggcaaggtcatcgacctaggctgcgggcggggcgggtggtcctactactgtgccggtctcaagaaggtgaccgaggtgaaagggtacaccaagggggggcccggccatgaggagccgatcccgatggcgacgtacggctggaacctggtcaagctgcattccggtaaggatgtgttcttcatcccgcccgagaagtgcgacactctcctgtgcgacatcggcgagagctcccccaaccctaccatcgaggaggggcgcaccctgcgggtgctcaagatggtcgagccctggctgcggggcaaccagttctgcatcaagatcctgaacccctacatgccctctgtcgtggagacgctcgagcagatgcaacggaagcacggcgggatgctagtccgaaacccgctgtcccggaactccacgcacgagatgtactgggtgtcctgcggcaccgggaacattgtgagcgccgtcaacatgacctcccgcatgcttttgaaccggttcaccatggcgcaccggaagcccacttacgagcgcgatgtggaccttggcgccggcacaagacacgtggcagtcgagcccgaggtggcgaacctcgacatcatcgggcagcgaatcgagaacatcaagcatgagcacaaaagcacatggcactacgacgaagacaacccctacaaaacctgggcctaccacggctcctacgaggtgaagccgtcagggtccgcaagcagcatggttaacggtgtcgtcaaactgctgacgaaaccctgggacgtgattcccatggtgacccagatcgctatgaccgacacaacgccgtttgggcagcagcgggtcttcaaagagaaagtggacacccgaacccccaaggccaagcggggcaccgcgcagatcatggaggtgacggctaagtggctctggggcttcctatcccggaacaagaagccccggatctgcacccgcgaagaattcacccggaaggtccggagcaacgctgccatcggggccgtttttgtggatgagaatcagtggaactccgccaaggaggccgtcgaggacgagcgattctgggacctggtgcacaaggagcgcgagctccataagcagggcaagtgcgcgacgtgcgtgtacaacatgatggggaagcgggagaagaagctgggagagtttgggaaggcgaagggcagccgcgcgatctggtacatgtggctgggtgcccgtttcctcgagttcgaggcactggggttcatgaatgaggaccactggttctcccgcgagaatagcctgtccggcgtcgagggggagggcttgcacaagcttggatacatcctgcgggacatcagcaagatcccgggcggcaatatgtacgccgatgacacggcagggtgggacacccgcatcaccgaggacgacctccagaacgaagcgaggatcaccgacatcatggaaccggagcacgccctgctggccaaaagcatcttcaagctcacgtaccagaacaaggtggttcgcgtccagcgccctgccaagaacggcaccgtcatggacgtgatcagccggagagaccagcggggatccggccaggtcggcacgtatgggctgaacaccttcacgaacatggaggcccagctaattaggcagatggagagcgagggaatcttctccccaagcgagctcgagacccccaacctggcggagcgggtgctggactggttggagaagtacggggtagagcgcctgaaaagaatggccatctccggcgacgactgcgtcgtcaaaccgatagacgaccgcttcgccaccgccttaactgccttgaacgacatggggaaagtacggaaggatatcccccaatgggagccatccaaaggctggaacgattggcagcaggtcccattctgctcccaccacttccaccagctgatcatgaaggacggccgcgagatcgtggtgccgtgtcggaaccaggacgagctggtcggtcgcgcccgggtcagccagggagcggggtggagcttacgcgagacggcctgcctgggcaaatcctacgcccagatgtggcagctgatgtacttccaccggcgcgacctccggctggcagccaatgcaatctgctctgccgtgcccgtcgactggatccccacctcccgaaccacctggagcatccacgcgcaccaccagtggatgacgaccgaagacatgctgagtgtgtggaaccgggtgtggatcgaggagaacccctggatggaagacaagacccacatcagctcctggggcgacgtcccgtacctcggcaagcgcgaggaccaatggtgtggcagcctgatcgggctgacagcgcgcgccacgtgggccaccaacatccaggtggccatcaaccaagtgcggcgcctcatagggaacgagaactacttagactacatgacctccatgaagcggttcaagaacgagagcgaccccgagggggccctgtggtaa

SEQ ID NO: 23798 - RNA, 9879 nt, synthetic construct
  misc_feature 1..9879: note = derived and/or modified CDS sequence (opt11) from DENV-1__GQ868632__SS-prME
  source 1..9879: mol_type = other RNA
agcgtgaccatgctgctcatgctgatgcccacagccctggccttccacctcacgacccggggtggggagccacacatgatcgtgagcaagcaggagcggggcaagagcttactgtttaagacgagcgcgggggtgaatatgtgcaccctcatcgccatggacctgggggagctgtgcgaggataccatgacctacaagtgcccccgaataaccgaggccgagcccgatgacgtggactgctggtgcaacgccacggacacgtgggtgacctacgggacctgctcacagaccggcgagcaccggcgcgacaaacggtccgtggctctcgcgccccacgtgggcctggggctggagacgcgcactgagacctggatgtcctccgagggcgcctggaagcagatccagcgggtggaaacttgggcactccgccaccccgggttcacggtgatcgccctgtttctagcgcacgccatcggcaccagcatcacccagaagggaatcatcttcatcctcctgatgctggtgaccccctccatggccatgaggtgcgtcggcatcggcagccgcgacttcgtagaggggctctccggggccacttgggtggacgtcgtgctggagcacggttcgtgcgttaccaccatggccaaggacaagcccaccctggacatcgagctcctgaagactgaggtcaccaacccagcgatcctgcggaagctctgcatcgaggccaagatctcgaatactaccactgacagccgctgtccgacccagggcgaggccaccctggtggaggaacaggacgccaacttcgtgtgcagacgcacctttgtagaccggggctgggggaacggctgcgggctgttcggcaaggggtcactcatcacgtgtgccaagttcaagtgcgtgaccaagctggagggcaagatcgtgcaatacgaaaacctgaagtacagtgtcattgtgaccgtgcacaccggcgaccagcaccaggtcgggaacgaatccactgagcacggcaccaccgcgaccatcacgccccaggcccccacgacggagatccagctaaccgactacggggccctgaccctggattgcagcccgagaaccggcctcgacttcaacgagatggtgctcctgactatgaaggagaagtcctggctcgtccacaagcagtggttcctggacctgcccctcccctggaccagcggggccagcacctcccaggagacgtggaatcggcaggacctgctggtgacgttcaagaccgcccacgcgaagaagcaggaggtggtcgtgctcggcagccaggagggcgcgatgcacaccgccctgacaggtgccaccgagatacagacctccggcaccacgaccattttcgccggccacctgaagtgccgcctcaagatggacaagctgaccctgaagggcgttagctatgtcatgtgcaccgggtccttcaagctggagaaggaggtggcggagacgcagcacggcaccgtgctggtccagatcaagtacgaaggcaccgacgccccctgcaagatccccttcagcacccaggacgagaagggggtgacacagaacgggcggctgataacagccaacccgatcgtgaccgacaaggaaaagcccgtcaacatcgaggctgagcctccgtttggggagtcctacatagtgataggcgctggcgagaaagcactgaagctctcgtggttcaaaaaggggtccagcatcggcaagatgttcgaggctaccgcccgcggggcgcggcgcatggcgattctgggcgacacggcctgggacttcgggtccatcggcggcgtgttcaccagcgtcgggaagctggtgcaccagatcttcggcaccgcctacggtgtcctcttttcgggtgtcagctggacaatgaagatcgggatcggcgtgctgctgacatggctcggcctgaactcccgcagcacctccctgagcatgacctgcattgccgtcgggctcgtaactctgtacctgggggtgatggtgcaggccgactccgggtgcgtcataaactggaaggggcgggagctcaagtgcgggagcgggatattcgtgacgaacgaggtacatacctggaccgagcagtacaagttccaggcggacagcccgaagagactgtccgccgccatcggcaaggcctgggaggaaggggtctgcggcatacggagcgcaacccgcctggagaacattatgtggaaacagatctccaacgaactcaaccatatcctgctagagaacgacatgaagttcaccgtggtggtcggggacgtggcgggcattcttgcccaggggaagaagatgatccggccccaaccgatggagtacaagtacagctggaagtcctggggcaaggccaagatcatcggcgccgacgtccagaacacgaccttcatcatcgatgggcccaacacccctgagtgccccgacgagcagcgcgcgtggaacatctgggaggtcgaggactacggctttgggatcttcaccacgaacatctggctgaagctgagagacagctacacccaggtgtgcgaccatcgcctcatgtccgcggccatcaaggacagcaaggccgtgcacgccgacatggggtactggatcgagtccgaaaaaaacgagacctggaagctcgcgagggccagcttcattgaagtcaagacgtgcatctggcccaagtcccatacgctgtggtcgaatggcgtgctcgaatccgagatgataatccccaagatctacgggggcccaatcagccagcacaactaccgccccgggtactttactcagaccgccggtccctggcatctgggaaaactggagctcgactttgacctgtgcgagggcaccacagtggtagtggacgagcactgcggcaaccgggggccatccctgcgcactaccaccgtgacgggtaagatcatacacgagtggtgctgccggagctgcaccctgccgcccctccgcttccgcggggaggacggctgttggtacgggatggagatccgccccgtcaaggagcgggaggagaacctggtgaagtccatggtaagcgctggcagcggcgaggtcgactcgttcagccttgggctgctttgcatctccatcatgatcgaggaggtgatgcgctcaaggtggtcccgcaaaatgctcatgaccggcaccctggcggtgttcctgctcctgatcatggggcagttgacgtggaacgacctgatccgcctgtgcatcatggtcggtgcgaacgccagcgataggatgggtatggggaccacctacctggccctcatggcaaccttcaagatgcgcccgatgttcgccgtgggactgttgttccggcgccttacctcccgcgaggtgttactgttaaccatcgggctgagcctagtcgcgtcggtggagctcccaaacagcctggaggagctgggcgacgggctcgccatggggatcatgatcctgaagctgctcaccgacttccagtcccaccagctatgggccaccctgttgtcgctgacgttcatcaaaaccaccttctccctgcactacgcctggaagactatggcgatggtccttagcatcgtttccctattccccctctgcttgagcacgacctcccagaagaccacctggttgcctgtgctgctcggcagcctggggtgcaagccgctgacgatgttcctcattgccgaaaacaagatctggggccgccggtcgtggcccctgaacgaagggatcatggccgtcggcatcgtgagcatcctgctcagctccttcttaaagaatgacgtgcctctggccgggccgctcatcgccgggggcatgctgatcgcgtgctacgtcatcagcggatccagcgcagacctctccctggagaaggccgctgaggtgagctgggaggaagaggccgagcacagtggcgccagccacaacatcctggtggaggtccaggacgacgggaccatgaagatcaaggatgaggaacgcgatgataccctgaccatcctcctgaaggccaccctactcgccgtgtcgggagtgtacccgctgtcgatccccgctacgctattcgtctggtacttctggcaaaagaagaagcaacggtccggggtactctgggacacgcccagcccgcccgaggtggagcgcgccgtcctggacgacggcatctaccggataatgcagcgcggcctgctggggcggtcccaggtgggcgtgggggtttttcaggagaacgttttccacaccatgtggcacgtgacacgcggcgcggtcctcatgtaccaggggaagcggctggagcctagctgggcttccgtaaagaaggatctgatcagctacggcggagggtggcgcctccagggctcctggaacacgggggaggaggtgcaggtcatcgccgtggagcccggcaagaaccccaagaacgtacagaccgctcccgggacctttaagacccccgaaggcgaggtcggcgccatcgccctggacttcaagcccggtacgagcggctcccccatagtgaaccgggagggtaagatcgtgggcctgtacggcaacggggtcgtcaccactagcggtacctacgtgagcgccatcgctcaggctaaggcgtcccaggaggggccgctccccgagatcgaggacgaggtcttccgtaagaggaacctgacgatcatggacctgcaccccggctcggggaagacccgccggtacctcccggcaatcgtgcgcgaggccatcaagcgcaaactacggaccctgatcctcgccccgacccgcgttgtagcctccgagatggcggaggcccttaaaggcatgccaatccggtaccagacgacggctgtcaagtcggagcacacaggcaaggagatcgtggacctgatgtgccacgccaccttcacgatgcggctcctgtcgcccgtccgggtaccgaactacaacatgatcatcatggacgaggcccatttcaccgatcccagcagtatcgcggcccgcgggtacatcagtacccgggtgggcatgggagaggccgccgccatctttatgaccgccactccgcccggctccgtcgaggcttttccgcagagcaacgccgtgatccaagacgaggagcgcgacatccccgagcggtcctggaacagcgggtacgagtggatcaccgacttccccggcaaaaccgtgtggttcgtcccctccatcaagagcggcaacgacatcgccaactgcctgcgcaagaacggaaaacgggtgatacagctctcccgcaagaccttcgacacggagtatcagaagacaaagaataacgattgggactacgtagtcaccaccgacatcagcgagatgggagcaaacttccgcgccgaccgagtgatcgacccgcggagatgtctgaaacccgtgattctgaaggacgggccagagcgggtcatcctcgccggccccatgccggtgacggtcgcctccgccgcgcagaggcggggacgcatcggccgcaaccacaacaaggagggcgaccagtatatctacatggggcagcccctgaacaacgatgaggaccatgcccactggaccgaggccaagatgctgttggacaacatcaacacccccgaaggcataatccctgcgctgttcgagccggagcgggagaagtcggccgcgatcgacggcgagtacaggctccggggcgaggcccgcaagacttttgtggagctcatgcggcgcggagaccttccagtttggctgtcctacaaggtcgccagcgagggctttcagtacagcgatcggcgctggtgcttcgacggagagaggaacaaccaggtgctcgaggagaacatggacgtggagatctggacgaaggagggggagcgcaagaagctgcggccccggtggctggatgcgagaacctactccgaccccctcgcactgcgcgagttcaaggagttcgcggccggccggcgcagcgtctccggggacctgatcctcgagatcggaaagctaccgcagcacctgacacagcgggcccagaatgccctcgacaacctggtgatgctgcacaacagcgagcagggcggccgagcgtatcggcatgccatggaggagctccccgacactatcgagacactgatgctgctcgcgctgatcgccgtgctgactggcggggtcacactcttcttcctgtccggccgcggactgggcaagaccagcattggcctcctgtgcgtgatggcctccagcgtactgctctggatggcgtccgtagaaccccactggatcgccgccagcatcatcctggagttcttcctgatggtgctcctgatccccgagccggaccggcagcgcaccccccaagacaaccagctggcctacgttgtcatcgggctcctgtttatgatcctgacggtggccgcgaacgagatgggcctcctggaaaccaccaagaaggacttgggaatcgggcacgtggccgtcggaaatcaccaccacgccgccatgctcgatgtggatctgcaccccgcaagcgcttggactctgtatgccgtggccacgacaataatcaccccaatgatgagacacaccatcgagaacacgaccgccaacatcagcctaaccgccatcgcgaaccaggccgccatcctgatgggactggacaagggctggcctatctctaagatggacatcggggtccccctcctggccctgggctgctacagccaggtcaaccccctcactctgacggcggccgtcttaatgctcgtcgcccactatgccataatcggcccgggcctgcaagcaaaggcaacccgggaggcccagaaacgcaccgccgccgggatcatgaagaatcccaccgtggacggaatcgtggctatagacctggaccctgtcgtgtacgacgcgaagttcgagaagcagctcgggcagatcatgctgctgatcctctgcacgtcccagatcctgctgatgcggactacctgggccctctgcgagagcatcacccttgccacggggcccttgacgaccctctgggaaggctccccgggcaagttctggaacacgaccatcgccgtgagcatggccaacatcttccgcggatcctacctggcgggcgccgggctggcgttcagcctcatgaagtcactgggcggggggcgccgcgggacgggcgcccagggcgagaccctgggggagaaatggaaacggcagctcaaccagctgtccaagtcagaattcaacacctataagcgctccggtatcatggaggtcgaccggtctgaggcgaaggaggggctgaagcgcggcgagacgaccaagcacgccgtgtcccgggggaccgccaagctccgctggttcgtagagcggaacctggtcaagcccgagggcaaggtgatcgacctgggctgcgggcgcggcgggtggagctactactgcgccggccttaaaaaggtgaccgaggtcaagggctacactaagggcgggcccgggcacgaggagcccatcccgatggccacctacggctggaacctagtgaagctgcactcggggaaggacgtgttcttcatcccccccgagaagtgcgacaccttgctctgcgatatcggggagtcctcccccaacccgaccatcgaggagggccggacgctgcgagtcctgaagatggtcgagccctggctccggggcaatcagttctgcatcaagatcctgaacccctacatgccctcagtcgtagagaccctggagcagatgcagcgcaagcacggcgggatgctcgtgaggaaccctctgtcccgcaacagcacccacgagatgtactgggtctcctgcgggactgggaacatcgtaagcgcggtgaacatgacctcccgcatgctgctcaatcgattcactatggcccaccgcaagcccacctacgaacgggatgtggaccttggcgccggcacccgccacgtggccgttgaacccgaggtggccaacttggacatcatcgggcagcggatcgaaaacatcaagcacgagcacaagagcacctggcactacgatgaggataacccatacaagacgtgggcgtaccacggctcctacgaagtcaagccgagcgggtccgccagcagcatggtgaacggcgtcgtgaagctcctaaccaagccctgggacgtgatccccatggtcacgcagatcgccatgaccgacacgacccccttcggccagcagcgagtgttcaaggagaaagtggatacccggaccccgaaggccaagcgcggcacggcacagatcatggaggtcaccgcgaagtggctttggggcttcctctcccgcaataagaagcccagaatctgcacacgtgaagagttcacccgcaaggtgcggagcaacgccgccattggggcggtgttcgtcgacgaaaaccaatggaattccgcgaaggaggccgtggaagacgagcgcttctgggacctggtgcacaaagagcgggagctgcacaagcagggcaagtgcgctacgtgcgtctacaacatgatggggaagcgcgaaaagaagttaggtgagttcgggaaggcaaagggcagcagagcaatctggtacatgtggctgggggcgcgcttcctggaattcgaggccctcgggttcatgaacgaggaccactggttctcccgggagaacagcctgtccggcgtggaaggggagggactgcacaagctcgggtacatcctgcgcgacatcagcaagatccccggcggcaacatgtacgcggacgacaccgccggatgggacacccgtatcaccgaggacgacctgcagaacgaagcccgcatcacagacatcatggagcccgagcacgcactcttggctaaatccatcttcaagctgacctaccagaacaaggtggtccgcgtgcagaggcccgccaagaacggcaccgtgatggatgtcatcagccgcagagaccagcgagggtccggtcaggtgggcacctacgggctcaacacgttcaccaacatggaggcccagctgatccggcagatggagtcagaaggaatcttttcccccagcgagcttgaaacccccaaccttgccgagcgcgtgctggactggctggagaagtacggggtcgagcggctcaagcgaatggcgatctccggggacgactgtgtggtcaagccgatcgacgaccggttcgccaccgccttgacggcgctgaatgatatggggaaggttcgcaaggacatcccccagtgggagcccagcaagggttggaacgactggcagcaggtcccgttctgctcccaccacttccaccagttaattatgaaggacggccgggagattgtggtcccgtgccgcaaccaggacgagctggtgggccgggcccgggtgagccagggcgctgggtggagcctgcgcgagaccgcatgcctcgggaagtcatacgcccagatgtggcaattgatgtacttccaccgcagagacctgcgcctcgccgcgaacgccatctgctcagccgtccccgttgactggatccccacctcccggacaacatggtcgatccacgcccaccaccagtggatgacgaccgaagacatgctgtccgtatggaaccgcgtttggatcgaggaaaacccatggatggaagacaagacccacatcagctcctggggcgacgtgccgtacctgggtaagcgcgaggatcagtggtgcggctctttgatcgggctgacggcccgagcgacctgggcaaccaacatccaggttgcgatcaaccaggtccgccggctaatcgggaacgaaaactaccttgactacatgacctctatgaagaggttcaagaacgagagcgacccagagggtgccctgtggtga

SEQ ID NO: 23799 - RNA, 9879 nt, synthetic construct
  misc_feature 1..9879: note = derived and/or modified CDS sequence (opt11) from DENV-1__GQ868633__SS-prME
  source 1..9879: mol_type = other RNA
tcagtaaccatgctactaatgcttatgccgacagccctggcgttccacctgacaacaaggggcggcgaaccccacatgatagtttcgaaacaggaacgggggaaaagcctattatttaaaacatccgccggagtaaacatgtgtactctaatagccatggacctcggcgaactatgcgaagacacgatgacgtacaagtgcccaaggatcaccgaagccgaacccgatgatgtcgactgttggtgcaatgctactgacacttgggtcacctacggtacatgtagccagacgggagaacaccgaagggacaaaagatcggtagcgcttgcaccccacgtaggcctcggactagaaacacgaacagaaacctggatgtcatcagaaggagcctggaaacagatacagcgtgtcgaaacctgggcgctccgacacccaggcttcacagtgatcgcactattccttgcacacgcgataggcacctccattacccagaaaggaataatttttatactgcttatgttagtcactccatctatggcgatgcggtgcgtaggcatcggatctcgggacttcgtcgaagggctttcaggagcaacctgggtagatgtagtgcttgaacacggctcgtgcgtaacgacgatggcaaaggataagccgaccttggacatcgagctgcttaaaacagaggttactaaccctgccatactccgaaagctatgcattgaagctaaaatctcgaacaccacgacggacagccgatgccccacacagggagaggcgacgctcgtcgaggaacaagatgccaacttcgtctgtagacgaaccttcgtcgaccgtggatggggaaacggctgtgggctatttggcaaagggagcttaattacatgtgcaaaattcaaatgcgtgacgaaacttgaaggtaaaatcgtacaatacgagaatttaaaatactccgtaatcgtcacagtccacacaggggaccagcaccaggtcggaaacgagtcgacggagcacgggacgacggcaacaattaccccacaagccccaacgacagagattcaactcacggactatggggctctaacattggactgtagtccacggacaggcttagacttcaacgaaatggtactgctcacaatgaaagagaaatcatggcttgtacacaagcaatggtttctcgaccttccgttaccatggacaagcggcgcctccacctcacaagagacgtggaacagacaagacttacttgtaacctttaaaaccgcccacgctaaaaagcaagaagtagtcgttctggggtcacaggagggggccatgcacacggcgctaaccggggcgaccgaaatacaaactagcggcacgacaacgatcttcgccgggcacctaaagtgccgactcaagatggataagctaaccctcaaaggcatgtcatacgtaatgtgcacaggctccttcaaactcgagaaggaggtcgctgaaacgcaacatggaacagtcttagtgcaaataaaatacgagggtaccgacgccccctgcaagatccctttttctactcaagacgagaaaggagtaacgcagaacggacggctaattacagccaaccccatcgtaacagacaaggagaaaccagtaaacatagaagcggaaccacccttcggcgaatcatatattgtaattggagcaggggaaaaagcgctgaagttatcgtggttcaaaaagggcagtagcatcggcaaaatgttcgaagcgacagcacggggagcgaggcgtatggccattctaggcgataccgcgtgggacttcggcagcataggcggggtattcacatcagtcggaaaactggtccatcaaatattcggtacagcgtatggggtactgtttagtggcgtcagctggactatgaaaataggcataggagtattacttacctggttaggcttgaactcgcgaagcacctctctgagcatgacctgcatagccgtcggacttgtcacactctacttaggggtgatggttcaagccgactccggctgcgtcatcaactggaaaggaagggagctcaaatgtgggagcggaatctttgtgacgaacgaagttcacacctggacagaacaatataagttccaggcggactcgccgaaaagacttagcgctgccataggcaaagcatgggaagagggagtttgcggaatccgatccgcaacacgactcgaaaacattatgtggaagcaaatatctaacgaactgaaccacatcctccttgaaaatgacatgaaattcaccgttgtggtcggcgacgtagctggaatcctcgctcaaggcaagaagatgatacgaccccagccgatggaatataagtattcctggaaatcgtggggaaaggcgaaaatcatcggagcagatgtgcaaaataccacattcataatcgacggcccaaatacgccggagtgcccggacgaccaacgggcatggaacatatgggaggtcgaagattacgggttcggtattttcacgacgaatatatggttgaaacttcgagactcctatacccaagtctgcgatcatcggctgatgtcagcggccatcaaagatagcaaagccgtacacgcagatatgggatactggatcgaatcagagaagaatgagacctggaaattggcaagagcatcattcattgaagtgaagacgtgtatatggcccaagtctcatacgctctggtccaacggggtactcgagtccgaaatgataatcccaaaaatatacgggggtccaataagtcaacacaattacagaccaggatacttcacacaaaccgccggaccctggcatctgggtaaacttgaactggactttgatttatgcgagggcacgacagtcgtagtggacgagcactgcgggaaccggggacccagtctaaggacaacaacggtaacgggcaaaataatccacgaatggtgctgccgttcatgcaccctcccacccctaaggtttcgaggtgaggacggctgctggtacggaatggaaatccgcccagtaaaggagaaagaagaaaacctcgttaagtccatggtcagcgcaggctcaggcgaagtggattcctttagcttagggctcctgtgcatctcgataatgatagaggaggtaatgcgcagccgctggtcccgaaaaatgctcatgacaggcacccttgcagtattcttactgctcatcatgggccaactaacctggaatgacctgattcggctatgcatcatggtgggagcaaacgcaagcgaccgaatgggcatgggaacgacatacttagccctcatggccacatttaaaatgagaccgatgtttgccgttggacttttgtttagacgcctcacctcgcgagaggtgctgctcctgacaataggtctaagtctagtcgcaagcgtcgagcttcccaactcgctagaggagttaggcgatggcctagcgatggggatcatgatcctaaagctccttaccgacttccaatcacaccagctgtgggcgacattactcagcctaactttcatcaaaactaccttcagccttcactacgcctggaagaccatggcaatggtcctcagcatagtgtcactgttcccactatgtctcagcacaacatcccagaaaaccacctggctaccagtactccttggctccctcggctgtaagccactaacgatgttccttatcgcagagaacaaaatctggggcaggaggagctggcctctaaacgaaggcatcatggctgtcggaatagtctctattctattgagcagcttgctcaaaaacgacgttccactcgccggtccactgatagccggcggaatgctaattgcctgctacgtgatatcagggagtagcgccgacctatccctggaaaaagcggcagaggtaagctgggaagaagaggcagaacatagcggcgcgagccacaatatcctagtcgaagtgcaagacgacggcacgatgaaaataaaggacgaagagagggatgacacactaaccatcttactcaaagcgaccctcttggcagttagcggagtgtaccctctctcaatacccgccaccctgttcgtatggtatttctggcagaagaaaaagcaacggagtggcgtcctatgggataccccgagtccacccgaagtagaaagggcagtcctggatgacggcatataccgcataatgcagcgcggacttctaggaaggtcccaagtgggcgtcggcgtattccaagaaaacgtcttccacacaatgtggcacgtaacgcggggagcagtcctcatgtatcaagggaaacggcttgagccgagctgggcaagcgtcaagaaagacttaatctcgtacggcggtggctggagactccaaggttcatggaacaccggagaagaggtccaagtcatagcagttgaacccgggaaaaacccgaaaaatgtacagacagctccaggcaccttcaaaacacctgagggggaggtaggcgcaatcgcgctagacttcaaaccaggaacgtcaggaagccccatcgtcaaccgagaagggaaaattgtcggactatacggaaacggtgtagtaacaacctcggggacctacgtaagcgcaatagctcaggcgaaggccagccaagagggcccccttccggagatcgaagacgaggttttcagaaagcgaaaccttaccatcatggacctgcacccaggaagcggaaaaacaaggcgatatctgcctgccattgttcgggaggcgatcaaaagaaaattgagaaccttaattctcgcacctactagagtcgtagcgagcgagatggccgaagccttaaaagggatgccaatcagatatcaaactaccgccgtgaaaagtgagcacacaggcaaagagattgtagacctgatgtgccatgccacattcaccatgcgactgctgagccccgtccgtgtaccgaactacaacatgataatcatggacgaggctcactttacagaccccagcagcatagcagcacgtggctacataagcactagagtaggtatgggcgaagcagcggcgatattcatgaccgcaacgccgcccggatcagtagaggcatttccgcaatccaacgcagtgatacaagacgaagagagagacattcccgagcgttcctggaatagcggatatgagtggattacagattttcccggcaaaactgtatggttcgtaccatcaatcaaatcgggaaacgacattgccaactgccttcgcaaaaacggaaagcgcgtcatccagctgtctaggaagacattcgacaccgagtatcaaaagactaagaacaacgactgggactatgtagtgacgaccgacataagcgaaatgggcgccaacttcagagccgatagggtcatcgacccccgtcgttgcttaaagccagtcatcctaaaagacggcccagaacgcgtaatactcgcaggcccgatgcccgtcacggtagcctccgcggcacagcgccggggacgtataggcagaaaccacaacaaagaaggagaccagtatatctacatgggacagccactaaacaacgacgaggaccacgcccactggaccgaagccaagatgctgctagacaacatcaacactccagaaggcatcattccagccttattcgaaccagagcgcgagaaaagcgccgcaatcgacggcgaataccgattaaggggcgaggcacgaaagacctttgtcgaactgatgcgacgaggtgatctgcccgtctggctaagttacaaagtcgcaagcgaaggctttcaatattctgaccgtcgctggtgttttgacggtgaacgtaacaatcaagtcctcgaggaaaacatggatgttgagatatggacaaaggaaggggaaagaaagaaactacgaccacgctggctcgacgctaggacctattcagacccactggccttaagagagttcaaagagttcgccgctgggagacgctcagtcagcggagaccttatactagaaataggaaaactcccgcaacacctgacccaaagggcacaaaacgcactcgataaccttgtcatgctgcacaatagcgaacagggaggcagggcatacaggcatgccatggaagaactacctgacaccatcgagactctaatgttactcgccctaatagccgtcctcactggaggagtaaccctattctttctgtccggccgaggactcggcaagacatctataggcctactgtgcgttatggcatcgagcgtactgctatggatggcaagcgtcgagccgcactggatcgcggccagcatcatccttgagttcttcctaatggtgctcctaatacctgaacccgacagacaaagaacgccccaagacaaccaactagcttacgtagttatcggtctcctcttcatgatactaacagttgcagcgaatgaaatgggactcctcgaaacaactaaaaaggatctaggcatcggccatgtagcagtaggcaaccaccaccacgctgccatgctggacgtagacttacatcccgcaagcgcctggacactatacgcagttgccacgacgatcatcaccccgatgatgaggcacacaatagaaaacacgaccgcaaacatctccctcacggccatcgccaaccaagccgccatattaatggggttggacaagggatggcctataagcaaaatggacatcggtgtaccacttcttgcccttggctgctactcccaggtaaatccattaacacttacagctgcggtgcttatgctcgtagctcactacgctataataggccctgggttgcaagcgaaagccacccgggaggcacaaaaacgaacagcagcaggaatcatgaagaaccctactgtcgacgggatagttgccatcgacctcgaccccgtggtgtacgacgccaaattcgaaaaacagctcggacaaataatgctactcatcctttgtacgagtcaaatcctattgatgcgcacgacatgggccctgtgtgaatcaatcacacttgcaacaggtcccctcaccaccttgtgggaagggtcgccaggaaaattctggaatactacgatagcggtttctatggcgaacatatttagggggtcatacctggcaggagcgggactcgctttttcacttatgaagtcactaggagggggacgcagagggaccggtgcccaaggcgaaactctaggtgaaaaatggaagagacaactaaatcagctatcaaaaagcgaatttaatacgtacaaaagatcaggcataatggaggttgacaggagtgaggctaaagagggtttaaaacggggcgaagcaaccaaacacgcagtgagccgaggacccgccaaattgcggtggttcgttgaacgcaacctcgtaaacccagagggaaaagttatagatttaggctgtggccgcggcgggtggagctactactgtgcaggactcaagaaagttaccgaggtgaaaggatacacgaaaggtgggcccgggcacgaagaaccaatccccatggccacgtacggttggaacctcgtaaaactccactcgggaaaagatgtattcttcatcccacctgaaaagtgcgacaccctgctgtgcgatataggagaatcatccccaaacccaactatagaggaaggacgaacacttcgcgtactaaaaatggtcgagccatggctacgcggaaaccagttctgcataaaaatactaaatccctacatgccgtctgtcgttgagactctggaacagatgcaacggaagcatggagggatgctcgtcagaaacccactcagccgcaatagtacacacgaaatgtattgggtaagctgcggaaccggcaacatagtctccgctgtcaacatgaccagccgcatgctactcaaccgctttactatggctcaccgcaaaccaacatacgagcgtgacgtggacctaggcgccgggacacgacacgtggcggtggaaccggaagtggccaacttagacataatcggacagcgcatagagaacataaaacacgaacacaaaagcacttggcactatgacgaagacaacccctataaaacctgggcataccacggaagctatgaggtcaagccatcaggatcagcgagctcaatggtgaacggagtagtaaaattgctaaccaaaccctgggacgtcatccccatggtgacacagatagccatgacggataccacaccgttcgggcaacaaagagtctttaaggaaaaggtagatacccgaacgccaaaggcgaaaagaggaactgcacaaatcatggaagtaacggcaaaatggctgtggggattcctctctcgtaacaagaaacctcgaatatgcacgagggaagagttcactcgaaaagtcaggagcaacgccgctatcggggccgtctttgtggacgagaaccaatggaacagtgcaaaagaagccgtagaggacgaaaggttctgggacctagtgcacaaggaaagggaacttcataagcaaggtaaatgtgcgacgtgcgtgtacaacatgatgggcaaacgtgaaaagaagctcggcgagttcggcaaagcaaaaggtagcagagccatctggtacatgtggttgggggcccgcttcctggagttcgaagcattaggcttcatgaatgaggaccattgggtcagccgagagaacagcctttctggagtagaaggcgagggactacacaagctcggctacatactcagggatatatcgaaaataccaggtggcaacatgtacgctgacgacacagcgggatgggatactagaatcactgaggacgacctccagaacgaggcacgaatcacagacataatggagcccgaacatgcactcctcgcgaagagtatcttcaaacttacctatcagaacaaggtggtccgagtccaaagaccagccaaaaatggaacggtaatggacgtcatatccagaagggaccaacgcggcagcgggcaggtcggtacatacggactgaacacattcaccaacatggaagcacagctaattcggcagatggaaagcgagggcatcttcagcccctcagagctcgagaccccaaacctggcggagcgcgtgctggactggttagaaaaatacggagtggaaaggctcaagcgtatggcaatatcgggagacgactgtgttgtaaagccaatagacgaccgattcgctaccgccctcacagcgctaaatgacatggggaaggttcgtaaggacatcccccaatgggaaccatccaaggggtggaatgactggcaacaagtcccattctggagccaccatttccaccagctaatcatgaaagacgggagggagatcgtcgtcccctgtcgcaaccaggatgagctggtaggccgtgcgagggtgagccaaggcgcgggatggtcactacgagaaacggcctgcttagggaaatcgtacgctcagatgtggcaactaatgtactttcaccgacgagatcttaggcttgcggccaacgcaatctgctcggctgtcccggtggactggatcccgacctctcgcactacgtggtcgattcatgcccatcaccaatggatgacaacagaggacatgctttctgtatggaaccgagtatggatcgaagagaacccttggatggaggacaaaacacacatatcgagctggggagacgtcccttaccttgggaagcgagaggaccaatggtgcgggtctcttataggcctaaccgcacgggccacctgggccacgaatatccaagtggctataaaccaggtacgcaggctcatcgggaatgagaactacctggattatatgacatctatgaaaaggttcaaaaacgagtcagaccctgagggggccctatggtag

SEQ ID NO: 23800 - RNA, 9879 nt, synthetic construct
  misc_feature 1..9879: note = derived and/or modified CDS sequence (opt11) from DENV-1__GU131919__SS-prME
  source 1..9879: mol_type = other RNA
tcagtaactatgctcctgatgctgatgcccacggccctggcctttcacttaaccacgagaggaggggaaccccacatgatagtgtccaaacaagaacgagggaaaagcctactcttcaaaaccagcgccggggtaaacatgtgcaccctgatcgcgatggatcttggtgaactttgcgaagacaccatgacatacaaatgcccaaggatcacagaagccgaaccagatgacgttgactgctggtgtaacgcgacagatacatgggtcacatacggtacctgctcacaaacgggggaacacagacgcgacaagaggagtgtagcactcgcgccgcacgtggggttagggctggaaacgcggaccgaaacctggatgtcgtcagaaggggcttggaaacagatacagcgggtcgaaacgtgggcactcagacacccggggttcacagttattgccttgtttctcgcccatgcaatcggaacgtcgataacgcagaaagggattatattcatactgctaatgttagtaacgccatctatggccatgcgctgcgttgggatcggtagtcgcgattttgttgaagggctatcgggagcaacctgggtcgatgtcgtcttagagcacggaagctgcgtcacaaccatggcaaaagacaaaccgacactggacatcgagcttctaaaaaccgaagtgaccaaccctgcaatcctcagaaaactatgcatcgaagcgaaaatatcaaacacaacaaccgattcccgatgcccaacccagggagaagcgacactggtcgaagaacaagacgcgaactttgtatgccgccgtacctttgtagaccgcggctggggtaatggctgcggactcttcgggaaaggcagcttaatcacgtgcgcgaaattcaagtgcgtaacgaaacttgagggaaagattgtacaatatgaaaacctcaaatacagcgtcatagttacagttcatactggagaccagcaccaagtaggcaatgagtcaaccgaacacggcaccactgcaactatcacacctcaggcaccaacaacggaaatacagctcacagattatggggccctaaccttggactgcagtccgcggacaggtctggactttaatgaaatggtcctcctcacgatgaaggagaagtcctggctcgtacacaagcaatggttcctcgacctcccactaccatggacaagcggcgcctccacctcccaggaaacgtggaacagacaggatctgctggtaaccttcaagacagcacatgcaaagaagcaagaagtcgtagtcctcggatcgcaggagggagctatgcatacagccctgaccggagccacggagatacagacctcggggaccaccacgatattcgcaggtcacctgaaatgccgtttaaagatggacaagctaaccctcaagggaatgtcatacgttatgtgtacaggctccttcaagctagagaaggaagtcgccgagacacaacacggaacggtgctagtacaaatcaagtacgaaggaaccgatgccccatgcaaaataccgttcctgacccaagatgaaaagggtgtcacacagaatgggcgccttatcacggcgaacccgatcgtgacggataaagaaaaaccagtgaacatcgaggcagagcccccattcggggaaagctacatagtaattggagctggcgagaaagcccttaaattgagctggtttaagaaaggaagctctatcggcaaaatgttcgaagccacggcccgaggtgcaagacggatggccatactcggggacacggcatgggactttggctcgatcggcggtgtcttcacctcggtaggcaagctgatccaccaaatctttgggacggcgtacggcgtcctgttctccggcgtatcctggacaatgaagatcggaatcggagtcctactgacctggctggggctcaactcacgaagcacctcgctgagcatgacttgcatcgcagtagggctcgtgaccctctacctaggcgtaatggtacaagctgactccgggtgtgttattaactggaaaggacgagagttaaaatgcggcagcgggatctttgtcactaatgaggtacatacctggaccgaacagtataaatttcaagcggactctcccaagaggctcagcgccgccatcggaaaggcgtgggaggagggcgtctgtggaatacgtagtgcaacgaggctggagaacataatgtggaaacaaatatcaaacgaactaaaccacatcctgttagaaaacgatatgaaattcaccgtggtcgtaggcgacgtagcgggcatcctcgcgcaaggcaagaaaatgatcagaccccaaccaatggaatacaagtatagctggaaatcgtggggaaaagcaaaaatcataggggcagacgtccaaaacaccacgttcataatcgacgggcccaatacacccgaatgcccagacgaccagagggcatggaacatatgggaagtcgaggactatggctttggaatattcaccacaaatatttggttaaaactacgggactcgtacacacaggtttgcgatcatcgactaatgtcagcagcgatcaaagattcaaaagccgtgcatgcggacatgggatactggatcgaaagcgagaaaaatgagacctggaaactagcacgagccagctttatagaagtaaaaacctgcatatggccaaagagccataccctatggtcaaacggcgtactcgagtccgaaatgatcataccaaagatatatggtggaccaatctcacagcacaactatcgcccaggatattttactcaaacggctggaccgtggcacctgggaaaactagaacttgactttgacttgtgcgagggaaccacagtcgtggtggatgaacactgcggaaatcgcggcccttccctgcgtacgacgacggtcaccggcaagatcattcacgagtggtgctgccgatcctgcacacttccgcccttgaggttcagaggagaggatggctgctggtacggcatggaaataaggccagtgaaagagaaagaggaaaatctcgtaaagtcaatggttagcgcgggatcaggtgaagtagacagcttcagcctcggcctcctttgcatctcgattatgatcgaagaagttatgcgaagcagatggagtagaaagatgctcatgactgggaccctcgcagttttcctgctattgataatgggacagctcacctggaacgaccttatccggctctgcataatggtaggcgcaaacgcctgtgatcgcatgggcatgggaacgacatacttggccctgatggcaacgttcaagatgcgcccaatgttcgcagtcgggctcttgttccgacgattgacatcgcgcgaagtcctactgcttaccatcggactcagtctggtggctagcgtggagctacccaactccctcgaggaactaggagacgggctagccatgggcatcatgatattgaagctgctcaccgactttcaatcataccaactgtgggctaccctcctgagtctgacctttataaaaaccacctttagcctacattacgcctggaagacaatggcaatggtgctatctatcgtgtcactattccctctgtgcctctccaccacaagccagaagaccacatggcttcccgtactgctagggagcttaggctgcaagccactcaccatgttcctaattgcagaaaataaaatatggggaagaagaagctggccactgaacgaaggtattatggcagtcggtatagtatctatcctcctatcgtcactgttaaagaatgacgtcccgctggcgggcccgctaatagcagggggaatgctaatcgcgtgctacgtcattagcggaagcagcgccgacctaagcctggaaaaggctgcagaggtgtcatgggaagaggaggcggaacactccggcgcgagccacaatatcctggttgaagtgcaggacgacggaaccatgaaaataaaggacgaagaacgtgatgatacattgactatcctattaaaagcaacactcttggccgtctcgggggtgtacccgctgtcgatccccgcaactcttttcgtctggtatttctggcagaaaaagaaacaaagatccggcgtactctgggacaccccttcaccaccggaggtggaaagggcggtcctagacgacgggatttatcgcatcatgcaaagaggcctcctcggtcgtagccaagtaggcgtaggggtattccaagagaacgtcttccataccatgtggcatgtcacgcgcggtgcagtcttaatgtatcaaggcaagcgtctagaaccctcttgggcatcagttaagaaagacctcatctcgtatggaggaggatggcgattacaggggtcttggaacacaggcgaagaagtgcaagtgatagcagttgagccaggcaaaaatcccaaaaacgtccaaactgcgccagggacatttaaaaccccagaaggggaagtaggggcaatagctctcgatttcaaacccggtacgagcgggtcgcccatagtgaaccgggaaggaaagatagtaggactctacgggaacggagtggtaaccacaagcggcacatacgttagcgcgatagcgcaggcaaaagctagccaagaagggccgctcccagaaatagaggacgaggtctttcggaaaaggaatttgacgatcatggacttgcaccccggcagtggcaagaccagacgatatctgcccgccatcgttagagaagctatcaaaaggaagctgcgaacgctcatacttgcgccgaccagagtggtcgcaagcgaaatggcggaggccctcaaaggcatgcccatccgatatcaaacaacggcagtaaagtcagaacataccggcaaggaaatagtcgacctcatgtgccacgctacgttcaccatgcgccttctcagtccggtgcgtgtacccaactacaacatgatcataatggatgaagctcatttcaccgatccgagctcgatagccgcccgaggatatatcagcacgcgggtaggaatgggagaggctgctgcaatcttcatgacggcaacaccgcccggaagcgtagaagcgttcccgcaatctaacgcagtgatacaagacgaggaaagggacatccccgagcgtagttggaactccggatacgaatggataacagacttcccagggaaaaccgtatggtttgtgccctcgatcaagtcgggaaatgacatcgcaaattgcctacggaaaaacggcaaaagggtgatccagctaagccgcaaaactttcgacacagagtaccagaaaacgaagaataacgattgggattacgtagtcacgaccgatatatccgagatgggtgccaactttagagcagacagagtgattgaccctaggcggtgcctgaaacccgtcatcctgaaggacggcccagagcgcgtaatactggcgggcccaatgccagtcacggtggctagtgcagctcaacgacgaggccggattggacgaaaccacaacaaagagggcgaccaatatatatacatgggtcaaccactgaacaatgacgaagaccacgcacactggaccgaagcaaagatgttgctagataatatcaacacccccgaaggcatcatcccagcgctattcgagccagaacgcgagaaaagcgcggcaattgacggcgaataccggctaagaggagaagccagaaaaacgtttgttgagctaatgagacgaggcgacctccccgtgtggctaagttacaaggtagcgagtgaagggttccagtactcagaccgcagatggtgctttgatggcgaaaggaacaaccaggtactggaagagaacatggacgtagaaatatggacaaaagaaggcgaacgcaagaaactgcgaccgaggtggctcgatgcgcgtacctacagcgacccactggccctacgcgagttcaaagagttcgcggcagggcgacgatcggtctcgggagacctgatactagagatcggaaagttaccacaacatctaacgcaacgggcgcagaacgccctcgacaatctggtcatgcttcataatagcgagcagggcggcagagcttaccgccacgcgatggaggaactccccgatacaatcgaaaccctaatgttgcttgccctaatcgcagtgctaacaggaggggtgactttgttctttttgtccgggcgcggacttggaaagacgagcatcgggctattgtgcgtaatggctagctcagtcctactgtggatggcatcagtggagcctcactggatcgctgcgtcaatcattctagagttcttcctcatggtgctgctaatcccagaaccggaccggcagcgcaccccacaggacaaccagctcgcctacgtagtgatcgggctactcttcatgatactgacagtagcggccaacgaaatgggcctgctagaaacaactaaaaaggacctaggaatcggccacgtagcagtggggaatcaccaccacgccgcaatgttagacgtagacctacatccagcatccgcctggaccctatacgccgtggcaaccacaataattacccctatgatgagacacaccatcgaaaacaccacggctaacatcagtctaacagcaatagcaaaccaggcggcaatcttaatgggactggacaaagggtggccgataagcaaaatggacatcggagtgccattgcttgcgctgggttgttacagccaagtgaatcctctaacgctaaccgcagcggtcctcatgctcgtcgcgcattacgcgataatcggaccaggcctccaagcgaaggcaacaagggaagcccaaaagcgcaccgcggctggaatcatgaaaaatccaaccgtcgatggaatagtcgcgatagacttggaccccgttgtgtacgacgcaaaattcgagaaacagctcggacaaatcatgctgctgattctgtgcacgtcccagatactgcttatgcgtacaacctgggctttatgcgaatcgataacactagccaccggacccctcaccacactctgggagggatctccaggaaagttctggaacacaacaatagctgtctcgatggcaaatatattcagaggcagctatttagcgggagccgggctagccttttcgcttatgaaatcattgggtggagggcgtcgcggcactggcgcgcagggcgaaacccttggagagaagtggaagcgtcagttaaatcaactaagcaaaagcgagttcaacacatacaaacgctcgggcatcatggaagtcgacagatccgaggccaaagaaggcctaaaaagaggtgaaacaaccaaacacgcagtatcgaggggcaccgccaagttgcggtggtttgtggaacgaaacctagtgaagcctgaagggaaagtaatagacctaggatgcggacgaggagggtggagttactactgcgctggactaaagaaagtcacagaagttaaaggctatacaaaaggtggacccggccacgaggagcccataccaatggcaacttacggctggaacctagtcaaactccactcaggaaaggacgtatttttcataccgcccgagaaatgcgacaccttgttatgtgacataggtgagagcagtccgaacccgactatagaagagggacgaacgctcagagttctcaagatggtcgagccgtggctgagaggcaaccaattctgtataaaaatcctaaacccgtacatgcctagtgtcgtcgagacattagaacaaatgcagaggaaacacggagggatgctcgtcaggaatcccctttcccgcaattcaacccacgagatgtactgggtgtcatgcggcacgggcaatatcgtaagcgcagtaaacatgaccagtcgcatgttgttgaaccgctttacaatggcccacagaaagccaacttacgaacgggatgtagacctcggggccggaacccggcacgttgctgtcgaacccgaagtggccaacctggacataatcggccaaagaatcgagaacataaaacatgagcacaaatccacgtggcactacgacgaagacaacccctataaaacctgggcctaccacggaagctatgaagtcaaaccgtcaggaagtgcaagctccatggtaaacggagtggtcaaactgcttaccaaaccatgggatgtgatccccatggtcacgcaaatcgcgatgacggatacgacaccctttggacaacaacgcgtcttcaaagaaaaggtggatacaaggacgccaaaagcaaaacgggggacagcccagatcatggaggtgacggcgaaatggttatggggattcctcagtagaaacaagaaaccccgaatatgcacgcgcgaagagttcacgagaaaggtaagaagcaacgcagccataggggcggtgttcgtagatgaaaaccaatggaactcagcgaaggaggcggtcgaagacgaaagattttgggacctcgtccaccgagaacgagagctgcacaaacaggggaagtgcgcgacgtgcgtctacaacatgatggggaaacgcgagaagaaactgggcgagttcggaaaggcaaagggcagccgagccatctggtatatgtggctgggtgcccgcttcctagagttcgaggccctcggcttcatgaacgaggaccactggttcagtcgagagaacagcctcagcggcgtggaaggggaaggactgcacaaactggggtacatcctacgcgatataagcaagatccccggcgggaatatgtatgcagatgacaccgctggatgggacacgcgtatcacagaagacgaccttcaaaacgaagcgcggatcacggatatcatggaaccagagcatgcactacttgcgaaaagcatctttaaactgacataccaaaacaaggtcgtgcgtgtccagcgacctgccaagaacggcacagtgatggacgtcatttcgcgtcgtgaccaaaggggctcgggtcaggtgggaacctatggactaaacacctttaccaacatggaagcccaactcataaggcagatggaatcggaggggatattctcacccagtgaacttgaaacgcctaacctcgcagaacgagtactagactggctagaaaaatacggtgttgagaggcttaagcgcatggctattagtggagacgactgtgtagtcaaaccaattgacgatagattcgccacagcgttaacagctttgaacgatatggggaaggtacgcaaagacataccgcaatgggagccaagcaaagggtggaacgactggcagcaggttccgttctgctcacaccacttccaccaactaataatgaaggacgggcgcgaaatagtagtcccctgccgaaatcaggacgaacttgtaggcagggcgcgcgtctcacaaggggccgggtggtccctgcgcgaaacggcgtgcttagggaaaagctatgcccaaatgtggcaactcatgtacttccaccgccgagacttgcgcctagctgcgaatgccatctgcagcgcagtaccggtggattggattccaacaagtcgcacgacatggtcgatacacgcccaccaccaatggatgacaaccgaggacatgctgtcggtttggaatagggtctggatcgaggagaatccttggatggaagacaagacccacatcagcagctggggcgacgtaccgtacctaggcaagcgagaagaccagtggtgcggcagtctcataggtttaaccgcaagagctacgtgggcaaccaatatccaagtcgctatcaaccaggtacgtcgattaataggcaacgagaattatctcgactacatgacctcgatgaagagatttaaaaacgaaagcgaccccgaaggggccttatggtga

SEQ ID NO: 23801 - RNA, 9879 nt, synthetic construct
  misc_feature 1..9879: note = derived and/or modified CDS sequence (opt11) from DENV-1__GU131920__SS-prME
  source 1..9879: mol_type = other RNA
agcgtcaccatgctgctcatgctgatgcccaccgccctggccttccacctcaccaccagaggcggtgaacctcatatgatcgtcagcaagcaggagagggggaagagcctgctgttcaagaccagcgccggggtgaacatgtgcacacttatcgccatggacctgggcgaactgtgcgaagacacgatgacctacaagtgccccaggatcaccgaggctgaacccgacgacgtcgactgctggtgcaacgcaaccgatacgtgggtgacctacgggacttgctcccagacaggggagcaccggcgcgacaagcgctccgtggccttggcgccacatgtggggctggggctggagacgcgcactgagacatggatgtccagcgagggcgcctggaagcagatccagcgggtcgagacatgggccctccgacaccccgggttcaccgtgatcgccctgttcctggcgcacgccatcggcaccagcatcacccagaagggaattatattcatcctattgatgctggttaccccctccatggccatgcggtgcgtcggaatcggtagcagggatttcgtggaaggactctccggtgccacatgggtggacgtagtgttggagcatgggagctgcgtgaccacgatggccaaagacaaacccacactagacatcgaactccttaagacggaggtcaccaaccctgctatcctgaggaagttgtgcattgaggccaagatctccaacaccaccaccgattctcgctgccccacacagggcgaggccacccttgtggaggagcaggacgccaactttgtgtgccggcgcacattcgtcgaccggggatgggggaacggctgcggactgttcgggaaggggagtctcattacgtgtgccaagttcaagtgcgtgacgaagcttgagggcaagatcgtgcagtatgagaatttaaaatatagcgtcattgtgaccgtgcacaccggagatcagcaccaagtcggcaacgagtcgacggagcacggcacaaccgcgaccatcacgccacaggctcccacgacagagatccagctcaccgactacggtgccctgaccttggactgcagcccccgtacgggcttagatttcaatgagatggtgctcctgaccatgaaggagaagtcctggctggttcacaagcagtggttccttgatctgcccctcccgtggacctccggtgcgagcacctcccaggagacgtggaatcggcaagacctgctcgtgaccttcaaaactgcccacgcgaagaagcaagaggtggtcgtcctcggaagccaggagggcgctatgcacaccgccctgacgggggctactgaaattcagacctccggcaccacgaccatcttcgccgggcacctcaagtgccgcctcaagatggacaaactaaccctgaagggcatgagctacgtgatgtgtaccggatccttcaagctcgagaaggaagtcgcggagacgcagcacggcactgtcctggtgcagataaagtacgagggcaccgacgccccttgcaagatccccttctcaacacaggacgagaagggggtcacgcaaaatgggcggctaatcaccgccaacccgatcgtgaccgaccgcgagaagcccgtgaacattgaggccgagccgcccttcggagagtcctatatagttatcggcgcgggcgagaaggcccttaaactcagctggtttaagaaggggagtagcattgggaagatgttcgaggccacagcccgcggggcacgtcgcatggccatccttggcgacaccgcctgggatttcggctccatcggcggcgtgttcacctcagtggggaagctggtccaccagatcttcggtacggcgtacggggtactgttctccggcgtgagctggaccatgaaaatcggaatcggcgtcctgctgacttggctcggcttaaattcccggagcacctccctgagcatgacctgcattgccgtggggctcgttacattatatctgggcgtcatggtgcaggccgactccgggtgcgttataaactggaaaggccgcgagctcaagtgcgggtcgggcatctttgtcaccaacgaggtacatacctggaccgagcagtacaagttccaggctgatagtccaaagcggctgtccgccgccataggcaaagcgtgggaggagggagtgtgcggcattcgcagcgctacccggctggagaacatcatgtggaagcagatttccaacgagctcaaccacatcttgctggagaacgacatgaagttcaccgttgtggttggggacgtagcgggcatcctggcccaggggaagaagatgatccggccacagccgatggagtacaagtactcctggaagtcctggggcaaagcaaagatcatcggcgctgacgtgcaaaacacgaccttcatcattgacggccccaacaccccggagtgccccgacgaccagcgggcgtggaacatctgggaggtggaggactacggcttcgggatcttcacaacgaatatctggcttaagctgcgagacagctacacccaggtctgcgaccaccggctcatgtccgccgccatcaaagattctaaagccgtgcacgcggacatggggtattggatcgaatcagagaagaacgagacctggaagctggcgcgcgcgagcttcatcgaggtgaagacctgcatctggccgaaaagtcacacgctgtggagcaacggcgtcctcgaatccgagatgattatccccaagatctacgggggcccgatcagccaacataactaccggcccggctacttcacccagaccgccggaccctggcaccttgggaaactggagctcgacttcgacctgtgcgagggcaccacggtggttgtcgacgagcactgcgggaaccgcggtccgtccctgcggaccaccaccgtgacgggcaagatcatccatgagtggtgctgcagaagttgcactttgccacccctccggttccgcggggaggatggctgctggtacgggatggagattcggcccgtgaaagaaaaggaggagaacctggtcaagtccatggtgagcgccggcagcggagaggtagacagtttcagtctcggattactgtgcatcagcatcatgatcgaggaggtcatgcgcagccggtggagccgcaagatgctcatgaccggcaccctggcagtgtttctactcctgatcatggggcagctgacgtggaacgacctaatccgcctgtgtatcatggtgggcgcgaacgccagtgaccggatggggatgggcacaacatatctggccctcatggcaacctttaagatgcgcccgatgttcgccgtagggctgctgtttcggagactcacatcccgggaggtcctgctactcactatcgggctgagtttagtggcgtccgttgagctgcccaatagcctggaggagctgggagacggtttagccatgggcataatgatcctgaagctgctcaccgactttcagtcccaccagctgtgggcgaccctcctcagcctgacgttcataaagaccaccttctcgctgcactacgcgtggaaaaccatggcgatggtgctcagcatagtctccctgttccccctgtgcctgtcaacaaccagtcagaagaccacctggctgcccgttctgctcggcagcctgggctgcaagcctctgacgatgttcctaatcgctgaaaacaagatatggggccgccgatcatggccactcaacgaggggatcatggccgtgggaatcgtcagcatcctgctctcgtcgcttctgaagaatgacgtgcccctagccgggcccctcatcgccggcggcatgcttattgcttgttacgtgataagcggttccagcgccgacctctcccttgagaaggccgccgaggtcagctgggaggaggaggccgagcacagtggcgcgtcacacaatattcttgtggaggtccaggacgatgggactatgaagatcaaggacgaggagcgggacgacaccctcaccatcctgctcaaggcgaccctcctggccgtctccggcgtgtatccgctgtcaatccccgccaccctgttcgtgtggtacttctggcagaagaaaaagcagcgctccggggtcctgtgggacactcccagcccgccggaggtggagcgcgcagtgctggacgacggcatctaccggatcatgcagcgcggcctgctcgggcggtcccaggtaggcgtgggggtattccaagaaaacgtcttccacaccatgtggcacgttacgcgcggcgcggtgctgatgtaccaggggaagcgactggagcccagctgggcttccgtcaagaaggacctcatctcttacggagggggctggagattgcaggggtcctggaacacgggtgaggaagtccaggtcatagccgtcgagccaggtaagaaccccaagaacgtgcaaacggcccccgggaccttcaaaactcccgagggagaggtgggagctatagctctggactttaagcccgggacgtcaggctcccccatcgtcaaccgggagggaaagatcgtggggctctacggcaacggggtcgtcaccaccagcggcacctacgtgagcgccatcgcccaggccaaggcgagtcaggaggggcctctgcccgagatcgaagatgaggtgttccgaaagcggaatctgacaatcatggaccttcaccccggctctgggaagacccgccggtacctgccggctatcgtccgcgaggccatcaagcgcagactgaggaccctcatcctggcccccacacgggtagtagcctcggagatggcggaagcactgaagggcatgcccatccgctaccagacgacagccgtgaagagcgagcacaccggcaaggagatcgtggatttgatgtgccacgctaccttcacgatgcgtttactgtcccccgtacgcgtcccaaattataatatgatcatcatggatgaagcacacttcacggaccccagctccatcgccgcccgggggtatatctcgacccgcgtgggaatgggggaagctgcggccatctttatgacggctacgccgcctggcagcgtagaggccttcccccaatccaacgccgtcatacaggacgaggaacgcgacatcccagagcgctcttggaactcggggtacgagtggatcaccgatttccccggcaagaccgtgtggttcgtgccttccatcaagagcggcaacgacatcgccaactgcttgcggaagaacgggaaacgcgtgatccagctgtcccggaagaccttcgatacggagtaccagaagaccaagaacaacgactgggactatgtggtgaccaccgacatcagcgagatgggagcgaattttcgcgccgaccgggtgattgaccctcgccggtgtctgaagcccgtgatcctcaaggatgggcccgagcgcgttatcctggccggccccatgccggtgaccgtggcctcagccgcgcagcggcgcgggcgcattggccggaaccacaacaaggaaggcgaccagtatatctacatggggcagcctctgaacaatgacgaggatcatgcccactggaccgaggccaagatgctcctggataacatcaatacccccgagggcatcatacccgctctgtttgagccggagcgagagaaatccgccgcgattgacggcgagtaccgcctccgcggcgaggcacgaaagacgttcgtggaactgatgcgacgcggggacctgcccgtgtggctctcttataaggtggccagcgagggcttccaatacagcgaccgccggtggtgcttcgacggcgagagaaacaaccaagtactggaggagaatatggatgtggagatctggactaaggagggggagcggaagaaactgcggccccgatggttggacgcccgtacctactccgaccccctggccctgcgggagttcaaggagttcgcagccggcagacggagcgtcagcggggacctcatcctggagatcggcaagctgccgcagcacttaacacagagagcccagaatgctctagacaacctcgtgatgctccacaacagcgaacaaggcgggcgggcgtaccgccacgccatggaggaacttcccgacaccatcgagacgctcatgctgctggcccttatcgccgtactcaccggcggcgtgacgctgttcttcctgtccggccggggcctcggcaagacaagcatcgggctgctgtgtgtcatggcctcttcggtgctcctgtggatggcgagcgtggagccccactggattgccgccagcatcatcttagagttcttcctcatggtccttctgatccccgagccggaccgccagcgcacgccccaggacaatcaactcgcctacgtagtgatcggtctgcttttcatgatcttgaccgtggccgcgaacgagatgggccttctggaaaccaccaagaaggacttagggatcggccacgtggctgtggggaaccaccaccacgcagccatgttggacgtcgacttgcaccccgcctctgcgtggaccttatacgctgtggccacgaccatcatcaccccgatgatgcggcacaccatcgaaaatacgaccgcaaacataagcctgaccgccatcgccaaccaggccgccatcctgatgggcctcgataagggctggcccatctccaagatggacattggggtgcctttgctagccttgggctgctacagccaagtcaacccactgacgctgaccgcggccgttctcatgctagtggctcattatgccatcatcgggccgggcctgcaggccaaggccacacgcgaagcccagaagcggacagccgccggaatcatgaagaatcccacggtcgacggaatcgttgccatcgaccttgaccctgtagtctatgacgcgaagttcgagaagcaactgggccagatcatgttgctcatcctgtgcacgagtcagatcttactcatgaggaccacctgggctctgtgcgagagcattaccctagccacgggtcccctaaccaccctgtgggaaggctccccggggaagttttggaacaccacgatcgccgtgagcatggcaaacatcttccggggctcctacctcgctggcgccggtctcgccttctctctgatgaagtctctaggcggggggagaagagggaccggcgcccagggcgagactctcggggagaagtggaagcgacagttgaaccaactgtccaagagcgagttcaacacgtacaagcggtccggcatcatggaggtggaccgctcggaagcgaaggaggggctcaagagaggcgagacgaccaaacacgccgtctcccgcgggactgccaaactgcggtggttcgttgagcgtaacctggtcaagcctgagggcaaggtcatagacctgggctgcgggaggggcggctggtcgtactactgcgcgggcttaaagaaggtgacggaggtgaaagggtacacgaagggcgggcccgggcatgaggagcccatcccgatggcgacgtacggctggaacctggtcaagctgcactccggaaaagacgtttttttcatcccgcccgagaagtgtgacaccctcctgtgcgacatcggcgagagctccccgaacccgacgatcgaggagggccgcacgctacgggtgttaaagatggtcgagccttggctacgaggcaaccagttctgcatcaagatattgaacccctacatgcctagtgtagtggagacactcgagcagatgcaacggaaacacggcgggatgctggtacgcaaccctctgagccgaaacagcacccacgagatgtactgggtgtcctgcggcaccgggaatatcgtgagcgcggtcaacatgacctcacggatgctcctgaaccgcttcaccatggctcaccgaaaaccgacctatgagagagatgtggacctgggcgccggcacccgtcacgtggcggtcgagcccgaggttgcaaacctcgacatcatcgggcagcgcatcgagaacataaaacacgagcataagtctacgtggcactacgacgaagacaacccttacaagacgtgggcgtaccacggctcgtacgaggtgaaaccgagcggctctgcgagcagcatggtcaacggcgtagtcaagctgctgaccaagccctgggacgtgattcccatggttactcagatcgctatgaccgacactaccccctttgggcagcagcgagttttcaaggaaaaggtggacacccgcaccccgaaggccaagcgggggacggcccagataatggaagtcaccgctaagtggttatggggattcttgagccgcaacaaaaagccccggatctgtactcgcgaggagttcacccgtaaggtgcgcagcaacgccgccatcggggccgtgtttgtggatgagaatcagtggaactccgctaaggaggccgttgaggacgagcggttttgggatctcgtgcataaggagcgcgagttacacaaacaggggaagtgcgccacgtgcgtgtacaacatgatggggaagcgggagaagaagctgggcgagttcgggaaggctaagggcagccgcgccatctggtacatgtggttaggcgcgaggttcttagagtttgaggccctggggttcatgaacgaggatcactggttctcccgtgagaatagcctgtccggcgtcgagggggagggcctccacaagctggggtacatcctgagggacatctcgaaaatccctggcgggaacatgtacgcggacgacacagccgggtgggacacccgtatcaccgaagatgaccttcagaacgaggcgcgcatcacggacatcatggaaccggagcacgcgctgctcgcgaaatccatcttcaagctaacctatcagaataaggtcgtgcgggtccaacgcccagccaagaacggcaccgtcatggacgtgattagccggcgcgaccagcggggtagcggccaggtcggcacttacgggctgaatacgttcactaacatggaggcccaactgattcgccagatggagagtgaggggatattcagcccttccgagctcgagacgccgaacctagccgagcgtgtgctggactggctggaaaagtacggggtggagcgtctgaaacggatggcgatctccggtgatgactgcgtcgtgaagccgatcgatgacagatttgccaccgccctgacggcccttaacgacatggggaaggtgcggaaagatatccctcagtgggaaccaagcaaaggctggaacgactggcagcaggtccccttctgctcccaccacttccatcaactgatcatgaaggacggtagagagatcgtggtgccctgccggaatcaggatgagctggttggacgcgcgcgggtgtctcagggtgcggggtggtccctccgtgagaccgcttgcctgggcaagtcctatgctcagatgtggcagctgatgtactttcaccggcgcgaccttcggctggctgcgaacgccatctgttcagccgtgccagtcgactggattcccacatcccgcaccacctggtcaatccacgctcaccaccagtggatgaccaccgaggacatgctgagtgtgtggaacagagtctggatcgaggagaacccctggatggaggacaagactcacatcagcagttggggcgacgtcccgtacctcggcaagcgggaggaccagtggtgcggcagccttatagggctgacggcacgtgcgacctgggccaccaatatacaagtggccatcaaccaagtgcggcgccttatcggaaacgagaactacctggactacatgacctccatgaagcggtttaaaaacgagagcgaccccgagggggccctgtggtag

SEQ ID NO: 23802 - RNA, 9879 nt, synthetic construct
  misc_feature 1..9879: note = derived and/or modified CDS sequence (opt11) from DENV-1__GU131921__SS-prME
  source 1..9879: mol_type = other RNA
agcgttactatgctgctcatgctgatgcccaccgcactggcgtttcacctgactacacggggcggagaaccccacatgatagtgagcaagcaagagcggggcaagagcctgctgttcaagacaagcgccggggtcaatatgtgtaccttaattgccatggacctgggcgagctgtgcgaagacacgatgacctacaaatgccccaggatcaccgaagctgagccagacgacgtggactgttggtgcaatgccaccgatacctgggtgacctatggtacctgttcgcaaaccggcgaacatcggagagacaaacgtagcgtggcgctcgctccccacgtcgggcttggcctggagacgcgcacagagacctggatgagcagtgaaggcgcatggaagcagatacaacgggtcgagacgtgggctctccgccaccctgggttcacggtgatggccctgttcctggcgcatgccatcggcacgtctatcacccagaaggggatcatcttcatcttgctgatgttagtgaccccctccatggccatgaggtgcgtgggcatcggctcgcgcgattttgtggagggtctctccggagccacgtgggtagacgtcgtgctggagcacggctcctgcgtgacgaccatggctaaagacaagcccacattggacatagagctcctgaagacagaagtgactaacccggcgatcctgcggaagctctgcattgaggccaagatctcaaacaccaccacggattctcgctgcccgacccagggcgaggctaccctggtggaagagcaggacgctaactttgtctgccggcgcactttcgtcgaccgtggctggggcaacggctgcgggctgtttggcaaagggtcactcattacgtgcgccaagttcaagtgcgtgacaaaattggagggcaaaattgtacagtacgagaacctgaaatactcggtcatcgtgaccgttcacacaggcgaccagcaccaggtcgggaacgagtccacggagcatggcacgaccgcgaccatcacgccccaggcccccatgaccgagatccagctcaccgactacggagcgttgacgctggattgcagcccccgcacagggttagacttcaacgagatggttctactgaccatgaaggagaaatcctggctcgtacacaaacagtggttcttagacctgccattgccttggaccagcggggctagcaccagccaggagacctggaaccggcaggacctactggtaacgttcaagaccgctcacgcgaagaagcaagaagtggttgtgctgggcagccaggagggggcgatgcacaccgcccttacgggggcaactgagatccagaccagcgggaccacgacgatcttcgccgggcatctaaagtgccggctcaagatggacaagctgaccctgaagggcatgagctacgtgatgtgcactgggtcctttaaactagagaaggaggtggcggaaacacagcacggcacggttctggtgcagatcaagtacgagggcacggacgccccctgcaagatccctttctccacccaggacgagaagggggtgacccaaaacggccggctgatcaccgcaaatcctatcgtgaccgataaagagaagcccgtaaatatcgaggccgaacctcccttcggggagtcctacatcgtaatcggagcgggcgagaaggcactgaagctcagttggttcaagaaggggagtagcatcggcaagatgttcgaggccaccgcccgcggggcacggcgaatggccatcctaggcgacacagcctgggacttcggtagcatcggcggtgtgtttacgtcagtcgggaagctggtgcaccaaatcttcggcgccgcctacggggtcctcttctccggcgtgtcatggaccatgaagatcgggatcggagtcctgctgacctggctgggactgaactcccggtctacctccctttctatgacgtgcatcgcagtagggctcgttaccctgtatctcggcgtcatggtgcaagcggactccgggtgcgttatcaactggaaaggccgggagctcaagtgtggaagcggcattttcgtgacaaacgaggttcacacctggacggaacaatacaagttccaagccgattcccccaagcgcctctccgccgccatcggcaaggcctgggaggaaggggtgtgcggcatacggagcgctacccgcctggagaatatcatgtggaagcagatttcaaacgagttaaatcacatcctgctggaaaacgacatgaagttcaccgtcgtcgttggggacgtcgcaggcatactcgcacaggggaagaaaatgatcagaccacagcctatggagtacaagtacagctggaagtcctggggcaaagcgaagatcattggtgcggacgttcagaacaccacgttcatcattgatgggcccaacacaccggagtgccccgacgaccagcgcgcgtggaacatctgggaagtggaagattatggcttcgggatttttaccacgaatatctggctgaaactgcgggacagctacacccaagtctgcgatcataggctcatgtccgccgccatcaaagatagcaaggccgtgcacgcggacatgggctactggatcgagtccgagaagaatgaaacgtggaagctggcgcgggccagcttcatcgaagtgaagacgtgtatctggcccaaatcccacaccctttggagcaacggcgtcctcgaatccgagatgattatccctaagatctacgggggcccgataagccagcacaactaccgccccggctacttcacccagacggcagggccctggcacctggggaagctggagctcgacttcgatctctgcgaaggcaccactgtggtggtcgatgagcactgcggcaaccggggaccgtccctgcgcaccacgaccgtgacggggaagataattcacgagtggtgctgccggagctgcaccctcccgcccctccgcttccgtggggaggacgggtgctggtacggcatggagattcgccccgtgaaggagaaagaggagaacttggtcaagtcgatggtgagcgccggcagcggggaggtcgactccttcagccttgggctgctgtgcatctccatcatgattgaggaggtaatgcggtctaggtggagtcggaagatgctcatgacaggcacgctggctgtgttcctgctcctgatcatggggcagctgacctggaacgacctcatacgactgtgcatcatggtaggtgccaacgcaagcgatcgcatggggatgggcaccacgtacctggccttaatggccaccttcaagatgaggccaatgtttgcggtcggactcctgttccgtcggctgacttctagggaggtgctactgctgaccatcggactaagcttagttgcatccgtcgagctgcctaacagcttagaagagctaggcgacgggctagccatgggcatcatgatcttaaaactgctgacggatttccagtcccatcaattgtgggccaccctgctcagtctgaccttcatcaaaaccacgttttccctgcactacgcgtggaagaccatggccatggtgctcagcattgtctccctgttcccactctgcctcagcaccacatcccaaaagacgacctggttgcccgttctgctcggctcgctagggtgtaaaccacttaccatgttcctcatcgcggagaataaaatctggggccggcgctcatggcccctgaacgaggggatcatggccgtaggcatagtcagcatcttactcagctccctgctgaagaacgacgtgcccctcgccgggcccctcatcgccggaggcatgctgatcgcgtgctacgtcatctccgggagtagcgcggacctgtccctggagaaagccgccgaggtcagctgggaggaggaggcagaacattccggcgctagccacaacatcctggtggaggtgcaggacgacggaaccatgaagataaaggacgaagagcgggacgacacgctcaccatattactgaaggccactctcttggccgtctccggcgtgtatccgctgagcatccccgcgacacttttcgtgtggtacttttggcagaagaagaagcaacggtccggagtcctgtgggacacacccagcccgcccgaagtcgagaaagcggttctcgacgacggaatctatcggatcatgcaaagaggactgctcggccggtcccaggtcggcgtaggagtgtttcaggagaatgtatttcacacgatgtggcatgtgactcgcggcgccgtgctcatgtaccaggggaagcgcctggagccaagctgggcgtccgtcaagaaagatctaataagctacggaggcggttggcgcctgcagggctcctggaataccggggaggaagtccaggtgatcgcagttgagcccggcaaaaaccccaagaatgtgcagacagctccggggacgttcaagacccccgaaggcgaggtgggggcgatcgccttggacttcaaaccgggtacttccggctcccccatcgtcaaccgagaggggaagatcgtgggcctctacggcaacggggtggtcaccacgtcgggcacctacgtgagcgccatcgcccaagcgaaggcctcccaggaggggccgctgcccgaaattgaggacgaggtctttcgcaagagaaatctgaccataatggacctccacccgggatcggggaagactcgccggtacctgccggccatcgtccgcgaggcgatcaagcggaagttgcgcacgttgatcctcgcacctacccgcgtagtggcttccgagatggcagaggcgctaaagggaatgccgatcagataccagacgactgctgtcaagagtgagcacacgggcaaggagatcgtggacctgatgtgccacgccacctttaccatgcgcctgctgtcacccgtgcgggtcccgaattacaatatgatcatcatggacgaggcgcactttaccgacccttctagcatcgcagcccgcgggtacatcagcacccgggtgggcatgggggaagcggccgcgatcttcatgactgccacgccgcccggctccgtggaggccttcccgcagagcaacgcggtcatacaggacgaggagagggacataccagagcggtcatggaatagcgggtacgagtggatcaccgacttcccaggcaaaacggtatggttcgtaccctccatcaagagcggcaacgacatagcgaactgcctccgcaagaacggcaagcgcgttatccagctgagccgtaaaaccttcgacaccgagtaccaaaagaccaagaacaacgactgggactacgtggtgaccaccgacatctccgaaatgggcgcaaattttagagcagatcgggtcatcgacccgcgacgctgtctgaagcccgtcatcctcaaggacgggcccgagcgcgtgatcctggccggccccatgccggtcacagtagcctccgcagcccagcgccgggggaggatcggccggaaccataacaaggagggagaccagtacatctatatggggcagccgctgaacaatgacgaagaccacgctcactggaccgaggccaagatgctccttgacaacatcaacaccccagagggtattatccccgcgctcttcgagccggagagggagaagtcggcggctatcgacggtgagtatcgccttcggggtgaggcccgcaaaacctttgtcgagctaatgcgccgcggggacctccccgtgtggctctcatacaaggtggcaagcgaaggattccagtacagcgaccggaggtggtgcttcgacggtgagcggaataaccaggtcctggaggagaatatggacgtcgagatttggaccaaggagggcgagcgcaagaagctgcggccccgctggctcgacgcccggacctactccgaccccctggcgctgcgcgagttcaaagaattcgcggcaggcagacgctcggtatccggcgacctcatcctggagatcggcaaactgccacagcacctcacccagagggcccagaatgcgttagataatttagtcatgctccacaacagcgagcagggtggccgcgcataccggcacgccatggaggagttgccggacaccatcgagacattaatgctcctagccctgatcgccgtgctaacaggcggagtaactctgttctttctgtcgggccgcgggctcggtaaaaccagcatcggtttactgtgcgttatggcgagtagcgtgctcctgtggatggccagtgttgagccccactggatcgccgccagcattatacttgagttcttcttgatggtactgctgatccccgagccggatagacagcgcacaccccaggacaatcagctcgcctacgtggtgatcgggcttctgttcatgatcctcaccgttgcagcgaacgaaatgggccttcttgagaccacgaagaaagacctcgggattggccacgtggcggtcgggaaccatcaccacgccgccatgctggacgtcgacctgcatcctgcaagcgcctggaccctctacgccgtggccaccaccatcatcaccccgatgatgcggcacaccatcgaaaacacgactgccaacatcagcctgacggcgatcgccaaccaggccgccatcctaatgggactcgataagggctggcccatatccaagatggatataggcgtgcccctgttggcgctcggttgttactctcaggtcaaccccctgacgctaaccgccgccgtgctcatgctggtggctcactacgccatcatagggccaggtctgcaggctaaagccacccgcgaggcgcagaaaaggactgcagcaggaatcatgaagaacccaaccgtggacggcatcgtcgctatagatttggacccagtggtgtatgacgccaagttcgaaaagcagctgggccagatcatgctgctgatcttatgcacttcccagattctgctcatgcggaccacatgggccttatgcgagagcataaccctagccaccgggcccttaaccaccctgtgggagggctcccccgggaagttttggaacaccacaatcgccgtgagcatggccaacatcttcagaggctcgtacttagctggcgccgggctcgcattcagccttatgaagtccctgggggggggccgccgcgggaccggcgcgcagggcgagacgcttggggaaaagtggaagaggcagcttaatcagctgtcgaagagcgagttcaacacctacaagcgctcgggaatcatggaggtggaccggagcgaggctaaggaggggctcaagcgcggcgagacgaccaagcacgcagtctcccgggggacggccaagctgcgctggttcgttgagagaaacctggtgaagcccgagggcaaggtcatcgacctgggctgcgggcgcggcgggtggagctattactgcgccgggttgaagaaagtgaccgaagtgaaggggtacacgaagggcggccccgggcatgaggagcccattcccatggcgacctatggctggaacttggtcaagttgcacagtgggaaggacgtgttcttcatcccgcccgagaagtgcgacacgctcctgtgcgatatcggcgagagctctcccaacccgaccatcgaggagggtcggaccctgcgcgtgctcaaaatggtcgagccctggctgcgggggaaccagttctgcatcaagatcctgaacccctatatgcccagcgtggtagagaccttagaacagatgcagcgcaagcacggcgggatgctggtccggaaccctctgtcccgcaactcgacccatgagatgtattgggtgtcctgcggcaccggtaacatagtaagcgccgtcaacatgacctcccggatgttactgaaccgcttcacgatggcccaccgcaagcccacctacgaacgggatgtggatcttggagccggtacccgccatgtagccgtcgagcccgaggtagcgaacctcgacatcatcgggcagcggatagagaacatcaagcacgaacacaagtcgacctggcactatgacgaagataacccctacaaaacctgggcctaccacggttcctacgaggtgaagccgtcaggctccgcgagtagcatggtcaacggtgtagtcaagctgctgacaaaaccttgggatgtcatcccaatggtgacccagatagcgatgaccgatacgaccccgttcgggcagcagcgcgtattcaaggagaaggtggacacacggaccccgaaagccaagcgcggcactgcgcaaattatggaggtcaccgcgaagtggctctggggcttcctgtccagaaacaaaaagcctcgcatttgtacgcgggaggagttcacgaggaaagtccggagcaatgctgccataggcgcggtattcgtggatgagaaccagtggaactcagccaaggaggccgtcgaggacgagagattctgggacctcgtgcaccgggagcgcgagctccacaaacaaggcaaatgtgctacgtgcgtgtacaacatgatggggaagcgggagaagaagctaggcgagttcggtaaggcgaaaggttcgcgggcgatctggtacatgtggctgggcgcgaggttcttagagttcgaagccctcgggttcatgaacgaggaccactggttctcccgcgagaacagcctatccggcgtcgaaggggaggggctgcataagctggggtatatcctgcgggacattagcaagatccctgggggaaacatgtacgccgacgacaccgccggttgggacacgcgcataaccgaggacgacctgcaaaatgaagcgcggatcaccgacatcatggaaccagagcacgccttgttggcaaagagcattttcaagctcacctaccagaacaaggtggtgcgcgtccagcgccccgccaagaacggcacggtaatggacgttatatcccgtcgcgaccagcgggggtccggccaggtcggcacctacggtttgaacaccttcaccaacatggaagcccagctgatccggcagatggagagcgagggcatattctccccatcagagctcgaaacgcccaacttggcggagcgggtactcgattggctggagaagtatggggtcgagcgcctcaagcggatggccatctccggcgacgactgcgtcgtgaagccgatcgacgaccgctttgcaaccgccctaacagccctcaacgatatgggtaaggtgcggaaagatatcccgcaatgggagccctccaaaggctggaacgactggcagcaggtccccttctgctcccaccatttccaccagctgatcatgaaggatggccgcgaaatcgtggtcccgtgcagaaatcaggacgagttggtcgggcgagcccgggtgagccagggcgccgggtggagcctccgcgagaccgcatgcttgggcaagtcctacgctcagatgtggcagctgatgtacttccatcgccgcgacctacggctggcggccaatgccatctgctcagccgtgcctgtcgactggatccccacgtccaggaccacatggagcatccacgcacaccaccagtggatgaccacagaggacatgctgtccgtatggaatcgggtgtggatcgaggagaacccttggatggaggacaagacccacatcagttcttggggcgacgtgccgtacctcggtaagcgtgaggaccagtggtgcggaagcctaatagggctgacggcccgcgccacctgggcaacaaacatccaagtggcaatcaaccaggtgcggcgactcatcggcaacgaaaactacctggattatatgacctcaatgaagcggttcaagaacgagagcgatccggaaggggctctgtggtga

SEQ ID NO: 23803 - RNA, 9879 nt, synthetic construct
  misc_feature 1..9879: note = derived and/or modified CDS sequence (opt11) from DENV-1__GQ868635__SS-prME
  source 1..9879: mol_type = other RNA
agcgtcaccatgctgctcatgctgatgcccaccgccctggcattccacctcaccacccgggggggggaaccccacatgatcgtaagcaagcaggagcggggcaagtcgctgctgttcaagaccagcgccggagtcaacatgtgcaccttgattgcaatggatctgggcgaattatgcgaggacaccatgacatacaagtgcccgagaatcaccgaggccgagcccgacgacgtggactgctggtgcaacgccaccgacacctgggtcacctacgggacctgtagccagaccggcgagcaccggagggacaaacggtccgtggccctcgcgccccacgtgggcctggggctggagacgcgcaccgagacctggatgagctccgaaggcgcctggaagcagatccaacgggtcgagacctgggccctacgccaccccgggttcacggtgatggcgctgttcttagctcacgccatcggcaccagcatcacccagaagggaatcatcttcatactcctgatgctagtaaccccctccatggccatgcggtgcgtgggcatcggcagccgcgatttcgtggagggcctctcgggcgccacgtgggtggacgtcgttctagagcacgggagctgcgtgaccaccatggccaaggacaagcccaccctggatattgaactcctgaagacagaggtcaccaaccctgcgatcctgcgaaagctctgcatcgaggccaagatctccaacaccaccacggacagcagatgcccgacgcagggcgaggcgacgctggtcgaggagcaggacgccaacttcgtatgcagaaggactttcgtcgaccgcggctgggggaatggctgtgggctgttcgggaaggggagtctcatcacgtgcgcaaagttcaagtgcgtgaccaagctggagggcaagatcgtgcagtacgagaacctgaaatacagcgtcatcgttaccgtgcataccggcgaccagcaccaggtcgggaacgagtccacggagcacggcaccaccgcaactattacgccccaggctcccacgactgaaatccagctcaccgactacggggccctgaccttggactgcagccccagaacgggcctcgacttcaacgaaatggtgctgctcaccatgaaggagaagtcctggctagtccacaagcagtggttcctggacctgcccctcccctggaccagcggggctagcacctcccaggaaacgtggaaccggcaggacctgctggtcaccttcaagaccgcccacgcgaagaagcaggaggtggtcgtgctcggtagccaggagggcgccatgcacaccgccctcacgggggcaaccgagatccagacctccgggaccacgaccatattcgccgggcacctgaagtgccggctgaagatggataaactgaccttgaagggcatgagctacgtgatgtgcaccgggtccttcaagttagaaaaggaggtagcggagacacagcacggcaccgtactggtgcagatcaagtacgagggcaccgacgccccctgcaagatacccttcagcacgcaagacgagaagggggttacgcagaacggccggctgatcaccgcgaacccgatcgtgaccgacaaggaaaagcccgtgaacatcgaggccgagccgcccttcggggagtcctacatcgtcattggcgctggcgagaaggccctgaagctcagttggttcaagaaggggtccagcatcggcaagatgttcgaggccaccgcccgcggggcccggcgcatggcgatcctgggcgatactgcctgggacttcgggtccatcggtggcgtgttcacaagcgttgggaagctggtccaccagatcttcggcgccgcgtacggggtgctgttctccggcgtgagctggaccatgaagatcgggatcggcgtccttctaacgtggctcggtctgaactcccgaagcacgtcactgagcatgacctgtatcgcagtggggctcgtgaccctgtacctgggtgttatggtgcaggcggactccgggtgcgtgatcaactggaagggtcgggagctcaagtgcgggagcggcatcttcgtcacgaacgaggtgcacacgtggaccgagcagtacaaattccaggccgacagcccgaagcgcttgtccgccgccatagggaaggcctgggaagagggggtgtgtggcatccggagcgcgacccgcctggagaacatcatgtggaagcagatctccaacgagttgaaccacatcctgctggagaacgatatgaagttcaccgtggtggtgggggacgtcgccggcatcctcgcccaagggaaaaagatgatacggcctcagcccatggagtacaagtacagctggaagtcctggggcaaggccaaaatcatcggcgcggacgtgcagaacaccacctttatcatcgacggtcccaacaccccggaatgccccgacgaccagcgcgcctggaacatatgggaagtagaggactacggcttcgggatctttaccacgaacatctggctgaagctgagggactcgtacacgcaagtctgcgaccaccgcctcatgtccgccgccatcaaggactctaaggccgtgcatgcggacatgggctactggatcgaatctgaaaagaacgaaacctggaagctggcccgggccagcttcatcgaggtaaagacctgcatctggccaaagtcccacaccctttggagcaacggcgtcctcgagtccgagatgatcatcccgaagatctacgggggtccgatcagccagcacaactaccgccccgggtatttcacgcagaccgccggcccctggcacttagggaagctggagctcgacttcgacctgtgcgagggtaccaccgtcgtggtcgacgagcactgcggcaaccgggggccgtccctgcgcacgaccaccgtgaccggtaagatcatccacgagtggtgctgccggagctgcacgttaccgcccctccggtttcgcggggaggacggctgctggtacgggatggagatcaggcccgtgaaggaaaaggaggagaacctggtcaagtccatggtgagcgccggcagcggtgaggtggactccttcagcctcgggctgttgtgtatctccatcatgatagaggaggtcatgcgcagccgctggtcccggaagatgctcatgaccggcaccctggcggtattcctgctactgatcatggggcaactgacgtggaacgatctcatccgcctgtgcatcatggtgggcgccaacgcatcggaccgcatggggatgggcacgacatacctggccctcatggccaccttcaaaatgcggccgatgttcgccgtcgggctgctgttccgccggttaacctcccgcgaggtgctcctgttaacaatcgggctgagcctggtggcttccgtcgagctccccaacagcctggaggagctcggcgacgggctcgccatgggcatcatgatcctgaagctgctcaccgatttccagtcccaccagctgtgggccaccctgctcagcttgaccttcattaagactaccttctccctccactacgcgtggaagaccatggccatggtgctcagcatcgtctccctgttcccgctgtgcctctcgactacgtcccagaagaccacctggctgcccgtgttactaggctcactggggtgcaagccgctgaccatgttcctcattgccgagaataaaatctggggccggcgctcctggcccctgaacgaggggatcatggccgtgggcatcgtcagcatactgctcagctccctgctgaagaatgacgtgcccttggccgggccacttattgcgggcggtatgctgatcgcctgctacgtgattagcggttcctcggccgacctctcgctggagaaggccgccgaagtcagctgggaggaggaggcggaacactccggagcctcccacaacatcctggtcgaggtgcaggacgacggaacgatgaagatcaaggacgaggagcgggacgacaccctcaccatcctgctgaaggcgaccctcctggcagtatccggagtgtacccgctgagcatccccgccaccctcttcgtgtggtacttttggcagaagaagaagcaaagatccggggtcctgtgggacacgcccagccctcccgaagtggagaaggcggtgctggacgacgggatctaccggatcatgcagcgcggcctgctcgggcggtcccaggtcggcgtgggggtgttccaggagaatgtcttccacaccatgtggcacgtgacccggggcgccgtcctgatgtaccaggggaagcggctggagcccagctgggcctcggtcaagaaggacctcatcagctacgggggcgggtggcgcctccaagggtcctggaacaccggggaggaggtccaagtaatcgccgttgagcccgggaagaaccccaagaacgtacagacggcgcccgggaccttcaagacccccgaaggagaggtcggcgcgatcgccctggacttcaagcccgggaccagcggatcccccatcgtcaacagagaaggcaagatcgtgggcctctacggcaacggggtggtcacgaccagtggcacctacgtgagtgctatcgcccaggcgaaggcctcccaggaggggccgctgcccgaaatcgaggacgaagtgttccgcaaacggaacctgaccatcatggacctccaccccggctcagggaagacgcgtcggtatcttccggccatcgtacgcgaggccatcaaacggaagctgcgtaccctgatcctggcccccacccgggtggtggcgtccgagatggccgaggccctgaagggcatgcccatccgataccagacgacggcggttaagtctgagcacaccggcaaggagatcgtggacctcatgtgccacgccaccttcaccatgcgactgctgtcccccgtgcgggtcccgaactacaacatgatcatcatggacgaggcgcacttcacggaccccagctccattgccgcgcgcggttacatcagcacccgggtgggcatgggggaggccgccgcgatttttatgaccgccacgccgcccggctccgtggaagccttcccgcagagcaacgccgtcatccaggacgaagagcgcgacatccccgagcggtcctggaacagcgggtacgagtggatcacggacttccccggcaagaccgtgtggttcgtgccctcaattaagtcaggcaacgacatcgcgaactgcctccgaaagaacgggaagcgggtcatccagctgtcccgcaagacattcgacaccgagtaccagaagacgaagaacaacgactgggactacgtggtgaccaccgacatcagtgagatgggcgccaacttccgtgccgaccgcgtcatcgacccgcggcgctgccttaagccggtgatcttaaaagacgggcccgagcgggtgatcctggccggtcccatgccggtgaccgtggcctccgctgcgcagcgccgggggcgcatcggccggaaccacaacaaggagggtgaccagtacatttacatgggacagcccctgaacaatgacgaggaccatgcccactggacggaggctaaaatgctcctggacaacatcaacacccccgagggcatcattcccgctttgttcgaaccggagcgcgagaaatccgcggccatcgacggggagtaccgcctccggggcgaggcccgcaagaccttcgtagaactgatgcggcgcggggacctgcccgtgtggctctcctataaggtggccagcgagggtttccagtacagcgaccggcgctggtgcttcgacggcgaacggaataaccaagtcctggaggagaacatggacgtggaaatctggaccaaggagggggaacgcaagaagctgagacctcgctggctcgatgcccggacatactccgaccccttagcgctgcgggagtttaaggagttcgccgccggtcggcgctcagtgtctggggacctcatcctggagatcggcaagctgccccagcacctgacccaacgggcccagaacgcactggacaacctggtcatgctccacaactcggagcagggcgggcgcgcctaccggcacgccatggaggagctgccagacaccatcgagaccctgatgctcctggccctgattgccgtgctcacgggcggggtaaccctgttcttcctgtccggccgcgggttgggtaagacctctatcggtctgctatgcgtcatggcgtccagcgtgctcctgtggatggcctctgtggagccgcactggattgccgccagcatcattctggaatttttcctcatggtcctgctcatccccgagccggaccggcagcgcacgccccaggacaatcagctcgcctacgtggtgatcgggctcctgttcatgatcctcaccgtcgcggccaacgagatgggcctgctggagacgaccaagaaagacctcggtatcggccacgtggccgtgggaaaccaccatcacgccgccatgctggacgtagatctgcaccccgcatccgcctggaccttgtacgccgtggccactacgatcatcaccccgatgatgcggcacaccatcgagaataccacggcgaacatcagcctgaccgcgatcgccaaccaggccgctatcctgatgggcctcgacaagggctggcccatatccaagatggacatcggggtgcccctgctcgccctcggctgttactcgcaggtcaatccgctgacactcaccgctgccgtgctcatgttagtggcccactacgccatcatcgggccgggcctgcaggcgaaggccacgcgcgaggcccaaaagcgcaccgccgccgggatcatgaagaaccctaccgtcgacggcatcgtggcgatcgacctcgaccccgtggtctacgatgccaagttcgagaagcagctgggccagatcatgctgctgatcctgtgcacctcccaaatcctgctcatgcggacaacctgggctctgtgtgagtccatcaccctggccaccgggcccctcacgaccctgtgggagggctccccgggtaagttctggaataccaccatagccgtgagcatggcgaacatcttccgcggatcctacctggccggcgccggtctcgccttcagcctgatgaagtccctgggcggcgggcggcgcgggacgggcgcgcaaggcgagaccctcggggagaagtggaagcggcaactaaaccagctgtcgaagtccgagttcaacacctacaaacgctccggtatcatggaggtggaccggagcgaggctaaggaaggcctcaagcgcggggagaccacgaagcatgccgtctcccgggggaccgccaagttgcgctggttcgtggagcggaatctggttaagcccgagggcaaggtcatcgacctgggctgcgggcgcggcggatggagctactattgcgcaggactcaagaaggtaaccgaagtgaaggggtacaccaagggcggccccggacacgaggaacccatccccatggctacctacggctggaacctggtcaagctgcattccgggaaggacgtgttcttcatcccgcccgagaagtgcgatacactcctatgcgacatcggcgagagctcccccaacccaaccatcgaagaaggacggaccctgcgggtgctcaagatggtagaaccctggctgcggggcaaccagttctgtatcaagatcctgaatccctacatgcccagcgtggtggagacgctcgagcaaatgcagcggaagcacggcgggatgttagtccggaacccgctgtcccgcaacagcacccacgagatgtactgggtgtcctgcggcaccgggaatattgtaagcgccgtaaacatgacctcccggatgctgcttaaccgcttcaccatggcgcatcgcaagcccacgtacgagcgggacgttgacctcggcgccgggacccgccacgtggccgtcgagcccgaggtggcaaacttagacattatcgggcagcggatcgagaacatcaagcacgagcacaagtccacgtggcactacgatgaggacaacccctataagacctgggcctaccacggctcatacgaagtaaagccgagcggctccgccagcagcatggtcaatggcgtggttaagctcctgacgaagccctgggacgtaatccccatggtgacccagatcgccatgacggacactacgcccttcgggcagcaacgcgtctttaaggagaaggtagacacccgcactccgaaggccaagcgcggcaccgcgcagattatggaggtgacggccaagtggctctggggcttcctgtcccggaacaagaagccccgcatctgcacccgggaagagttcacacgcaaggtccggagcaacgccgccatcggggcggtcttcgtggacgagaaccagtggaactccgccaaggaggctgtagaggacgagagattttgggatctggtgcaccgggagagagaattgcacaagcagggcaagtgtgcgacgtgcgtgtacaacatgatggggaagcgagagaagaagctgggcgagttcgggaaggccaagggcagccgcgcgatctggtacatgtggctcggcgcccggttccttgagttcgaggccctggggttcatgaacgaggaccactggttctcccgcgagaactcactgtccggcgtcgaaggggagggtctccacaagttagggtacatcctgcgggacatcagcaaaatacccgggggcaacatgtacgctgacgacacggcagggtgggacacccgtatcaccgaggacgacctccagaacgaggccaggatcaccgacataatggaacctgagcacgctctgctggccaagtccatcttcaaactcacgtaccagaacaaagtagtgcgcgtccagcgccccgccaagaacggcacagtcatggacgtgataagccgtcgcgaccagcgcgggtccggccaggtcggcacctacgggcttaacaccttcacaaacatggaggcccagctgatccgccagatggagtcggagggcatcttctcccccagcgagctcgagaccccaaacctggcggagcgggtgcttgactggctcgagaagtacggggtggagcgcctgaagcggatggcaatctccggcgacgactgcgtcgtaaagccgatcgatgaccggttcgccaccgccttgacggccctcaacgatatggggaaggtgcggaaggacatcccccagtgggagcccagcaagggctggaacgactggcaacaagtccccttctgttcccaccacttccaccaactgatcatgaaggacggccgcgagatcgtggttccgtgccgaaaccaggacgagctggtggggcgcgcgcgggtgtcgcaaggcgccgggtggtccctgcgtgagacggcatgccttggcaagtcctacgcccagatgtggcagcttatgtacttccaccggcgcgacctcagactggcggccaacgccatctgtagcgcggtgcccgtcgattggatccccacctcccgaaccacctggtcgatccacgcccaccaccaatggatgacgactgaggacatgctgtccgtgtggaaccgggtgtggatagaggagaacccttggatggaggacaaaacccacatcagctcctggggcgacgtcccgtacctcggcaaacgcgaggaccagtggtgcgggagccttatcgggctgaccgcgcgcgccacgtgggccaccaacatccaggtggccataaatcaggtgcggcgtctcatcggcaacgaaaactacctcgactacatgacctccatgaagagattcaagaatgagagcgaccccgagggtgccctgtggtga

SEQ ID NO: 23804 - RNA, 9879 nt, synthetic construct
  misc_feature 1..9879: note = derived and/or modified CDS sequence (opt11) from DENV-1__GQ868636__SS-prME
  source 1..9879: mol_type = other RNA
agcgtgaccatgctgctaatgctgatgccgaccgcccttgccttccatctaaccacccggggcggagagccccacatgatagtgaccaagcaagagcgggggaagtcgctgttgtttaaaaccagcgcgggagtgaacatgtgcaccctcatcgcaatggacctgggtgaattgtgcgaggacaccatgacctacaaatgcccgcggatcaccgaagccgagccggacgacgtcgattgctggtgcaacgccaccgatacatgggtcacctacgggacttgctcccagaccggcgaacacaggagagacaagcggagcgtcgccttggcaccccacgtggggctgggactggagacccgcactgagacctggatgtccagcgagggcgcatggaagcaaatacagcgggtcgagacatgggccctcaggcaccccgggtttacagttatcgccctgttcctggctcacgcaatcggcacctccatcacacaaaaggggatcatcttcatcctcttaatgctggtgacgccgtcgatggccatgcgatgcgtgggcatcggctcccgcgacttcgtcgaagggttgagcggcgccacatgggtggacgtcgtgctggagcacgggtcctgcgtaacgaccatggccaaggataagcccactttagacatcgagctcctgaagaccgaagtcactaaccctgcggtgcttcgcaaactttgcatcgaggccaagatcagcaacactacgaccgattcgcggtgccccacccagggcgaagccaccttaatggaagaacaggacgcgaactttgtgtgccggagaacgttcgtcgaccggggctgggggaacggctgcgggctgttcggaaaggggagcctcatcacgtgcgcaaagttcaagtgcgtgaccaagctcgagggcaagatagttcagtatgagaacctcaagtactcggtaatcgttaccgttcacacaggcgaccagcaccaggtcggtaacgaaagcaccgagcacggaaccaccgcgaccatcacgccgcaggcccccacttccgaaattcagctcaccgattatggggccctgaccttggactgttctccccgcacgggactcgattttaacgaaatggttttgctgactatgaaagaaaagtcctggctcgtacacaagcagtggttcttggacctgccgctcccatggaccagcggggcatctacctcgcaggaaacgtggaatcgccaagatctgctcgtgaccttcaagaccgcacacgcaaagaagcaggaagtggtcgtcctcggtagccaagagggcgcaatgcacaccgccctgacgggggccaccgagatccagacctccggaaccacgacgatattcgccgggcacttgaagtgtcgactcaagatggataagctgaccctgaaaggcatgagctacgtgatgtgcaccgggtccttcaagctcgaaaaggaagtcgcggaaacgcagcacgggactgtgctagtccagatcaagtacgaaggcaccgacgccccgtgtaagatccccttcagtactcaagacgagaagggagtcacgcaaaacgggcggctaatcaccgccaacccgatcgtgactgacaaggagaagcccgtgaacatcgaggccgaacctcccttcggggagtcatacatcgtcatcggcgcgggcgagaaggccctgaagttaagctggttcaagaaagggtccagcatcggcaagatgtttgaagccaccgcccgtggggcccggaggatggcaattctgggcgacactgcctgggactttgggtccatcggcggagtgttcaccagtgtagggaagctggtccatcagatcttcggaaccgcctacggagtgttgttttccggcgtcagctggaccatgaagatcgggattggcgtactgttaacctggctcggtctgaactcccgaagtacctccctgtccatgacctgcatcgcggtagggctcgtgacactttacctgggcgtcatggtgcaggcggactccggttgcgttatcaactggaagggccgggagcttaagtgcgggagcggcatctttgtcactaatgaggtgcacacctggaccgagcagtacaagttccaggcagactcgcccaagcgactttccgccgccatcggaaaggcctgggaggagggggtgtgcgggatccggagtgctacccgccttgagaatatcatgtggaagcagatctccaatgaattgaaccatatcctgctggagaacgacatgaagttcaccgtggtggttggggacgtcgtgggcatcctggcgcaggggaagaagatgatccggccccaacctatggagcacaagtattcgtggaagtcctggggtaaggccaagatcatcggcgcagacgtgcagaacacgaccttcatcatcgacgggcccaacacaccggagtgccccgacgaccagcgcgcatggaacatctgggaggtcgaggactatggcttcgggatcttcaccacgaacatctggctgaaactgcgggacagctacacccaagtgtgcgaccaccgcctcatgtccgcggccatcaaggacagcaaggccgtccacgccgacatgggttactggatcgaatccgaaaaaaacgaaacttggaaactcgcgcgggcgtccttcatcgaggtcaagacgtgcatctggcccaagtctcacactctgtggagcaacggggtgctcgagtcggagatgatcattcccaagatctacggcggcccgatcagccagcacaactaccgccctggatatttcacccagacggccggcccctggcacctgggtaagctggagctcgactttgacctttgcgaaggtacgacggtggtcgttgacgagcattgcggcaaccgggggccgtccctgcgtacaaccacggtgactggtaagatcatccacgagtggtgctgccggagctgcacgctgccgcctctcagattcaagggggaggatggctgctggtatgggatggagatacggcccgtcaaggagaaggaggagaacctggtgaagtccatggtgagcgcgggcctcggcgaggtcgacagcttctcccttgggcttctctgcatcagcatcatgattgaggaggtgatgcgctctcggtggagccgcaagatgctgatggcgggcaccctggcagtgttcctcttgctgatcatggggcagttaacttggaatgacctgatacggctgtgcatcatggtcggcgcgaacgcctccgaccgcatggggatgggcacgacctatctcgccctgatggccaccttcaaaatgcgtcctatgttcgccgtggggctcttgttccggcggcttacctctcgggaggtgctgctcctgactatagggctgtccctcgtcgcgagtgtggagctacccaactccctggaggagctcggcgacgggttggccatgggcatcatgatactgaagctactgaccgatttccagagccaccagctgtgggccacgctcttatccctaacattcatcaagacgaccctcagcctgcaccacgcctggaaaactatggcgatggtcctcagtatagtgagcctcttccccctgtgcctgtccaccacgagccagaaaaccacctggctccccgtgctgctgggctccctcgggtgtaagcccctgaccatgttcctgatcgccgagaacaagatctggggtcgcaagagctggcccctcaacgagggaatcatggccgtaggggtagtgtccatcttgctgtcctcactcctgaagaacgacgtccccctcgccgggcccttgatagccggcggcatgctgatcgcgtgctacgtgatctccgggtcctccgccgacctgtcgctcgagaaggccgccgaggtttcctgggaggaggaggccgagcactccggcgcgtcccacaacatcctggtcgaggtacaggacgacggtacgatgaagattaaggatgaggagcgagatgacaccctgaccatcctcctgaaggccaccctcctcgcgatcagcggcgtctacccgttatccatccccgccaccctgttcgtctggtacttctggcagaagaagaagcagcgctctggggttctgtgggacacgcccagccctccggaggtggagcgggccgtactcgacgacggcatttaccgcatcatgcagcggggcctcctcgggagaagccaggtgggcgttggagtcttccaggagaacgtgtttcacaccatgtggcacgttactcggggcgcggtcctcatgtatcaagggaagcgcttagagccctcatgggcttctgtgaagaaagacctcatctcctacggcggtgggtggcggctccagggctcatggaacacaggagaggaggtgcaggtcatcgccgtggagcctggcaagaatcccaagaacgtccagacagctcccgggaccttcaagacaccagagggggaggtaggagccatcgcgttggatttcaagcctggaacctccggctcccccatcgtgaaccgcgaagggaaaatcgtcggcctgtacggcaacggtgtcgtgactaccagcggtacctacgtgagcgccatcgcacaggccaaggcgagccaggaggggccgctccccgagatcgaagacgaggtcttccggaagcgcaacctaaccatcatggacctgcaccccggctccgggaagacgcggcgctacttaccggcaatcgtacgggaggccataaagcgcaagttgcgaaccctaatcctcgccccaacccgcgtggtcgccagcgagatggcggaagctctgaagggcatgcccatccgctaccaaaccacggctgtgaagtcagagcacaccggcaaggagatcgtggacctgatgtgtcacgccaccttcacgatgagactgctgagccccgtcagggtgccgaactataacatgatcatcatggacgaggcccacttcactgacccctccagcatcgcggcacgggggtacatttccacccgcgtgggcatgggggaagctgctgccatcttcatgaccgcaacgccaccaggcagcgtcgaggcattcccgcagtccaacgccgtgatacaagacgaagagagagacatccctgagaggagctggaacagcgggtatgagtggatcacggacttccctggcaagaccgtgtggttcgtccccagcatcaaatccggcaacgacattgccaactgcctgcgcaagaacggtaagcgcgtgatccagctcagccgaaagaccttcgacaccgaataccagaagacgaagaacaacgactgggactacgtagtgaccactgacatatccgaaatgggcgccaacttccgcgccgaccgggtgattgacccgaggagatgcctgaagcctgtaatcttaaaagatggtcccgaacgcgtcatcttagccggccccatgccggtgaccgtagcctcggccgcacagcggagggggcggattggccgcaaccataacaaggagggtgaccaatacatctatatggggcagcccctgaacaacgacgaggaccacgcacactggactgaggccaagatgctgctcgacaacatcaacacccccgagggcattatccccgccctgtttgaaccggagcgggagaagagtgccgccatcgacggagagtaccgactgcgcggcgaagcccggaagacctttgtggagctcatgcggcgcggggacctgcctgtgtggctgtcttataaggtcgcctccgagggcttccagtactccgatcgccggtggtgctttgatggcgagcgcaacaatcaagtgctcgaggaaaacatggatgttgagatttggaccaaagagggggagcggaagaaactacgcccgcggtggctagacgcccggacatatagtgaccccctcgccctgagggagttcaaagagtttgcggccggcaggcggtccgtaagtggggacctgatcctcgagataggaaagctgccacagcacctgacacagcgagcacaaaatgccttggacaacttagtgatgctgcacaactccgagcaaggtggacgcgcgtacaggcatgccatggaggagctccccgacacaatcgagacccttatgctgctcgcgctgatcgccgtgctgacgggcggggtcaccttatttttcctgagcggccgggggctgggtaaaacctctatcggtctcctgtgtgtgatggcatcttccgtgctgctctggatggcgagcgtcgagccccactggatcgccgcatccattatcctggagtttttcctgatggtgctcctgatccccgagccggacagacaaagaacaccccaggacaaccagctagcctacgtggttatcgggctcctgttcatgatcctgaccgttgccgcaaacgagatgggcctcctggagacgaccaagaaagacctgggtatcggtcatgttgccgtcgagaaccaccaccacgccaccatgctcgacgtggaccttcaccccgccagcgcctggaccctgtacgcagttgcaacgactatcatcaccccgatgatgcgccacaccatcgagaacacaaccgctaacatatcactcacggcgatagccaaccaagctgcaatcctgatgggcctggacaagggctggcccatcagcaagatggatatcggcgtcccccttttagccctggggtgctacagtcaggtcaaccccctcacgctgacagccgcggtgcttatgcttgtcgcccattacgccattattggccctgggctgcaggccaaggccacccgggaggcgcagaagcgaaccgccgccggcatcatgaaaaaccccaccgtggacggcattgtcgccatcgacctggatcccgtcgtgtacgacgccaagttcgagaagcagctcggccagatcatgctgctgatcctctgcaccagccagatcctgctgatgcgcaccacatgggcgctatgcgagtccatcaccctggcaacgggccccctgaccaccttatgggaagggagcccgggcaagttctggaacaccacgatcgccgtgtcgatggcaaacatcttccgggggagctacctggccggcgctggtttagccttctccctcatgaagagcctggggggcgggcgacgggggaccggggcccagggcgagaccctgggcgagaagtggaagcgccaactcaaccagctgagcaagtccgagttcaacatctacaagcggagcgggatcatggaggtagaccgctctgaggcaaaggagggtctgaagcgcggtgagaccacgcgccacgcggtgagccggggcaccgcaaagctgcgctggttcgtggagcggaatctcgtcaagcctgagggaaaggtgatcgaccttggctgcggtcgcgggggctggtcctactactgcgccgggctgaagaaggtaacggaggtcaagggctacaccaagggcgggcccggccacgaggagcccatccctatggccacgtacggctggaacctcgtaaagctacattccggtaaggacgtgtttttcactccgccagagaggtgcgacaccctgctctgcgacataggggagtccagccctaacccgacgatcgaggagggacgcacactgagggtactgaagatggtggagccatggctccgggggaaccagttttgtatcaagatcctgaacccctacatgccatccgtggttgaaaccctggagcagatgcagcgtaaacacggcggcatgctcgtgcgcaatccgctgagccggaactccactcatgagatgtactgggtgagttgtgggacgggcaacatcgtgtccgcagtgaacatgacaagccgcatgctgctcaaccgctttaccatggcgcaccggaagcccacctacgagcgagacgtggacctgggggcgggcacaagacatgtggccgtggagcccgaggtggccaacttagacataatcggccagcgcatagaaaacatcaagcatgaacataagtccacctggcactacgacgaggacaacccctataagacgtgggcctaccacgggagctacgaggtgaagccttccggcagcgcgagctctatggtgaatggggtcgtgaagctactgactaagccctgggatgttatccccatggtcacccagatagccatgacagacacgacccctttcggccagcagcgggtgttcaaggagaaggtggacacccggaccccgaaggccaaacggggcactgcccagataatggaggtcaccgcacgctggctctggggcttcctctcgcggaataagaaaccccgcatctgcacccgggaggagttcacgcgcaaggtgcggagcaacgcggcgatcggcgcggtgtttgtcgacgagaaccagtggaactctgccaaggaggcggtggaggacgagcgcttctgggatctggtccagaaagaacgcgaactacataagcaggggaaatgcgccacgtgcgtctacaacatgatgggcaaacgcgaaaagaaacttggagagtttggcaaggcgaaggggtccagggcaatctggtacatgtggctgggtgccagattccttgaattcgaagcgctcggcttcatgaacgaggaccattggttcagccgggaaaactccctatcaggggtggagggcgaggggctgcataagctcggctacatccttcgcgatatctccaagatccccgggggcaacatgtacgccgacgacaccgccggctgggacacccgaatcaccgaggacgacctgcagaacgaggccaaaatcacggacatcatggagccggaacacgctcttttggcgacctccatcttcaagctgacctaccagaataaggtggtccgcgtccagcgcccagctaagaacgggaccgtaatggacgtcatctctcggcgcgaccagcggggcagcggccaggttggcacgtatggcttaaatacctttaccaacatggaggctcagcttatccgccagatggagtccgaagggatcttcctcccgtctgagctcgagactcccaacctggccgaacgcgttctggactggctggagaagcacggcgttgagcgcttgaaacgtatggccatctcgggggacgactgcgtggtgaagccgattgacgaccgcttcgcgacggctctgacagctcttaacgacatgggcaaggtgcggaaagacatccctcagtgggagcccagcaaagggtggaacgactggcagcaggtccccttctgctcccaccatttccaccagctgatcatgaaggacggccgcgagatcgtggtcccgtgccggaaccaggacgagcttgtgggtcgcgcacgggtgagccaaggtgccggctggagcctccgcgagaccgcttgcctgggcaagtcgtatgcgcagatgtggcagctaatgtactttcaccggcgcgacctcagactggccgccaacgcgatctgcagcgccgtccccgtggattgggtgcccacctctcgtacgacctggagcatccacgcccaccatcagtggatgacaacagaggatatgctgtccgtgtggaaccgggtgtggatagaggaaaacccatggatggaggacaagacgcacgtgagctcctggggagacgtcccgtatctcggcaagcgcgaggaccagtggtgcggcagtctgattggcctgaccgctcgcgcaacctgggcatccaatatccaagtggccatcaaccaggtgcggcgcctcatcgggaacgagaactacctggactacatgaccagcatgaagcgattcaagaacgaaggcgaccccgagggggccctgtggtag

SEQ ID NO: 23805 - RNA, 9879 nt, synthetic construct
  misc_feature 1..9879: note = derived and/or modified CDS sequence (opt11) from DENV-1__GU131922__SS-prME
  source 1..9879: mol_type = other RNA
agcgtgatcatgctgctcatgctgatgcccaccgccttagcattccatctcactacacgtggtggggaaccccacatgattgtgtccaagcaggaacggggaaagagccttttgtttaagacctcggccggggtgaatatgtgtaccctgatcgccatggatctgggcgagctgtgcgaagacaccatgacctataagtgcccccggatcaccgaggcggagccggacgacgttgactgctggtgcaacgccaccgatacctgggtaacatacgggacctgttcgcaaaccggcgagcaccggcgcgataagcgctccgtggccttggcaccccacgtcggtctggggttagagacccgcaccgaaacctggatgagctcagagggtgcatggaagcagatccagagggttgagacctgggcgctcaggcaccccggattcaccgtgatcgcgttgttcctggcacatgccatcggcacgagcatcacccaaaagggtataatcttcatcctcctgatgcttgtgacgccatccatggcgatgcggtgcgtaggtattggaagccgcgactttgtggagggtctctcgggggccacctgggtggacgtggtattagagcatggtagctgcgtgacgactatggccaaggacaagcccaccttggacatcgagctcctgaagaccgaagtcactaaccccgctatcctgcgcaagctctgcatcgaagctaagatcagtaacacaaccaccgacagccgctgcccgacgcagggcgaggccactctggtggaggagcaggatgccaacttcgtttgccggcggaccttcgtcgatcgggggtgggggaacggctgcggcctgttcgggaagggttcactcattacctgcgccaagttcaagtgcgtcacgaagctcgaaggcaaaatagtgcagtacgagaatctgaaatactcagtcatcgttaccgtgcacaccggcgaccagcatcaggtagggaatgaaagcaccgaacatggcacgaccgcgactatcacgccccaggcacccaccacggagatccagctgaccgattacggcgccctgacattagattgcagccctcggactggactcgacttcaatgagatggtgctgctgacgatgaaggagaagtcctggcttgtccataaacagtggttcctggacctgcccctcccttggaccagcggggcctcaacttcacaggagacctggaatcggcaggacttactggtgacgttcaagacggcccacgcgaagaagcaggaggtggttgtgctaggaagccaagagggagccatgcacaccgccttaaccggggccacggaaatccaaacctctggcaccaccacgatattcgccgggcacctgaagtgccgcctcaagatggacaagctgaccctgaagggtatgtcctacgtgatgtgcaccggctcgtttaagctcgagaaggaggtcgcagaaacccaacatggcacagtgctggtgcaaatcaagtatgagggcaccgatgccccctgcaagataccctttagcacccaggacgagaagggggtcacccaaaacggccggctgatcacggccaacccgatcgtcaccgacaaagagaagcccgtgaacattgaagccgagccgcccttcggggagtcctacattgtcataggcgcgggcgagaaggccttgaagctcagttggttcaagaaggggtcatcgattggcaagatgttcgaggcgacagcacgcggggccaggagaatggcgattctcggcgataccgcctgggacttcggatccattggaggcgtgttcactagcgtggggaaactggtacaccagatcttcggcaccgcctacggggtcctgttttcaggagtgtcttggaccatgaaaatcggcataggcgtactgctgacgtggctgggcttgaactcccgctctacatccttgagcatgacttgcatcgccgtcgggctcgtgaccctttacctgggagtgatggttcaggccgactccgggtgcgtgatcaactggaagggacgggagctcaagtgcggtagcggcatcttcgtaaccaacgaagtgcacacttggaccgagcagtacaagttccaggcggacagcccgaagcgcctatccgccgctatcggtaaggcttgggaggaaggggtgtgtggcattcggagcgccaccagacttgagaacattatgtggaagcagatctccaacgagcttaaccacatcctgctggaaaacgacatgaagttcacagtagtcgtgggggacgtcgcgggtatcctcgcgcaggggaagaagatgatccgccctcagcccatggagtacaagtactcgtggaaatcatggggcaaggccaaaatcatcggcgccgatgtccagaacaccacgttcatcatcgacgggcctaacactccggagtgcccagacgaccaacgcgcgtggaacatatgggaggtggaggactacggttttgggatattcactacgaacatctggctgaaactgcgagactcgtacacgcaggtctgcgaccaccgcctcatgtccgccgcgatcaaagatagcaaggccgtgcacgcggacatgggctactggatcgagagtgagaagaacgagacctggaagctggcgcgggcaagtttcatcgaggtgaagacctgcatctggcccaaatcccacaccctgtggagcaatggtgtcctcgagtccgagatgatcatccccaaaatctacggaggtcccatcagccagcacaactatcgcccggggtacttcacgcagaccgccggcccctggcacctgggcaagctggagctcgacttcgacttgtgtgagggcacaaccgtagtagtcgatgagcactgcggcaaccgggggccgagtctgcgtacgaccaccgtcaccggtaagatcatccacgaatggtgctgccggagctgcacgctcccgccactacgcttcagaggcgaagacggatgttggtacggaatggaaatccggcctgttaaggaaaaagaggagaacctggtcaagtccatggtgagcgctggcagcggcgaggtggactccttcagcctagggctgctgtgcatctccatcatgatcgaggaggtcatgcggagtaggtggtcccggaagatgctcatgaccggcacgctggctgtgttcctcttgttgatcatggggcagctgacatggaacgatttaatccgactgtgcatcatggtgggcgcgaacgccagcgaccgcatggggatgggcacgacctatctagctctcatggcgaccttcaagatgcgaccgatgttcgccgttgggctgctgttccgccggcttacctccagggaggtgctgttactcacaattgggctgagcctggtggcgtccgtagagctccccaacagcctcgaggaattgggcgatgggttagccatgggcatcatgatcctgaagttgttaaccgacttccagtcccaccaactgtgggccaccctgcttagcttgactttcatcaagacgaccttctctctgcattacgcttggaagacgatggcgatggtgctcagcattgtctctctgttccccctgtgcctttccaccacgagccagaagaccacctggctccccgtgctgctcggctctctggggtgcaagccgctgaccatgttcttaattgccgagaataagatatggggtaggagatcctggcccctcaacgaggggatcatggccgtggggatagtcagcatactgctgagctctctattgaaaaacgacgtgcccctcgcggggcccctgatcgcgggcggtatgctgatcgcctgctacgtgatcagcggatcgagcgcagatctttccctggaaaaggccgccgaggtcagctgggaggaggaggcagagcactccggcgcgagccacaatattttggtggaggttcaagacgatgggacgatgaaaattaaggacgaggagcgggacgacaccctcaccatcctgctgaaggccaccctcctggccgtttccggcgtgtacccgttaagcatccccgccacactctttgtctggtacttctggcagaagaagaagcagcgcagcggggtcctgtgggatactccaagcccgcccgaggtggagagagccgttctcgacgacggcatctaccgcatcatgcagcgtggcctgctcggccggtcccaggtcggcgtgggggtctttcaggagaacgtgttccacacgatgtggcacgtgacacggggcgcggtgctgatgtaccaggggaagcggctggagcccagttgggcctccgtaaagaaggatctcatctcctatggcggcggatggcggttgcagggtagttggaacacgggggaggaggtccaggtaatagccgtcgagccgggcaagaatccgaagaacgtgcagaccgcccctgggaccttcaagacccccgagggcgaggtcggggccattgcactggacttcaagccggggacgagcggatcccctatcgtaaaccgcgagggaaagatcgtgggcctctacggcaacggggtggtcacgaccagtggcacctacgtgtcagccattgcccaggcaaaagcgtcccaggaggggccgctgccggagatcgaagatgaggtctttcggaagcgcaacctgacgataatggacctccaccccggcagcgggaagactagacgatacctgccggccatcgtcagagaagccatcaagcgcaaactgcggaccctaatccttgctccaacgcgggttgtggccagcgagatggcggaagccttaaagggcatgcccatccgctaccagaccacggccgtcaagagcgagcacaccggaaaggagattgtcgatctcatgtgccacgccacctttaccatgcgcctgctgagccccgtgcgcgtcccgaactacaacatgattatcatggacgaagcccactttaccgaccccagctccattgctgcccgtggatacatcagcacccgcgtcggaatgggtgaggctgccgccatctttatgaccgcgacgccacctggatccgtggaggccttcccgcagagcaacgccgtcatccaggacgaggagcgtgacatacccgagcggagctggaacagcggctatgagtggatcacggactttcccggcaagaccgtgtggttcgtcccctccatcaagtccggcaacgacatcgccaactgcctccggaagaatgggaagcgtgtaatccaactgtcccgcaagactttcgacactgaatatcagaagacaaagaacaacgactgggactacgtggtgaccaccgacataagcgaaatgggcgcgaacttccgcgccgatcgggtaatcgatccccgtaggtgcctgaagcccgtcatactcaaggacggtcccgagcgcgtgattctggctggcccaatgcccgtcacggtggcctcggccgcgcagcggcgcgggcggatcggacgaaatcacaacaaggagggcgaccagtacatatacatgggtcagcccttaaacaacgacgaggatcacgctcactggacagaggccaagatgctcctcgacaacatcaacaccccggaaggcattatacccgcattgttcgagcccgagcgcgagaagtccgccgcgatcgatggggagtatcggctccggggcgaggcccggaagaccttcgtcgaactaatgcgccgcggggacctgccagtgtggctctcatacaaggtggcctcagaaggtttccaatatagcgacagacggtggtgctttgacggcgagcgcaataaccaagtcttagaggagaatatggacgtggagatctggacaaaggagggggagcggaagaagctgcggccccgctggctcgacgccaggacgtattcggaccccctggcattgcgggagttcaaagagtttgctgcgggccgccggagcgtgtccggggacctcatcctggagatcggcaagctgccacagcacctcacccagagagcccagaacgccctggacaacttagtgatgttacacaatagcgagcagggcgggcgggcgtaccgccacgccatggaggagctgccggacactatagaaacactgatgctgctggcacttatagccgtcctcaccggcggagtgactctcttcttcctgagcggccgggggttaggcaagaccagcattggcttactgtgcgttatggccagcagcgtgctactgtggatggcgtcagtggagccccattggatcgccgcaagcatcatcttggagttcttcctcatggtcttactaatccctgagccggatcgccagcgaacgccccaggacaaccaactcgcgtacgtggttattggcctgcttttcatgatcctcaccgtagcggcgaacgagatgggcctgctcgaaacaaccaagaaggacttagggatcggccatgtggccgttgggaatcaccatcacgcagctatgctggacgtcgacctgcaccccgcgtccgcgtggaccctctacgccgtggcgaccacgatcatcaccccgatgatgcgccacaccatcgagaacactacggctaacatctcgctcaccgccatcgccaaccaagccgcgatcttgatgggcttagacaaagggtggccgatcagcaagatggacatcggggtgcccctgctagccttaggatgttacagccaggtaaacccgctgaccctgactgcagccgtgttaatgctggtggctcactacgccatcattggtccgggcctgcaggctaaagcgacgagagaggcacaaaaacggaccgccgcgggcattatgaagaaccccaccgtcgacggaatcgtggccatcgatttagaccctgtcgtctacgacgcgaagttcgaaaaacaactggggcagattatgctcctcatcctatgtacatctcaaatcctgcttatgcgcacgacttgggctctgtgtgagagcattacactggccaccgggccactcacgactctgtgggagggctccccggggaagttctggaacaccaccatcgctgtgtctatggccaacatctttcggggctcctacctggcgggcgccggtctcgctttcagcctgatgaagtccctaggagggggccgccgtgggactggggcccagggagagaccctcggggagaagtggaagcgccagctgaaccagctgagcaaatccgagttcaatacctacaagcggagcggaatcatggaagtcgaccgcagcgaggctaaagaagggctgaagagaggggaaaccactaagcatgccgtttcccgcgggacagccaagttgcgctggtttgtagaacgcaacttggtgaaacccgagggcaaggtaatagatctggggtgcggtcggggtggctggagctactactgcgcgggcctcaaaaaggtcaccgaggtcaaagggtataccaaaggtggccccgggcacgaggagcctatacccatggctacgtacggctggaacctggtcaaactgcattctggtaaagacgtctttttcataccccctgagaagtgtgacaccctcctgtgcgacatcggcgaaagctcccccaacccgactatcgaggaggggcgcacccttcgcgtgctcaagatggtcgagccctggctgcgcggcaatcagttctgcattaagatcttgaacccctacatgcccagcgtggtggagacgctcgagcagatgcaacggaagcacggtgggatgctcgtaaggaacccgctgtctcggaacagcacccacgagatgtactgggtgtcctgcggcactgggaacatcgtgtccgcagtcaatatgacatcccgcatgcttctgaaccgcttcaccatggcccaccggaaacccacgtacgagagggacgtggacctgggcgcgggcacgcgacacgtggcagtcgagcccgaggtggccaacctcgatatcataggtcagcgcatagagaacatcaagcacgaacacaagtccacgtggcactacgacgaggacaatccctacaaaacctgggcgtaccacggctcatacgaagtgaagccgtcagggtccgccagcagcatggttaacggcgttgtgaagctgctgacgaagccctgggacgtgatccccatggtgacccagatcgccatgactgatacaacgccattcggccagcagcgggtctttaaggaaaaggtggacacccgcactccgaaggcgaaaagaggaaccgcacagatcatggaggtgaccgcaaagtggctctggggattcctgtcgagaaacaaaaagccccgaatctgcacccgcgaggagttcacccggaaggtccgcagcaacgccgccataggtgccgtgttcgtggacgagaatcagtggaactccgcgaaggaggccgtcgaagatgagcggttctgggacctcgtacacaaggaacgcgagctccataagcaggggaagtgcgctacctgcgtctacaatatgatggggaagcgggagaagaagctgggcgaatttggtaaggctaagggctcccgcgcgatctggtacatgtggctaggcgctagattcctcgagtttgaggccctggggtttatgaacgaggaccactggttctcccgcgagaacagcctgtccggcgtagagggcgagggcctccacaaacttgggtacatactgcgggacatctccaagatcccaggcggcaacatgtacgcagatgatacggccgggtgggataccaggatcacggaggacgacctgcagaacgaggcccgaatcaccgacatcatggagccggagcacgctctcctagccaagtccattttcaagctcacgtaccagaacaaggtggttcgcgtccaacgccctgccaagaacggcaccgtaatggacgtgattagccgtagggaccagcggggctccgggcaggtcggcacttacgggctgaacaccttcacgaacatggaggcccagcttatccgccagatggagagtgagggaatcttcagcccctcggagttagagactcccaatttagcagagagagtgttagattggctcgagaagtacggtgtggagcgactcaagcgaatggcgatctccggggacgactgcgtcgtgaagccgatcgatgaccgcttcgcaaccgccctgaccgccctaaacgacatggggaaagttcggaaggacataccacagtgggagccctctaagggctggaacgactggcagcaagtacccttttgttcccaccacttccaccagttaataatgaaggacggccgcgagatcgtggtgccgtgccgcaatcaggatgagctggtggggagggcccgggtgagccagggtgcggggtggtcactacgcgagacggcctgcctgggcaagtcctatgcccagatgtggcagctgatgtacttccatcgcagagacctgagacttgcggcaaatgcaatctgcagcgccgttcccgtcgactggattcccacctcccgcacgacctggtcaatccacgcccatcaccagtggatgacaaccgaggacatgttgtcggtatggaaccgggtgtggatcgaagaaaatccctggatggaggacaagactcacatatcatcctggggcgacgtcccctacctgggtaagcgcgaggaccagtggtgcggcagcctgatcgggttaacagctcgcgctacctgggccactaacatccaagtggctatcaatcaggtgcggcgcctcatcggtaacgagaattatttagactacatgacctccatgaagcggttcaagaacgagagcgaccccgagggagccctgtggtga

SEQ ID NO: 23806 - RNA, 9879 nt, synthetic construct
  misc_feature 1..9879: note = derived and/or modified CDS sequence (opt11) from DENV-1__GU131923__SS-prME
  source 1..9879: mol_type = other RNA
agcgtgaccatgctgcttatgctgatgcccaccgccctggcctttcacctcaccacccggggcggggagccgcacatgatcgtgagcaagcaggaacggggcaaaagtctgctgttcaagaccagcgccggggtgaatatgtgcaccctcatcgccatggacctgggggaactgtgtgaggacacaatgacatacaagtgcccccgcatcaccgaagccgagcccgacgacgtggactgctggtgcaacgccaccgacacgtgggtgacctacggtacctgcagccaaaccggcgagcaccggcgagacaagcggtccgtggcgctagctccccacgtaggcctgggcctggagacgcgcaccgagacctggatgtccagcgagggcgcgtggaagcagatccagagggtggaaacctgggcacttcgccaccccggttttacagtgatcgccctgttcctcgcgcatgccatcggcacctctatcacccagaaggggatcatcttcatcctcctgatgctcgtgacccccagcatggccatgcggtgcgtcggcatcggctcgcgcgacttcgtggagggactctccggcgctacgtgggttgatgtcgtgcttgagcacgggtcttgcgtgaccaccatggccaaggataaacccaccttagacatcgagctactgaagacggaggtcaccaaccccgctatcctgcgaaagctctgtatcgaggccaagatttccaacactaccactgatagccgctgcccgacccagggcgaggccacgctggtggaggagcaggacgccaacttcgtgtgccggcgcactgtcgtggaccggggctggggcaacggctgtgggctgttcggcaaggggagtctcatcacttgcgccaagttcaagtgcgtgacgaagctggagggcaagatcgtgcaatacgagaacctgaagtacagcgtgattgtgactgtgcacaccggcgaccagcatcaggtggggaatgagtccacggagcacggcacgaccgccaccatcacgccccaggcacccacaaccgagatccaactcacggactacggagccctgaccctggactgcagcccccggacgggcctcgactttaatgaaatggtcctgttaaccatgaaggagaagtcctggctcgtgcacaagcagtggtttctggatctgcccctcccctggaccagcggagcgagcacctcacaggagacgtggaacagacaggacctgctcgtgaccttcaagacagcccacgcaaagaagcaggaggtcgtagtgttgggcagccaggagggcgctatgcacaccgccctgaccggggccaccgaaatccaaacctccggtaccacaaccatcttcgccgggcacctgaaatgccgccttaagatggacaagctaacactgaagggcatgagctacgtcatgtgtaccgggtcctttaagttagagaaggaggtggcggagacgcagcatggcaccgtgttagtccagatcaagtacgaaggcactgacgccccatgtaagatccctttcagcacccaggacgaaaaggggattacgcagaacggccgcctgatcacggctaatccgatcgtaaccgataaggagaagcccgtgaacatcgaggccgagcctccgttcggggagtcctacattgtcatcggcgccggcgagaaagccctgaaactcagctggttcaagaaggggtccagcataggcaagatgttcgaggccaccgcccgcggggccagacgcatggcgatactgggggatacggcgtgggattttgggtccatcgggggcgtttttaccagtgtggggaagctggtgcatcaaatcttcggaaccgcctacggggtcctcttctccggcgtgagctggaccatgaagatcggcatcggcgtcctgctgacgtggctcggcttaaactcccgaagtacctccctctcgatgacctgcatagccgtagggctcgtgaccctgtacctgggcgtcatggtgcaggccgactccgggtgcgtgattaactggaagggccgggagctcaagtgcgggagcggcattttcgtcacgaacgaggtgcacacctggaccgagcagtacaagttccaagcggacagcccgaagcgcctgtccgccgcaatcggcaaggcctgggaggaaggggtgtgcggcatccggagcgctacgaggctggagaacatcatgtggaaacagatctctaacgagctcaaccacattctgctggaaaacgacatgaaatttaccgtcgtggtgggagacgtcgcgggcatcctcgcccaaggaaagaagatgatcagaccccagcccatggaatacaagtacagctggaagtcctggggcaaggccaagatcataggcgcagatgtgcagaacacgacctttatcattgacggacccaacaccccggagtgccccgatgaccaacgcgcgtggaacatctgggaggtggaggattatggcttcgggatcttcaccacgaacatctggttaaaactgcgggacagctacacccaggtctgcgaccaccgcctcatgtcagctgcgatcaaggacagtaaggctgtacatgccgacatgggctactggattgagtccgaaaagaacgaaacctggaaactggcacgggccagcttcatcgaggtgaaaacctgcatatggcccaagtcgcatacgctgtggagcaacggcgtcctcgagtccgagatgattatccccaagatctacggtggcccgatcagccagcacaactaccgccctgggtatttcacccagacagccggcccctggcacctgggcaagctggagctcgacttcgacctgtgtgagggtaccacagtggtggttgacgagcactgcggcaaccggggcccgtccctccgcaccaccaccgtgacaggcaaaattattcacgaatggtgctgccggagctgcaccttgccgcccttacggttccgcggggaggacggctgctggtacgggatggagatacgccccgtgaaggagaaggaggagaacttggtcaagtcgatggtgagcgccggcagcggcgaggttgactccttcagcctcgggctactctgcatctccatcatgatcgaggaggtcatgcgtagccgctggtctcggaaaatgctcatgaccggcacactggccgtgttcctgctcctgattatgggccaactgacgtggaacgatctcatccgcctgtgcatcatggtgggcgcaaacgccagcgatcgcatggggatgggcaccacctacctggcgctcatggccacctttaagatgcggccaatgttcgcagtcgggctgctgttccgccggctcacgtcccgcgaagtgctgcttctcacaatcggcctgagcctggttgcgtcggtcgagctcccaaacagcctcgaggagctgggcgatgggctcgccatgggcatcatgatcctgaagctcctgaccgacttccagtctcaccagctttgggccaccctgctctcgctgactttcattaagaccaccttctccctgcactatgcctggaagaccatggcgatggtgctaagcatcgtctccctgttccccctgtgcctcagcaccacctcacagaagaccacctggctgccagtgttgctcggcagcctgggttgcaagccgctgacgatgttcctcatcgccgaaaataagatctggggcaaacggtcctggcccctgaacgaggggattatggccgtgggcatcgtcagcatcttgcttagctccctgctgaagaacgatgtgcccctcgctgggccattgattgctggcgggatgcttatcgcgtgctacgtgatcagcgggtccagcgccgacctctccctggagaaggccgccgaggtgagttgggaggaggaggccgagcactccggcgcttctcacaatatcttagtggaggtgcaggacgacggtaccatgaagataaaggacgaggagcgagatgacaccctcaccatactgctgaaggccaccctcctagcagtctccggcgtctacccgctgagcatccccgccaccctgttcgtatggtacttctggcagaagaagaagcagcggtccggggtcctttgggacacccccagcccgcccgaggtggaacgcgccgtgcttgacgacggcatataccggatcatgcagcgcggcctgttagggcggtcccaggtcggagtaggggtgtttcaggaaaacgtctttcacaccatgtggcacgtgacccgcggagctgtgctgatgtaccaggggaagcggctggagcctagctgggccagtgtcaagaaggacctcatcagctacggcggcgggtggaggctgcagggctcctggaacacgggtgaggaggtccaggtgatcgccgtcgagccgggtaagaaccccaagaacgtgcagaccgcgcccgggaccttcaagacccctgagggcgaagtgggcgccattgcgctggacttcaagcccgggacgtcggggtcccccattgtaaaccgggagggaaagatcgtgggcctgtacggaaacggggtggtcaccaccagcggcacctacgtgagtgccatcgcccaagccaaggcgagtcaggaagggccgctgcccgagatagaggacgaggtattccgcaagcggaacctgacgatcatggatctccaccctggcagcgggaagacccgccggtacctcccggccattgtacgcgaggctattaaaaggaagctgagaacactcatcctggcccccacccgcgttgtggcctccgagatggcggaggccctaaagggaatgcctatccggtaccagacgaccgccgtcaagtcagagcacaccggcaaggaaattgtggacctcatgtgccacgctaccttcactatgcgcctgctttcccccgtgcgggttccgaactacaatatgatcataatggacgaggcccacttcactgacccatcttccatcgcggcccgcggttacatcagcacccgggtgggcatgggcgaggctgccgccatcttcatgaccgcgacgccgcccggcagcgtcgaggccttccctcagagcaacgccgtcatccaggatgaggagcgcgacatccccgaacggtcctggaactctgggtacgagtggatcaccgactttcccggcaagaccgtttggttcgtgccatccatcaagagcggcaacgacatcgccaactgtctccgcaagaacggaaaacgggtcatccagttatccaggaaaacattcgacacggaataccagaagaccaagaataacgactgggattacgtggtgaccaccgacatctcggagatgggcgcgaacttccgggcagaccgcgtcatcgacccgcggcgctgcctgaagcccgtgatactcaaggatggtccagagcgggttatcctggccggcccaatgccggtcacggtggcgtccgccgcgcagcgccgggggcgcatcggccgtaaccacaacaaggagggcgaccagtacatctacatggggcagcctctgaacaatgacgaagaccatgcacactggaccgaggccaagatgctgctggacaacataaacacccctgagggcatcatccccgccctcttcgaaccggagagggagaagtccgccgcgatcgacggggaataccgcctccggggtgaggcccgcaagaccttcgtcgagctgatgagacgcggggacctaccagtgtggctgtcctacaaggtcgcgtccgagggtttccagtacagcgaccggcgctggtgcttcgacggcgagcgtaacaaccaggtcctggaggagaacatggacgtggagatctggacaaaggaaggggagcgcaagaagctgcggccacggtggcttgacgcgcggacctactccgaccccttggccctgcgcgagttcaaggagtttgcagccggccggcgcagtgtgtctggggacctaatcctagagattggcaagctgccacagcacctcacccagcgggcgcagaacgctttagacaacttagtcatgcttcacaacagcgagcagggcgggcgcgcgtaccggcacgccatggaggagctgcccgataccatcgagacgcttatgctcctggccctgatcgccgtgctcaccggcggtgtgaccctgttctttctgtccggccgcgggctcggcaagaccagcatcggcctgctgtgcgtcatggcctcgagcgtgttgctgtggatggcgtccgtggagccccactggatcgccgccagcatcatacttgagttcttcttaatggtcctgctgatccccgaaccggaccggcagcgcacgccccaggacaatcagctcgcctacgtggtaatcgggctgctgttcatgattctcacagtggccgcgaacgagatgggcctgttggagaccaccaagaaggatctagggatcggtcacgaggccgtggggaaccaccaccacgcagccatgctggatgtagacctgcaccccgcctccgcttggaccctatacgccgtcgccacgaccattattaccccgatgatgagacacactattgaaaacacgaccgccaacatcagcctgaccgccatcgcgaatcaggccgccatcctaatgggcctcgacaagggctggcccatctccaagatggacatcggagtccccctgttagccctaggctgctacagccaggttaatcctctgaccttaaccgcggccgtcctcatgctagtggcccactacgccatcatcggaccgggtctccaggcaaaggctacccgggaggcccagaagcgcaccgccgctgggatcatgaagaaccccacagtggacgggatcgtagccatcgatcttgatcctgtcgtatacgacgcgaagttcgagaagcagttaggacaaatcatgttattaatcctctgcacgtcccagatccttctgatgcggaccacgtgggccctctgcgagagcatcaccctggccacggggcccttgactaccctgtgggaaggctctccggggaagttctggaacaccacgatcgctgtatctatggccaacatcttcagaggctcctacctggcgggggccgggctcgccttcagcctgatgaaatctctgggcgggggccggagagggacaggggcacagggcgagaccctcggggaaaagtggaagaggcagttgaaccagctgtcaaagagcgagttcaacacctacaagcgctccggcatcatggaggtggaccggagcgaggcgaaggaggggctcaagagaggcgagacgaccaagcatgccgttagtcgggggacggcaaagctgagatggttcgtcgagcggaacctagtgaagcctgaaggaaaagtgatcgacctgggatgcgggcgcggcggatggtcgtactactgcgccggcctcaagaaggtaactgaagtgaaggggtacaccaagggcggccccgggcacgaggagccgatcccgatggccacctatggctggaacctggtaaagctgcactccgggaaggacgtcttcttcatccctcccgagaaatgtgacaccctcctgtgcgacattggcgaaagctcccccaacccgaccatcgaggaggggcggacgctgcgcgtgctcaaaatggtggagccctggctgcggggcaaccagttttgcatcaagatcctgaacccctacatgccttcagtcgttgagaccctcgagcaaatgcagcgaaagcacggcgggatgctggtgaggaacccgctctcccgcaactcgacccacgagatgtattgggtctcttgcggcaccggcaacatcgtgagcgcggtgaatatgacctcccggatgctcctgaaccgcttcacgatggcccaccgaaaaccgacctacgagcgggacgtcgacctgggagccggcacgcgccacgtggcagttgagcccgaggtcgccaacttagacatcatcgggcaacggatcgagaacataaagcacgagcacaagagcacctggcactatgacgaggacaacccctacaagacctgggcgtaccatggctcctacgaagtgaagccttctgggtcagccagcagcatggtgaacggcgtcgtgaagttactgaccaaaccctgggatgtcatacccatggtgacccagatcgctatgacagacacgacccccttcgggcagcagcgcgtattcaaagagaaggtcgacacccggaccccgaaggccaagcgcggtacagcgcagatcatggaggtaaccgcgaagtggctctggggtttcctgtcccggaacaaaaaacctcgcatttgtacccgggaagagttcacccgcaaggtgcggagcaacgccgccattggggctgtcttcgtggatgagaaccagtggaactccgcgaaggaggcagtggaggatgagcgcttctgggatctggtccacagggagcgcgagctccacaagcagggcaagtgcgcgacgtgtgtgtacaacatgatgggcaagcgggagaagaagctgggcgagttcggcaaggctaagggcagccgtgccatctggtatatgtggctgggcgcccggttcctcgagttcgaggccctggggttcatgaacgaggaccactggttctcacgcgagaacagcctgagcggcgttgaaggggagggtctccacaagctggggtacatccttcgggacatatctaagatcccaggcggcaacatgtacgcagacgacaccgccgggtgggacacccgcatcaccgaggacgaccttcagaatgaggcccggatcacggacatcatggagccggagcacgcgctgctggccaagtctatcttcaagctcacgtaccagaacaaagtcgtgcgggtgcagcgaccggccaaaaacggcaccgtcatggacgtgatcagccggcgagaccagcgggggtccggccaggtcgggacatatgggctgaacacgttcactaacatggaggcccagctgatcagacagatggagagcgagggcatcttcagtcccagcgaactcgagacccctaacctggccgagcgggtcctagactggctcgagaagtacggggtggagcgcctgaagcggatggctatatccggggacgactgcgttgtcaagcctatcgacgaccgcttcgccaccgccctgacggccctcaacgacatggggaaggtgcggaaggacatcccccagtgggaacccagcaaggggtggaacgactggcagcaggtccccttctgctcccaccattttcaccagctaatcatgaaggatggccgcgagatagtggtgccttgccggaaccaggatgagctggtggggagagcccgggtctcccagggagccgggtggagcctgcgcgaaaccgcctgcctgggcaagtcctacgcccagatgtggcagctgatgtactttcaccgacgcgatctccggctggccgcgaatgccatctgtagcgccgtgcccgtggactggatccccacctctcgcaccacatggagcatccacgcccaccaccagtggatgacgaccgaggacatgctgagtgtctggaaccgggtctggatcgaggagaacccctggatggaggacaagacccacatcagctcttggggcgatgtgccgtaccttggcaaacgcgaggaccagtggtgcggcagcttaatagggctcacggcacgtgcgacatgggccaccaacatccaggtggccatcaaccaggtgcgaagactgataggcaacgagaactatctggactacatgacctccatgaagcggtttaagaacgagagcgaccccgaaggggccctgtggtga

SEQ ID NO: 23807 - RNA, 9879 nt, synthetic construct
  misc_feature 1..9879: note = derived and/or modified CDS sequence (opt11) from DENV-1__GQ868637__SS-prME
  source 1..9879: mol_type = other RNA
agcgttaccatgctgcttatgcttatgcccactgccctggccttccaccttactacccgcggaggggaaccgcacatgatcgtgagtaaacaggagcgaggcaaatctctcctgttcaaaacgtctgccggggtgaatatgtgcacgctaatcgccatggatctgggagagctgtgcgaggacaccatgacctacaaatgcccgcggataactgaagtagagcccgacgacgtggactgctggtgcaacaccacggacacatgggtgacctacggtacctgttcccaaacaggcgagcacagaagggacaagaggtccgtcgccttggcgccccacgtcggcctgggcctagagacccgcgccgagacctggatgagctccgagggcgcttggaagcaaatacagcgggtggagacctgggccctccgccacccagggtttacggtgatcgccctgttcctggcgcacgcgatagggacctcaatcacccagaaggggatcatcttcatcctcctgatgctggtcaccccctccatggccatgcggtgtgtgggcatcggtagccgcgacttcgtggaggggctttccggcgcaacttgggtagacgttgtgctggagcacgggagctgcgttaccaccatggcaaaggacaagcccaccctggacatcgagctcctcaagactgaagtaaccaatcccgccgttcttcgaaagctctgcatcgaggcgaagatttccaacaccacgacagatagccgctgccctacccagggtgaggccaccctggtcgaggagcaagacgcgaacttcgtgtgtcgccgcaccttcgtggatcgcggctgggggaacgggtgtggtcttttcggcaaggggtccctaatcacgtgcgcaaagttcaaatgcgtcaccaagctggaggggaagatcgtacagtacgagaacctcaaatacagcgttatcgttaccgtacacaccggtgaccagcatcaagtcggcaacgagtcgacggagcacggcacaacggcaaccattacaccccaggcgccgacgagcgagattcaactcaccgactacggggcactgaccctggactgcagcccccggaccgggctcgatttcaatgagatggtgctgctgacgatgaaagagaagtcctggctcgtgcataaacagtggttcctggacctgcccctcccctggaccagcggcgccagcacttctcaggagacctggaaccggcaggatctcctggtgacgtttaagactgcccacgcgaaaaagcaagaggtggtggtactcggctcccaggagggcgcgatgcacaccgccctgaccggagccacggagattcagacctctggcacaaccacgattttcgccgggcacctgaagtgtcgactcaagatggacaagctgactctgaagggcatgtcatacgtgatgtgcaccgggagcttcaagctcgagaaagaagtagctgagacccagcacggcacggtcctcgtgcagatcaagtacgagggaaccgatgcgccctgcaaaatccccttctccacccaggacgagaagggagtgacgcagaatggtcgacttattacggccaacccgattgtgacagacaaggagaagcccgtcaacatcgaggccgagccgcccttcggagagtcatacatcgtaatcggcgcaggcgagaaggcgctgaaacttagctggttcaaaaaggggagcagcatcggcaagatgtttgaggcaaccgctcgcggcgctcggcggatggccatcctgggcgacacagcttgggatttcggatcgatcggtggcgtcttcacgtccgttggcaagctggtacaccagattttcggcacggcctacggagtcctcttcagtggcgtgtcgtggaccatgaagatcgggatcggtgtgctgctgacctggttaggcctgaacagccgcagcacgagcctgagtatgacctgcatcgctgttggcctcgtgaccctgtacctgggagtgatggtccaagctgacagcgggtgcgttataaactggaaagggcgcgagctgaagtgcgggtctggcatcttcgtgacaaacgaggtccacacgtggaccgagcagtataagttccaggccgactccccgaagcgcctttccgcggccatcggtaaggcttgggaggagggtgtctgcggcatacgttccgctacccggctggagaacattatgtggcggcagatcagtaacgagctcaaccacatcctgctggagaacgacatgaagttcaccgtggttgtgggggatgttgtcggcatcctcgcccaaggtaagaagatgatccggccccagcccatggagcacaaatactcctggaaaagctggggaaaggcaaaaatcatcggtgccgacgtgcagaacaccacgttcatcatcgacggccccaataccccggagtgcccagatgatcagcgtgcctggaacatctgggaggtggaggactacggattcgggatatttaccacgaacatctggctgaagctgagggattcctacacgcaagtctgcgaccaccgcctcatgagcgctgccattaaggactccaaggccgtacacgccgacatgggctattggatagagagcgagaagaacgagacatggaaactggcgcgcgcctccttcatcgaggtaaagacctgcatctggcccaagagccacactctgtggtccaacggagttctcgagagcgagatgatcatcccgaagatttacggcggcccgatctcccaacacaactaccgaccggggtacttcacccaaactgcaggaccatggcacttggggaaactggagttagacttcgacctctgcgagggtactacggttgttgttgacgagcactgcggtaaccgcgggccaagcctccgtactaccacggtgaccggaaagattatccacgagtggtgttgccgctcctgcacgttaccacccctccggtttaagggtgaggatgggtgctggtacgggatggagattcgccccgtgaaggagcgggaagagaacctggtcaagagcatggttagtgccggctcaggcgaagtggacagcttcagtctcgggttgttgtgcataagcatcatgatagaggaggtcatgcgctcccgctggtctcgcaaaatgctcatgaccggcacccttgccgtctttttcctgctcatcatggggcagctgacgtggaatgacctgatccgcctctgcatcatggttggcgccaatgcgtccgaccggatgggaatggggacgacttatctagcactgatggccactttcaagatgcgacctatgtttgccgtcggcctgctgttccgccgcctcaccagccgcgaggtgctcctgctgacgatcgggctctcgctggtcgcgagtgtggagctgcccaattccctcgaggaactgggcgatggcctagcaatgggcattatgatcctcaagctcctgaccgacttccagagccatcaactctgggcgaccctactgtcgctgaccttcatcaagacgaccttttccctgcactatgcctggaaaacgatggccatggtgctcagcatcgtcagtctcctccccctatgcctctccaccacgagccagaagactacgtggctccccgtgctgctcggctccctggggtgcaagccgttaactatgttcctcatcgcggagaacaaaatatggggccgcaagtcttggccgctgaacgaagggatcatggcggtgggcatcgtctcaatcttgctctcctcgctgctcaaaaacgatgtgccactcgcagggccccttatcgccggcggaatgttaatagcctgctacgtgatctccgggagctccgccgatctgtccctggaaaaggcggctgaagtcagttgggaagaggaggcggagcattcaggcgcctcccataacatcctggtggaggtgcaggatgacgggacaatgaagattaaggacgaggagcgagacgataccctcaccatccttcttaaggccaccttactggcggtcagcggcgtatacccgctgtccatccccgcaacgctgttcgtgtggtacttctggcagaagaagaagcaacgcagcggcgtgctgtgggacacgccctcaccaccggaggttgaacgggcagtgctggacgacggtatctaccgcattatgcagcggggcctgttaggccgcagccaggtcggcgtgggcgtgtttcaggagaatgtattccacaccatgtggcacgtgacccgaggcgcagttctgatgtaccaagggaagcgcctggagccgtcctgggcctcggtcaagaaagacctcatctcatacggcggcgggtggcggctgcagggttcgtggaataccggggaggaagtacaggtgatcgcggtcgaacccggcaagaaccccaagaacgtgcaaacggcccccgggaccttcaagactcccgaaggtgaggtgggggccatcgccctggatttcaagcctggaacctccggctcgccaatcgtcaaccgcgagggtaagatcgtgggtttatacggaaacggagtagtcacgaccagtggcacctacgtttccgccattgcacaagccaaggcctcgcaggaagggccgctacccgagatcgaggacgaggtgttccggaaacgcaatctgaccatcatggaccttcacccgggctccgggaagacgaggcgctacctgccggccatcgtccgggaagctatcaagcgcaagctgcgcaccctcatccttgctcccacccgggtggtggccagcgagatggcagaggccctgaagggcatgccaatacgctaccagaccacggcggtcaagtccgagcatacaggccgggaaatcgtggacctcatgtgtcatgcaaccttcacgatgcgcttgttgagccccgtacgtgtgccgaactacaatatgatcatcatggacgaggcacacttcacagacccctccagcatagccgcccgcggatacatctctacccgggtgggcatgggggaagcggccgccatcttcatgaccgcaacaccgcccgggagtgttgaagccttcccgcagtccaacgcggtcatccaagacgaggagcgcgacattccggagagaagctggaactcggggtatgagtggatcacggacttccccggcaagaccgtatggttcgtgccgtcgattaagtccggcaacgacatcgccaactgcctccgcaagaatggcaagcgtgtcattcagcttagccgtaagaccttcgacacggagtatcagaagacgaagaacaacgactgggactatgtggtcaccaccgacatctcagaaatgggagctaacttccgggctgaccgcgtgatcgatccgcggcgctgcctgaagcccgtgatcctgaaggatgggccggagagggtcatcctggctggcccgatgccggtaaccgtggcgagcgccgcccagcgccgggggcgcatcggacgcaatcataacaaggagggcgaccaatatatctatatggggcagcccttgaataacgacgaagaccacgcacactggactgaagcgaagatgctcctggacaacattaataccccggagggcatcatccccgcgctttttgaaccagagcgggagaagtccgccgccatcgacggcgagtaccgcctccggggcgaagcccgcaagaccttcgtcgagctgatgcggaggggagatctgcccgtatggctttcatacaaggtggccagcgagggtttccaatactccgaccgacgctggtgcttcgatggcgagcggaacaaccaggtccttgaggagaacatggacgtggagatctggacgaaagagggtgaacgaaagaaactccgtcctcgctggctcgacgcccggacgtacagcgaccccctggcccttagagagttcaaggagttcgcagccggccggagatccgttagcggggacctcattctggagatcggtaagttgccgcagcatttgacccagcgggcgcagaacgcgttggacaatctggtcatgctccacaacagtgagcagggtgggcgggcctaccggcacgccatggaggagctgcccgatactattgagacgttgatgctcttagcgctgatcgcagtgctcacaggaggggtgacgctgttctttctgagtggacgaggactcggcaagacatccattggcctgctgtgtgttatggcgagttcagccctcctgtggatggcctcggtggagccccactggattgcggcctccatcattctggagttcttcctaatggtgctgttgatcccggagcccgaccggcaacgcacgccccaggacaaccagttggcctatgtcgtgatcggtcttctgttcatgatcctcaccgtagccgcgaacgagatgggcctgctggagacgactaaaaaggacctcgggattggccacgtggctgtggaaaaccaccatcacgccaccatgctggacgtggacctccaccctgccagcgcctggactctctacgctgtcgcgacgaccattatcacccccatgatgcgtcacacaattgaaaacacgaccgcgaacatctccctaactgcaatcgccaaccaggccgcgatcttgatggggctcgacaaagggtggcccatcagcaagatggacatcggcgtgcccctcctggccctcggctgttactctcaggtgaacccactcacccttatcgccgccgtccttatgctggtggcgcactatgccattatcggcccggggctgcaagccaaggcaacgcgggaagcgcagaaacggaccgcggccggcataatgaagaaccccactgtggatggcatcgtagccatcgaccttgaccccgtggtgtatgacgcgaagttcgaaaagcaactgggccagatcatgctgctcatattatgcactagccagatacttctcatgcggacgacctgggccctttgtgagtccatcaccctggcgacgggccccctcacgaccctttgggagggttcacctggcaaattctggaacaccactatcgccgtgtctatggctaatatcttccgcgggagttacctggccggagccggcctcgcgttctcgctgatgaagtccctcggagggggccggcgcgggactggcgctcagggcgaaaccctaggcgagaagtggaagaggcagctgaaccaactgagcaagagtgagttcaacacctacaaacgcagcggcattatggaggtggaccgttctgaggccaaggaggggctgcgccgaggcgaaaccacgaaacacgcagtcagccgcggtaccgcgaaactgaggtggttcgtcgagcgcaacttagtgaagcccgaagggaaggtgatcgacctgggttgcggaaggggcgggtggtcttactactgtgccgggctcaagaaggtcactgaggtgaaggggtacacaaagggaggtccgggacacgaggagcctatcccgatggccacttacgggtggaatctggtaaaactgcacagtgggaaggacgtattctttatcccgcccgagaagtgcgatacgctattatgcgatatcggcgagtcctcccccaacccgaccattgaggagggcagaaccctgcgtgtgctgaagatggtggaaccctggctgcgcggcaatcagttttgcattaagatcctgaacccctacatgccatccgtagttgaaacgctcgagcagatgcagcggaagcatggaggcatgctggttcgcaaccccctgagccgcaactccacccacgagatgtactgggtcagttgcgggaccggcaacatcgtgtccgcagtgaacatgacctcgcgtatgttgctgaaccgctttaccatggcccatcgcaagcctacatacgagcgtgacgtagacctgggggccggcacccggcatgtagctgtcgagccggaagtagccaatctagacatcatcggacagcgcattgaaaatataaagcacgagcacaagtccacatggcactatgacgaagacaacccctacaagacctgggcttatcacgggtcctatgaagtgaagccctccggctcagcaagcagtatggtcaacggagtggtgaaactgctcacgaagccttgggacgtaatcccaatggtaactcaaatcgcgatgacggataccacgcccttcggacagcagcgggttttcaaggagaaggtcgatacccgcaccccgaaagcaaagcggggtaccgcccagatcatggaggtgacagcccgctggctctgggggttcctgagtagaaataagaaacccagaatttgcacccgggaggagttcacgcgcaaggtgcggagcaatgctgcgataggtgccgtcttcgtagacgagaaccaatggaactcggccaaggaggccgtggaggatgagcgattctgggacctggttcacagggaacgcgagctccacaagcagggaaagtgcgcgacctgcgtttacaacatgatgggcaagcgggagaagaagctgggtgagttcggcaaagccaaggggtcccgtgccatttggtatatgtggctgggcgctcggttcctggagttcgaggccctgggctttatgaacgaggaccactggtttagcagagagaactccctcagtggggtcgaaggggaggggctccacaagctaggctacattctgcgcgacatctcgaagatccccgggggtaatatgtacgctgatgacacggccggttgggacacccggattactgaggacgacctccaaaacgaggccaaaatcaccgacattatggagccggagcacgccttgttagccaccagcatctttaagctcacctaccagaataaagtggtgcgcgtgcagagacccgcgaagaacgggaccgttatggacgtaatatcacgccgagatcagagaggcagcggccaggtggggacctatggcctgaacacgttcaccaacatggaagcccaattaattcggcagatggaatccgagggtatcttctccccctccgagcttgagactcccaaccttgccgagcgcgtcctggactggctcgaaaagtatggtgtggagcggctgaagcgcatggccatcagcggcgacgactgcgtggtcaagccgatcgatgaccggttcgccaccgcgttaacagccctgaacgacatggggaaggtgcgcaaggacatcccccagtgggaaccctccaaggggtggaacgactggcagcaggtccccttctgctcacaccatttccaccagctgatcatgaaggacggtcgggagatcgttgtgccgtgccgcaaccaggacgaattagtcgggcgggcccgcgtctcacagggcgccggttggtccctgcgagaaaccgcctgcctgggcaagagctatgcgcagatgtggcagctcatgtacttccatcgccgagaccttcgactggccgccaacgcgatctgcagcgcggtgccagtagattgggtccccaccagccgcacgacgtggtccattcacgcccaccaccagtggatgaccaccgaggacatgctgtcggtttggaaccgggtgtggatcgatgagaacccctggatggaggacaagacccacatctcgagctggggcgacgtcccgtatctcggaaagcgggaggaccaatggtgcggctccctgattggcctgacggccagagctacctgggccaccaacattcaggtggccatcaaccaagtgcgacggctcatcggtaacgagaactaccttgattacatgaccagcatgaagcgcttcaaaaacgagtccgatcccgagggagccctgtggtga

SEQ ID NO: 23808 - RNA, 9879 nt, synthetic construct
  misc_feature 1..9879: note = derived and/or modified CDS sequence (opt11) from DENV-1__GQ868639__SS-prME
  source 1..9879: mol_type = other RNA
agcgtgaccatgctgttgatgctgatgcccacagctctggccttccacctcaccacccggggcggggagccccacatgatcgtaagcaagcaggaacgcggcaagtccctgttattcaagacctctgccggggtaaatatgtgtaccctcatcgccatggatctgggcgaattctgtgaggacaccatgacctacaagtgtcctcggatctccgaggccgagcccgacgatgtggattgctggtgcaacgccacggacacctgggtcacgtacgggacctgtagccagactggcgagcacagacgcgacaaacggtctgtagccttggcaccccacgtggggctcggactggaaacccggacggagacctggatgtccagcgagggcgcctggaagcaaatccagcgagtcgaaacctgggccctgcgccacccagggttcaccgtgatcgcccttttccttgcacacgccatcggtacgtcgatcacgcagaaggggattatcttcattctgctcatgctagtcacccccagcatggccatgcggtgcgtcggcataggctcccgcgacttcgtggaggggctatcgggcgccacctgggttgatgtcgttctagaacacgggtcctgcgtgacgaccatggcgaaggacaagccaaccctcgatatagagctcctcaagaccgaggtcacgaaccccgcggtgctacggaagctgtgtatcgaagccaagattagcaacaccaccaccgactcccgatgcccgactcagggcgaggccaccctcgtggaggagcaggacgccaatttcgtgtgccggcggacattcgtggaccggggttgggggaacggatgcgggctgttcggcaaagggtcattaatcacgtgcgctaagttcaaatgcgtgactaagctcgaaggcaagattgtccagtacgagaacctgaagtactccgtgattgtgaccgtccacaccggcgaccagcatcaagtggggaacgagagcactgagcatggcacgaccgcgaccatcacgccccaggccccatccaccgagatacagctcacggactacggagccctcactctggactgcagcccacggaccggcctggacttcaatgaaatggttctactgaccatgaaagagaagtcatggctggttcataaacagtggttcctcgacttgccgctgccgtggacgtccggggccagcacctcccaggagacctggaaccggcaggacctcctggtgacctttaagacagcccacgcgaaaaagcaggaggtcgtggtgctgggcagccaggagggcgccatgcacaccgccctcaccggggccaccgaaatccagacgtccggtaccaccaccatcttcgccgggcatctgaagtgccgcctgaaaatggataagctcacactgaaaggtatgagctacgttatgtgcaccgggtccttcaagctggagaaggaagtagccgaaacccaacacggcaccgtgttagtccagatcaagtacgagggcacggacgccccctgtaagatcccgttcagtacccaggatgagaagggggtcacccagaacggccggctgatcaccgccaaccctatagttacggacaaagagaagccagtcaacatcgaagccgagccccccttcggggagtcctacatcgtgatcggcgcgggcgaaaaagccctgaagctatcgtggttcaagaaagggtccagcataggcaagatgttcgaggccacggctcgcggagcccggcgcatggccatcctaggcgacacagcctgggacttcgggtccatcggcggcgtgttcactagcgtcggcaagctggtgcaccagatattcggcaccgcctacggcgtgctgttctccggcgtctcatggaccatgaagatcgggattggcgtgctcctgacttggctgggtctcaactccaggagcacctcactgagcatgacatgcattgcagttgggctggtcaccctctaccttggcgtgatggtgcaggccgactccgggtgcgttatcaactggaagggtagagagttgaaatgcggctccggcatcttcgtgaccaacgaagtgcacacttggacggagcagtacaaattccaggcggacagcccgaagcgcctctcagcagctataggtaaggcctgggaggagggggtctgcggtatccggagcgccactagattggagaacatcatgtggaaacagatctctaatgagctgaaccatatcctcctggagaatgacatgaagtttaccgtcgtagtcggggacgttgctgggatcctggcccaggggaagaagatgatccggccccagcctatggagtataagtacagctggaagtcatggggcaaggctaagattatcggtgccgacgtgcagaacaccaccttcattatcgatgggcctaacacgcccgagtgccccgatgaccagcgagcgtggaacatatgggaggtcgaggactacggcttcgggatcttcaccaccaacatctggcttaagctgcgggattcctacacccaggtgtgcgatcatcgcctgatgtccgctgcaatcaaggacagcaaggccgtgcacgccgatatgggctattggatcgagtcagagaagaacgaaacgtggaagctcgcgcgtgcatctttcatagaggtcaagacatgcatctggcccaagtcccacactctgtggagcaacggcgtgctggagtccgagatgatcatccccaagatctacgggggcccaatctcacagcataactaccgccccggatacttcacccaaacggccggcccctggcacctcggaaagctggagctggacttcgatttgtgcgagggaaccaccgtggtcgtggacgaacactgcggcaaccgggggccgtcactgcgcaccacaacagtgactggcaaaatcatccacgagtggtgctgtcggagctgtactctgccgccactgcgcttcaagggggaggacgggtgctggtatggtatggagatacggcccgtcaaagagaaggaggagaacctggttaagagcatggtgtctgccggctctggcgaagtcgactctttctcactggggctcctttgtatctccataatgatagaggaggtgatgcggagtcggtggtcccgtaagatgttaatgacgggtacgctcgccgtctttttcctgcttatcatggggcagttgacctggaacgatctgatccggttgtgcatcatggtcggcgcgaacgccagcgatcgcatgggcatgggtatgacatacctcgcccttatggccacattcaagatgcgcccgatgtttgccgtaggcctcctgttcagaagactgacatcccgggaggtgctgttattgaccatcgggctgagcctggtcgcgtccgtagagctgccaaacagtctggaagagctcggcgacgggctggccatgggcatcatgattctgaagcttctcgcggactttcagtcccatcagctgtgggccaccctcctcagcctcactttcatcaaaaccaccttctccctccactacgcgtggaagaccatggccatggtcctgagcatcgtgagtctgttcccactctgcctgagcaccaccagtcaaaagaccacttggctgcctgtgctcctgggcagcttagggtgcaagccgctcactatgttcctgatcgctgagaacaagatctggggccgcaagtcttggccgctgaatgaggggatcatggctgttggcatcgtgtcgatcctcttatcgtcgctgttgaaaaacgacgtgccccttgctgggcctttgatcgctggcggcatgttaatcgcctgctacgtcatcagcgggtccagcgccgacctctcactggaaaaggccgccgaggtgagctgggaggaggaggctgagcactccggagccagccacaacatcctcgtagaggtccaagacgacgggactatgaagataaaagatgaggagcgggacgacactctgactatcctgctcaaggccacactgctggccgtgagtggcgtctacccacttagcatccccgccaccctgtttgtatggtacttctggcagaagaagaagcagaggtccggagtgctatgggacacgccaagcccgcccgaggtggaaagagcggtcctcgatgacggcatctaccgtatcatgcagcgtggcctgttagggcgttctcaagtaggagtgggggtcttccaggagaacgtgttccacaccatgtggcacgtgacccggggagccgtgctgatgtaccagggtaagcgcttggagccctcctgggcctccgtgaagaaagatctgatctcttacggtggcgggtggaggctgcagggctcctggaacacgggggaggaggtgcaggtcatcgccgttgagcccggcaagaaccccaagaacgtccagaccgctcccgggacgttcaagaccagcgaaggcgaggttggggcgattgccctcgactttaagccaggtacgagcggatcccccatcgtaaaccgcgaggggaagatcgtgggcctgtacggcaacggggtcgtgaccaccagcgggacctatgtatccgcaatcgcccaggcgaaagcgagccaggaggggcccctgccggagatcgaggacgaggtgttccggaagcgcaacctcactatcatggacttgcaccccggctccgggaagacccggcgctaccttcccgccatagtccgggaagccatcaaaaggaaactccggaccctgatcctggcaccgacacgggtggttgcgagtgagatggcagaggcactcaagggcatgcccatccgctaccagacgaccgccgttaagtcagagcacacggggaaagaaatagtggacttgatgtgtcatgcaaccttcacgatgcggttgttaagcccggtccgcgtgcccaattacaacatgataatcatggacgaggctcactttaccgacccgagtagcattgctgcccgtgggtacatctccacccgcgtgggaatgggggaggcggccgcgatcttcatgaccgccacgccgcccggtagcgccgaggccttcccccagtcaaacgccgtcatccaggacgaggagcgggacatccccgagcgctcatggaacagtgggtacgagtggataaccgacttccccggcaagacagtgtggttcgtcccgagcatcaagtccggcaacgacatcgcaaactgcttgcggaagaacgggaagagagtcatacagctgagccggaagacattcgacacggagtaccagaaaactaaaaacaatgactgggactacgtagtaaccacggacatctccgaaatgggcgccaacttcagagccgacagggtcatcgacccgagacggtgtctcaagccagtgatccttaaggacgggcccgagcgcgtgattctggccggccccatgcccgtcacggtggcgtcggccgcccagcgtcgagggaggatcggccgtaatcataacaaggaaggcgaccaatatatctacatggggcagccgctcaacaacgacgaagatcacgcccattggaccgaggccaagatgctgctggacaacataaatacccccgagggcatcatccccgccctgttcgaacccgagcgggagaagtccgccgcaatagatggcgagtatagactgcgcggagaggctcggaagacctttgttgaactgatgcgccgcggcgacctaccggtctggctgtcctacaaggtcgcctcggaaggtttccagtactccgaccgccgctggtgtttcgacggcgagagaaataaccaggtgctcgaggagaacatggatgtggaaatctggacgaaggagggggagcggaagaagctccggccccggtggcttgacgcgcgcacctatagcgaccctctggccctccgggagttcaaggaattcgccgccggccggcgatcggtgtccggggacctgatcctcgagatcggcaagctccctcagcacctgacgcagagggcgcagaacgctctggacaacctcgtcatgctgcacaacagtgagcaagggggtcgggcctacagacacgccatggaggagttaccggacacgatcgagacgctgatgctgctggccctaatcgccgttctgaccggcggggttaccctgttcttcttgagcggacgtggtctgggcaagacctcaatcgggctgctctgcgtcatggccagctccgtgctgctgtggatggccagcgtggagccccactggatcgcggcctccatcatcttagagttcttcctgatggtcctactcatccccgaacccgatcggcagcgcacaccgcaagacaaccagctagcgtacgttgtgattggcctcttgttcatgatcctgaccgtcgccgccaacgagatgggcctgctcgagaccaccaagaaagacttggggataggccacgtcgccgtggagaatcatcaccatgccgcgatgctggacgtcgacctccaccccgcctccgcctggacactttacgccgttgccacgaccatcattacccctatgatgaggcacaccatcgagaacacgactgctaacatcagtctgaccgcgatcgccaaccaggccgccatcctgatgggtctggacaaaggatggcctataagcaagatggatatcggcgtgcccctgctcgccctggggtgttacagtcaggtcaatcccctgaccctcacggccgccgttttgatgctggtggcccattacgcgatcataggcccggggctccaggcgaaggccacccgggaggcccagaagcgaaccgccgcggggatcatgaagaaccccacagtggacgggatcgtcgccatcgatctggacccagtagtctacgacgccaagttcgaaaagcagttaggtcagatcatgctcctgatcctctgcacgagccagatcctactgatgaggaccacctgggctttgtgtgaatccataaccctcgcaacgggccccttaaccaccctgtgggaggggagcccgggcaagttctggaacaccactatcgcggtgtcaatggccaacatcttccgggggtcctacctcgccggcgccgggctggccttcagtctgatgaaatccctcgggggcgggcgtcggggcaccggggcccagggcgagacccttggcgagaagtggaaacgccagctgaaccagctcagcaaatccgagttcaacacctacaaacgtagcggcataatggaagtggatcgctccgaggccaaggaaggcctgaagagaggagagacgaccaagcatgccgtcagccgcggaaccgccaagctgcggtggttcgtggaacgcaacctcgtgaagccggaagggaaggtaatcgatctgggctgcggtcgcggggggtggtcctactattgcgcggggctgaagaaggtgaccgaggtgaaggggtacacgaaaggcgggcccggccacgaggagcccatccccatggcaacctatggatggaacctggtaaagctccacagcgggaaggacgttttctttgtgccgccagagaagtgcgacaccctactgtgcgacatcggggagtcgagccccaaccccacaattgaggagggccgcacgttacgggtccttaagatggttgagccgtggctgcgcggtaaccaattctgcatcaagatcctcaacccctacatgccctccgtggtggagaccctggaacagatgcagcggaaacacggcggcatgctggtgagaaaccccctctctcggaacagtacccacgagatgtactgggtcagctgcgggaccggtaatatcgtaagcgccgtgaacatgacgagccgcatgctactgaaccggttcaccatggcacatcgcaagccgacctacgaacgagacgtcgacctcggcgccggcaccagacacgtcgcggtggagcccgaggttgctaacctggatatcattggccagagaatcgagaacattaagcatgagcacaagtccacgtggcactacgatgaagacaacccctacaagacgtgggcctatcacgggtcatacgaggtcaagccctctggctccgctagctccatggtgaacggggtcgtgaagctgctcaccaagccgtgggacgtgattccaatggttacccagatcgccatgactgacaccaccccgttcggccagcagcgtgttttcaaggaaaaagtggacacacgcacccctaaggcgaagcgtgggactgcccagatcatggaggtaaccgcaaaatggctctggggcttcctgtctcgcaacaaaaagccgcggatttgcacccgcgaggaattcacccggaaggtgagaagcaacgctgcgatcggcgcggttttcgtcgatgagaaccagtggaatagcgccaaagaagccgtggaggacgagcggttctgggacctcgtgcaccgcgagcgggagcttcacaagcaggggaagtgcgccacgtgtgtctacaacatgatgggaaagcgcgagaagaaattgggggagttcggcaaagcgaaaggttcccgggcgatatggtatatgtggttgggcgccaggttcctggagtttgaggccctgggcttcatgaacgaggaccactggtttagcagggagaactccctcagcggcgtggagggcgaagggctgcacaagctgggctatatcttacgcgacatctccaagatcagcgggggcaacatgtacgccgacgataccgcaggctgggacacccgtataactgaggacgacttacagaacgaggcaaagatcactgacataatggagcccgagcacgccctcctcgcaaaatccattttcaagctaacctatcagaacaaggtggtccgcgtgcagcggcccgccaagaacgggaccgtgatggatgtcatcagccgcagggaccagcggggctccggccaggtagggacctacggactgaacacgttcaccaatatggaggcgcagctgatccggcagatggagtcggaagggatattctcaccgtcagagctggagacccccaatctggccgagcgggctcttgactggctagagaaacatggtgtggaacgcctgaagcggatggccattagcggggatgactgcgtcgtcaagcccatagacgacaggttcgccacagcgctcacggcactgaacgacatgggaaaggtacggaaggatatcccccagtgggagccctccaaggggtggaacgactggcagcaggtacccttttgtagccatcacttccaccagctgatcatgaaggacggcagagagatcgtggtgccctgccggaaccaggacgagctcgtcggacgtgcgcgggtgtctcagggggccggttggtcattaagagagaccgcttgcctggggaagtcttacgcccagatgtggcaactcatgtacttccacaggcgggatttgcggctggccgcgaacgcaatctgcagcgcggtgcccgtcgattgggttccgaccagcaggaccacctggtcgatccacgcccatcaccagtggatgacgaccgaggacatgctctcagtatggaaccgggtctggatcgaggagaacccctggatggaggataagacccacatctcatcttgggaggacgtaccttaccttggcaagagagaggaccagtggtgcgggagcctaatcggcctcacggcccgggccacctgggctaccaacatacaagttgccattaaccaggtccgccgccttatcggcaacgagaactacctggactacatgaccagcatgaagcggttcaagaatgaatcggatcccgagggtgccctctggtga

SEQ ID NO: 23809 - RNA, 9879 nt, synthetic construct
  misc_feature 1..9879: note = derived and/or modified CDS sequence (opt11) from DENV-1__GU131925__SS-prME
  source 1..9879: mol_type = other RNA
agcgtaaccatgctgctcatgctgatgccgactgccctggccttccacctgaccaccaggggcggggagccgcacatgattgtcagcaagcaggagcggggcaagagcctgttgttcaagaccagcgcgggggttaacatgtgcaccctcatcgcaatggacctgggcgaactttgcgaggatacgatgacctacaagtgtccgcgcattaccgaggccgaacccgacgacgtggattgctggtgcaacgcgaccgacacttgggtgacgtatgggacctgcagtcagacgggtgagcaccggcgcgacaagcggtccgtggccctcgcgccccatgtgggcctcgggctggagacccgcaccgaaacgtggatgagctccgagggtgcgtggaagcaaatccaacgggtcgagacttgggcgctccggcatcccgggttcaccgtcatagccctgttcttggcgcacgcaatcggcacgagcatcacccagaaggggattatattcatcctcttaatgctggtgaccccttcaatggccatgagatgcgtcggcatcggctctcgcgacttcgtagaggggttgtccggagccacttgggtggacgtcgtgctagagcacgggagctgtgttaccaccatggcaaaagacaagccgaccctggacatcgagctcctgaagacggaggttaccaaccccgcgatcttacggaagctctgcatcgaggccaagatctccaacactactacggactcacgctgcccgacccaaggagaggccactctggtggaggaacaggacgccaacttcgtgtgtcggcgcacctttgtggaccggggctgggggaacggatgcgggctgttcggcaaggggtccctcatcacgtgtgccaagttcaagtgtgtgactaagctagagggcaagatcgtgcagtacgagaacctcaaatacagcgtcatcgttaccgtacatactggcgaccagcaccaggtgggaaacgagtcgacggagcacggcactaccgcgaccatcaccccccaggccccgacaaccgagatccagctgaccgattacggcgccctgaccctggactgctcgccccgcacgggcctcgacttcaacgagatggtgctgctcaccatgaaagagaagtcatggcttgtccataagcagtggttcctagacttacctttaccctggaccagcggagcatcaacctcccaggagacctggaaccggcaggacctcttggtaacgttcaagaccgcccacgccaagaagcaagaggtggtcgtgctcggaagccaggagggagccatgcacacggccctaactggagccaccgagatccagacctccgggaccacgaccatcttcgccggccacctgaagtgtcgcttgaaaatggacaaactgaccctgaaaggcatgagctacgtgatgtgtaccgggtcctttaagctcgagaaggaggtcgcggagacacagcacgggaccgtgctagtgcaaatcaagtacgagggcaccgacgccccatgcaagattcccttcagcacgcaggacgagaagggcgtcactcagaacggacgcctgataaccgccaacccgatcgtaaccgataaggagaagcccgtcaacattgaagctgaaccgcccttcggggagtcttatatcgtcattggagcgggcgagaaggctttaaaactcagctggttcaagaagggaagctccatcggcaaaatgttcgaggccactgcgcgcggtgcccggcgtatggctatcctgggcgacactgcctgggacttcggctccatcggaggcgtgttcaccagcgtcggtaaactggttcaccagatcttcggcaccgcctacggagtactcttttccggcgtaagctggaccatgaaaatcgggatcggcgtgctattaacatggctcggcctgaactcccgatcaacatccctgagcatgacatgcatcgccgtgggtctcgtaacgctgtatctgggagttatggtccaggccgactctgggtgtgtgatcaattggaagggcagggaactcaaatgtggctctgggatcttcgtcacgaatgaagtacacacatggacagagcaatacaagttccaagcggactcaccgaagcgcctatccgccgctatcggcaaggcctgggaggagggggtatgcggcatccggagcgccacacgactggagaacatcatgtggaagcagatcagcaacgagcttaaccatattctgctggagaatgatatgaagttcaccgtcgtggtgggggatgtagcgggcatcctcgcccagggaaagaagatgatccggccccagccaatggagtataagtatagctggaagtcatggggcaaggcaaagatcatcggcgctgacgtgcaaaacacgaccttcatcattgacgggcccaatactcccgaatgtcccgacgaccaacgcgcgtggaacatctgggaggttgaagactacggcttcggcattttcaccacgaacatctggctcaagctgagggacagctacactcaggtctgcgatcatcgccttatgtccgccgccatcaaggacagcaaggctgtgcacgccgatatgggctattggatcgagagtgaaaaaaatgagacctggaaactggcgcgagctagcttcatcgaggttaaaacgtgcatctggcccaagtcgcacacgctgtggtcaaacggcgtgctcgagtccgagatgatcatcccgaagatatatgggggcccgatcagccagcacaattatcggcccgggtactttacgcaaaccgccggaccttggcacctggggaaactggagctcgacttcgacctgtgtgagggcaccaccgtagtggttgatgaacactgcggcaaccgggggccgtccctgcgcacgaccaccgtgacggggaagatcatccacgagtggtgctgtcggagctgcaccttgccgccattacgattccgcggggaggacggctgttggtatggcatggagatcaggcccgtaaaggagaaggaggagaacctggtgaagtccatggtttctgccggatccggcgaggtcgactcattcagcctcgggctactgtgcatctccattatgattgaagaggtcatgagaagccggtggtcccgtaagatgctcatgaccggcaccttggcagtgtttctgctcctgatcatgggtcagctgacatggaacgacctcatccgcctctgcataatggtaggtgcgaatgcgtctgaccgcatggggatgggaaccacctacctggccctcatggccacattcaaaatgcgcccgatgtttgcagtcggtctgctgttccgcagactaacgtcccgcgaggttttgttgcttaccatcgggctctcgttggtggcgtccgtcgagctccccaactcacttgaagaactgggcgacgggttagctatgggcatcatgatcctaaagctgctcactgacttccagagtcaccagctgtgggccacgctgctaagcctcacctttatcaagacgaccttctccctgcattacgcttggaagaccatggcaatggtactcagcatcgtctccctgttcccactttgtttgagtacgacttcccaaaagaccacatggctgcccgtgttgctaggcagcctggggtgcaagccgctgaccatgtttctcatcgccgagaacaagatctgggggcggcgctcgtggcccctgaatgagggcatcatggccgtgggaatcgtcagcatcctcctcagcagtctgctgaaaaacgacgtgcccctcgccggacccctgatcgcgggcggtatgctgatcgcatgctacgtaatcagtggttccagcgccgacctgagcctggaaaaggccgccgaagtcagctgggaggaggaggcggaacactccggggcatcccacaacatcctggtagaagttcaagatgacgggaccatgaagattaaggatgaagagcgcgacgacaccctcaccatcctactgaaggccaccttgctagcagtctccggggtatatcccctgagcatccccgccaccttattcgtgtggtatttttggcagaaaaagaagcagcgctctggcgtactttgggacactcccagcccgcccgaggtggagcgggccgtgctggacgacggcatctacaggatcatgcagcggggattactcggccgctcccaggtcggggtgggggttttccaagagaacgtcttccatactatgtggcatgtgacacgcggcgcggtgctcatgtaccaggggaagcgcctcgagcccagctgggcctccgttaagaaagatctcatcagctacggcggcgggtggcggttacagggctcctggaacacgggagaggaggtccaggtgatagctgttgagcccggcaagaaccccaaaaacgtacagaccgcgcccgggacgtttaagacccccgaaggcgaggtgggcgcgatagcgctggacttcaaaccgggtacaagcggatcccccatagtgaaccgcgaggggaaaatcgtcgggttgtacggaaacggggttgttaccaccagcggtacctatgtgagcgccatcgctcaggccaaggcgtcccaggaggggcccctgcccgaaatcgaggatgaggtgttccggaagcggaacctgacgatcatggacctacatcccggatcggggaagacgcggcgatatctcccggccatcgtaagagaggccatcaagcgtaagctgagaaccctcatcctggcccccacccgggtcgtggcctccgagatggccgaggccctgaagggcatgcccatccgctaccagacaaccgccgtcaagagcgagcatactggtaaggagattgtggacttaatgtgccacgctaccttcacgatgcggctgctgtcccccgtgcgcgtgccgaactacaatatgattatcatggacgaagcgcacttcactgacccaagctccattgcggctagggggtacataagcacccgcgtgggcatgggggaggccgccgctatcttcatgaccgcgacgcctccggggtccgtggaagccttcccacagtctaacgcggtcatacaggacgaggagcgggacattcctgaacgcagctggaacagcggatacgagtggatcactgatttccctggcaagactgtttggtttgtgccttcaatcaagagcgggaacgacatcgccaactgcctaagaaaaaacgggaaacgtgtcatccagctgagtcggaaaaccttcgacacggagtaccagaagacgaagaacaacgactgggattacgtggtgaccaccgacatctcagagatgggcgcgaactttagagcggatcgggtaatagacccacgccgatgcctgaaacccgtgattctcaaggacgggcccgagcgcgtgatcctagccggtcccatgccggtcacggtcgcctccgccgcgcagcggagggggcggataggacgcaaccacaacaaggaaggcgaccagtatatctacatggggcagcctctgaacaacgacgaagaccatgcccactggaccgaagccaaaatgctgctggataacataaacacgcctgaaggcattatccccgcactgttcgagccggagcgggagaaatccgctgcgatcgatggggagtaccgcctccgcggcgaggcccggaaaaccttcgtcgagctgatgcggcgaggggatcttcccgtgtggttaagctacaaagtggcctccgaaggcttccaatactcagaccgtaggtggtgctttgacggtgaacgaaataatcaggtgctggaggagaacatggacgtggagatatggaccaaggaaggcgagcggaagaaactgcgccccagatggcttgacgcgcgcacttattccgatcccctggccctgcgggagttcaaagagttcgcggccggccgccgtagcgtttcaggcgacctcatcctggagataggcaagctgccccagcacctcacccaacgtgcacaaaacgcactggacaacctggtcatgttacataatagcgagcagggcgggcgagcctaccgccacgccatggaggagctcccagacaccatcgaaactttgatgctcctggcattgatcgcggtgctcaccggaggcgtgaccctgttctttctttccggccggggattgggcaaaactagcatcgggcttctgtgcgtcatggcatccagcgtgctcctgtggatggcgtccgtggaaccccactggatcgccgccagcatcatactggaattcttcctcatggttctgcttatccccgagccggaccgccaacggacgccccaggataaccagctggcctacgtggtgatcggcctgctgttcatgattctcacggtcgccgccaacgagatggggctgcttgagacgacgaagaaggaccttgggataggccacgttgccgtggggaaccaccaccatgccgcaatgctagacgtagacttgcatcctgcttccgcgtggactctttatgccgtggccacgaccatcataacccctatgatgcgccacacaatcgaaaatactaccgccaacatcagcctgaccgccatcgcaaaccaagcagccatcctaatgggacttgacaaaggctggcccatctccaagatggatatcggtgtgcccttgcttgccctcgggtgttacagtcaggtcaatccgctgaccctgaccgcggcagtgctcatgcttgtggcacactacgccatcatcggtccgggcctgcaggctaaggcgacccgtgaggcccagaagcggaccgcggcggggatcatgaagaacccaacagtcgacggtatcgtagccatcgacttggaccccgttgtttacgacgcgaaattcgagaaacagttagggcagataatgctgctcatcctatgcacgagtcaaatcctactcatgaggaccacctgggcactgtgcgagagcatcacgttggccacggggcccctcactaccctgtgggaaggaagcccgggtaagttctggaacacaaccattgccgtctcaatggccaacatctttcggggttcttacctggccggagcagggctcgcattcagcctcatgaagagcctgggcgggggccggcgggggacgggggcccagggcgagaccctaggggagaagtggaagagacaactgaaccagctgagcaagagcgagttcaacacgtataagcggtccggaatcatggaagtggaccgctcggaggcgaaagaagggctaaagcggggcgagacgacgaagcacgcggtgtcccgcgggaccgccaagctgaggtggttcgtggagcgcaatctggtcaaaccagagggcaaggttatcgaccttgggtgtgggcggggcggctggagctattactgtgctggcctcaaaaaggtgacagaagtgaaggggtacacgaaaggcgggcccggccacgaagagccgattcctatggccacctacggatggaacctggtcaagctgcactccggtaaggacgtgttcttcattccgcccgagaagtgcgataccctcttgtgcgacatcggagagagcagtcccaacccgaccatagaggagggtcgcactctgcgggtactcaagatggtcgagccgtggttgaggggcaaccaattctgcatcaagatcctgaacccgtacatgccaagcgtggtggaaacccttgagcagatgcaacgtaagcacggcggaatgctcgtccgcaatcctttgtcccggaacagcacccacgagatgtattgggtctcctgcggcaccggaaacatcgtgagcgccgttaacatgacgtctaggatgctcttaaaccgcttcacgatggcacatcggaagccaacatacgagcgcgacgtagacctgggtgccggcacacgtcacgtggccgtagagcctgaagtagccaaccttgacatcatcggacaacgcatcgagaatataaagcacgaacacaagtcaacctggcattacgacgaggataacccctacaagacgtgggcgtatcatggctcctatgaggtcaagccaagcggctccgcctccagcatggtcaacggcgtggtcaagctgttgaccaagccgtgggacgtcatccccatggtgacccagatcgcaatgactgatacgactccattcgggcagcagagggtttttaaggaaaaagtggatacccgcaccccgaaggcaaagcggggcacggcgcaaattatggaggtgaccgcgaagtggctctggggcttcctgtcacgtaacaagaagccccggatctgtacgcgcgaggagtttacccgtaaagttcgttccaacgctgctatcggggccgtttttgtagacgagaaccagtggaactccgccaaagaagccgtcgaggatgagcggttttgggacctggtgcatagagagagagagcttcacaaacaaggcaagtgtgctacgtgcgtgtacaatatgatggggaagcgggagaaaaagctgggcgagttcgggaaggccaagggctcacgcgccatctggtacatgtggctgggggcgcggttcctcgagttcgaggccctgggctttatgaacgaggatcattggttctcccgggagaacagcctgtcgggcgtcgagggggagggtctccacaagctggggtatatcctgcgcgatatcagcaagatacccggcggcaacatgtacgctgatgataccgcggggtgggacaccagaataaccgaagatgacctccagaatgaggcgaggatcacggacattatggaaccggaacacgcgctgctagcgaagtccatcttcaagctcacctatcaaaataaggtggtgagagtccagcgccctgcgaagaacggaaccgtcatggatgtaatcagccggcgcgaccaaagggggtcgggccaagtcggcacctacgggctgaacacattcacaaacatggaggctcagcttatccgccagatggagagcgaagggatcttctcccccagcgaactcgaaaccccaaacctggccgagcgcgtgttagactggctcgaaaagtacggggtcgagcggctgaagcgcatggcgatctccggcgatgactgtgtcgtaaagccgatcgacgacagattcgcgaccgccctcactgcactcaacgacatgggaaaggtgaggaaggacataccccaatgggagcctagtaagggctggaacgattggcagcaagtccccttttgttcccaccatttccaccaattgatcatgaaagacggccgggaaatcgtggtgccgtgccggaaccaggatgagctggttgggcgtgcccgcgtgagccagggcgctgggtggtcgttgcgtgagaccgcctgcctgggcaaatcctatgcccagatgtggcagctcatgtactttcacaggcgggacctccgattggccgctaacgccatttgtagcgccgtgcccgtcgactggatccctacgtcccggaccacctggagcatccacgcccaccaccagtggatgaccaccgaggacatgctgtccgtgtggaaccgcgtgtggatcgaggagaatccttggatggaagacaagacccacatcagttcctggggagacgtcccctacctcggcaagcgcgaggatcagtggtgcggctctctgatcggcctgacggctagagcgacgtgggcaaccaacattcaggtagccataaaccaagtgcgccggttaatcggcaacgagaattacctggattacatgacctcaatgaagaggttcaagaatgagagtgatcccgagggagccctgtggtga

SEQ ID NO: 23810 - RNA, 9879 nt, synthetic construct
  misc_feature 1..9879: note = derived and/or modified CDS sequence (opt11) from DENV-1__GU131926__SS-prME
  source 1..9879: mol_type = other RNA
agtgtaactatgcttctgatgctcatgcccaccgcccttgcctttcaccttactacccggggcggggaaccccatatgatcgttagcaagcaggaacggggcaagtcactcctcttcaagactagcgccggggtgaacatgtgtaccctcattgccatggacctgggtgagttctgcgaggacaccatgacctataagtgcccccggatcagcgaggccgagccggatgacgtagattgctggtgcaacgccacggacacctgggtaacgtacggtacctgcagtcaaaccggcgagcaccggcgcgacaagcggagcgtggccctggcgccccacgtgggcctcgggctggagacccggactgagacctggatgtccagcgagggcgcctggaagcagatccagagagtagagacctgggctctgcgccaccccgggttcaccgtgatcgccctcttcctggcgcacgcgatagggacgtccatcacgcagaagggtataatcttcatcctgctaatgctggtgacccccagcatggccatgcggtgcgtcggcatcggctctcgcgacttcgtggaggggctgagcggggccacctgggtggacgtcgtgctcgagcacgggagttgcgtgacgaccatggctaaggacaagcccaccctggacattgagttgctcaagacagaggtcacgaaccccgcggtgttacggaagctgtgcattgaagctaagattagcaatactaccaccgactcccgctgcccgacgcagggcgaggccaccctcgtggaggagcaggacgcgaacttcgtctgccggcgcacattcgtggatcggggctgggggaacggttgcggtctgttcggtaaggggagcctgatcacgtgcgccaagttcaagtgtgtgacgaagctagaaggaaagatagtccagtacgagaatctgaagtactccgtaatcgtaaccgtccacaccggcgaccagcaccaggtggggaacgagtcaaccgagcacggcacgaccgcaaccatcacgccacaagccccctcaaccgagatccagcttacggactatggggcccttaccctggattgctcgccacgcaccggcctggactttaacgagatggttctcctgacgatgaaggagaagtcctggctggtgcacaagcagtggttcctcgacctcccgctgccctggacttccggggccagcacctcccaggagacctggaaccggcaggacctcttagtcacgttcaagactgcccatgcgaagaagcaggaggtcgtggtgttggggtctcaggagggagccatgcacaccgccctcaccggcgccaccgagatccagacgtccggcaccaccaccatcttcgccggtcacttgaagtgccggctgaagatggacaaacttacgctgaagggcatgagctacgtcatgtgtaccgggtccttcaagctggagaaagaggtggcggagacgcagcacggcaccgtacttgtccagatcaagtacgagggcacggatgcgccctgcaagattcccttcagcacccaggacgagaaaggggtgacccagaacggccgcttgatcaccgccaacccgatcgtgacggacaaggagaagcccgtcaacatcgaagccgagccgccgttcggggagtcctatatcgtgatcggtgccggcgagaaggctctgaagctgagctggttcaagaagggttccagcatcggcaagatgttcgaagccaccgcccggggcgcccggcggatggcgatcctcggcgacactgcctgggacttcgggtccatcggcggcgtgttcaccagcgtcgggaagctggtgcaccagattttcggcacggcctacggagtgctgttctccggcgtcagctggaccatgaagatcgggatcggcgtgctcctgacatggctaggcgttaactcccgctctacgtctctcagcatgacgtgcatcgcggttgggctcgtcaccctgtacctgggcgttatggtccaggctgactctgggtgcgtgatcaattggaagggccgggagttaaagtgcggcagtggcatctttgtgaccaacgaggtccacacctggacagagcagtacaagttccaggcagactctccgaagcgactgtccgcggccatcgggaaggcgtgggaggaaggggtttgcggcatccggagcgccacccgcctcgagaacatcatgtggaagcagatctccaacgagctgaaccacatcctgctcgagaacgacatgaagttcaccgtggtcgtgggggacgtggcgggcatcctggcccaggggaagaagatgatccggccgcagccgatggagtacaagtattcgtggaagtcctggggcaaggcgaagatcatcggcgcggacgtccaaaacaccaccttcatcattgacgggcccaacaccccggaatgccccgacgaccagagagcgtggaatatctgggaggtggaggactatggtttcgggatattcaccaccaacatctggcttaagctgcgggactcttacacccaggtgtgcgaccaccgcctgatgagcgccgccatcaaggacagcaaggcagtccacgccgacatggggtattggatcgagtccgagaagaacgagacgtggaaacttgcgcgggccagcttcatcgaggttaagacatgtatctggcccaagtcccacactctctggagcaacggcgtcctcgagtcggaaatgataatccccaagatctatgggggcccgatcagccagcacaactaccgccccgggtatttcacccaaacggccggcccctggcacctgggaaagctagaactggacttcgatctgtgcgagggcaccaccgtggtggtggacgaacactgcggcaaccgggggccgtccttacgcactacgaccgtcactgggaagataattcacgagtggtgctgtcggagctgtactctgccgcccctgcgcttcaagggagaggatggctgctggtacggtatggagatccggcctgtgaaagagaaggaggagaacctcgtcaagtcgatggtttccgccggcagcggtgaggtggactccttcagccttggtcttctctgcatctccatcatgatcgaggaggttatgcggagtcgctggtcccgcaagatgctgatgacgggcaccctggcagtctttttcctcctgatcatggggcagctgacctggaatgacctcatccgtctgtgcatcatggtgggcgcgaacgcgagcgaccgcatgggaatgggcatgacctacctagcactcatggccacattcaagatgcgcccgatgttcgccgtgggcctgctgttccgtcgcctcacctcccgggaggtcctgctactaactatcgggctgtcccttgtagcgtccgtcgagctcccaaacagcctggaggagctaggcgacggactagccatgggcatcatgatcctgaagctgcttaccgacttccagtcccaccagctgtgggccacgctcctcagcctgaccttcatcaagaccaccttttccctgcattatgcttggaaaacgatggctatggtgctctcaatcgtatccctgttcccgctgtgcttgagcaccacctcccagaaaaccacgtggctgcccgtcctgctcggcagtctggggtgcaagccgctcaccatgttcctgatcgccgaaaacaagatctggggccgcaagtcatggcccctgaacgaggggatcatggccgtagggatcgtgtccatcctactcagcagcttactgaagaacgacgtccccctcgcagggcctctgatcgccggcggaatgttgattgcctgctatgtgatcagcggttcaagcgccgacctcagcctggagaaggcggccgaagtgagctgggaagaggaggccgagcactcgggggctagccacaatatcctcgtcgaggtgcaggacgacgggacgatgaagataaaggacgaggagcgggatgacaccctcactatcctcctgaaagccacactactggccgtgtctggcgtctatccactgagcatccccgccacccttttcgtttggtatttttggcaaaagaaaaagcagaggtccggggtgttatgggacaccccctcgccgccagaggtcgagcgggccgtcctggacgacgggatctaccgcatcatgcagcggggcctcctggggcgctcccaggtgggagttggggtattccaggagaatgtcttccacaccatgtggcacgtcacgcggggcgcggttcttatgtatcaggggaagcgcctggaaccttcatgggcctccgtgaagaaggacttgatcagctacggcggcggctggcgactgcaggggtcttggaacaccggcgaggaggttcaggtgatagccgtggaacccggcaagaaccctaagaacgtacagaccgcccccgggaccttcaagacgagcgagggcgaggtcggggccatcgccctggattttaagcccgggaccagcggctcccccatcgtgaatcgcgaggggaagatcgtcggcttatacggcaacggggtagtcaccacctccggcacgtacgtctccgccatcgcccaggccaaggcaagccaggaggggcccttgccggagatcgaggacgaggtgttccggaaaaggaacctgactatcatggacctccaccccggctccgggaagacccgacgttatctgccggctatcgtgcgggaggccatcaagcgcaagctgcgcaccctcatcctggccccgacgcgcgtcgtggccagcgagatggcggaggccctaaagggcatgccaattcgctaccagaccaccgccgtgaagtccgagcacacgggcaaggagatcgtcgacctcatgtgtcatgccacgtttaccatgcggctgctgagccccgtgcgcgtccccaactacaacatgatcatcatggacgaggcccacttcaccgatccttcctcgatcgcggcccggggatacatctccacgcgcgtcggcatgggggaggcggctgccatctttatgacggcaactccgcccggcagcgccgaggccttcccccagtccaatgccgtgatccaggacgaggagcgggacatcccggagcgaagctggaactccgggtacgagtggatcaccgactttcccgggaaaaccgtgtggttcgttccatctattaagtccggcaacgacatagcaaactgcctccggaaaaacgggaagcgcgtgatccagcttagccggaagacgttcgacaccgagtaccagaagaccaaaaacaatgattgggactacgtggtgaccacggacatctccgagatgggcgccaacttccgcgcggaccgggtgatcgacccgagacggtgcctgaagccggtcatcctcaaggacgggccagagagggtcatcttggccggccccatgcccgtgaccgtagctagcgccgcccaacggcgcgggcggatcggccgtaatcacaacaaggagggcgatcagtacatctatatgggacagccgctgaataatgacgaggaccacgcccactggaccgaggccaagatgctcctggacaacatcaatacccccgagggcatcatccccgcccttttcgagcctgagcgggagaaatccgcggccattgacggcgagtaccgcctccgcggcgaggcccgtaagacgtttgtggaattgatgcgtcgcggcgacctaccggtgtggctctcctataaggttgccagcgagggtttccagtactcagatcgccggtggtgcttcgatggcgaacgcaacaaccaagtgctggaggaaaacatggacgtggagatatggaccaaggaaggggagcggaagaaactacgcccccgttggctcgacgcccgcacatacagcgaccccctggctctgcgggagttcaaggagttcgccgccggacgcagatcagtcagcggggatctcatcctggagatcggcaagctgccccaacacctcacccagcgcgcccagaatgctctggataatctggtgatgctacacaactccgaacagggtgggcgcgcatataggcatgccatggaggagctgccggacacgattgagaccctgatgctcctggcactgattgcggtgttaactggcggtgtcaccctgttctttctatcaggccgggggctcggcaagacgtccatcggccttctgtgcgtgatggcgagctccgtacttctatggatggccagcgtcgaaccccactggattgccgcctccataatcctggagttcttcctcatggttctgctgatccccgagcccgaccgccagcgcacaccccaggacaaccagctcgcctacgtggttatcgggctgctgttcatgatcctcaccgtcgcggccaacgagatgggcctgctggaaaccaccaaaaaggatctcggaatcggccacgtggccgtcgagaaccaccaccacgccgcaatgctggacgtggacctgcatcccgccagcgcatggacgctctacgccgtggccaccaccataatcacccccatgatgcgccacacgatcgagaacaccaccgccaacatcagtcttaccgcgatcgccaaccaggccgcgatcctgatggggttagacaagggatggccgatcagcaagatggacatcggcgtccccctgctggcgctcgggtgctactcccaggtgaacccactgacgctgaccgccgccgtgctaatgctggtagcccactacgccatcatcggccccggtctacaggcgaaagctacccgggaggcccaaaaacgcaccgccgctggtatcatgaagaacccaaccgtggacgggatcgtggcgatcgacctcgaccccgtcgtgtacgacgccaaattcgaaaagcaactgggccagattatgctgctcatcctgtgtaccagccagatcctgctcatgcgtaccacctgggccctgtgtgaatccatcacgctggccaccggccccttaaccaccctgtgggaggggagccccggcaagttctggaacactacaatagcagtgtcgatggcgaacatcttcagagggtcctatctggccggagccggcctcgcgttcagcctgatgaagagtctcggtggcgggcgccgagggaccggtgcgcagggtgagacgctcggcgagaagtggaagcgccagctgaaccaactgtcaaagtccgagttcaacacgtacaaaaggagcgggatcatggaggtcgaccgatccgaggccaaggagggcctcaagcgcggagagaccactaagcacgccgtgagccgcggcactgccaagctgcgctggttcgtggagcgcaacttagttaagcctgaggggaaggtgatcgacctcggctgtggtcgcggagggtggtcctactactgcgccgggctcaagaaggtgacagaggtcaaggggtacaccaagggcggccccggtcacgaggagcccatacctatggcaacctacgggtggaacctggtgaagctccacagcggtaaggacgtgttcttcgtccctcccgagaagtgcgacaccctcctgtgcgacataggggagtccagcccgaaccccacgatcgaggaaggccgcacactgcgggtcctcaaaatggtggagccgtggttaagaggcaaccagttctgcatcaagatcctgaatccctacatgccctccgtcgtcgagaccctcgagcaaatgcagcggaaacacggcggcatgctggtacgcaacccactcagcagaaactccacccacgagatgtactgggtctcttgcgggactggcaacatcgtctccgccgtgaacatgacaagcaggatgctcctgaaccggttcacaatggcccaccgcaaaccgacctacgagcgtgacgtcgatctgggggccggaacccggcacgtggccgtggagcctgaggtcgcgaacctcgacatcatcggccagcgcatcgagaacatcaagcacgagcacaagtccacgtggcactacgacgaggacaacccctacaagacctgggcgtatcacgggagctacgaagtgaagcccagcggctccgccagttccatggtcaacggggtggtgaagctgctgaccaagccgtgggacgtcattcctatggtgactcaaatcgccatgacggacaccacgcccttcgggcagcagcgggtgttcaaggagaaggttgacactaggacgcccaaggccaagcggggaaccgcgcagatcatggaggtgaccgccaagtggctctggggcttcctgagccgcaacaaaaagccccggatctgcacccgcgaggaatttacgcgtaaagttcgctctaacgctgccatcggcgcggtcttcgtggacgagaaccagtggaatagcgctaaggaggcagttgaggacgagcggttctgggacctggtccaccgggagcgggaacttcacaagcaggggaagtgcgcgacctgcgtgtacaacatgatgggcaaacgcgagaagaagctgggagagttcggcaaggccaaggggtctcgggcgatatggtacatgtggctgggcgctcgctttctggagttcgaggcattaggcttcatgaacgaggaccattggtttagccgggaaaattccctgagcggggttgagggtgaggggctccacaagctgggctacatccttagggacatctccaagatcagcgggggcaacatgtacgccgacgacaccgccggctgggacacccgtattacggaggacgacttgcagaacgaggcgaagatcaccgatatcatggagcccgagcacgcgctactggccaagagcatctttaagctaacctaccagaacaaagtcgtgcgcgtgcagcgtcccgccaagaacgggaccgtgatggacgtgatatctcgccgagaccagcggggctccggccaggtgggcacgtacggcctgaacacattcaccaacatggaggcacagctgatccgccagatggaaagcgaggggatcttcagcccgtcggagctcgaaacccccaacctcgcggagcgggccctggactggctcgagaaacatggagtcgaacgcctgaagcggatggctatcagtggggacgactgcgtggtcaagcccatcgacgatcgcttcgccacggcactgacggcgctcaacgatatgggcaaggtccggaaggatattccccagtgggagccgtccaagggatggaacgactggcagcaggtccctttttgcagccaccatttccaccagctgatcatgaaggacggccgcgagatcgtggtcccctgccggaaccaggacgagctggtgggccgtgcgcgggtgtcacagggggccggctggagtcttcgcgagaccgcctgcctggggaaatcctacgcgcagatgtggcagctgatgtacttccaccgtcgcgaccttcggctggctgccaacgcgatctgcagcgcggtgcccgtggactgggtgccgacctcccgcacgacctggtctatccatgcccaccaccagtggatgaccaccgaagacatgctgtccgtctggaaccgggtgtggatagaggagaacccctggatggaggacaaaacgcacatctcctcctgggaggacgtcccctacctcggcaaacgcgaggaccagtggtgcgggagcctgataggcctgaccgcccgggccacctgggcaaccaacatccaggtcgccatcaaccaggtgcgccgcctaattggcaacgagaactacctcgactacatgacttccatgaaacggttcaagaacgagagcgatcccgagggggcactgtggtga

SEQ ID NO: 23811 - RNA, 9879 nt, synthetic construct
  misc_feature 1..9879: note = derived and/or modified CDS sequence (opt11) from DENV-1__FJ639669__SS-prME
  source 1..9879: mol_type = other RNA
agcgtgaccatgctgctcatgcttatgcctacggccctggccttccacctcaccacccggggcggggaaccccatatgatcgtgtcaaagcaggaacggggcaagagcctgctgtttaaaacctccgcgggggtgaacatgtgcacactcatcgcgatggacctgggcgaactgtgcgaggacactatgacctacaaatgtccccgcatcaccgaggccgagcctgacgacgtggactgctggtgcaatgcgacagacacttgggtcacatacgggacctgtagtcaaaccggcgagcaccggcgtgacaagcggtcagtggcgctcgcaccccacgttggcctcggtctggagactcggacagagacatggatgagctcagaaggcgcctggaagcagatccagagagtggagacgtgggccttgcgccaccccgggttcacggtgatagccttattcctggcgcacgcaattggcacctctataacccagaagggcatcatcttcatcctactgatgctagtgacccctagcatggcaatgcggtgcgtcggcatcggctctcgggactttgtagaagggctatcaggcgccacgtgggtggacgtcgtgctggagcacgggagctgcgtgaccaccatggccaaagacaagcccacgctcgacatcgagctgctgaagacggaggtcacaaatcccgccgtgctgcggaagctctgcatcgaggccaagatctccaacactaccacagatagccgctgccccacccagggggaggccaccctggtcgaggagcaggacgcaaactttgtgtgtcgacgcaccttcgtggatcggggctgggggaacggctgcgggctgttcggaaaggggtccctcatcacgtgcgcaaaatttaagtgcgttaccaagttagagggcaagatcgtacagtacgagaatttaaagtacagcgtaatcgtgaccgttcacaccggggatcagcaccaggtggggaatgagtccacggaacacggtaccaccgcgaccatcacgccccaagctcctacgaccgagatccaactcaccgattacggcgccctaaccctggactgtagcccccgcacgggcctcgacttcaatgagatggtcctacttaccatgaaggagaagtcctggttggtgcataaacagtggtttttggacctgcccctaccctggacgagcggggcgagcacctcacaggagacgtggaacagacaggacctgctggtgaccttcaagaccgcccacgcgaagaaacaggaggtcgttgttctcggcagtcaagagggcgccatgcacaccgcccttacgggggcgaccgagatccaaacctccggaaccacgaccatattcgccgggcacctgaagtgccgcctcaagatggacaagctgaccctaaagggcatgtcttacgtcatgtgtaccgggtcctttaagctcgagaaggaggtggcggagacacagcacggaactgtgctggtacagatcaagtatgagggcaccgacgccccctgcaagatccccttcagcacccaagacgagaaaggggtgacgcagaacggtcggctgattaccgccaacccgatcgtgaccgacaaggagaaaccggtcaacattgaggccgagccacccttcggggaatcctacatcgtgataggagcgggcgagaaggccctgaaacttagctggttcaagaagggatcctcaattggcaagatgtttgaagcgaccgcccgaggtgcccggcgcatggcgatcctgggagacaccgcctgggatttcgggtcaatcggcggcgtctttacctccgtcgggaagctggtacatcagatcttcgggaccgcctacggggtattattttcaggggtcagctggaccatgaagataggtatcggggtgctgctgacgtggctaggactaaattcgcgcagcacctccttgtcaatgacctgcatcgcggtggggctggtcaccttatacctgggcgtgatggtccaggcagactccggctgcgtcatcaactggaagggccgggagttgaagtgtgggagcggcatcttcgttacaaacgaggtacacacctggacggaacagtacaagttccaggcggactcgccgaagcgcctgtctgctgctatcggcaaggcctgggaggagggggtctgtggcatacggtctgccaccagacttgagaacattatgtggaaacagatttccaacgagctcaaccacatccttttagagaacgacatgaagctgaccgttgtggtcggggacgtggcaggcatactggcccagggaaagaaaatgatccgcccccagcccatggaatacaaatatagctggaaatcatggggcaaagctaagatcatcggtgccgacgttcagaacacaacctttatcatagacgggcccaacaccccggagtgccctgacgaccagcgcgcgtggaacatttgggaggtcgaagactacggattcgggatctttaccacgaacatctggctgaagttacgggattcctacacccaggtctgcgatcatcgactgatgtccgccgccatcaaggactcaaaggccgtgcacgccgacatgggttactggatcgagtctgagaagaacgagacgtggaagctggcccgggccagttttatagaagtcaagacctgtatatggccgaagtcccacactctctggagcaacggcgtgctggagtccgagatgataatccccaagatctacgggggcccgataagccagcacaattaccgccccggttacttcacccagacggccgggccctggcacctggggaaattagagctggactttgacctatgcgagggaaccacggtggttgtggacgaacattgcggaaatcgggggccgagtctccgcaccaccaccgtgacgggcaagattatccatgaatggtgttgcaggagctgtactttaccgccccttcgcttccgcggggaggacggctgctggtatgggatggagatacgccccgtcaaggagaaggaagaaaatctcgtgaagtccatggttagcgccggatcgggcgaggttgattccttcagcttagggctgctctgtatctccattatgatcgaagaagtcatgcggtctcgatggtcgagaaagatgctgatgaccggcacactagcggttttcttcctgctgattatggggcaacttacgtggaacgacctaatccgcttatgtatcatggtaggcgcgaacgcctctgaccgcatggggatgggcaccacttacctggcgctaatggccacattcaagatgcggcccatgttcgccgtggggcttctgttccgccgcctcacctcccgcgaggtgctgctcttgacgataggtctgagcctggtcgcgtccgtggaactccccaatagccttgaggagctgggcgacggtctcgccatgggcataatgatcctgaaactactcaccgacttccagtcccatcaactgtgggctaccctgctcagcctaacgttcattaagaccaccttctccctgcactacgcctggaagactatggccatggtcctcagcatcgtgagtctgttccccctgtgcctgagcacgacatcccagaagaccacctggttacccgtgctactcggtagcctgggatgcaagccgctaacgatgttcctaatcgccgagaacaagatttggggccggaagtcttggcccctcaacgagggcatcatggcggtcgggatagtgagcatactcctatcaagtctcctgaagaacgacgtgcccctcgctgggccgctgattgctggcggcatgctgatcgcttgctacgtcatcagcggatcctccgccgacttgtccctagagaaggccgcggaggtctcatgggaggaggaggccgaacactctggcgctagccacaatattttggtggaggtccaagacgacgggaccatgaagatcaaggacgaggagcgcgacgataccttgacaattctgctgaaggccaccctcttggcggtgtccggagtttatcccctttctatccctgccaccctctttgtctggtacttctggcagaaaaagaaacagcggtccggggtgctgtgggacactcccagcccgcccgaggtggagcgcgccgtcctggatgacggcatctaccgcatcatgcaacgagggttgctcggccgttcccaggtgggggtgggggtcttccaagagaacgtattccataccatgtggcacgtaacccgcggcgcagtcctgatgtaccaggggaagcggctggaacccagctgggcgtctgtcaagaaggacctcatcagctatggcggagggtggcgtctccaaggctcatggaacacgggggaagaggtacaggtcattgccgtcgagccaggcaagaaccccaaaaacgttcagacagcccctgggaccttcaaaacccccgagggcgaggtcggagccatcgcgctggacttcaaacccgggacgtcaggttcccccatcgtaaaccgggagggaaaaatcgtggggctctatggcaatggcgtagtaaccacctctggcacatacgtgtccgccatcgcccaggctaaagcctcccaagagggccccctaccagagatcgaagatgaggtttttaggaagcggaacttaacaataatggatctccaccccggcagcgggaaaacccgccggtatctgccagccatagtgcgcgaggccataaagcggaagctcaggaccctcatcctggcccccaccagggtcgtggcctccgagatggcagaggcgctgaaggggatgcctatccggtaccaaacaaccgccgtcaagtcggagcacactggcaaggagatcgttgatctcatgtgtcacgccaccttcacgatgcgattactgagccctgtccgggtgccgaactacaatatgatcatcatggacgaggcccatttcacagaccccagctccatcgcggcccgtgggtatataagcacgcgggttgggatgggggaggcggcagctatcttcatgacagcgacaccgcccgggtccgttgaggcctttccgcaaagcaacgcagtgatccaagacgaggagcgcgacatacccgaacgtagttggaacagtgggtacgagtggatcaccgatttccccgggaagaccgtctggtttgtccccagcatcaagtcgggcaacgacatcgcaaactgtctccgcaagaacgggaagcgagtgattcaactgtctcgcaagaccttcgacactgagtatcagaagactaagaacaatgactgggactacgtggtaaccactgatatctctgagatgggcgcgaacttccgtgccgatcgcgtgatcgacccgcggagatgcttgaaaccggtgatcctcaaggatgggcccgaacgggtgatcctggccgggcccatgccggtgacggttgccagcgccgcacagcgccgggggcgcataggcaggaaccacaacaaggagggggaccagtacatctacatgggacagccacttaacaacgacgaagaccacgcccactggaccgaggccaaaatgctcttagacaacatcaacacccccgagggcatcatccccgcactcttcgaaccggaacgcgagaagtcagctgcgatcgacggggaataccgcctccggggcgaagcccgaaagacttttgtggaattgatgaggcgcggggacctccccgtttggttatcctacaaggtcgcctctgagggcttccagtacagtgaccggcgctggtgcttcgacggcgagcggaacaaccaagtattagaagagaacatggacgtggaaatctggacgaaggagggcgagcgtaagaaactgcggccacgctggcttgacgccagaacctactctgatcccctagccctgcgcgagttcaaagagttcgcggccggacggcgatctgtctctggggatctcatcctcgagataggtaagctgccgcagcacctcacgcaacgggcgcaaaatgctctcgacaacctggtaatgctccacaacagcgagcagggcgggcgcgcataccggcacgccatggaggagctgcctgatacgatcgagaccttgatgctgctggcactaatcgccgtgctcaccggcggggtcacactgtttttcctgagtggccgcgggctcggtaagacgagcatcggactgctgtgtgtgatggcctctagcgtactcctgtggatggcgtcggtagagccccactggatcgctgcctctatcatcttagagttcttcctcatggtgcttctaatcccggagccggatcggcagcgaacaccccaagataaccagctcgcctacgtggtaatcgggctgctgttcatgatcttaactgtggctgcgaacgaaatgggcctgttagaaaccaccaagaaggacctcgggatcggccacgtggccgtcgagaaccaccatcacgccgccatgctagacgttgacctgcaccccgcttcggcttggaccctttacgctgtcgccaccaccatcatcaccccgatgatgcggcacaccatcgagaacacaaccgccaacatcagcctgaccgctatcgcgaatcaagccgcgatcttgatgggtttagataagggctggcccatctccaagatggacatcggcgtccccctacttgcccttgggtgctatagccaagtgaacccgctgaccctgactgctgccgtgctcatgttagtcgctcattacgccataatcggtccggggctgcaggccaaggcgacccgggaggcgcaaaagcggacggcagcaggcatcatgaagaaccctaccgtggatggcatcgtggccattgacctggaccccgtagtgtacgacgcgaagttcgagaagcagctggggcaaatcatgctgctcatcctgtgcacttcccaaattctgctcatgcgaaccacctgggccctatgcgagtcaatcaccctggccactggccccctaaccacgctgtgggaggggtccccgggcaagttctggaacaccacgatcgccgtgagcatggccaacatattccgcgggtcctacctagcgggggccggtctcgccttcagcctgatgaagtccctaggaggtgggcgtcgcgggaccggcgcccagggcgagaccctgggcgagaagtggaagcgacagctgaaccagctgtccaagagcgagttcaacacctacaagcgcagcgggatcatggaagtagaccggagcgaggcgaaggagggcctaaaacgcggggagactaccaaacacgctgtgtcccggggcaccgctaaactgaggtggttcgtggaacggaatctggtcaagcccgagggaaaggtaatcgacctgggatgcggccgcgggggctggtcttactattgcgcagggctcaagaaggttaccgaggtcaagggctacacgaagggagggccaggccacgaagaacccatccctatggctacctacggctggaacctggtcaaattacattccggcaaggacgtgttcttcatcccgcccgagaagtgcgataccctcctgtgcgacattggggagagctccccgaacccgactatagaggagggacggacgctccgcgtactcaaaatggtggagccctggctgcgggggaatcaattttgcatcaaaatactgaacccctacatgcccagtgtggtcgagacgctcgagcagatgcagcgcaaacacgggggcatgctggtacggaacccgctgagccgcaacagtacccatgagatgtactgggtttcctgcgggaccggcaacatagtcagcgccgtgaacatgacttcccggatgctactgaacagattcacgatggcccaccgcaagcccacctacgaacgggatgttgatttagggaccggcacccgccacgtcgccgtggagcccgaagtggccaatcttgacatcatcggacagcggattgaaaacattaaacatgagcacaagagcacgtggcactatgacgaggacaacccttacaagacctgggcctaccacgggtcctatgaagtcaagccgagcggttccgccagcagcatggtgaacggggtagtgaagctgctgaccaaaccatgggatgtcatccccatggttacacaaatcgcaatgacggacacaacccccttcgggcagcagcgtgtgttcaaagagaaagtggatacccggacgccgaaagccaagcgaggcactgcccagatcatggaggtcacggcacggtggctctgggggttcctgtccaggaacaaaaagccccggatctgcacgcgcgaggagttcacgcggaaggtgcgctcaaacgcggccattggggccgtcttcgtcgacgagaaccagtggaactctgcaaaggaagcggtagaggacgagcggttctgggatctggtgcaccgcgagcgggagcttcacaagcaggggaagtgcgcgacctgtgtctacaatatgatgggcaagcgcgaaaagaagttaggggagttcggcaaggctaaaggtagccgggctatctggtacatgtggctgggcgcccgctttctcgagttcgaggcgctggggtttatgaacgaggaccactggttctcccgggagaacagcctgtccggggttgaaggggagggactccacaaacttggctacatcctgcgcgacatctctaagatccccgggggcaacatgtacgccgatgataccgccggctgggatactcggatcacggaggacgacctccagaacgaggcaaagataaccgacatcatggagccggaacacgccctgctggcaaaggccatctttaaactcacataccagaacaaagtagtccgcgtgcaacgcccagcgaagaacgggaccgtcatggatgtcatttcacggagagaccagcggggcagcggccaggtgggaacatacggcctgaatactttcaccaacatggaggcccagctgatccgccagatggagtccgaggggatcttcagcccctccgagctcgagacccccaacctggcagagcgggcgttggactggctcgagaagtacggcgtggaacggctgaagcggatggctatcagcggggacgactgcgtagtgaagcccatcgacgaccgattcgccacggccctgaccgccctcaacgacatgggaaaggtgaggaaggatatcccccagtgggaaccttctaagggttggaacgactggcagcaggtccccttctgcagccaccacttccaccagctaatcatgaaagacggccgcgaaatcgtggtaccgtgccggaatcaagacgagctggtaggccgggctcgggtgtcccagggggccggctggagcctccgggagaccgcatgtctgggcaaaagctacgcccagatgtggcagctgatgtacttccaccggcgggacctacggctggcggccaacgccatctgcagtgccgtgccagtcgactgggttcccaccagccgcacgacgtggtctatccacgctcaccatcagtggatgacgacggaagacatgcttagcgtgtggaaccgcgtctggatagaggagaacccctggatggaggacaagacacacatctcctcttgggaagatgtgccgtacctcggtaagcgcgaggaccaatggtgcgggtcactgataggcctgacagctcgcgccacctgggccacgaatatccaggtggccatcaaccaggttcggagactcatcggaaacgagaactacctggactacatgacgagcatgaagcgcttcaagaatgagtccgaccccgaaggggccttatggtga

SEQ ID NO: 23812 - RNA, 9882 nt, synthetic construct
  misc_feature 1..9882: note = derived and/or modified CDS sequence (opt11) from DENV-1__FJ639670__SS-prME
  source 1..9882: mol_type = other RNA
tcagtgactatgcttctcatgctgatgccgaccgccctggccttccacctcaccactcggggcggcgagccccacatgatagtatcaaagcaggaacgggggaagtccctgctgttcaagacctccgcgggcgtgaatatgtgcaccctaatcgccatggacctgggtgagttatgcgaagacacgatgacctacaagtgcccgcgcattactgaggcagagcccgacgacgttgactgttggtgcaacgccaccgatacttgggtcacctatggtacatgcagccagaccggcgaacaccgccgcgataagcggtctgtggccctcgcgccacacgtcggtctggggctggagacaagaaccgaaacatggatgagttccgagggggcctggaaacagatccagcgggttgagacctgggccctccgccaccccgggttcacggtgatagccctgttcttagcgcacgcgataggcacctctatcactcaaaaggggatcatttttatcctcctgatgttggtgacgccctccatggccatgaggtgcgtagggatcggcagccgggacttcgtggagggtctctccggcgccacgtgggtggacgtcgtactcgaacacggtagttgtgtgaccactatggctaaggacaaacccaccttggacattgagctgttgaagacggaagtcaccaacccagccgtactgcggaagctctgcatcgaggccaaaatctccaacaccaccactgactcgaggtgccctacccagggtgaagccaccctggtggaggagcaggatgctaacttcgtctgccggcgcacctttgtggaccgagggtgggggaacggctgcggtctgtttggcaaggggagtctcatcacgtgtgccaagttcaaatgcgtgaccaagctggaggggaagattgtacagtacgaaaacctaaagtactcggtgatcgtgaccgtccacacgggagaccagcaccaagtggggaatgagtccacggaacacggtaccaccgcaaccatcacgccccaggcccctacgactgaaatccagctcacagattacggggctctgactctggattgctctccgagaacgggcctcgatttcaacgaaatggtcctgctgaccatgaaggagaagtcgtggctggttcacaaacaatggttcctggacttacccctcccctggacctcgggggccagcacctcccaggagacctggaacagacaggatctcctggtgaccttcaagactgcccacgcgaagaagcaagaggtcgtggttctcggcagccaggagggcgccatgcacaccgccctgacaggggcaaccgaaatccagacctccggcaccaccacaatcttcgccgggcacctgaagtgtaggctcaagatggacaagttgaccctcaagggaatgtcctacgtcatgtgcaccgggagttttaagctcgagaaagaggttgcggagacgcaacacggcaccgtgctggtgcagatcaagtacgaaggcacagatgccccctgcaaaatacccttcagcacccaggatgaaaagggggtaacgcagaacggccggctcatcaccgccaatccaatcgttaccgacaaggagaagcccgttaacattgaggccgaacctcccttcggtgagtcatacatcgtaatcggcgcaggggagaaagccctgaaacttagctggttcaagaaagggtccagcataggaaagatgttcgaggccactgcccgcggcgcccggcgcatggccatcctgggcgatacagcttgggacttcgggtccatcggcggcgtcttcaccagcgtagggaagctggttcaccaaatattcggtactgcctacggggtgctgttctccggcgtctcttggacgatgaagatcgggattggcgtcctcctaacatggcttggcctaaacagtcgatccacctccttaagcatgacttgcatagcagtagggctcgtcaccttatatctgggagttatggtccaggccgactcaggctgcgtcatcaactggaagggaagagagttaaagtgcggtagcggcatcttcgtgacaaacgaagtccatacttggaccgagcagtacaaattccaggccgactccccgaagaggttgtccgccgccatcggcaaggcttgggaggagggggtctgcggcatccggagcgcaacacgcttggaaaacatcatgtggaaacagatttccaatgagctcaaccatatcctgctggagaacgacatgaagctaaccgtcgtggttggggacgtggctgggatccttgcccagggcaaaaagatgatccggccccagcccatggagtacaaatacagctggaagtcctggggcaaagctaagattatcggcgccgacgctcagaacacgaccttcataatcgacggtccaaatacaccggaatgcccagacgaccagcgcgcgtggaacatctgggaggtcgaagactacggctttgggatcttcacaacgaacatatggttaaagttacgcgacagctacactcaggtgtgtgatcaccgcctaatgtccgcggcaatcaaggatagcaaagctgtacatgcggacatgggatactggatcgagtccgagaagaacgagacctggaagctggcccgggccagcttcatcgaggtgaagacatgtatctggcccaagtctcacacgctttggagcaacggcgtactggagtccgaaatgatcatccccaagatctacggcggaccgatctctcaacacaattacaggcccggttactttacgcaaaccgcaggtccctggcatctgggaaagctcgagctggacttcgacctgtgcgagggcaccacagttgttgtcgacgaacactgcggcaaccgcgggccctccttgcgcacgaccaccgtgacgggcaaaatcatccacgagtggtgttgccggtcctgcaccctaccccccctgcggttccgcggggaggacggctgctggtacgggatggagatccgcccggtgaaggaaaaagaggagaacctcgtcaaatccatggtgtctgccggctcgggtgaggtagatagcttcagcctggggctactctgcatctccattatgatcgaggaggtcatgcggtctcgctggtcccggaagatgctgatgaccgggaccctggcagtgttcttcctcctgatcatggggcagttgacatggaacgatctcatccgcttatgtatcatggtgggcgcaaatgccagcgaccgcatgggtatgggcactacctaccttgccctcatggcgaccttcaaaatgcgcccgatgttcgcggtcggccttctgtttcgacgtctgacttcacgcgaggtactgctgctaaccatagggctgagcctcgtggcaagcgttgaattacccaacagcctggaagaactgggcgatgggctcgccatgggcataatgatcttgaagttgcttaccgacttccagtcacaccaactgtgggccacgctgcttagcctgacgttcatcaagacgacattcagtctacactacgcgtggaagaccatggctatggtgctcagcatcgtgagcctgtttccactgtgccttagcacgacgtcccagaagacgacctggctgcccgtgctactcggctcgttgggatgcaaaccgctcacgatgttcctaatcgcagagaacaagatttggggcagaaagtcctggcccctgaacgaggggatcatggcagttggcatagtcagcatcctcctttcttcccttcttaagaacgacgttccattagccgggcccctgatagcgggaggcatgctgatcgcctgttacgtgatctccggctcctcagcagacctctccctggagaaggccgccgaggtcagctgggaggaagaggccgaacactcaggggcgtcacacaatatcctcgtggaagtgcaggacgacgggaccatgaagatcaaggacgaggagcgcgacgacacccttaccatactgctgaaagccacccttttagccgtcagcggcgtctacccactgtcaatccccgctacacttttcgtgtggtacttctggcagaagaaaaagcaacggtctggggttctgtgggacacccccagcccgcctgaggtggagcgcgcggtgctggatgacggcatataccggatcatgcagcggggcctgctcggacgaagccaggtgggagttggggtgttccaagagaatgtcttccacaccatgtggcacgtaactcgtggcgctgtgctgatgtaccaggggaagcggctggagcctagttgggcgagcgtcaagaaagatctcatcagctacggaggcgggtggcgcctgcagggctcatggaacacgggcgaggaagtccaggtgatagccgtggagcccggtaagaatccgaagaacgtgcagactgccccggggaccttcaagacccccgagggcgaggtgggcgccattgccctggattttaagcccgggaccagcggaagcccaatcgtcaaccgggaggggaaaatcgtaggcctgtatggaaatggggtggtcaccacctctggcacctatgtgtcggccatcgcacaagcgaaggcctcccaagaagggccactgccagagattgaggacgaagtatttcgcaagcggaacctaacgatcatggacctccacccagggtcaggtaaaacgaggagatacttaccggcaattgtccgtgaagccattaagcggaagctgcgcaccctcatccttgcccccacccgcgtggtggcgtccgagatggctgaggcgctcaaaggcatgcctatccggtaccaaacgaccgccgtcaaatccgaacacactggtaaggaaatagtggacctcatgtgccacgccaccttcaccatgagactactgtcccccgtgcgggtccccaattacaatatgattatcatggacgaggcgcacttcaccgacccgagcagcatcgccgcccgcgggtatatatcgaccagagtgggcatgggagaggccgctgcgatcttcatgaccgccacgccgccaggcagcgtggaggccttcccgcagtcaaacgctgtcatccaggacgaggagcgcgatatccccgaaaggagttggaacagcgggtacgagtggatcacggatttccccggcaagaccgtttggtttgtaccctcgatcaagagcggcaacgatatcgcgaactgtttgcgcaagaacggcaaaagagtcatacagctgtccagaaaaactttcgacacggagtatcaaaagactaaaaataacgactgggattacgtcgttaccacagatattagcgagatgggcgccaatttccgggcggaccgcgttatcgacccccggcgctgtttaaaacccgtgatcctcaaggacggtcccgaacgggtgatactggccggccccatgccggtcacggttgcctccgcggcacaacgcagagggcgcatcggccgtaaccacaacaaggagggcgatcaatacatctatatggggcaacccctgaacaacgacgaggaccacgcgcactggactgaggccaaaatgctcctggataatatcaacaccccagaaggcatcattcccgccctgttcgagccggagagggagaagtcagctgccattgacggggaatatcgcctaaggggtgaggcccgcaagaccttcgtcgagctcatgcggcgaggggatctaccggtgtggctcagttacaaggtagcctcagagggcttccagtactctgaccggagatggtgcttcgatggcgaacgtaataatcaggtgctggaagaaaacatggacgttgagatctggacgaaggaaggggttagtcggaagaacctgcgaccccgatggcttgacgctcgaacctatagcgatcccctggcgcttcgcgaatttaaagaattcgccgcaggccggaggtccgtctcgggggacctcatcctggagatcggcaaactgccgcagcacctaacccaacgggcccagaacgccctggacaacttagtgatgctacacaactcggagcaaggtggtcgtgcctaccggcacgcaatggaggagcttccggacaccatcgagacgctgatgctactggcactgatcgccgtgcttaccggtggggtcaccctattttttcttagcggccgcggactgggcaagacctccatcggcttactttgcgtcatggcttcgtcagtgttgctgtggatcgccagcgtcgagccccactggatcgcagcctccattatcctcgagttcttcctcatggtgctgctgatacccgagcccgaccgccagcgcacgccgcaggacaaccagctcgcctacgtggtcatagggcttctgttcatgatcctgacggtggcggccaatgagatgggcctgctggagaccaccaagaaggacctagggattggacacgtagccgtcgaaaaccaccaccacgccgccatgcttgatgtggacttgcaccccgccagcgcctggaccctatacgccgtggccacgaccatcatcacgccaatgatgcgacacacgatcgagaacacgacggccaacatctcactgaccgccatagcaaaccaggctgccatcctgatggggctcgacaagggctggcccatctcaaagatggacatcggtgtccccttactggcgctcgggtgctactctcaggttaacccactgacccttacggcggccgtgctcatgctggtcgcccactacgcaatcatcggaccggggcttcaagcgaaagccaccagagaggcccagaagcgcaccgccgccgggatcatgaaaaaccccactgtagacggaatagtcgctattgacttggaccccgtcgtgtatgacgccaagttcgaaaagcagctgggtcagattatgctcctcatcctgtgcacgagccaaatccttctcatgcggactacctgggccctctgcgagtccatcaccctagctacgggacccctcacaaccctgtgggaagggagtccgggcaagttttggaataccactatcgctgtatccatggcgaacattttccgcgggagctacttagccggcgccggcctcgccttcagcctgatgaagtccctcgggggcgggcggcgggggacgggggcgcagggggagaccctcggcgaaaagtggaaacggcagctgaatcagctgtctaagtccgagtttaacacatacaagcggtctgggatcatggaggtcgacagaagtgaggcaaaggagggtctcaagcgtggggagacgaccaagcacgccgtatcgcggggcacggccaagctgcgttggttcgtggaacggaacttagtcaagcccgagggcaaggtgatcgacctgggctgcggccgcgggggctggtcctactactgcgctggtctcaagaaggtgacggaggtcaagggctacacgaagggcgggcctggccacgaagagcccatcccgatggctacttacgggtggaacctggtcaagctgcactccgggaaggacgtgtttttcatcccacccgagaagtgtgataccctcctgtgtgacattggcgaatccagctcaaatcccaccattgaagagggccgtacgctgcgcgtactcaagatggtcgagccgtggctccggggaaaccagttctgcataaagatcctgaatccctacatgccaagcgtggtagaaaccctcgaacagatgcagcgaaagcacggcggcatgctggttcggaatccgctgtcacgcaactcgacacatgagatgtactgggtgtcctgtggcaccggtaacatcgtgagcgcggtgaacatgacttcccggatgcttctgaaccgcttcacgatggcccacagaaagccaacctacgagcgggacgtggacctggggaccggcacccgccacgtagccgtggagcccgaggtagctaacctcgacatcattggccaacgtatcgagaatattaagcacgagcacaagtcgacatggcactacgacgaggataacccttacaaaacctgggcttaccatggttcatacgaggtgaagccgtcaggcagtgcctccagcatggtgaacggggtagtgaagttgctgaccaagccgtgggacgtgatccctatggttacccaaatcgcgatgaccgacaccactccgttcggccaacagcgcgtgtttaaggaaaaggtagatacccggacgcccaaggccaagcgcggaaccgcacagatcatggaggttaccgcacggtggctctggggcttcctgtctcgcaataagaaaccgcgaatctgcacccgagaggaattcaccaggaaggttcgcagcaatgcggccattggcgccgtgttcgtcgacgaaaaccagtggaactccgcgaaagaagcggtcgaggacgagcgattctgggacttagttcaccgcgaacgggagttgcacaaacaggggaaatgcgcgacatgcgtctacaacatgatgggcaagcgcgagaagaagctgggggaattcgggaaggcgaagggttcccgagccatatggtacatgtggttaggcgcacgcttcctggagttcgaggccttgggtttcatgaacgaggatcactggttctcgagggagaatagcttatccggggtagagggcgaggggctccataagcttggctacatcctgcgcgacataagcaagatcccagggggcaacatgtacgccgacgatacggcaggctgggacacccggatcacggaggacgacctccagaatgaggccaagatcactgatatcatggagcccgaacacgcgctgctggccaaggcgatcttcaagcttacctatcagaataaggtggtgcgcgtgcagcgtcctgcaaagaacgggaccgtgatggacgttatctcgcgccgcgaccagcggggcagcggccaagtcgggacatacggtcttaacacctttaccaacatggaggcccagctgattcgccagatggaatccgaagggatcttcagcccctcagagctcgagacccccaacctagcagagagagctctcgactggctcgaaaagtacggtgtcgagaggttgaagcggatggccatcagcggcgacgactgcgtagtgaagccaatcgacgaccgcttcgcaactgcactgaccgctctcaacgacatgggcaaggtacggaaggacatcccacagtgggagccgtcaaaggggtggaatgattggcagcaagtccccttttgcagccatcacttccaccagctgattatgaaggatggccgagagatcgttgtgccctgccggaaccaggatgaactggtcggaagagcccgcgtgtcgcagggggccggttggtccctcagggagaccgcatgcctggggaagtcctatgcccagatgtggcagcttatgtatttccaccggcgcgacctccggttagccgccaacgcaatatgctcagccgtgccggtcgactgggttcctacgtcgcgtactacatggtcgatccacgcgcaccaccaatggatgaccacggaggacatgctgtctgtgtggaaccgggtctggatcgaggagaacccatggatggaggacaaaacacatatcagctcctgggaagacgtcccgtacctcggtaagcgcgaggaccaatggtgcgggtcccttataggcttaaccgcgcgagcgacctgggcgacgaatatccaggtagccatcaatcaggtccgtcgcttaatagggaacgagaactacctggactacatgacctcgatgaagcggttcaaaaatgagtccgaccccgagggggccttatggtga

SEQ ID NO: 23813 - RNA, 9879 nt, synthetic construct
  misc_feature 1..9879: note = derived and/or modified CDS sequence (opt11) from DENV-1__FJ639671__SS-prME
  source 1..9879: mol_type = other RNA
agcgttaccatgctgctcatgctcatgcccactgctctggccttccacctaacgacccgtggcggggaaccccacatgatagtgagcaagcaagagcgcggcaagagcctgctgttcaagacctcagccggggtgaacatgtgtaccctcatcgcaatggacctgggcgagctgtgcgaagacaccctcacctacaaatgcccgcgcatcaccgaggtggaacccgatgatgtggactgctggtgcaatactacggacacctgggtgacctacgggacctgcagccagaccggcgagcacagacgcgataaacggtcggtagctctggcaccccacgtgggccttgggttagagacccgcgccgagacatggatgagcagcgagggcgcgtggaagcaaatacagagagtggagacttgggccctgcgacaccctggattcacagtgatagccttgttcctagcgcacgcgatcggcactagcatcacacagaaggggatcatcttcattctgctgatgctcgtcacgccctcaatggccatgcggtgtgtgggcattgggagccgcgacttcgtggaggggctgtccggcgccacgtgggtcgacgtggtgctggagcacgggagctgcgtcaccaccatggcgaaggacaagcccaccctcgacatcgagctgcttaagacggaggtaaccaacccggccgtgttgcggaagttgtgcatcgaggctaagatctccaacaccaccacggacagccgctgcccgacgcagggggaggcgaccctggtcgaggaacaggacgctaatttcgtgtgccggcggaccttcgtggaccggggctggggcaatggttgcggccttttcggcaaagggtccttaatcacttgtgccaagttcaagtgcgtcaccaagctggagggtaagattgtgcagtacgaaaacctcaaatacagcgtgatcgtcaccgtgcacaccggggaccagcaccaggtcgggaacgaatccacagagcacggtaccaccgccaccataacgccccaggcgcccaccagcgagatccaactgacggattatggggccttaaccttagactgcagccccagaaccggcctagacttcaacgagatggtgttactcacaatgaaggagaagtcatggttagtccacaagcagtggttcctagatttaccgcttccctggacgagcggtgcctccacctcgcaggagacctggaaccggcaggacctgctcgtcacgttcaagaccgcccacgcaaagaagcaagaggtggtggtcctgggctcccaggagggcgcgatgcacaccgccctgaccggggccacggagatccagacctccggcaccaccacgatattcgctggtcacctgaaatgccgcctaaagatggacaaactgaccctcaaaggcatgtcctacgtgatgtgcaccggtagttttaagctggagaaagaagtggcagagacgcagcatggtacggtcctcgtccagatcaaatacgagggtaccgacgccccttgcaagataccgttctccacccaagacgggaagggcgtgacccagaacgggcggctgatcacggccaacccgatcgtcacggacaaggaaaaaccggtgaatatagaggcggagccgcccttcggggagtcatacatcgtgatcggcgccggggagaaggcgctcaagttgagctggtttaaaaagggctcatctatcgggaagatgttcgaggcaacagcccgaggcgcccggcgcatggccatactgggggacaccgcgtgggacttcggcagcgtcggtggggtgtttacctccgtgggcaagctcgtccaccagatcttcggcacggcttatggcgtgctgttctccggagtgagctggaccatgaagatcggtataggggttctgctcacctggctggggctgaatagccgctccacgagcttatcaatgacctgtatcgcagtaggcctagttaccctgtatctcggggtcatggtgcaggcagactccggttgcgtgatcaattggaaggggcgtgaactgaagtgcggctcgggaattttcgtcacgaacgaggtgcacacgtggactgagcagtataagttccaggccgattcccctaagcggttgagcgccgccatcgggaaagcctgggaggagggcgtgtgtgggattcgctccgccacaagactcgaaaatgtaatgtggcggcaaattagcaatgaactgaaccacatcttactcgagaacgatatgaagttcaccgtggtggtcggcgacgtcgtagggatccttgcgcagggcaaaaagatgatccgcccgcaacccatggagcacaagtactcctggaagagttggggcaaggctaaaatcatcggggccgatgtccagaacaccacgttcataatagacggcccgaacaccagtgagtgcccggacgaccagcgggcctggaacatctgggaggtggaggactatgggttcgggatatttaccactaacatatggctgaaactccgcgacagctatacccaggtgtgcgaccaccggctgatgtccgccgcgatcaaagacagtcgcgcggtccacgccgacatgggctactggatcgagtccgagaagaatgagacctggaaacttgcacgggcttccttcatcgaggtgaagacttgcatctggcctaagtcgcacaccctgtggtcaaacggggtgctggagtccgaaatgatcatccccaagatatacggcggccccattagccaacacaactaccgtccgggctacttcacacagactgcgggcccctggcacctgggcaagttagagctggactttgacctgtgcgagggtaccacggtcgttgtggatgagcactgcgggaaccgagggccctccctccgcacgacgaccgtcaccggtaagatcatccacgagtggtgctgccgatcttgcacgctgccgccgctgcgcttcaaaggcgaagacgggtgctggtacggcatggagatccggccggtgaaggaaaaggaggagaacctcgtgaaaagcatggtttccgccgggtcgggtgaggtcgactcatttagcttaggactgctctgcatcagcattatgatcgaagaagtgatgagaagccggtggagtcgcaagatgctgatgacagggactctggcggtctttttcctccttataatgggacagctgacttggaacgacttgatacgcctgtgcattatggttggggcaaacgcaagcgatcggatgggtatggggacgacatacctggccttgatggccacattcaagatgcgcccgatgtttgcagtcgggctgctgttccggcggctcacctcccgcgaggtactgctgctcactatcgggctgtcattagtggcctccgtcgagctaccaaattccctcgaggagctcggcgacggcctcgcgatgggcataatgatacttaagctgctgaccgacttccagtcctaccagctgtgggcgaccctgcttagcctgaccttcatcaagacgaccttctcactgcattacgcctggaagaccatggccatggtgctctccatcgtctcgttactgccactctgcctaagcactacttcccagaagaccacctggctacccgtcctcctgggttcgcttggctgcaagcccttaaccatgttcctgattgccgaaaacaagatctgggggcgcaagtcttggccgttgaacgaaggcatcatggcggtggggatagtgtctatccttctttcatccctgctcaagaacgacgtccccctggccggccccttgatcgccggcgggatgctcatcgcctgctatgtgatcagcggttccagcgccgacctgtccctggagaaggcggcagaagtgtcttgggaggaggaggccgagcactccggggccagccacaacattctagtggaggtgcaggatgacggcacgatgaagataaaggacgaggagcgggacgataccctgacaatactactcaaggccacgctgcttgccgtgtccggcgtctaccccctatctatcccggccacgctattcgtgtggtacttctggcagaaaaagaagcaacgctccggggtgctatgggataccccctccccgcccgaagtagagcgggccgtactcgacgacggaatataccgtatcatgcagcgggggctgttaggacgaagccaagttggggtcggcgtattccaggagaatgtgttccacaccatgtggcacgtcacccgcggagctgtgctgatgtatcaaggcaagcgcctcgagcctagctgggcttccgtgaagaaggatctaatcagctacggagggggatggcggctgcagggctcctggaacacaggcgaagaggtccaggtgatagccgtggagcccgggaagaacccgaaaaatgttcaaacggctcctgggacctttaagaccccggagggagaggtaggggctatcgccctcgacttcaagcccggcactagcggctcgcccattgtcaaccgcgaaggaaaaatcgtcggcctgtacggtaacggcgtggtgacgacctcagggacatacgtctcagccatcgcccaagccaaagcctcccaagaaggccccctgccggagatagaggacgaggtgttccggaagcgtaacttaaccatcatggacttgcacccggggagcggtaagacgcgtcggtacctgcccgccatagtaagagaagccatcaaacgcaagctacgcaccctgatcctggctccgacccgggtcgtggcttccgagatggccgaggccctcaaaggaatgcccatacgctatcagacgacggcggtaaagagcgagcacaccgggcgggaaatcgtggatctgatgtgccatgccaccttcacaatgagactcctctcccccgtgcgagtgcccaactacaacatgataataatggatgaagcacatttcaccgatccgagctccatcgccgcccgcggctacatcagcacacgggtcggaatgggcgaggcggccgccatcttcatgaccgccacgccgcccgggtcggtagaagccttcccccagtccaacgccgtgatccaggacgaggagcgcgatatcccggagcggtcatggaacagcggctacgagtggatcactgacttccccggcaaaacggtctggttcgtgccttccatcaaaagcgggaacgacatagccaactgcctaagaaagaacggcaaacgggttattcaactatcccgcaagaccttcgacaccgaatatcagaagacgaagaacaatgactgggactacgtcgtaaccactgacataagcgagatgggggcaaattttcgggcggaccgggtcatcgacccgcggcgctgtttaaaaccggtcatcctgaaggacggtcccgagcgagtgatactggcggggcccatgcccgtgaccgtggcttccgccgcccagcgcagaggccgcatcggccgtaatcacaacaaggaaggggaccagtacatttacatgggccaaccattaaacaatgacgaagaccatgcccactggacggaagcgaagatgttgcttgacaacatcaacaccccagaggggatcatacctgcactcttcgagcccgagcgggaaaaatccgccgccatcgacggagagtaccgcctgcgaggtgaggccaggaagacgttcgtcgagctgatgcggcgcggcgacctcccggtctggttatcctacaaggtggcgagcgagggcttccagtacagcgaccggcgctggtgtttcgacggtgagaggaacaaccaggtgctggaggagaacatggacgtcgaaatttggacaaaagagggagagaggaagaaactccggccccgctggctggacgcccggacgtactccgacccgctggccctccgcgaatttaaggagttcgcagccggccgccgatcggtatccggcgacctcattctggagatcggaaagctcccccagcacctgacgcagcgggcgcagaacgcgctggacaacttggtgatgttgcataactccgagcagggcggtagggcataccggcatgcaatggaggaactgccggagacaattgagaccttgatgttactggcgctcatcgccgtcctgactggtggggtgaccctgttcttcctctccggtcgcgggctgggcaaaaccagcatcggcctactctgtgtcatggcctccagcgccctactatggatggcctccgtcgagcctcactggatcgcagccagcatcatccttgagttcttcctgatggtgcttctcatccccgagccagaccggcagcgcacaccgcaggataaccaactggcctacgtagtcattggcctcttatttatgatactgaccgttgccgcaaacgagatggggctgcttgagacgacgaagaaggacctcggtatcgggcacgtggcagtcgagaaccatcatcacgctaccatgctcgacgtggacctccaccccgccagcgcctggaccctctatgccgtggcgacgactatcatcacccctatgatgcgccatacaatcgagaacacgaccgcgaacatcagcctgaccgccatcgcaaaccaggcggctatcttaatggggctagataagggctggccgatttccaagatggacataggtgtccccctgttagccctgggctgttacagccaggtgaaccccctgaccctgacggccgccgtcctgatgctggtcgcgcattacgccatcatcgggcccggcttgcaggccaaggccaccagagaggcccagaagcgcaccgcggccgggatcatgaagaatccgaccgtggacggcattgttgctatcgacctggacccggtcgtgtacgacgccaagttcgagaagcagctgggccagatcatgctcctgatcctatgcacgtctcagatactcctaatgcggacaacctgggccttatgcgagtcgatcaccctcgcaacggggcccctaaccaccctgtgggagggcagtcccgggaagttctggaacaccacgatcgccgtgagtatggcaaacatctttcgcggctcttacctcgccggcgccgggctcgcgttctccctgatgaagtccctaggcggcggccgtcgcgggaccggggcccagggggagactctgggggagaaatggaagcggcaactaaaccaacttagtaagagcgagttcaacacctacaagcgctccggcatcatggaggtggaccggtcagaggccaaggaggggctgcgccggggcgagacaaccaagcacgccgtttcccgcgggaccgcgaagctgaggtggttcgttgaacgcaatctggtcaagccggagggcaaggtgatagacctcggctgcgggagaggcgggtggagttactactgtgccggcctgaagaaagttaccgaggtcaaggggtatacgaagggcggccccggccatgaggagcccattcccatggcaacctacggctggaatctcgtaaagctccactcgggtaaagacgtgtttttcatcccgcccgagaagtgcgataccctgctgtgcgatatcggcgaaagctctccaaaccccaccatcgaggaggggaggacgttgcgggtcctgaagatggtggagccgtggcttcggggcaaccagttttgcatcaagattctcaacccctacatgcccagcgtagtcgagaccctcgagcagatgcagcggaaacacggcgggatgctggtgaggaatcccctctcacggaactcaacccacgaaatgtactgggtttcctgcggcaccgggaacattgtctctgccgtgaacatgactagccgcatgttgctgaaccgctttacgatggctcaccgcaagccgacatatgagagagacgtggacctgggcgcgggcacccggcacgttgccgtcgaacccgaggtagctaacctggacataattggtcaacgcatagaaaacataaagcacgagcacaagagcacctggcactacgatgaggacaacccctacaagacttgggcctaccacggctcctacgaggtaaagcccagcgggtctgcctcctccatggtgaacggcgtcgtgaagctgctaaccaagccgtgggacgttatcccaatggtcactcaaatcgcgatgacggacactactcccttcgggcagcagagggtgttcaaggaaaaggtggacacacgaacccccaaggcgaagagaggaacggctcaaatcatggaggtcaccgcccggtggttatggggcttcctgtcccggaacaagaaaccgcgcatctgtacgcgcgaggagttcacccgcaaggtgcggagcaacgccgcgatcggggccgtgttcgtcgacgagaaccagtggaactccgcgaaggaggcggtggaggacgaacgcttctgggacctcgttcacagagaacgtgagctgcacaaacaaggaaagtgcgcgacgtgcgtctataacatgatgggaaagagagagaagaaactgggcgagttcggtaaggccaaaggcagccgcgccatctggtacatgtggttaggcgccaggttcctggagttcgaggcgcttggttttatgaatgaggaccactggttcagccgcgagaacagcctaagtggcgtggagggtgagggacttcacaagctggggtacattcttcgcgacattagcaaaatccccggcggtaacatgtatgcagacgacaccgccgggtgggacaccaggataaccgaggacgacctccagaacgaggccaaaatcacggacattatggagcccgagcacgcactgctcgccacctcaatctttaaactgacctaccagaacaaggtggtccgggttcaacgcccggcgaagaacggtaccgtgatggacgtcatttcccggcgcgaccagcgcggctcaggccaggttggcacctatgggctgaataccttcactaacatggaggctcagctcatcaggcagatggagagcgagggcattttctcccccagcgaactggagactcctaacctggctgagagggtgctggattggttagagaagtacggggtcgagcggctgaaacgcatggccataagtggcgacgattgcgttgtcaagcccatagacgaccgtttcgccacggccctcaccgctctgaacgacatggggaaggtccgcaaagacataccgcaatgggaacctagcaagggttggaacgactggcagcaggtccccttctgctcacaccacttccaccaactaatcatgaaggacggtcgagagattgtagtaccttgccgcaatcaagatgagctcgtggggcgggcccgcgtgagtcagggtgccgggtggagcctgcgggagaccgcctgcctaggcaagtcctacgcacaaatgtggcagctcatgtacttccatagacgggatctgcgcctggcggccaacgccatctgcagtgcagtcccggtggactgggtccccacgagtcgaacaacgtggagcatccacgcccaccaccaatggatgactactgaagacatgctctccgtctggaaccgcgtgtggatcgaagagaatccctggatggaggataagacgcatataagctcctggggcgacgtgccctaccttggaaagcgcgaggatcagtggtgcggcagcttgatcgggctcacagcgcgggccacctgggccaccaacatccaggtcgcgatcaaccaggtgcgacggctgataggcaacgagaactatcttgactacatgacctctatgaagcgcttcaagaatgagagcgacccggagggtgccctctggtag

SEQ ID NO: 23814 - RNA, 9879 nt, synthetic construct
  misc_feature 1..9879: note = derived and/or modified CDS sequence (opt11) from DENV-1__JN819423__SS-prME
  source 1..9879: mol_type = other RNA
agcgtaaccatgctgctcatgctgatgcctaccgccctggcgttccatctcacaacgcgagggggagaaccccacatgattgtttcgaagcaagaacgcggcaaaagcctcctcttcaagacgagcgccggggtgaatatgtgcacactcatcgccatggacttaggcgagctgtgtgaggacactctcacgtataagtgcccccgcataactgaagtggagcccgacgatgtggattgctggtgtaataccacagatacctgggtgacctacgggacctgtagccagacaggcgagcaccggcgcgacaagcggagcgttgccctggcgccgcatgtgggattaggtctcgagacccgggctgagacctggatgtccagcgagggcgcgtggaagcagatacaacgggtggagacctgggccctgcggcaccccggatttaccgtgatagccttgttcctcgctcacgccatcggcacctcgataacccagaaggggataatcttcatcctgctcatgttagtgacacccagtatggctatgaggtgcgtgggcatcggctcccgcgacttcgtggaagggctgtccggggcgacctgggtcgacgtggtgcttgaacacgggagctgcgtcaccacaatggccaaggacaagcctacgctcgacatagagcttctgaagaccgaagtaacgaaccccgccgtgctccggaagctgtgcatcgaagcgaaaatctccaacacgaccaccgacagccgctgccccacgcaaggagaggcaacactggtggaggagcaagacgccaactttgtgtgccggcgcacctttgttgaccggggctgggggaatggttgtggcctctttggcaagggaagcctgattacgtgcgccaaattcaaatgcgtcacaaagctggaaggcaagatcgttcaatacgagaacctcaagtactctgtgatcgtcaccgtccacaccggcgaccagcaccaggtgggcaacgagtccacggaacacggaaccaccgctactatcactccccaggcgcctaccagcgagatacagctaacggactacggtgctctgaccctcgactgcagcccaaggactggcctggacttcaacgagatggtgctgttaacgatgaaggagaagtcctggctagtacacaagcagtggtttctggatctcccgttaccttggaccagcggggcctcaaccagccaggagacctggaaccggcaggacctgttagtcacgttcaaaaccgcacacgcgaagaagcaggaggtggtggtgcttggctcccaagagggggcgatgcatactgcactgacgggagctacggagatacagaccagcggaacgaccacaatctttgccgggcacctgaagtgccgcctgaagatggataagctgaccctcaagggcatgtcctatgtaatgtgcaccggatctttcaaattggaaaaagaggtggcggagacccagcacggtaccgtcctcgtacagatcaagtacgaagggacggatgcgccctgcaaaatccccttttccacccaggacgggaagggcgtgacccaaaacggtcgcctaatcacggccaacccgatagtcaccgacaaggagaagcccgtgaacatcgaggcggaaccgccgttcggcgagagctatatcgtgatcggtgccggggaaaaggccctcaaactgtcttggttcaaaaagggaagctctatcggtaagatgttcgaagctaccgcccgcggtgctcggcgcatggccatcctaggggacaccgcgtgggacttcggtagcgtcggcggggtgttcacttccgtgggcaagctcgtacaccaaatattcgggacggcctacggcgtactcttcagcggggtgtcgtggacaatgaaaatcgggatcggcgtacttctcacatggctggggctgaacagtcgctccacgagtctctcgatgacctgtatcgccgtgggcctggtaaccctgtatttgggagttatggtgcaggcggacagcggatgcgtgataaattggaaagggcgtgagctgaagtgcggcagcggcatcttcgtcactaacgaggttcacacgtggaccgaacagtacaaattccaggcggactccccgaagcgcctgagtgccgccatcgggaaggcctgggaggagggggtgtgtggcatccggagcgcaacccgcttggagaatgtcatgtggcggcagatctccaacgagctgaaccatatcctcttagaaaacgacatgaagttcaccgtggtggtcggtgacgttgtgggcatcctggcgcagggcaagaagatgatccgcccccagcccatggagcataagtattcctggaagagttggggcaaggcgaagatcatcggggccgacgttcagaataccaccttcatcatagatggccccaacacctccgagtgcccagacgaccaacgagcctggaatatttgggaagtggaagactatggtttcggcatcttcactaccaacatctggctcaagctccgcgacagctacacccaggtttgcgatcaccggttgatgtccgccgcgatcaaggactctagggcggtgcacgccgacatgggctactggatcgaatccgagaagaacgagacctggaagttggcccgggctagtttcatcgaggtcaaaacctgcatctggcccaagagtcacacactatggagcaacggggtgctggagtccgagatgatcatacccaagatatacggcggacccatcagccagcacaattacaggccgggctacttcacccagacggcgggtccctggcacctgggcaagttagagctggatttcgatctctgcgagggtaccaccgtcgtcgtggacgagcactgcgggaaccgcggcccttccttacgaacgactacggttacagggaagatcatccacgagtggtgctgccggagctgcacactgccgcccctgcgatttaagggagaggacggctgctggtacggcatggagatcagacccgtaaaggagaaggaggaaaacctcgtcaagtcgatggtttcggcaggctctggggaggtggattctttttccctgggcctgctctgtatttccattatgatcgaggaggtgatgaggtcacgttggtcccgaaagatgctgatgacggggaccctggccgtcttctttctcctgatcatggggcagctaacgtggaatgatttgatcaggctgtgtataatggtgggcgccaatgccagtgaccggatggggatgggcacgacgtacttggcgctcatggccaccttcaagatgcgccccatgttcgccgtcgggctcctgttccggcgcctcacctcaagggaagttctgttacttacgatcgggctgagccttgtggcctccgtcgagttacctaacagcctggaagagttgggggacggtctggccatgggtatcatgatactgaagctgttaactgacttccaatcctatcagctgtgggcgaccctgctcagcctgacctttattaagactaccttctcgctgcactacgcctggaaaacgatggccatggtgctcagcatcgtctccctcctcccgttatgcctatcaacgacctcccagaagaccacctggctgcccgtccttcttgggtctctgggctgtaaacccctcacgatgtttctgatcgccgagaacaaaatttggggacgaaagtcatggccgctgaacgagggcattatggcggtgggaatagtgtcaattttactaagctccctgcttaaaaatgatgtccccctagcaggccccctgatcgccggcgggatgctcatcgcctgctacgttatcagcggatcgagcgccgacctgtcgctggagaaagcggccgaggttagctgggaagaggaggctgagcactccggtgccagccataacattttggtcgaggtgcaagacgatggcaccatgaagattaaggacgaggagcgggatgacacgctgacaatcctattgaaagccacgctgttagcggtctccggggtctaccctcttagcataccggcaacccttttcgtctggtacttttggcagaagaagaagcaacggtccggtgtgctatgggacacgccttccccgcccgaggtcgagcgggcggtactggacgacggaatctaccgcattatgcaaagagggctcttaggccgctcccaggtgggggtgggcgtattccaggaaaacgtgttccacacaatgtggcacgtcacgagaggggccgtgctgatgtatcagggtaagcgcctcgagccgagctgggcctccgtcaagaaagacctgattagctacggtgggggctggcgtctgcagggctcctggaataccggcgaggaggtccaggtgatcgcggtggagccggggaaaaaccccaagaatgtccagacagcgcccgggacctttaagaccccggagggcgaggtgggagccatcgcactcgacttcaagccaggcaccagcggcagtcccattgtgaaccgtgagggcaagatcgtcggcctgtacggtaacggagtggtgacgacctccgggacctacgtctccgcgatcgcgcaggctaaggccagccaggagggaccgctgccggagatagaggacgaagtgttccggaaacgcaacctgactatcatggacctacaccccgggagcggaaagacgcggagatacctgccggccatcgtgcgggaagccattaagaggaaactgcgcacactgatactagcaccgacccgggtcgtggcctcagagatggcggaggccttgaagggcatgcccatacgctaccagaccacggcggtaaagagcgagcacaccgggagggagatagtcgacttaatgtgtcatgcgacgtttaccatgcgcctactgtctcccgtgagggtgcccaactacaatatgataataatggacgaggcgcacttcacggatccgagcagcatcgcagctcgcggttacatttccacacgtgtcgggatgggagaggcggccgccatcttcatgaccgccacgcccccaggatccgttgaagcctttccccagtctaacgcggtgatccaggacgaggagagagacatccctgagcggtcctggaactctggctacgagtggattaccgacttccccggtaagactgtttggttcgtgccctcgatcaagagcggcaacgacatcgccaattgcctgcgcaagaacggcaaacgggtgatccagctttcgcgcaagaccttcgacaccgagtaccagaagacgaagaacaacgattgggactacgtcgtgaccaccgatatcagcgagatgggggccaacttccgtgccgatcgggtcatcgatccccggagatgcttgaaaccggtgatcttgaaggatggccccgaacgggtgatcctggcggggcccatgcctgtcaccgttgcctccgccgcccagcggcgtggccgaatcggccgaaatcacaataaagagggggaccagtacatatacatgggacagccgctcaacaacgacgaggaccatgctcactggacggaggctaaaatgctgctcgataacatcaacacaccagaggggattatccccgctcttttcgagcctgagcgggagaagtccgccgccatcgacggcgagtatcgcctgagaggggaagcccgcaagaccttcgtcgaattgatgcgccgcggcgacctcccggtttggctgagctacaaagtggcgtccgagggcttccagtacagcgaccggcgctggtgcttcgacggggaacggaacaaccaagtgctggaggagaacatggacgtggaaatctggaccaaggaaggagagcgcaagaagctccggccccgctggctggacgcccgtacctattcagatcccctagcactgcgcgagttcaaggagtttgctgctgggcggcgcagcgtgagcggggacctgatcctggaaatcggcaagttaccgcagcacctgacgcagcgggcgcaaaacgctctggacaacctggtgatgcttcacaacagtgagcagggcgggcgcgcataccggcacgccatggaagaactcccggaaacaatagagaccctaatgctgctagcgttaattgccgtcctaacgggcggggttaccctgttcttcctctccgggagaggtctgggcaagacctcaatcggactgctatgtgtgatggcttcgtcggcgctcctctggatggcctccgtcgagccccactggatcgcagcgagcatcatcctggagttctttctgatggtcttactcatccccgagcccgaccggcagcgcaccccacaggacaaccagctggcctacgtggtcatcggccttcttttcatgatcctgaccgttgccgccaatgagatggggctgttagagacgaccaagaaggacctgggcatagggcacgtggcggtagaaaatcaccaccatgccacgatgctagacgtcgacctgcatcccgcctccgcctggaccctgtacgcggtggcgacgacaatcataacccccatgatgcgccacactatcgaaaacacaacagcgaacatcagtctgacggccatagccaaccaggcagcgatcctgatgggcttagacaaaggatggccgatctctaaaatggacatcggtgttcctctgctcgccctgggctgctatagtcaggtgaatcccctgaccctaacggcagctgtgctaatgctagtagctcattacgccatcataggtcccggcttgcaagccaaagccacccgggaggcgcagaagcgcaccgcggccgggatcatgaagaatccaaccgtcgacggaatagtcgccatagacttggaccccgtcgtatatgacgccaaattcgagaagcaactagggcagattatgctcctgattttgtgcacatcccagatactgctgatgaggacgacctgggccctgtgcgagagtatcaccctcgcaactggaccgctgaccaccttgtgggagggctcccccggaaaattctggaataccacgatcgctgtttccatggccaacatcttccgcggttcttacctcgcaggagccgggttagcgttctctctaatgaagtccctcggcggagggcggagagggaccggcgcacaaggagagaccctgggcgaaaagtggaagcgacagttgaatcaactgtccaagtcagagtttaacacctataaacggtccggcatcatggaagtagacaggtctgaggccaaagaggggcttcgccggggtgagacaaccaagcacgccgtctcccgcgggacagcgaaactgcgctggttcgtggagcgcaacctggtgaaaccggaaggcaaggtgatcgacctcggctgcgggcggggagggtggagctattattgcgccggcttgaagaaagtgaccgaggtcaaagggtacacgaagggcgggcccgggcacgaggagcccatccccatggctacgtacggatggaacctggtgaagctccactcggggaaggacgtgtttttcatcccgcccgagaagtgcgacaccttactgtgcgacatcggcgagtcgagtcctaaccccacaatcgaagaggggcgcacgcttcgggtcctgaaaatggtggagccgtggcttcgcgggaaccagttctgcatcaagatcctcaacccttacatgccgtcggtggtcgagaccctggagcagatgcaacggaagcacggtgggatgttagtccgtaacccactgtcacgcaacagcacccacgagatgtattgggttagttgcggcaccggaaacatcgtctctgcggtaaatatgacctcacgtatgttactgaatcgcttcacgatggctcaccggaagccaacctatgagcgcgacgtggatctaggcgcgggcacccggcatgtagccgtggagcccgaagtcgccaacttggacataatagggcagcgaatcgaaaacattaagcacgagcacaaatcaacctggcactacgacgaggataacccctacaagacgtgggcctaccacggctcctacgaagtgaagcctagcgggagcgcctccagcatggtgaacggggtcgtgaagctgctcaccaagccgtgggatgtcatccccatggtgacccagatcgctatgaccgacacaactcccttcggacaacagagggtcttcaaggaaaaggtggacacccgcacaccgaaggccaagcggggaaccgcccagattatggaagttaccgcccgctggctgtggggattcttatcgcggaataagaaaccgcgcatctgcacccgggaagagttcacccgcaaagtccgaagcaatgcagcgattggggccgtattcgtcgacgagaatcagtggaactccgccaaggaggccgtggaggacgagcgcttctgggacctcgtgcaccgggagcgtgagctgcacaagcagggcaagtgcgcgacgtgtgtctacaacatgatggggaagcgcgagaagaaactgggtgagttcggaaaggccaagggcagcagagccatctggtatatgtggctcggtgcccggtttctagagttcgaggccctagggttcatgaatgaggatcactggttctctcgcgagaactctctctccggcgtggagggggagggcctacacaagctagggtacatcctccgcgacataagcaagatccccggcggtaacatgtatgccgacgacaccgccgggtgggacacacggataaccgaggacgatctgcaaaacgaggccaaaattacggacatcatggagccagagcatgcgctcctcgccacctccattttcaaactgacttaccagaataaggtggtccgcgttcagcggccggctaagaacgggacagtgatggacgtcatcagccggcgggaccaacgcgggtccggccaggtgggcacgtacgggctgaacaccttcaccaacatggaggcccaactcatcaggcagatggagagtgagggcatattctccccaagcgagctggagaccccgaacctggctgagcgcgtgctcgattggctggaaaagtacggagtagagcggcttaagagaatggcaatctccggagacgactgtgttgttaagccgatcgacgaccgattcgccacggcgctcaccgctctgaacgacatgggaaaagtcaggaaggatatcccccaatgggaacctagcaagggctggaatgactggcagcaagtgcccttctgtagccaccattttcatcaacttattatgaaggacggccgggagatcgtggtcccatgccggaaccaggacgagctcgtggggcgggctcgcgtgtcccaaggcgcagggtggagcctccgggagactgcctgcctgggcaaatcatacgcgcaaatgtggcaactgatgtacttccaccgccgagacctgcgcctcgccgccaacgccatttgcagtgcggtcccagttgactgggtgcccacctccagaacgacctggagcatccacgctcaccaacagtggatgaccaccgaagatatgctctccgtctggaaccgggtgtggatcgaggagaacccctggatggaggacaaaactcacatcagctcctggggcgatgtgccttacctgggtaagcgcgaggaccaatggtgcggaagcctgatcggactcaccgcccgcgccacctgggccaccaatatccaggtggcgatcaaccaagtgcggcggctgatcggcaacgagaactacctagactacatgacctccatgaagcgcttcaagaatgagagcgacccagagggggcgttatggtag

SEQ ID NO: 23815 - RNA, 9879 nt, synthetic construct
  misc_feature 1..9879: note = derived and/or modified CDS sequence (opt11) from DENV-1__FJ639672__SS-prME
  source 1..9879: mol_type = other RNA
agcgtcacaatgctgctcatgctgatgccgaccgccctggccttccacctcaccacaaggggtggagagccccacatgatagtgtcgaagcaggagcggggcaagagcctgctgttcaaaacctctgcaggggtgaacatgtgcaccctaatcgccatggacctgggggagctgtgcgaggacacaatgacctacaagtgtccccgcatcacagaggccgagcccgacgacgtggactgctggtgcaacgccaccgacacgtgggtgacctacggtacttgcagccagaccggcgaacaccggcgcgacaagcggtccgtggccctcgcaccccacgtgggcctggggttggagacgcgcaccgagacctggatgtcgtcagagggagcatggaaacagatccagcgggtggagacctgggccctccgccacccggggttcacagtgatcgcgctgttccttgcgcacgccattgggaccagcatcacccaaaaggggataattttcattctcttaatgttggtgactccttccatggctatgcggtgcgtcggcatcagctcccgcgacttcgtggagggcctcagcggggccacgtgggtggacgtcgtgttggagcacggctcctgcgtgaccaccatggcgaaggacaagcctaccctggatatcgagctcctgaagaccgaggtcactaaccccgcggtgctgcggaagctctgcatcgaggccaagatcagcaacaccaccacggactcccgctgcccgacccagggggaggccaccctggtggaagagcaggacgccaacttcgtctgccggcgcaccttcgtggaccggggctggggcaacgggtgcggcctgttcgggaagggcagcttgatcacgtgtgccaagttcaagtgcgtgaccaagctggaggggaagattgttcagtacgagaacctgaagtactccgtgatcgtgacagtccacaccggtgaccaacaccaggtgggcaatgaaagtacggagcacgggaccaccgccactatcacgccccaagcccccacgaccgagatccagctcacagactatggcgccctgaccctggactgcagtccccggacggggctcgactttaacgagatggtcctgctgaccatgaaggagaagtcctggctcgtgcacaagcagtggttccttgacctgcccctcccctggaccagcggggcctcaaccagccaggagacatggaaccggcaggacctgctggtgactttcaagaccgcccacgcgaagaagcaggaggtcgtggtgctggggtcccaggagggcgctatgcatacagccctgacgggcgcaaccgaaatccagaccagcggcaccacgaccatcttcgccggccacctgaaatgccgactcaagatggacaaacttaccctgaaggggatgtcctacgtcatgtgcaccgggtcgttcaagctcgaaaaagaggtggcggagacgcagcacgggaccgtgctggtacaaatcaagtacgagggcaccgacgccccctgcaagatacccttctccacacaggacgagaagggcgtgacgcagaatgggcggctgattaccgccaacccgatcgtgaccgataaagaaaagcccgtcaacattgaggccgagccgcccttcggcgagtcctacatcgtgatcggggcgggcgagaaggccctgaaactctcctggttcaagaagggcagctccatcgggaagatgttcgaggcgaccgctcgtggcgcccggcgcatggcgatcttgggggatacggcctgggatttcgggagcatcgggggcgttttcacttcggtcggaaagctggtacaccaaatctttggcacagcctacggggtcctcttctccggggtctcctggaccatgaagatcggtatcggggtgctactgacgtggcttggcctcaacagccgctccaccagcctgtccatgacctgcatcgccgtgggcctcgtcaccctgtacctgggtgtgatggtgcaggccgactcaggctgcgtcatcaactggaaggggcgagagctcaagtgcggcagcgggatcttcgtgactaacgaggtgcacacatggaccgagcagtacaagtttcaggcggactccccgaaacgcctgagcgccgccatcggcaaggcctgggaggaaggcgtctgcgggatcagatctgcaacccgcctggagaacatcatgtggaaacagatctcaaacgagctcaatcacatcctgctggaaaacgacatgaagctcaccgtggtggtcggcgacgtagcggggatcctggcccagggcaagaagatgatccggccccagcccatggagtacaagtactcctggaaaagctgggggaaggccaagatcatcggcgccgacgtgcagaacacgaccttcatcatagacggccccaacacccccgagtgccccgacgaccaacgcgcctggaacatctgggaggtcgaggattacgggttcggcatcttcaccactaacatctggcttaagctcagggactcctacacccaggtgtgcgaccaccgcctgatgagcgccgccatcaaggattccaaggccgtgcatgccgacatggggtactggatcgagagcgagaaaaacgagacttggaagctggcccgtgcctccttcattgaagtcaagacctgcatctggccaaagagccacacgctctggtccaacggcgtcctggaaagcgagatgatcatccccaagatttacggaggcccgatctcccagcacaattaccgccccggctatttcacccagaccgccggaccctggcacctgggcaagcttgagctggacttcgacttgtgcgaggggaccacggtggtcgttgacgagcactgcggcaaccggggcccatcgctccgcaccaccaccgtgacggggaagatcatccacgagtggtgctgccggtcctgtaccctaccgcccctgcgctttcggggagaggacgggtgctggtacggaatggagatccgccccgtcaaggaaaaagaggagaacctcgtcaagagcatggtgagcgccgggtccggcgaggtcgacagcttctccctgggcctgctctgcatctctataatgatcgaggaggtgatgcggtcccgctggagccggaagatgctgatgaccgggaccctggcggtgtttttcctcttaatcatgggccagctgacgtggaacgacttgatccggttgtgcattatggtcggggcgaacgcctccgaccgcatgggaatggggaccacatacctggccttaatggccaccttcaagatgcggccgatgttcgccgtgggactgctgtttaggcggctcacgagccgcgaggtgctgctgctgaccatcggcctttcccttgtcgcctcagtggagctccccaattcactggaggagctgggtgacggcctggccatggggatcatgattttaaagctgctcaccgactttcaatctcaccaactgtgggccaccctgctgtccctcacgttcatcaagaccacattcagcctccactacgcctggaaaactatggctatggtcctctccatcgtgagcctgttccccctatgcttgtccacgaccagccagaagaccacctggctgcccgtactgttgggctccctgggctgcaagccgttgacgatgttcctaatcgccgaaaacaagatctggggacgcaagtcatggcccctgaacgagggcatcatggccgtcgggatcgtgagcatcctgctctcctcactgctgaagaacgatgtgcccctggcgggccccctaatcgcagggggcatgctgatcgcctgctacgtcatctccggctcttccgccgacctcagcttggagaaggccgccgaggtgtcctgggaggaggaggccgagcacagcggcgcgtcccacaacatactggtggaggtccaggacgacggcaccatgaagatcaaggatgaggagcgcgacgacaccctcaccatcttgctgaaggccaccctcctggccgtgagtggggtgtacccgctatccatccccgccaccctctttgtctggtacttctggcagaagaaaaagcagcgaagcggcgtgctgtgggatacccccagcccgcccgaggtggagcgcgctgtcctggacgacgggatataccggatcatgcagcgcggcctgctcgggcgatcccaggtgggggtgggcgtcttccaggagaacgtattccacaccatgtggcacgtgacgcgcggggcggtcctgatgtaccagggcaagcggttggagccctcctgggccagcgtgaagaaggacctcatttcctacgggggcggctggcgcctccagggaagctggaacacgggcgaggaggtgcaggtcatcgccgtcgagcccgggaagaaccccaagaacgtgcagaccgcgccgggcaccttcaagacccccgagggggaggtcggagccatcgcgctcgacttcaagccgggcacgtccggcagccccatcgtgaaccgagagggcaagatcgtggggttgtacggcaatggcgtcgtgactaccagtgggacctacgtgtccgccatcgctcaggccaaggcgagccaggagggcccgctgcccgagatagaggacgaggtcttcaggaaacggaacctgacgatcatggacctccaccccgggtccggcaagacccgccggtacctgccggcgatcgtgcgcgaggccatcaagcggaagctgcgcacccttatcctggcccccacccgcgtggttgccagtgagatggcggaagccctgaaggggatgcccatccggtaccaaacgactgccgttaagtccgagcataccggaaaggagatcgtagacctgatgtgccatgccacctttacgatgaggctgctgagccccgtccgggtgccgaactacaacatgatcatcatggacgaggctcacttcaccgacccctccagcatcgcagcccgcggctacatctccacccgcgtgggcatgggggaggccgccgccatctttatgaccgcgacgccacccgggagcgtcgaggcattcccgcagtccaacgctgtgattcaggacgaggagcgcgacatccccgagaggagctggaactcaggctacgagtggatcacggacttccccgggaagaccgtgtggttcgtgcccagcatcaagtccggcaacgacatcgcgaactgcctccgcaagaacggcaagcgggtgatccagctgagcagaaagaccttcgacacggagtaccagaagacgaagaacaacgactgggactacgtggtcaccaccgacatctccgagatgggggcgaacttccgggccgaccgcgtgatcgacccgcggaggtgtcttaagcccgtgatcctcaaggacggccccgagagggtcatcctggccggacccatgccggtgacggtcgccagcgccgcccagaggcggggccggatcggccggaaccacaacaaggagggcgaccagtacatctacatgggccagcccctgaacaatgacgaggaccacgcccactggacagaggccaagatgctcctggataacatcaacacccccgagggtataatccccgccctgttcgaaccggagcgcgagaagtccgccgcgatagacggggaataccgcctccgcggggaggcccgcaagacattcgtggagctgatgaggcgcggcgatctgcccgtgtggctcagctacaaggtcgccagcgaggggttccagtactccgaccggcgctggtgtttcgacggcgagcggaataatcaggtgctggaggaaaacatggacgtggagatctggacgaaggagggcgaacgaaagaagctgcggccccgctggctcgacgcccggacctacagcgaccccctggccctgcgggagttcaaggagttcgcggccgggcgtcgctccgttagcggcgacttaatcctggagatcgggaagctgcctcagcacctcactcagagagcccagaacgccctggacaacctggttatgctccacaactcggaacagggcggcagagcgtaccgccacgccatggaggagctgcccgacaccatcgagaccctgatgctcctggccctgatcgccgtgctcacgggcggcgtcaccctgttcttcctcagcgggagaggcctcgggaagacatccatcggcctgctgtgcgttatggcctcctccgtcctactgtggatggcaagcgtcgagcctcactggatcgcggcctccatcatcctggagttcttcctcatggtgctgctgatccccgagccggaccggcagcgcacgccccaggacaaccaactagcctatgtcgtcatcggcctgctgttcatgatcctcacggtagccgcgaacgagatgggacttctggagaccaccaaaaaagacttgggcatcggacacgtggccgtcgagaatcaccatcacgccgccatgctggacgtggacctgcacccggccagcgcctggaccctatacgccgtggccacgaccatcatcaccccaatgatgcgccacacaatcgagaacacgacagccaatatatcactgaccgccatcgcgaaccaggccgccatcctgatgggcctcgacaaggggtggcccatcagcaagatggacatcggtgtaccactgctggccctcggctgctactcccaggtgaacccgctgaccctgacggcggccgtgctcatgctggttgcccactacgccatcatcggaccgggcctgcaggccaaagcaacccgcgaggcccagaagagaaccgccgccgggatcatgaagaaccccaccgtggacggcatcgtggccatcgacctcgacccggtggtgtacgacgcaaagtttgagaagcagctggggcagatcatgctgttaattctttgcaccagccaaatcctgctcatgcggaccacctgggcactgtgcgagtccatcaccctggccacaggccccctcaccaccctgtgggaggggagcccggggaagttctggaacacaacgatcgctgtttccatggccaacatatttcgcggcagctacctggcgggggccggcctcgcgttcagtctgatgaagtcgctgggcggaggccggcgcgggaccggcgcccagggagaaaccctcggcgagaagtggaagcggcaactgaaccagctgagcaagtccgagttcaacacctacaagcgcagcggcatcatggaggtcgaccggtccgaggccaaggaggggctcaagcgcggcgagacgaccaagcacgcagtgtctcgggggacggccaagctgcgatggttcgtggagcggaacctggttaagcccgaggggaaggtgatcgacctggggtgcggccgaggcgggtggtcctactattgcgccggcctcaagaaggtgaccgaagtcaaggggtatacgaagggcggccccggacacgaggagcccatcccgatggccacctatggctggaacctggtgaaactgcacagcgggaaggacgcattcttcatcccacccgagaagtgcgacacgctcctgtgcgacatcggcgagtcctcgcccaaccctaccatagaagaggggcggacgctgcgcgtgctcaagatggttgagccctggttacggggcaaccagttctgcatcaaaatcctgaacccctacatgccctccgtggttgagaccttggagcagatgcagcgcaagcacgggggtatgctggtaagaaatccgctatctaggaactccacccacgagatgtattgggtgagctgcggcaccgggaacatcgtgtccgcggtcaacatgaccagccggatgttgctgaacaggtttacgatggcccaccgcaagcccacctatgagagagacgtggacctgggcaccgggactcgccacgtggccgtcgagcccgaggtggctaacctagacattatcgggcagcggatcgagaacatcaagcacgaacacaagtctacttggcactacgacgaggacaacccctacaagacctgggcgtaccacggcagctacgaggtgaagccgtccgggagcgcgagctccatggtcaacggcgtggtaaagctgctgaccaagccttgggacgtgatccccatggtgacccagattgccatgacggacaccaccccattcgggcagcagcgcgtcttcaaggagaaggtggacacccggacgccgaaggccaagcgcggcaccgcccagatcatggaagtgacggcgcggtggctctgggggttccttagccggaacaagaagccccggatatgcacccgggaggagttcacacgaaaggttcgctccaacgccgccatcggcgccgtgttcgtggacgagaaccagtggaacagcgctaaggaagcagtcgaggacgagagattctgggacctggtgcaccgcgagcgggagctccataagcagggcaagtgcgcgacctgcgtatacaatatgatggggaagcgcgagaagaagctgggcgagttcggtaaggccaagggctcccgggccatttggtacatgtggctgggggcgagattcctagagttcgaggccctgggcttcatgaacgaggaccactggttctcgcgggagaactccctgtcaggcgttgagggcgagggcctccacaaactggggtacatcctgcgcgacatttccaagatccccggcggcaacatgtacgccgacgacaccgccggctgggacacccgcatcacggaggatgacctccagaatgaagccaagattaccgacatcatggagccggagcacgcgctactggctaaggccatcttcaagctcacctaccagaacaaggtggtgcgcgtccagcgacccgccaagaacggcaccgtgatggacgtgatcagccggcgcgaccagagagggtccggtcaggtcgggacgtacgggctgaacactttcacgaacatggaggcgcagctgatccgccagatggaaagcgaaggcatcttctcccccagcgagctcgagacccccaatctcgcggagcgcgcccttgactggctcgaaaagtatggggtggaacgcctgaagagaatggcaatcagcggcgacgactgcgttgtcaagccgatcgacgataggttcgcgacggccctgaccgcgttgaacgacatggggaaggtgcggaaggatatcccccagtgggagccctcgaagggctggaatgactggcagcaggtccccttctgctcccaccactttcaccagttaattatgaaggacgggcgcgagatcgtcgtgccgtgccggaatcaggacgaattggtcggccgcgcgcgggtaagccagggcgccgggtggtctctccgcgagaccgcctgcctgggcaagtcttacgcgcagatgtggcagctgatgtacttccaccggcgcgacctccggctggccgctaacgccatctgcagcgccgtgcctgtagactgggtccccacctcccgcactacctggagcatccatgcgcaccaccagtggatgaccaccgaggacatgctctccgtctggaatcgggtgtggatcgaggagaacccctggatggaggacaaaacgcacattagctcctgggaggacgtaccgtacctcgggaagcgcgaggaccagtggtgcggcagcttaatcgggctgaccgcccgagcgacctgggccaccaatatccaggtcgccatcaaccaggttcggcggctcatcgggaacgaaaactacttagactacatgacctccatgaagcggttcaaaaacgagagcgaccctgagggcgcgctgtggtga

SEQ ID NO: 23816 - RNA, 9879 nt, synthetic construct
  misc_feature 1..9879: note = derived and/or modified CDS sequence (opt11) from DENV-1__FJ639673__SS-prME
  source 1..9879: mol_type = other RNA
agcgtcaccatgctcctgatgctgatgcccaccgctctggccttccacctgaccaccagaggaggggaaccccacatgattgtgagcaaacaggagcggggcaaatcgctgttattcaagacgtctgcgggggtgaatatgtgcaccctcattgccatggacctgggcgagctgtgcgaagacacaatgacctacaagtgcccccgcatcaccgaagtggagccggacgacgtagactgttggtgcaacacaaccgacacctgggtgacctacgggacctgctcgcagacgggcgagcatcggagagacaagcggtcggtcgccctagcgccccatgtggggctgggcctggagacacgtgccgagacttggatgagctccgagggcgcgtggaagcagatacagcgggtggagacctgggccctccggcatccggggttcaccgtaattgccctgttcctggcccatgctatcggcaccagcatcacccagaaagggatcatcttcatcctcctgatgttagtcaccccttccatggccatgcgttgcgtgggcatcggcagcagggacttcgtcgaggggctcagcggagctacctgggtagatgtggtactcgagcatgggagctgcgtcacaaccatggccaaagataagcccaccctggacatcgagctcctgaagacggaggtgaccaatcccgccgtgctgaggaagttgtgcatcgaggcgaagatctcgaacaccaccacagacagccgctgcccaacccagggcgaggcgaccttggttgaggaacaggacgccaacttcgtttgccgtcgcaccttcgtggaccggggctgggggaacggatgcgggctgttcggcaaggggtccctaatcacgtgcgcgaagttcaagtgcgtcaccaagctcgagggcaagattgtgcagtacgagaacctgaagtacagcgtgatcgtcaccgtgcacaccggggaccagcaccaggtaggaaacgagtcaacggagcacgggaccaccgctacgatcacgcctcaggcgcccacgagcgaaatccagctgacggactacggggcgctgaccctggactgcagtccccggaccgggctcgacttcaacgagatggtgctgctgacaatgaaggaaaaatcctggctagtgcacaagcagtggttcctggacctgccgctcccctggacaagcggtgcgtccaccagccaagagacctggaaccggcaggacctgttagttacgttcaagaccgcccacgccaaaaagcaagaggtggtggtcctcggctcccaggagggcgcgatgcataccgccctgaccggggccaccgagatccagaccagcggaaccaccacgatatttgcgggtcacctgaagtgccgccttaaaatggacaagttaaccctgaaaggaatgtcctatgtgatgtgcaccgggagctttaaacttgagaaggaggtcgccgaaactcagcacggcactgtcctggtgcagatcaagtacgaaggaaccgacgccccctgcaagatccccttctccacccaggacgaaaagggcgttacacagaacggccggctgatcacagccaacccgattgtcaccgacaaggagaagcccgtgaacatcgaggccgagccacccttcggtgagagttacatagtgatcggcgccggtgagaaagcgctgaagctaagttggtttaaaaagggttcctccatcggtaaaatgttcgaagccaccgcgcgcggggcccgtcgcatggcaatactaggcgacaccgcttgggacttcgggtccatagggggcgtcttcacatccgtgggtaaattagtgcaccagattttcggcacggcctacggagtcctgttcagcggggtgtcctggaccatgaaaatcgggatcggagtgctgttaacgtggctcggcctgaatagccgttccacgtctctgtccatgacctgcatagccgtcgggttggtgaccctgtacctgggggtgatggtgcaggcggactcagggtgtgtgatcaactggaagggccgggagttaaaatgcgggtcgggcatcttcgtgaccaacgaagtacacacgtggacggagcagtataagttccaggccgattccccgaagagactgagcgcagccatcggcaaggcttgggaggagggagtatgcggcatccggtccgccacccgcctggagaatatcatgtggcggcagatctccaacgagctcaaccacatcctgctggaaaacgacatgaagttcaccgttgtcgtaggggacgtggtgggtatcttggcccaggggaagaagatgatccgcccacagcccatggaacacaagtactcgtggaagtcctggggaaaagccaagatcatcggagccgatgtgcagaacaccacctttataatcgatgggcccaacacccccgagtgccccgacgaccaacgggcctggaacatctgggaggttgaggattacggtttcgggatcttcaccaccaacatctggctgaagctgcgcgactcctacacgcaagtctgcgaccaccgtttgatgtccgccgcgatcaaggattccaaggccgttcacgccgacatgggctactggatcgagagcgagaagaacgaaacctggaaactggcccgcgcgtccttcatcgaagtgaagacctgcatctggcccaagtcgcacacactttggtctaacggcgttctcgagagcgagatgatcatccccaagatctacggcgggcccatctcccaacacaattaccggcccgggtacttcacgcagaccgcgggtccgtggcacctgggcaagctggagctcgatttcgacctttgcgagggcaccaccgtggtcgtcgacgagcactgtggcaaccgcgggccgagcctgcggacgaccaccgtgaccggcaagatcatccacgagtggtgctgtagatcatgcaccctgcctcccctacgattcaagggggaagacggctgctggtacgggatggagatccgccccgtgaaggagaaagaggagaacctggtgaagtccatggtatctgctggctccggcgaagtcgactctttttcgctcggcctgctttgcatctccatcatgatcgaggaggtcatgcggtcccgctggtcacggaaaatgctcatgaccggcactctggccgttttctttctgttaatcatggggcagctgacctggaacgaccttatccgaagctgcatcatggtgggcgccaacgccagcgaccgcatggggatgggcacgacctacctcgcgctgatggccaccttcaagatgcggccgatgttcgcagtaggcctcctgttccgacggttaaccagtcgcgaggtgctcctcctgacgatcgggctgagcctcgttgccagcgtggagttgcccaacagcctggaggaactcggcgacgggctggctatgggcatcatgatacttaagttactgaccgacttccagtcctaccagttgtgggcgaccctcctgagcctgaccttcataaagacaaccttctccttacactacgcatggaagacaatggccatggtgctgagtatcgtctctctgctccccctgtgtctgagcaccacatcccagaaaaccacttggcttccagtgctgctgggctccttggggtgcaagccgctgacaatgttcttaatagccgagaacaaaatctggggtcgaaagtcgtggcccttgaacgaagggataatggcggttggcatagtctccatcctgctcagctccctcctgaagaacgatgtgcccctggctgggccgctcatcgcaggcggcatgctaatagcgtgctacgtgatcagcggatcttccgccgacctgtctctagagaaggcagccgtcgtaagctgggaggaggaagccgagcactccggcgccagccacaatatcctggtggaggtccaggacgacggtaccatgaagatcaaggacgaggagcgcgacgacaccctgaccatactcctgaaggccactctactcgccgtgtccggcgtttacccgttgtctatccccgccaccctgttcgtctggtatttctggcagaaaaagaaacagcggtccggggttctctgggacacgcccagcccgccggaggtggagcgcgcagtacttgacgacggcatctacaggatcatgcagcgcggcctactggggcgtagtcaagtgggcgtgggtgtcttccaggagaacgtgttccacacaatgtggcacgtgacccgcggcgccgtcctcatgtaccaggggaagcggctggagcctagctgggcttcagtgaagaaagaccttattagctacggcggcgggtggcgcctccagggttcctggaacacaggggaggaggtgcaagtgatcgcggttgagcctggtaagaacccaaagaatgtacagacggcccccgggactttcaagacccccgagggcgaggtaggtgccatcgccctggacttcaagcccgggaccagcggcagcccaatcgtgaaccgagaggggaagatcgtaggactgtatggcaatggggtcgtgaccacctccggcacctacgtcagcgccatcgcccaagccaaggcctcccaggaaggtccgctccccgagatagaggacgaggtcttccgtaagcggaacctgactatcatggacctgcaccccggctctggaaagacccgccggtatctcccggccatcgtgcgtgaggcgatcaagcggaagctgcgcaccctgatcctcgcccccacgagagtggtcgctagcgagatggctgaggccctcaagggaatgcccatacgctaccagacgacggcggtcaagagcgagcacaccggccgtgagatcgtggacttaatgtgccatgccacattcactatgcggctcctgagccccgtccgcgtcccgaactacaatatgattatcatggacgaggcccacttcacagaccccagcagtatcgcggcccgggggtacataagcactcgcgtgggcatgggggaggcggccgccatcttcatgaccgccacgccgcccggcagtgtagaggctttcccgcagagcaacgcggttatccaggacgaggagcgggacatccccgagcgctcgtggaacagcgggtacgagtggatcacggacttccccggaaagactgtgtggttcgttccctccatcaagtcaggcaacgacatcgccaactgcctgcgcaagaacggaaagcgtgtgatccagttaagtcggaaaaccttcgacactgagtaccaaaagacgaaaaacaatgactgggactacgtggtcaccaccgacatctctgaaatgggcgccaacttccgcgcggaccgggtgatcgacccgcggcggtgtctcaagcccgtcatcctaaaggacgggcccgagcgcgtgatcctcgcgggtcccatgccggtgaccgtcgcatctgcggcccagcggcgagggcggatcggccgcaaccacaataaagagggagaccagtacatttacatgggccaacccctgaacaatgatgaggaccacgcccactggacggaggcgaagatgctgctcgataacatcaacacccccgaggggatcatccccgccctgttcgagccggaacgagaaaagtccgcggctatcgacggggagtacaggctgagaggcgaagcgcggaaaacatttgtggaactcatgcgccggggcgatctgcccgtgtggctcagctacaaagtcgcgtccgaaggctttcagtacagtgacaggcggtggtgcttcgacggtgaacgcaacaaccaggtgctcgaggaaaacatggacgtggagatctggaccaaggagggagagcggaagaaactgcgcccacggtggctggacgcgcgtacgtattctgacccgctcgccctgcgggagtttaaggagttcgccgccggacgacggagtgtcagtggggacctgattctcgagatcggcaagctgccgcagcatctgacccagcgcgcgcagaacgctttagacaatctggtgatgctgcacaatagcgagcagggcggtcgggcctacagacatgccatggaggagctccccgacaccatcgagaccctgatgttgcttgctctgatcgccgtcctgacgggcggggtaactttattcttcctgtcgggccggggtctgggcaagaccagcataggcttgctatgcgtgatggcctccagtgcactgctctggatggcgtccgtcgaaccccactggatcgcggccagcatcatcctggagtttttcctgatggtcctcctgatccccgagccggacaggcagcggactccccaggataatcagctggcttacgtggtgatcgggctcctgttcatgatcctgaccgtagcagctaatgaaatgggcctactggaaactactaagaaggacctgggcatcggacatgtagcggtggagaaccaccatcacgcaacgatgctcgacgtcgacttacatcccgcctcagcctggactctgtacgccgtggcgacgacaatcatcactcctatgatgcgtcataccatcgagaacacgaccgccaacatctcactcaccgccattgcgaaccaggccgcgatcctgatggggctggacaaaggatggccaatctccaagatggacatcggcgtgcccctcctggccctggggtgctacagccaggtcaaccccctgaccctgaccgccgccgtgctgatgctcgtggcgcactacgccatcatcggcccggggctgcaggccaaggccacgagggaagcccagaagcggacggcggccggcatcatgaagaaccccaccgtcgacggtattgtggcaatagacctcgaccccgtggtctacgacgccaagtttgagaagcagttgggtcagatcatgctgctgatactctgtacttcccagatcttgctgatgcgcaccacctgggctctgtgcgagtcaatcaccctggcaaccggccccctgaccacactctgggaggggtcgccgggcaagttctggaacaccacgatcgctgtttcgatggccaacatctttcgggggagctacttagccggggccggactagcgttctccctaatgaaatccttgggcggagggcgccgggggactggggcccagggcgagaccctgggcgagaagtggaaacgccaactcaaccagctgtccaagagcgagttcaatacctataagcggtccggaattatggaggtggaccgcagcgaggccaaggagggtttgcggcgcggggagacgacaaagcacgccgtctcccgcggcacagcgaaactcagatggttcgttgagcggaacctggtgaagcccgagggcaaggtcatagacttgggatgcgggcgtggaggctggagctactactgcgccggactaaagaaggtgaccgaagtgaagggctacaccaagggcggccccggccatgaggaaccgattccaatggccacctacggatggaacctcgtcaaattacactctgggaaggacgtgttcttcatcccacccgaaaaatgcgatactcttctctgcgacataggagagagcagccccaacccgaccattgaggaaggtcggacgctgcgcgtgctgaagatggtcgaaccctggctccgtgggaatcagttctgcataaaaatccttaacccctacatgcccagcgtggtggagaccttggagcagatgcagcgcaagcacggcggcatgctcgtccggaatccgctgtcccgcaactctacacacgagatgtactgggtgtcctgcgggaccggcaacatcgtgagtgcagttaacatgaccagtagaatgctactgaaccggtttacgatggcgcatcgcaagcccacatacgagcgggatgtggacctaggggcgggcacccgccacgtggccgtagagcccgaggtggccaatctggacatcatcggccagcgtatcgaaaacatcaagcatgagcacaaatccacatggcattacgatgaggacaacccctacaagacgtgggcctaccacgggtcttacgaagtcaagccgagcggcagcgcctccagcatggtcaacggggtggtcaagctcctgaccaagccctgggacgttatccccatggtaacccagattgcgatgaccgacacgacccccttcggccagcagcgcgtatttaaggaaaaggtggacacgaggacgccgaaggccaagcgaggtacggcccagatcatggaggtgaccgctcggtggctgtgggggttcttgtctcgcaacaagaagccgcgtatatgcacccgcgaggagttcacccgaaaggtccgcagcaacgcggcgattggcgcagtatttgtggacgagaaccagtggaactccgccaaggaggccgtcgaggacgagcggttctgggacctggtgcatcgcgagcgggaactgcacaagcaggggaaatgtgcgacgtgcgtgtacaacatgatgggaaagcgcgagaagaaactcggggagtttggcaaggccaaggggagccgagctatctggtacatgtggttgggcgccaggttcctcgagttcgaggccctcggcttcatgaatgaggaccattggttctcccgcgagaacagcctgtcaggggtagagggtgaaggactgcacaagctcggatacatcttgcgcgacatctctaaaatccccgggggcaacatgtacgctgacgacaccgccggttgggacacccggatcaccgaggacgaccttcagaacgaagccaaaatcacagacatcatggagccggagcacgctctcctagccacctcaatcttcaagctcacctatcaaaacaaggtagtgcgagtgcagcggcccgcgaagaacgggaccgtaatggacgtgatttctcgcagagaccaacgggggtccggacaagtcggcacgtatggcctcaacaccttcacaaacatggaggcgcagctgatccgccagatggagtctgaggggatattttcccccagcgagctggagactcccaacctcgctgaacgggtgctagactggctggagaagtacggcgtggagagacttaagcggatggctatctcgggggacgattgcgtcgtcaaaccgatcgacgaccgcttcgccacggcgctgacagctctgaacgacatgggcaaagtgcggaaggacatcccacagtgggagcccagcaaggggtggaacgattggcagcaagtccccttttgtagccatcacttccaccagctaatcatgaaggatggccgcgagatcgtggtgccctgccggaaccaggacgagctggtcggccgcgcgcgggtgtcccagggtgcaggatggtcactgcgcgagactgcctgcctcgggaagtcctacgcgcagatgtggcagctgatgtacttccaccggcgggacttacggctcgccgccaacgccatttgctcagcggtccctgtagactgggttccgacatctcgcacgacctggagcatccatgcccaccaccagtggatgacgaccgaggacatgctgtccgtttggaaccgcgtatggatcgaggaaaacccgtggatggaggacaagactcacatatccagctggggagacgtgccgtacctggggaagcgggaggaccaatggtgcggcagcctcatcggcctgacagcgcgcgccacctgggccactaacatccaggtggcgatcaaccaggtgcgtcgcctgatcgggaacgagaactatctcgactacatgacctccatgaaacggtttaaaaacgagagcgaccctgagggcgccctgtggtaa

SEQ ID NO: 23817 - RNA, 9879 nt, synthetic construct
  misc_feature 1..9879: note = derived and/or modified CDS sequence (opt11) from DENV-1__FJ639674__SS-prME
  source 1..9879: mol_type = other RNA
agcgtgaccatgctgttgatgctgatgcccacggctctggcattccacctcacaacccggggcggggagccccacatgatcgtgagtaaacaggaaagggggaaaagcctgctgtttaagaccagcgccggggtgaatatgtgcaccctaatcgccatggacttgggggagttctgcgaggatacaatgacatacaaatgcccacgcatcaccgaagccgagccggacgacgtggactgctggtgcaacgccaccgacacctgggtgacctacgggacctgcagccagaccggcgagcacaggcgcgacaagagatccgtggccctggcgccgcatgtgggcctcgggctggaaacgcggaccgaaacctggatgagttccgagggggcctggaagcagatccaacgcgtggagacctgggctctgcgccaccctggcttcacggtgatagccctttttctggctcacgccatcggcaccagcatcacccagaaggggatcattttcatcctgctcatgctggtgaccccctccatggccatgcgatgcgtaggcatcgggagccgtgattttgtggaggggttgagcggcgccacttgggtggacgtcgtgctcgaacacgggtcgtgcgtgacaaccatggccaaggacaagcccaccctagatatcgagctgctcaagacggaggtcaccaaccccgcggtgctgcggaaactttgcatcgaggcgaagatttccaataccaccacggacagccgctgcccgacccaaggcgaggcgaccctcgtggaggagcaggacgccaacttcgtctgccggcgtaccttcgtggaccgaggctgggggaatgggtgcggactatttgggaaggggtccctgatcacgtgcgccaaatttaagtgcgtgaccaagctcgaaggtaagatcgtccagtatgagaacttgaagtactcagtgatcgtgactgttcacacaggcgaccagcaccaggtgggtaacgagtcaacggagcacggcaccaccgccaccattacgccccaggcccccagcacggagatacagctcacggactacggggccctcacgttggactgctcaccccggacgggactggacttcaatgagatggtccttcttacgatgaaggaaaagtcctggttggtgcacaagcagtggttcctcgacctaccgcttccctggacaagcggggcctccaccagccaggagacctggaaccggcaggacttgctagtgacctttaagacggcacacgcgaagaagcaggaggtcgtagtgctgggctcccaggagggcgctatgcacaccgccctcaccggggcgacagagatccagaccagcggcaccaccacgatcttcgccgggcaccttaagtgcagactgaaaatggacaagttaacgctgaaggggatgtcctacgtcatgtgcacggggagcttcaagctggaaaaagaggtggccgaaacccagcatggcacggtgctcgtacagatcaagtacgaaggcactgacgcaccttgcaagatccccttctccacccaggacgagaagggagtgacacagaatggcagactgataacggccaatccgatagtgaccgataaagagaagccggtgaacatcgaagccgagccgccgttcggtgaaagctacatcgtgatcggcgcaggagagaaggccttgaagctgtcctggtttaagaagggcagctccatcggcaagatgtttgaagccacggcgcgcggggcccggcgcatggcgatcttaggagacaccgcatgggattttggaagcatcggcggtgttttcacctccgtcgggaagttagttcaccagatcttcggcaccgcttacggggtactgttcagcggcgtaagctggaccatgaagatcgggatcggcgtgctcctgacctggctcggcctcaactctcgctccatgagcttatccatgacgtgtattgcggtgggactggtcaccctatacctgggcgtcatggtacaggccgacagcgggtgcgtgatcaactggaagggtcgggagctaaaatgcgggagcggtatcttcgttaccaacgaggtgcacacctggacggagcagtacaaatttcaggcggattccccgaagcgcttgagcgccgcaatcggcaaggcgtgggaagagggggtctgtggcatccggtccgccacccgcctggagaacataatgtggaagcagataagcaacgaattgaaccacatcctcctggaaaacgacatgaagtttaccgttgtggtcggggacgttgcaggcattctggcccagggcaagaagatgatccgacctcaacccatggagtataagtactcctggaaatcctggggcaaggccaaaatcataggcgccgacgtgcaaaacaccaccttcatcatcgacgggcccaacaccccggagtgtcccgacgaccagcgtgcttggaatatctgggaggtcgaagactacggcttcggcatcttcaccactaatatctggctcaaactccgtgactcatatacccaggtttgcgaccacaggctcatgagcgctgccatcaaggactccaaggccgtgcacgctgacatgggctactggatcgagagcgagaaaaacgagacgtggaagctcgcgagagcctccttcatagaggtcaagacctgcatttggcccaagagccacactctgtggtccaacggcgtgctcgagtccgagatgatcatcccgaagatctacggagggccgatctcacaacacaactaccgccccggatatttcacccagacggccggcccatggcacctcgggaagctggagctggatttcgatttgtgcgagggcaccactgtggtagtggacgagcactgcggcaatagagggccgagcctgcgcaccacgaccgttaccggcaagatcatacacgaatggtgctgccgctcctgcaccctgccgcccctgcgctttaagggggaggacggctgctggtacgggatggagatacggcccgtaaaggaaaaggaggagaacttggtcaagagcatggtgagcgccggctccggcgaggtcgacagcttttccctcggcctgctgtgcatcagcataatgattgaggaggtgatgcgcagccggtggtcgcgtaaaatgctgatgacaggcaccttagcggtattcttcctgctgattatggggcagctaacctggaacgatttgatccggttatgcataatggtcggcgcaaacgcctctgaccggatggggatgggcaccacctacctagccctgatggccacgttcaagatgcgcccaatgttcgccgtgggactcttattccgccgcctgaccagccgggaggtgctgctactgaccatcgggctatcgctcgtcgcgagcgtggagttgcccaacagtctggaggagctaggcgacgggctggccatgggcatcatgatcctaaagctcctgacggacttccagagccaccagctatgggccacgctcctgtcccttacgttcatcaagaccacgttcagcctccactacgcctggaagaccatggcgatggtgctgagtatcgtgagcctttttccgctctgcctgtccacaaccagccagaagacgacatggctgcccgtgctcctcggttccctggggtgcaagccgctcaccatgttcctgatcgccgagaacaagatctggggtcgcaagagctggccactgaacgaagggataatggccgtggggatcgtgagcatactcctgtccagcctgctcaagaatgacgttccgctggccgggcccctgattgccggcggaatgctcatcgcgtgctacgtcatctccggcagtagtgcagacctgagcctggaaaaagccgcagaggtatcctgggaggaggaggccgagcacagcggtgcgtcccacaatatcttagtggaggtccaggacgacggtactatgaagatcaaggacgaagaacgggatgatacgcttaccatcctgctcaaggctaccctgctggccgtgagcggcgtgtacccgctcagcatcccggccactctattcgtgtggtacttttggcagaagaaaaagcaacgctcaggtgttctgtgggacacaccctcaccacccgaagtggaacgggcggtcctcgacgacgggatctaccggatcatgcagcgaggcctgctggggcgcagccaagtgggcgtgggtgtattccaggagaacgttttccacacgatgtggcacgtgacccggggcgcggtcctgatgtatcaggggaagaggctcgagcctagctgggccagcgtgaagaaggacctgatttcctacggcggcggttggcggcttcagggcagctggaacaccggggaggaggtgcaggtcatagccgtggagcctggcaagaaccccaagaatgtacagaccgcgccggggacgttcaagacctccgagggcgaggtcggcgcgatcgcgctcgacttcaagccgggaaccagcggcagcccgatcgttaatcgcgagggaaagatagtcggcctgtacggaaacggagtcgtgaccacgtctggtacctatgtgagcgccatcgcccaggccaaagcgtcacaggaggggcccctccctgagatcgaggacgaggtcttccggaagaggaacctgacaataatggacctgcacccgggcagcgggaagacgcggcgctatctgcccgcaatcgtccgggaggctatcaaacgcaagttgcggacgctgatccttgccccgacacgcgtggtcgcctccgaaatggcagaggccctcaagggcatgcccatccgataccagacaacagctgtcaagagcgagcatacgggcaaggagatcgtggacctgatgtgccacgcgaccttcacgatgcggttactctcacccgtccgtgtgcccaactacaacatgatcatcatggacgaggcccacttcacagatccgagctccatcgcggctcgggggtacatctcaaccagagttggtatgggggaggccgccgccatcttcatgacagcgacgcctcccggctccgtcgaggccttcccccagtcaaatgcggtgatacaggacgaggagcgggatatccctgagagaagttggaacagcggatacgagtggattaccgacttccccggcaagacggtgtggtttgtcccgtcgattaagagcggcaacgacatcgccaactgcctgcggaaaaacggaaagcgcgtgatacagctgtccagaaagacctttgataccgaataccagaagaccaagaataatgactgggactacgtggtcacgaccgacataagcgagatgggcgcgaacttcagggccgatcgggtgatcgacccccgccggtgcctcaagccggtgatcctgaaggatgggcccgagcgcgtcatcctggcaggccccatgcctgtgaccgtcgccagcgccgcgcaacggcgggggaggattggccgcaaccataataaggagggcgaccaatacatctacatgggacagccgctcaacaacgacgaggaccatgcacactggaccgaagcaaagatgctgctggataacatcaacacgcccgagggcataataccagccctattcgagccggagcgcgagaagtccgcagcgatcgacggtgagtacagactgaggggcgaggcccggaagaccttcgtggaactgatgagacgaggggaccttccggtgtggttaagctacaaagtcgcatccgagggcttccagtatagcgatcgacgctggtgcttcgacggcgagcgcaataaccaggtgctggaggagaacatggacgtggagatttggacgaaggagggagaaagaaagaagctccggccccggtggcttgacgcccgtacctacagtgaccccctggccctccgggagtttaaggagttcgcggcgggccgccggtccgtttcaggggaccttatactggagatcggcaagttgccccagcacctgacgcaaagagctcagaacgcactggacaaccttgtgatgcttcacaattcggagcagggcgggcgggcgtaccgccatgctatggaggaactgccggataccatcgagaccttgatgctgttagccctcatcgccgtgctgaccggtggtgtcaccctattcttcctctccgggcgcgggctgggcaaaacatccatcggacttctctgcgtgatggcctcctcggtgctactatggatggcatctgtggagccccactggattgccgccagcatcatccttgagttcttcctgatggtgctgctcatccccgagccagaccgccagcggaccccgcaggataatcagctggcctatgtggttatcggcctcctcttcatgattctgaccgtggctgctaacgagatgggcctgcttgagaccacgaagaaggacctagggatcggccacgtggcggtcgagaaccaccaccacgccgccatgctggatgtagatctccaccccgcctctgcgtggaccttatacgccgtggccaccaccatcatcacgcccatgatgcgccacaccatcgagaataccaccgccaacatcagcctgacggcaatcgcgaaccaagccgccatcctgatgggactggacaagggttggccgatttccaaaatggacatcggcgtcccactgctcgccctgggatgctacagccaggtgaaccccctgacccttaccgcggcagtgctgatgcttgtggcccactacgccatcataggacccggtctccaggccaaggcaacccgggaggcccagaagcgcacggccgccggcatcatgaagaacccgactgtggatgggatcgtggcaatagacctggaccccgtcgtttacgacgcgaagttcgagaaacagctgggtcagatcatgttgctgatactgtgcacctcgcagatcctcctaatgcgcactacgtgggccctgtgcgagagcatcaccctcgccaccggcccgctaactacactgtgggaaggctcccccggcaagttttggaacacgaccatcgccgtcagcatggccaacatcttccgggggagctacctagcgggcgctgggctggccttttccctgatgaaatccctagggggtgggaggcggggcaccggggcacagggcgagacgctgggcgagaagtggaagcgccagttgaaccagctctccaaaagcgagttcaacacctataagcggtcaggtatcatggaggtcgaccgcagtgaggcgaaagagggcctgaagcgcggggagactactaagcacgccgtgtcgcgcgggacggccaagctgcggtggttcgtggagcgcaacctcgtcaagccagaggggaaggtgatcgacctgggttgcggacgcggagggtggtcctactactgtgcagggctcaagaaggtcaccgaggtcaaggggtataccaagggcgggcccggacacgaagaacccatcccgatggccacgtacgggtggaacttggtaaagctccactccgggaaggacgtgttcttcatcccgcctgagaagtgcgacacgctgctgtgtgacattggtgagagctccccaaaccccaccatcgaggagggccgcaccctccgggtcctgaagatggtggagccgtggctacgcgggaatcagttctgcatcaagatactaaacccctacatgccaagcgtggtagagacgctggaacaaatgcagcggaagcatggcggtatgctcgttcgcaatccgctctccaggaacagtacccacgaaatgtactgggtgtcctgcgggacgggaaacatagtctccgcggtgaacatgacgtcgcgtatgctgctgaatcgctttaccatggcacatcgcaagccgacatacgagcgcgacgtcgacctcggggccggcacgcgccacgttgccgtggaacccgaagtggccaacctggacatcatcggacagcgcatagagaacatcaagcacgagcacaagagcacctggcattacgacgaagacaacccctacaaaacctgggcgtatcacgggtcctacgaggtcaagcccagcggatcagcctcaagcatggtgaacggggtggtgaagttactcaccaaaccgtgggacgtgatacccatggtcacgcagattgccatgacagacactacgcccttcggccagcagagagttttcaaggagaaagtggacacgcgtacccctaaggcaaagcgggggaccgcgcaaattatggaagtcaccgctaagtggctgtggggcttcctatcccgaaacaagaagccgcggatctgcacgcgcgaggagttcactcgcaaggtgcgcagcaacgccgccatcggcgccgtgttcgtagacgagaatcaatggaactccgctaaagaggccgtggaggacgagcggttctgggacttagttcaccgcgagcgcgaactgcataaacaggggaagtgtgcaacttgcgtctacaacatgatgggcaaacgcgaaaagaagctgggggagttcggtaaggccaaggggagccgggccatttggtacatgtggcttggtgcgaggttcctggagttcgaggccctgggttttatgaatgaagaccactggttcagccgggagaacagtctctccggggtggaaggggagggcctgcacaagctgggctatatcctccgcgacatcagcaagatccccgggggaaatatgtatgccgacgacaccgcaggttgggacacgcggatcacagaggacgatctccaaaacgaggccaagattaccgacataatggaacccgagcatgccctgctcgccaaatccatcttcaaactgacctaccagaacaaagtagtccgcgtgcagcggccggtcaagaacgggacggtcatggatgtcatcagcagacgcgaccagagaggcagtggacaggtgggcacctacggcctgaacaccttcaccaacatggaggcccaactcatccgccaaatggagagtgaggggatctttagtcccagcgagctggaaaccccgaacctggccggccgagttttagactggctggagaagcatggcgtggagcgccttaagcgtatggccatctccggtgacgactgcgtggtcaagcccatcgatgaccggttcgcgaccgccctcaccgccctgaacgacatggggaaggtacgcaaggacataccgcagtgggagccgagcaaaggatggaacgattggcagcaggtcccgttctgtagccaccacttccaccaactgataatgaaggacggccgcgagatagtagtaccctgccgcaaccaggatgaactcgtggggcgcgctagagtctcccagggcgccgggtggagccttcgcgaaaccgcgtgcctgggcaaatcctacgcccagatgtggcagctaatgtactttcaccggcgtgacctgcggctggccgccaacgctatctgcagcgccgtgccggtggactgggtccccacgagcagaaccacgtggagcatccacgcccaccatcagtggatgaccacggaagacatgctctccgtgtggaatagggtgtggatcgaggagaacccctggatggaggacaagacccacatatcgtcctggggcgacgttccctatctgggcaagcgcgaggatcagtggtgcggcagcctcatcgggttaaccgcccgggccacctgggcgacgaacattcaggtggccatcaatcaggtgcgccgccttatcggcaacgagaactacctggactacatgacctccatgaagcggttcaagaatgaaagcgatccagaaggcgcactctggtga

SEQ ID NO: 23818 - RNA, 9879 nt, synthetic construct
  misc_feature 1..9879: note = derived and/or modified CDS sequence (opt11) from DENV-1__FJ639675__SS-prME
  source 1..9879: mol_type = other RNA
agcgtgaccatgctactcatgctgatgcccaccgccctggccttccacctcactacccgtggcggggagcctcacatgatagtgagtaagcaggagcgcggcaagagcttactgttcaagaccagcgccggggtgaacatgtgtactctgatcgccatggacctaggcgagttctgcgaggacacgatgacttacaagtgcccccgcatcaccgaggcagagccagacgacgtggactgttggtgcaacgccacagacacttgggtgacttatgggacctgcagccagacaggggaacacaggcgggacaaacggagtgtcgccttagccccgcatgttggcctggggctggagacaaggaccgaaacctggatgagctccgagggcgcctggaagcagatacagcgggtagagacctgggccctgcgccaccccggtttcacggtgatcgccctctttctggcacacgcaataggcacctcaatcacacagaaggggatcatcttcatcctgctcatgctggtcaccccctccatggccatgcggtgcgtcggaataggcagccgcgattttgtggaggggttatccggcgccacatgggtggacgtcgtcctagagcacggtagctgcgtaaccacaatggccaaggacaagcccaccctggacatcgaactgctcaaaacggaggtcaccaaccccgcagttctgcggaagctgtgtatcgaggcaaagatctccaacacaaccacggacagccgctgcccgacccagggcgaggccaccctcgtagaggagcaggacgccaatttcgtctgccggcgcaccttcgtagaccggggttggggaaacggctgcgggttattcggcaaggggtccctgattacgtgcgcgaagttcaagtgcgtgaccaagctcgaggggaagatcgtccagtacgagaacctgaagtattccgttatcgtgaccgtacacaccggcgaccagcaccaggtgggaaatgagtcaacggagcacggcaccacagcgaccatcacgccccaagctccaagcacggaaatccagctgaccgactacggggctttaacactggactgctcgccccggaccgggctggatttcaatgagatggtactcctgacgatgaaggagaaatcctggctcgtccataagcagtggttcctcgacctgccgctgccctggacctccggggcctccaccagccaggagacctggaaccggcaggacctcctggtgacgttcaagaccgcgcatgcgaagaagcaagaggtcgtggtgttgggttcccaagagggcgccatgcacaccgcactaaccggggcaacagagatacagaccagcggcaccacaacgattttcgccgggcaccttaagtgccgcctgaagatggataaactcaccctcaaggggatgtcctacgtcatgtgcaccggactgttcaagctcgagaaggaggtggcggagacccagcacggcacggtactggtccagatcaagtatgagggcaccgacgcaccttgcaagatcccattcagcacccaggacgagaagggtgtaacccagaacggccggctgatcacggccaatccgatagtgacggataaggagaagcctgtcaacatcgaggccgagccgcctttcggggagtcctacatcgttataggtgccggtgagaaggcgctgaagttaagctggttcaagaaggggtccagcatcggcaaaatgttcgaggctacagcccgcggtgccagacgcatggcaatcctgggcgacaccgcctgggacttcgggtccatcggtggcgtgttcacgagcgtcggcaagttggtgcatcagatcttcggcaccgcctatggggtgctgttctcgggcgtgagctggaccatgaaaatcgggattggcgtgctgctgacatggctcggcctgaactcaagatccacgtccctgagtatgacctgcatcgcagtggggctagtcaccctgtacctcggcgtgatggtgcaggctgacagtgggtgcgtcatcaactggaagggccgggagcttaaatgcgggagcggcatcttcgtgactaacgaggtacacacgtggaccgagcaatacaagttccaagcggacagcccgaagcgcctatcaagcgcaatagggaaggcttgggaagagggtgtctgcggcatccggtccgccacccgcctggagaacatcatgtggaagcagatcagcaacgagttgaaccacatcctgctggagaacgatatgaagttcaccgtggtcgtcggggacgtggccggcatcctcgcgcagggaaaaaagatgatccggcctcaacccatggaatacaagtattcctggaagtcatggggcaaggccaagatcatcggcgccgacgtgcagaatacaactttcatcatcgacggccccaacaccccggagtgcccagacgatcagcgcgcctggaacatctgggaggtcgaggactacggcttcggaatcttcaccaccaacatttggctgaagctccgggactcctacacccaggtgtgcgaccacaggctcatgagtgcggccatcaaggattccaaggctgtgcacgccgacatgggatattggatcgaatccgagaagaacgagacctggaagctggcccgggcgagcttcatcgaggtcaagacctgcatctggcccaagagccataccctgtggtccaacggcgttctcgagagcgagatgatcatccctaagatatatgggggcccgatcagccagcacaactaccgccccgggtacttcacgcagaccgcaggcccttggcatctcgggaagctggagctcgacttcgacctgtgcgaggggaccaccgtggtcgtggacgaacactgcgggaaccggggtccgagcttgcgaactaccaccgtgaccggcaagatcattcacgagtggtgctgtcggtcctgcacgctgccacccctccgctttaagggagaggacggttgctggtacggtatggagatccggcccgtcaaagagaaggaggagaaccttgtaaagagcatggttagtgctggctccggggaagtcgacagcttctccctcgggctgctgtgtatcagcataatgatcgaggaggttatgcggtcccggtggtctcgtaaaatgctcatgactggcacacttgccgtgttcttcctgctcatcatggggcaactgacgtggaatgacctaatccggctctgtatcatggtcggcgccaatgcgtccgacagaatgggcatgggcatgacgtacttagccctgatggccaccttcaaaatgcgaccgatgttcgctgtgggcctactgttccgacgcctgacctcgcgggaggtgcttctgctgaccatcgggctcagtctggtagccagcgtggagttgcccaactccctcgaagagctgggcgacgggctcgctatgggtatcatgatattaaagctgctgacggacttccagagtcaccagctctgggccaccctcctgagccttacctttatcaaaaccacgttcagcctgcactacgcctggaagacgatggctatggtgttgtccatcgtgagccttttccctctgtgcctgtccactaccagccagaagactacctggcttcccgtactgttgggcagcctcgggtgcaagccactgaccatgttcctgatcgccgaaaataagatctgggggcgcaaaagctggccgctcaacgagggtatcatggccgtcggcatcgtctcaatcctcctgtcgtctctcctgaagaacgacgtgcccctggccgggcccctgattgcgggcggcatgttgatcgcctgctacgtgatttccgggagctcagcggatctgagcctagagaaggccgccgaagtgtcctgggaggaggaagcggagcacagcggggcgtcccataatatcttggtagaggtccaggacgacgggaccatgaagatcaaggacgaagagcgggacgatacgctgaccatcctcctgaaggcaaccctgctcgccgtaagcggtgtgtacccgctgtccatccctgccaccttgttcgtctggtacttctggcagaaaaagaagcagaggagcggagtgctatgggacacgccctcaccgccggaggtcgagcgggcggtcctcgacgatggcatctacagaatcatgcagagagggctactagggcgcagccaggtgggcgtgggggttttccaggagaacgtgtttcacacgatgtggcacgttacccggggcgctgtcttaatgtaccaagggaagcgactggagccctcctgggcgtcggtgaagaaggacctgatctcctacggaggcgggtggcgtctccagggttcatggaataccggagaggaagtgcaagtcatcgccgtcgagcccgggaagaaccccaagaatgtgcagaccgcgccaggaacgttcaagacctccgagggcgaggtcggcgcaattgccctggacttcaagcccgggaccagcggctccccgatcgtgaaccgcgaggggaaaatcgtgggattatatggcaacggggtcgtaaccacgtccggcacttacgtaagcgcgatcgcccaggccaaggcctcccaggaggggcccctcccggaaatcgaggacgaggtcttccgcaagcgcaacctgaccattatggacctacatcccggctccgggaagacccgacgatacctacccgctatcgtgcgggaagctatcaagagaaagctacggacgctgatattggccccgacccgcgtggtcgcctcggagatggcggaggcgctgaagggcatgcccatccgctatcagacaaccgcagtcaagagcgagcacacgggcaaggagatcgtggacctgatgtgccacgctaccttcaccatgcgcctcctgtccccggtgcgcgtgcccaactataatatgatcatcatggacgaggcccacttcaccgacccgtcctccatcgccgcgcgtggctacatcagcacgcgtgtcggcatgggggaggccgccgccatcttcatgactgccacaccgcccggctccgtcgaagcgttcccccagagcaacgccgtgatccaggacgaagagcgagacatcccggagaggagctggaacagcggctacgagtggatcactgatttccccggcaaaacggtgtggttcgtcccctccatcaaaagcggaaacgacatcgccaattgccttaggaagaacgggaagcgggtgatccagctctcccggaagacctttgacaccgagtaccagaaaacgaagaacaacgactgggactacgtagtcacgaccgacatcagcgagatgggcgcgaattttcgcgccgaccgtgtaatcgacccccgccggtgcctgaagccggtcatcttgaaggacgggcccgaacgcgtcatactagctggcccgatgccggtcaccgtggcctcagccgcgcagcggcgcggccggatcggccgcaaccacaacaaggagggggaccagtatatatacatgggccagccgctgaacaacgatgaggaccacgcgcactggaccgaggcgaagatgctgctagacaacattaacacgccggagggcattatccccgccctgttcgagcccgagcgcgagaagtccgccgccatcgacggggagtaccgcctgcgcggcgaggcgcgcaagacctttgtggagctcatgcgccgcggcgacctcccggtgtggctgagctataaggtcgcctctgagggctttcagtacagcgatcgccggtggtgcttcgacggcgagcgaaacaaccaagtactggaggagaatatggacgtggagatctggaccaaggagggggagcggaagaaactgcgtcccagatggctcgacgcccgtacgtattccgacccactcgctctgcgggagttcaaggagtttgctgcgggccgcaggagcgtctccggggacctgatactagaaatcggcaagctgccccaacacctgacgcagcgcgctcagaacgctctcgacaacctggtgatgctgcacaacagcgagcaaggcgggcgcgcataccgccacgcgatggaggagctaccggacaccatagagactctgatgctccttgcgctgatcgccgtgctgaccggcggggtgaccttgttcttcttgtccgggcggggcctgggcaagacgagcatcggcctcctgtgcgtgatggccagcagcgtgctgctctggatggcgagtgtcgagccccactggatcgcggccagcatcattctggagttcttcctgatggtgctcctgatccccgagcccgaccgccagcggacaccgcaggacaaccagctggcctatgtggtcatcgggctcctgttcatgattttgactgtagcagccaacgagatgggcctcctggagaccacgaaaaaggacctggggatcggccacgtcgcggtcgagaaccaccaccacgctgccatgcttgatgtcgatctgcaccccgcctcggcctggaccctgtacgctgtggccaccaccatcataacgcccatgatgcgccatacgatcgagaacacaaccgccaacatctcactcaccgcaatagctaaccaggcggccatcctaatggggctggataaagggtggcctatcagtaagatggacatcggcgtccccttactggccctggggtgctactcgcaggtgaaccccctcaccctgaccgccgcggtgctgatgctcgtcgcccattacgccatcattggccccgggctgcaggcaaaggccacccgggaggcgcagaagcgcacggccgcaggcatcatgaagaacccgaccgtggacgggatcgtggccatagacctcgaccccgtcgtgtacgacgccaaattcgagaagcaactcggccagatcatgttgctgatcctctgcacgtcccagatcttgctgatgcgcactacgtgggccctctgtgagtcaatcacactggccaccggccccctaaccacgctctgggaggggtcccccggcaagttctggaacaccaccattgctgtgagcatggccaacatcttcagggggagttacctcgccggagcgggcctggccttcagtctgatgaagtcgctcgggggcggacgcagaggcacaggggcgcagggcgagactctgggcgaaaagtggaagcgccagctaaatcagctctccaaaagcgagttcaacacctacaagcggagtgggatcatggaggtcgaccgcagcgaggccaaggaaggtttaaagcgaggggagaccaccaagcacgcggtatcccgcggtactgcgaagctccggtggttcgtagagcgcaatctggtcaaaccggagggcaaggtgatcgacctgggctgcggccgcggcgggtggagctactactgcgcgggtctgaaaaaggtgacagaggtcaaggggtacaccaagggcggccccggccacgaagaacccatccccatggccacttacgggtggaacctcgtgaagctgcactccggcaaggacgtcttcttcatcccgcccgagaagtgcgacaccctgctctgcgacatcggtgaatcatccccaaatcccaccatcgaggaggggcggacgcttcgggtcttaaaaatggtggagccgtggctgcgcggaaaccagttctgcattaagattctgaacccctacatgccctccgtggtcgagacgctggagcagatgcagcggaagcacggcggcatgttggtgaggaacccactgagcaggaattccacccatgagatgtactgggtgtcctgcgggacgggcaacatagtctcggccgtgaatatgacctcgagaatgctgctgaaccggtttaccatggcccaccgcaaaccgacttacgagagagacgtggaccttggtgctggcacgcggcacgtcgcagtggagccagaagtggccaacctggacatcatagggcagcgtatcgagaacatcaagcacgagcacaagagcacttggcactacgacgaggacaacccttacaagacctgggcctaccacggatcctacgaggtcaagccatcaggctcggcgtccagcatggtgaacggcgtcgtgaagcttctgaccaagccgtgggacgtcatccccatggtcacacagattgccatgaccgacactacccccttcggccagcagcgggtgtttaaggagaaggtggacacgcggacccccaaggccaagcgagggaccgcccagatcatggaggtcacagctaagtggctatggggcttcctctcccgaaacaagaagccgcggatctgcacgagagaggagttcactcggaaagtgcgttcaaatgcagctatcggcgcggtcttcgttgacgaaaaccagtggaactccgccaaggaggcggtggaggacgagaggttctgggacctggtgcaccgcgagcgagagctgcacaagcaagggaaatgcgccacctgcgtctacaacatgatgggtaagagagagaagaagcttggagagttcggcaaagccaaaggtagccgggccatctggtacatgtggctgggcgcacgcttcctggagttcgaggcgctaggattcatgaacgaggaccactggttctcccgggagaatagcctgtccggggtagagggagagggtttacacaagctcggctacatcctgcgcgatatcagcaagatacccgggggcaacatgtatgccgatgacactgcgggctgggacacaagaatcaccgaggacgacctgcagaacgaggccaagatcaccgacatcatggagcccgagcacgctttactcgcgaagtccatattcaagctgacctaccaaaataaggtggtccgtgtgcagcggccggccaagaacggtacggtaatggacgtaatcagccgccgcgaccagcgtggcagcggccaggtgggcacctatggcttaaacaccttcaccaacatggaggcccagctgatccgccaaatggagagcgaggggatattttctccatcggagctggagacaccgaacttagccgaacgggtgttagactggttagaaaagcacggggtcgaacgcctcaagcggatggccatctccggggacgactgcgtggtgaaacccatcgatgaccgcttcgccaccgccctgacggccctgaacgatatgggtaaggtcagaaaagacattccgcaatgggagcccagcaaggggtggaacgactggcagcaggtccccttctgctctcaccacttccaccagctcatcatgaaggacggccgcgagatagtggtgccctgccggaaccaagacgagctggttggcagagccagagtgagccagggggccggctggagcctgcgcgaaacggcgtgcctggggaaaagttacgctcaaatgtggcagctgatgtacttccaccggcgggatctgaggctcgcagccaacgcgatctgctctgccgtcccggtggactgggtgcccacttcgcgcaccacctggagcattcacgcccaccaccagtggatgaccacggaggacatgctgtccgtatggaatcgggtgtggatcgaggagaacccctggatggaggacaagacccacatctcttcctggggcgatgtgccctacctgggaaagagagaggaccagtggtgcgggagtctgataggcctgaccgcccgcgccacctgggcgacgaacatccaggtcgccatcaaccaagttagacgcctgatcggaaacgagaactacctcgactacatgaccagtatgaaacggtttaagaacgagtcagacccggagggcgccctgtggtga

SEQ ID NO: 23819 - RNA, 9879 nt, synthetic construct
  misc_feature 1..9879: note = derived and/or modified CDS sequence (opt11) from DENV-1__FJ639676__SS-prME
  source 1..9879: mol_type = other RNA
tcagttactatgctcctgatgctaatgcccactgcccttgcttttcacctcaccaccaggggcggggagccccacatgatcgtgtccaaacaggaacgtggcaagagcttgctattcaagacaagtgctggggtgaacatgtgcaccctgatcgccatggacctgggcgagctgtgtgaggataccatgacgtacaagtgcccgaggataaccgaggtagagcctgatgacgtcgattgctggtgtaacactaccgacacatgggtaacctacgggacctgctcgcagacgggagagcacaggcgagacaagagatccgtggccctcgcgccccacgccggcctggggctggaaacgagggcggagacttggatgtcgtccgagggcgcctggaagcagatccagcgggtcgaaacctgggccttgcgccaccccgggttcacggttatcgccctgttcctagcgcacgtgatcgggacctctatcacccagaagggaatcattttcattctactgatgcttgttacgccttccatggccatgcgatgcgtaggaatcggcagccgcgatttcgtggagggactatccggtgccacgtgggtcgatgtggtgctggaacatggttcgtgcgtaaccaccatggccaaggacaagcccacgctcgacatcgaactactgaagactgaggtgaccaaccccgccgtgctgcggaagttatgcatcgaggcgaagatttccaacaccaccaccgactctcgctgtccgacccaaggcgaagcaacactggtcgaggagcaggatgccaacttcgtgtgccggcgcacctttgtagaccgggggtgggggaatgggtgcggtctgtttgggaaggggtccctcatcacatgcgcaaagttcaagtgcgtaaccaagctggaaggtaagatcgtgcagtacgagaacctgaaatactctgtcatcgtgaccgtgcacaccggcgaccagcaccaggtcgggaacgagtccacagagcacggtaccaccgctaccatcacgccccaggcgcctacgagcgagatccaactcaccgattacggggcgttgaccctagactgtagcccccggaccggcctcgacttcaacgaaatggtgctgctcacgatgaaggagaagtcatggctagtgcacaagcagtggttcctcgacctgcctctcccgtggaccagcggggcctccaccagccaagagacgtggaaccggcaggacctgctggtgacgttcaaaaccgcccatgccaagaagcaagaggtggtcgtactcggttcgcaggagggcgcgatgcacacggccttgaccggggccacggagatccagaccagcggcactaccacgattttcgccgggcacctaaagtgcaggctcaagatggacaagctaaccctgaagggcatgtcgtacgtcatgtgcactgggagcttcaagctggagaaggaggtggcggagacccaacacggaacagtcctggtccagatcaagtacgaagggaccgacgcgccctgcaagatccccttttccacgcaggatgaaaagggggttacccagaacgggcgcctgatcacggctaaccccattgtcaccgataaggaaaagcccgtgaatatcgaggctgaaccgccctttggggaatcgtacatcgtgatcggcgccggtgagaaagcactgaagctctcgtggttcaagaagggatcatccatcggtaagatgttcgaggccactgcaagaggggctcggaggatggccattctgggggataccgcgtgggacttcggaagcatcggcggagtcttcacgtccgtggggaagctggtgcatcagatctttggcaccgcctacggggtcctcttctctggcgtatcctggaccatgaaaatcggaattggcgtactgttaacctggctcggcctgaactcgcgttccacaagcctgtccatgacatgcatcgcggtaggtctcgtaaccctgtatctgggcgtgatggtccaggccgacagtgggtgcgtgattaactggaaaggccgggagctcaagtgcgggagcggcatcttcgtgacgaacgaggtccacacgtggaccgagcagtacaaattccaggccgactccccaaaacgactgagcgcggcaatcgggaaggcctgggaggagggggtgtgcggcatcagatcagccacgcggttggagaacatcatgtggcggcagatctccaatgagctcaatcacatcctgctggagaacgacatgaagttcactgtggtcgtgggggacgtggtgggcatcctcgcgcaggggaagaaaatgatacgcccccagcccatggagcacaagtactcctggaagtcctggggaaaggcgaaaataattggcgccgacgtgcagaacaccacgttcattatcgacgggcccaacacccctgagtgccccgacgaccagagagcttggaacatctgggaggtggaggactacggattcgggatattcaccacaaacatctggctgaagctgcgcgactcttacacgcaggtctgcgaccaccggttgatgagcgccgcgatcaaggactccaaggccgtccacgcggacatggggtactggatcgagtccgaaaagaacgaaacctggaagctggcgcgcgcgtccttcatcgaggtgaagacttgcatctggcccaagagccacaccttatggagcaatggcgttctcgaaagcgaaatgatcatccccaagatctacggcggccctatctcccagcataactatagacctggttactttacgcagaccgcgggaccttggcacttggggaaactggagctagacttcgacctgtgcgaaggcaccaccgtggttgtcgacgagcactgtggcaaccgagggcctagcctgcggaccactaccgtgacaggtaagattatccacgaatggtgctgtcgatcctgcacactcccacccttgcgattcaagggagaggacgggtgctggtacgggatggagattcgccccgtgaaagaaaaggaggagaacctggtcaagagcatggtgagcgcgggttccggagaagtagacagcttctcactcgggctcctatgcatcagcataatgatcgaggaggtaatgcggagccggtggagcaggaagatgctcatgacgggtactctggcagtgtttttcctgttaatagtggggcagctgacttggaacgacctgatacgcctctgcataatggtcggcgccaacgcctccgaccgcatggggatgggcaccacctacctggcgttaatggccaccttcaagatgaggccgatgttcgccgtaggtctactgtttcggcggcttaccagccgcgaggttctcctactgacgatcgggctctctctggtggcgagcgtggaacttcccaactccctcgaggagctcggcgacgggctggccatggggatcatgatcctcaaactactgacagacttccaatcttaccaactctgggccacgctgctatcgctgacgttcatcaagacgaccttctccttacactatgcctggaaaaccatggccatggttctatccatcgtgagcctccttcccctctgcctctccaccacgagccaaaagaccacctggctgcccgtgctgctcggctctctgggctgcaagccgctgaccatgttcttcatcgcggagaacaagatctggggccgcaagagctggccactcaacgaagggataatggcggtgggcatagtgagcattctgctgtcctctctcctaaagaacgacgtgcccttggccggaccattaatcgcgggcggcatgcttatagcctgctacgtcatctccgggtcatccgccgacttgagcctggagaaagcggcggaggtgtcttgggaggaagaggccgaacactctggtgcctcccacaacatcctggtagaagttcaggacgacgggacgatgaagataaaggacgaggaacgcgatgacactctgacgatcttgctgaaggccaccctccttgcggtgagtggcgtatacccgctttccattcccgcaaccttattcgtctggtacttttggcagaaaaagaagcagcggagcggggttctctgggacacgcccagccctccagaggtggagcgtgccgtcctcgatgacggcatttaccggatcatgcagcgtggcttgctggggcggagtcaggtgggcgttggcgtcttccaggagaacgtgtttcataccatgtggcacgtcacccgcggcgccgtgctcatgtaccaggggaagcggctagagcccagttgggcctctgtaaagaaggatttgatctcctacggcgggggatggcggcttcagggctcttggaacaccggagaggaggtgcaggtcatcgcggtggagcccggcaagaaccccaagaacgtgcaaactgctcccgggactttcaagaccccggagggcgaggtcggcgcgatcgcgctggatttcaagcccgggacctccggaagccccatcgtgaaccgagaggggaagatcgtgggcttgtacggcaacggtgtcgtaacgaccagcggcacctacgtgtccgccatcgcgcaggcaaaagcctcacaagaggggccgctcccggagatcgaggacgaggtgttccgcaaacggaacctcacgatcatggacctccacccaggctcgggtaaaacgcggcggtacctgccggcaatcgtgagggaggcgatcaagcggaaactgcgcacgctgatcctggcccccacccgcgtagtcgccagcgaaatggccgaggccctgaagggcatgcccatccggtaccagaccacggcggtgaagtccgagcacaccggccgcgagatcgtggacctgatgtgtcacgccactttcaccatgcgacttctgagccccgtacgcgtgccgaattataacatgatcatcatggacgaggctcacttcacggacccctccagcatcgccgcccgggggtatatctccactcgcgtgggcatgggggaggcagccgccatattcatgaccgccaccccgcctggcagcgttgaggcctttccgcagagtaatgctgtgatacaagacgaggagcgtgacatccccgagcgcagctggaactccgggtacgagtggatcacggatttccccggcaaaaccgtgtggttcgtcccgagtatcaaaagcggcaacgacattgccaattgcttgcggaagaacgggaagcgcgtgattcagctctcccggaagaccttcgacaccgagtaccagaagacgaagaacaatgactgggactatgtggtcaccacggacatctcggagatgggcgccaactttcgcgccgatcgggttatcgatccccgccggtgccttaaacccgtcatcctcaaggacgggcccgagcgcgtgatcctcgcgggccccatgccggtaaccgtagcaagcgccgcacagcggcgcggccggattggtcgcaaccacaataaggaaggggaccagtacatctacatgggacagcccttgaacaacgacgaagaccacgcccactggacggaagcgaagatgctgctcgataacatcaacactcccgagggcattatccccgccctgttcgagccggagcgggagaagtccgccgcgatcgacggagaataccggctgaggggagaggcccgcaagacctttgtggagctcatgaggcgcggtgatctcccagtgtggcttagctacaaggtcgccagcgaaggcttccagtactcggaccgccggtggtgcttcgacggtgagcgaaataaccaggtgttggaagagaatatggacgtggagatatggaccaaggagggggagcggaagaagctgcgcccccggtggctggacgcccgcacgtattcggacccgctggcacttcgggagttcaaagaatttgcggccggtcgccggtcgatcagcggggacctgattctcgagatcggcaagctaccccagcacctcacccaacgcgcgcagaacgccctcgacaatctggtcatgctgcataattccgagcagggcggacgggcctaccgccacgctatggaggaactccccgacacaatcgaaacgctgatgcttctcgccctgatcgcagtcctgacgggcggggtaaccctcttcttcctgagcggccgggggttaggtaagacctccatcggcctcttatgtgtcatggctagctccgccctgctctggatggcatccgtagagccccactggattgcggcctccatcatactggagttcttcctgatggtgctcctgatccccgagccggaccgccagcggacccctcaggacaaccagcttgcctacgttgtgatcgggctcctgttcatgatcctcacagtggccgctaacgagatgggcctcctcgagacgactaagaaagacctggggatcggccacgtcgcggtggagaaccatcaccatgccaccatgctcgatgtggacctacaccccgcgagcgcctggaccctgtacgctgtggcgactacaatcatcactccgatgatgcgccataccatcgagaataccacagccaatatctccctcaccgcgattgccaaccaggcagcgatcctgatgggtctagataaaggctggccaatcagcaagatggatatcggcgtgcccctcctggccctggggtgttactcccaagtaaaccccctgaccctgacggccgctgtcctaatgctcgtagcgcactacgccatcatcggaccgggtctccaggccaaggccacccgcgaggcccagaagcggaccgctgccggcatcatgaaaaaccccaccgtggatgggatagtcgccatagatctggaccctgtggtgtacgacgccaagttcgagaaacagttgggccagatcatgctgctgatcctgtgtactagccagatcctacttatgcgcaccacctgggccctgtgtgagtccataactctggcgacgggacccttgaccactctctgggaggggagcccaggaaagttctggaacaccacgatcgcagtatcgatggccaatatcttccggggcagctacctggcgggcgcgggcctggccttcagcctcatgaagtccctcggaggagggcgtcgggggactggagcccagggcgagactctgggggagaagtggaaacgccagctcaaccagcttagcaagtccgagttcaacacctacaagaggagcgggattctagaggtggatcgttccgaggcgaaagagggcctccgtagaggcgagacgaccaagcacgccgtgtctcggggcaccgcgaagctgaggtggtttgtcgagcggaacctggtgaagcccgaggggaaggttattgacctgggttgcggccgcgggggctggtcctactactgcgccgggctcaagaaggttaccgaggttaaaggttacactaagggcgggccgggacatgaggagcccatccctatggccacctacgggtggaaccttgtgaagctgcacagcggcaaggacgtcttctttatcccgcccgagaagtgcgacaccctcctgtgtgacatcggcgagagtagccccaacccgacgatcgaagaaggaagaacgctgcgcgtactaaagatggtcgagccctggcttcggggcaaccagttctgtatcaagatcctgaatccgtatatgccttccgtcgttgagacgctcgaacaaatgcagaggaagcacgggggcatgctggtacggaatccgctcagccgcaactccacccacgagatgtactgggtgagctgcggtaccggcaatatagtctccgcagtaaacatgacgtcacgcatgctgctgaacagattcacgatggcccaccgcaaacccacctacgagcgggacgtggatctgggggcgggcacccgccacgtcgcagtggagcctgaggtcgcaaatctcgatatcatcggccaaagaatcgagaacatcaaacacgagcacaagtctacctggcactatgatgaggacaacccctacaaaacgtgggcctaccacggcagctatgaggttaagccctccggaagcgcaagctccatggtcaacggggttgttaagctgctgaccaagccatgggatgtcatccccatggtgacgcagattgcgatgacggacacgacgcccttcggccagcagcgtgtcttcaaggagaaggtggacacgcggacccctaaggccaagcgcgggaccgcccagatcatggaggtgactgctagatggctctggggcttcctatctcgcaacaagaagcccaggatctgtacgcgcgaggagtttaccagaaaggtgcgctcgaacgccgcgatcggagccgtcttcgtggacgagaaccaatggaactctgccaaggaggccgtagaggatgagaggttctgggacctggtccaccgagaacgtgagctccacaaacagggtaagtgcgcgacgtgcgtgtacaacatgatgggcaagagagagaaaaagctgggcgagttcggaaaagccaaaggatcccgggccatttggtacatgtggctgggcgcgagattccttgagttcgaagcccttggcttcatgaacgaggaccactggttctctagggaaaattcgctgagcggagtagagggcgaggggctccacaagctaggctacatcctgagggacatcagcaagattcccgggggaaacatgtatgcggatgacaccgccggctgggatacccgtataaccgaggacgaccttcagaacgaggcgaagattacggacatcatggagccggaacacgccttgttagcaacctcaattttcaaactcacctaccaaaataaggtcgtgcgggtgcagcggcccgcaaagaacgggaccgtcatggacgtgataagccggcgcgatcaacggggtagcggacaggtaggcacgtacggtctgaacactttcacgaacatggaagcacagctgatccgccagatggaatccgaagggatcttctctccctccgagctcgagacccccaacctggctgagcgggtcttggattggctcgaaaagtatggagtcgagaggctgaagcggatggctataagcggggatgattgtgtagtgaagccgatagacgatcgcttcgcaacggcgctaacagccttaaacgatatgggcaaagtacggaaggacatcccccagtgggagccctcaaaaggatggaatgattggcagcaggtacccttctgcagccaccacttccaccaactgatcatgaaggacggtagagagatcgtcgtgccgtgcagaaaccaggacgagctggtgggcagagcccgggtgagccagggtgccggctggtcactccgtgagaccgcctgcctgggcaagagctacgctcagatgtggcaactgatgtactttcaccgtcgcgacttgcgactcgcagccaacgcaatatgctcagcagtgcccgtggactgggtaccgaccagccgcacgacctggtccatacacgcccaccaccagtggatgaccaccgaggatatgctgtcagtgtggaaccgcgtgtggatcgaagagaacccctggatggaggataagacacacatctcctcatgggaggacgtcccgtacctcggcaagcgggaagaccagtggtgtgggtccctcatcggcctgaccgctcgcgccacgtgggcgacaaacattcaagttgcgatcaaccaggtgagacgcctcatcggcaacgagaattacctggacttcatgaccagcatgaagagattcaagaacgagtccgacacggaaggggccctgtggtga

SEQ ID NO: 23820 - RNA, 9879 nt, synthetic construct
  misc_feature 1..9879: note = derived and/or modified CDS sequence (opt11) from DENV-1__FJ639677__SS-prME
  source 1..9879: mol_type = other RNA
tcagtaaccatgctgctcatgctaatgccgacggccttggcattccacctgaccacccgaggaggagaacctcacatgattgtctcgaaacaagaacggggtaaatcactactcttcaaaacatccgcaggggtgaatatgtgcacacttatcgccatggacctcggagaactttgcgaggataccatgacttataaatgcccccgcgtgacagaggccgagccggatgacgtcgattgctggtgcaacgccaccgacacgtgggtgacgtatggcacgtgcagccaaacaggcgagcaccgcagagataagaggtcggtggctctcgcaccgcacgtaggcctcggcctagagaccagaaccgaaacctggatgtcgtcggaaggtgcatggaagcaaattcaacgcgtcgagacatgggcccttagacaccccggcttcaccgtaatagcgctgtttctggcccacgctattggcacctcaatcactcaaaaaggcataatattcattctcctaatgctcgtcacaccctcaatggcgatgcgctgcgtgggtatcggaagcagggacttcgttgaaggtctgagtggcgccacctgggtagacgttgttctagaacacggaagttgtgtcacaaccatggcgaaggacaaaccaacgttagatatagagctcctgaaaaccgaggttacaaatccagcagtactccgaaagttgtgcatagaggctaaaattagtaacaccacaacagattccagatgtcctacccagggcgaagcaacccttgtggaagaacaggacgccaacttcgtatgtcgaaggacgtttgtagataggggctggggcaacggttgcggactcttcggcaagggctctctcataacttgcgcgaaattcaagtgtgttactaaactcgaagggaaaattgttcagtacgaaaatctaaagtattcagtgatagtaaccgtacacacgggtgaccaacaccaggtgggtaacgaaagtacagaacatgggacgacagcaacgatcactccccaggccccaactaccgagatccaactaaccgattatggagcgctcaccctggactgttcgcctaggacggggctcgacttcaatgaaatggtgctacttaccatgaaggagaagagttggcttgtacacaaacaatggtttctggaccttccgttaccgtggaccagtggagcatccacatcccaggaaacgtggaaccgacaagatctcctagtgactttcaagacggcacacgctaaaaagcaagaagttgtcgtcttgggctctcaggaaggggcaatgcacacggccctaacaggggcaacggaaatccagacatcgggaacaacaacaatctttgccgggcacctgaaatgccgcctcaaaatggacaaacttaccctcaaaggcatgagctacgtaatgtgtacgggcagtttcaaactggagaaggaagtagcagagacgcagcatggcacggtgctagtccaaattaaatatgaaggaacagacgcaccctgcaaaatccccttcagcacgcaagacgaaaagggcgtaacccaaaacgggcggttaataacagcgaacccaatagtcaccgacaaagaaaagccagtgaatatagaggccgaacctccattcggggagagctacatagtgatcggcgcgggagaaaaggccctcaagctctcatggttcaaaaaggggagtagcatcggaaagatgtttgaagccacagcaagaggcgcacgccgcatggcgatccttggtgacaccgcatgggactttgggagcataggaggggtttttacgtcagttggaaagttagtacaccaaatattcggaacggcatatggagtactattctccggagtgtcgtggaccatgaagatcggcatcggagtgctcctaacctggctcggcctcaattcaagaagtacgagcctaagcatgacatgcattgccgtaggcctagtaaccctctacctcggcgtgatggtacaggcagactcaggatgcgtgatcaactggaaggggcgcgaactcaagtgcggttcgggaatattcgtaactaacgaagtacacacgtggacggaacaatacaaattccaagcagacagtcccaagcgcctgagcgcagccatagggaaagcgtgggaagagggtgtctgcgggatacgaagtgcgacgagattagaaaatataatgtggaaacaaatttcaaatgaactaaaccacatcctacttgagaacgatatgaaactcacagtagtcgtgggcgacgtagccggcatcctcgcacaagggaagaaaatgattcgaccccagcctatggaatacaaatactcatggaaaagctggggcaaagcaaaaataatcggcgcagacgcgcagaataccaccttcatcatagacggccctaacacgccggaatgcccagatgaccagcgggcgtggaacatctgggaggtagaagactacggattcggaatatttacgaccaacatttggctaaagttacgcgactcatacacacaagtatgtgatcaccgtttaatgagcgcggcaataaaagactcgaaagcagtccatgccgacatgggatactggatcgagtccgaaaagaatgaaacgtggaaactcgcgagggcttcattcattgaggtaaaaacatgcatatggccaaagtctcatacactctggtccaacggagtgctcgagtcggagatgataatcccaaagatttacggaggacctataagccagcacaactaccgtcccggctattttacacaaactgccggaccctggcacctgggtaaactcgaactagatttcgacctctgcgaaggcacaaccgttgtagtggacgaacactgtggtaacaggggcccatctctacgcaccacgacagttactggcaaaatcatccacgaatggtgttgccggtcgtgtaccctgccgccactacgcttccgaggcgaggatggctgctggtacggcatggaaatcagaccagtgaaggaaaaagaagaaaaccttgtcaagagtatggtcagcgccggaagtggggaagttgacagtttttctctcggcctgctctgtatatccataatgatagaggaagttatgcgaagcagatggagccgtaaaatgttaatgaccggaaccctagcggtcttcttcctcctcattatgggacagctaacctggaacgacctaataagactctgcattatggtgggggcaaatgcctccgaccggatgggcatgggaaccacctacctcgcactaatggcaacgttcaagatgcgtccaatgttcgcgatggggctcctcttcaggcggcttacctctagagaggtactcctgctgacaatcggcctatccctcgtggcctcggtcgagctaccaaacagtctcgaagaactcggcgacggactggcaatgggaatcatgatattaaagctattaacggatttccaaagccaccaactgtgggctactctattatctttaaccttcataaaaacaacattcagcctgcactacgcttggaagacaatggcaatggtgctcagcatcgtgagcctctttccgttgtgcctctctacgacatcgcagaaaactacgtggctacctgtattgctaggctcgctaggatgcaaacctctcaccatgtttctaatagcggagaataaaatatgggggcgcaagtcctggccgcttaacgagggaataatggcagtagggatagtgtccatactgctgagcagcctcttaaagaacgacgtgccactcgccgggcccctaatagccggaggtatgctgatagcgtgttacgtcatcagtggctccagcgcagacctctccctagagaaagcggcagaagtctcctgggaggaggaagcggaacactcaggtgcgtcacacaacatactggtggaggtccaagacgatggaacaatgaaaattaaagacgaagaacgagacgatacattaacaatactactcaaagcaaccctgctcgctgtctcaggggtgtacccgctctccatccccgccacccttttcgtctggtacttctggcagaaaaagaaacaacggagcggagtactgtgggatacaccgtcaccacccgaagtagaacgagcagtcctcgacgacgggatatatcgaattatgcaacgcggactcctgggtcgctcacaagtaggcgtcggagtattccaagagaacgtgttccacaccatgtggcatgtcacacgaggagccgttctgatgtaccaaggcaaaagactagaaccctcatgggcaagcgtcaagaaagaccttattagttacgggggaggctggcgcctaaagggatcatggaatacgggagaagaagtacaggtgatagcagtagaaccaggcaaaaaccccaaaaacgtccaaaccgcacccgggaccttcaagacccccgagggagaagtcggagctatagcgctggatttcaaaccagggacctcggggagccccattgtcaaccgcgagggtaaaattgtaggtctatacggaaacggagtggtcacgacatccggcacctatgttagtgcaatagcgcaagctaaagcatctcaggaaggaccgctgccggaaattgaggacgaagtcttccgcaagcgaaatctcacaataatggacctgcaccccggtagcgggaagactagaagatacctgccagcaatcgttagagaggctataaaacggaaactaagaaccctcatactcgccccaacacgggttgtcgcatcggaaatggcggaggccctcaaagggatgcccatccgctaccagaccaccgccgttaagtctgagcacaccggcaaggaaatagtcgacctcatgtgtcacgccacattcacaatgcgcctactctcccccgtccgagttccaaactacaacatgataatcatggacgaggcccacttcactgatccgtccagcatcgcagcgcggggctatatttccacccgggtaggcatgggggaagcagcagcgatatttatgacggcaactccccctggaagcgtagaggccttcccccaatctaacgccgtcatacaagacgaagaacgcgacatcccggagaggagctggaacagtggatacgagtggattacagactttcccggtaaaacggtctggttcgttcccagtatcaaatccgggaacgacatcgcaaactgccttcggaagaacggaaagagggtcattcagctaagcaggaaaacctttgacaccgaataccagaaaaccaaaaataacgattgggactatgtggtcaccactgacataagcgaaatgggggctaatttcagagctgatcgggtcatagacccacgccgttgcctaaaaccagtcattctgaaggatggacccgagcgtgtgatcctcgcaggacccatgcccgtcacggtagcatccgcagcccagcgacggggccgaatcgggcggaaccacaacaaagaaggcgaccagtacatctacatgggacaacccctgaacaacgacgaagaccacgcgcattggaccgaagcaaagatgcttctcgacaatataaacacgcccgagggcataataccagctctgttcgaacccgagagagagaagtcggcggcgattgacggggaataccgcctaaggggagaagcacggaaaacatttgtagagctaatgcgcagaggagatctgccagtatggctaagctacaaagtagcatcagaagggtttcaatacagcgaccgcagatggtgcttcgatggagagaggaacaaccaggtcctcgaggaaaacatggacgtcgaaatatggacaaaggaaggagaaagaaagaaactcaggcccaggtggctcgacgccaggacgtacagcgaccccttggccttgcgagagttcaaggaatttgcggcagggcgacgatccgtgtcaggggacctcatactagaaatcggtaaactgccgcaacacctaacacaaagagctcagaacgctcttgataacctagtcatgttacataactcggagcaagggggacgcgcgtaccgacatgccatggaggaactccccgacaccatcgagacactgatgcttctggcactaatcgctgtcctaacagggggagtcacgctattcttcttgagcggaagaggactcggcaagacgagcataggcctgctgtgcgtaatggcttcatcggtgctcctttggatggcgtctgttgaaccacattggatagccgcttctatcatactagagttcttcttaatggtacttttgatacccgaaccagacagacagagaactccccaggacaaccagctagcatacgtggtaatagggctcctttttatgatcctcaccgtggccgcaaacgaaatgggactcttagaaacaaccaagaaggacttaggcatcgggcacgtcgcagtcgagaatcaccaccacgcggctatgctcgacgtagacctccaccccgcgtcagcgtggacactttacgcagtggcaacgacaatcataacccccatgatgcgccacacaatcgaaaacaccacggccaatatctctctgacagcaatagcgaaccaagccgcaatactgatgggactagacaagggttggcccattagcaaaatggacataggtgtgcccttacttgcactcggttgctacagccaagtaaaccctcttaccctcactgccgcagtcctaatgctggtagcccactacgctattattgggccgggtctccaggcaaaagcaacgcgtgaggcgcagaagaggaccgccgcaggtataatgaaaaaccccaccgtggacggcatagtcgccatagatcttgaccccgtcgtgtacgacgcaaagttcgagaaacaactcgggcagataatgcttctcatcctttgcaccagccaaatcctcctaatgcgtacaacgtgggcactttgcgaaagcataacactcgcgactggaccactgacaacactatgggagggatcgcccggcaagttttggaatacaaccatagcggtatccatggcaaacatcttcagaggatcctacttggccggcgcaggactcgcattctcactgatgaagtccctaggaggaggacgacgagggacgggcgcacaaggggagactctaggagaaaaatggaaacgacaactgaatcagctctcgaaaagtgagttcaacacgtacaaacggagtggcattatggaagttgaccgcagcgaagcgaaagagggcctaaaaagaggcgaaacgacaaaacatgcagtatccagagggaccgccaaactacgctggtttgtggaacggaatttagtgaaaccagagggaaaggtcattgacctaggatgcggccgcggaggctggtcgtactactgtgcgggactcaagaaggtcaccgaagtaaaagggtacacgaagggcggcccaggtcacgaagaaccgatcccaatggcaacctacggttggaacctggttaagctccacagcggcaaggacgtgttcttcataccaccagagaaatgtgatacactgttatgcgatatcggagagtcaagtcccaaccctacgatcgaggaaggccggacactgagagtcctcaaaatggtcgagccatggctacgcggcaatcaattctgcataaagatcctaaatccgtacatgcctagcgtggtcgaaaccctggaacaaatgcagaggaaacacggaggcatgctagtgagaaaccccctctcccgaaattccacacacgagatgtactgggtctcatgtgggacagggaacatcgtctcggccgtaaatatgaccagccgcatgctcttgaaccggttcacaatggcccatcgaaagcccacttacgaacgcgacgttgacctggggacaggtacacgtcacgtagccgttgagccggaagtagccaatctcgatataatcgggcaaagaatcgagaacatcaaacacgaacacaagagtacctggcactatgacgaggacaacccttacaagacatgggcctaccatggtagttacgaggtaaagcccagcgggtcagcgtcgagtatggtaaacggcgtggtaaagctcctcacgaagccgtgggacgtcatcccaatggtcacgcaaattgccatgacagacacaaccccttttggccaacagagagtgttcaaggaaaaggtggataccaggacgcctaaagcgaaacgcggaaccgcacaaatcatggaagtaacagcacgctggctctggggctttcttagtagaagcaagaaaccacgaatctgcacccgcgaagagttcatacggaaagtacgcagtaacgcagcgatcggcgccgtgttcgtagacgaaaaccagtggaacagcgcgaaagaagcggtagaagacgagaggttctgggacttagttcaccgagaacgagaactgcacaagcaaggtaaatgtgccacgtgcgtgtacaatatgatgggaaaacgagaaaagaagctaggcgagttcgggaaagccaaaggaagccgtgccatatggtatatgtggctcggagcacgcttcctggagttcgaggcacttgggtttatgaacgaagaccattggttcagccgagaaaactcactatcaggcgtagaaggggaagggctacacaagctcggttacatactccgagacataagcaagatcccgggcgggaacatgtatgcggacgataccgcaggatgggacacacgaattacggaagacgacttacagaacgaagcgaagataaccgacataatggaacccgaacatgcgctcctagccaaagcaatattcaaactcacatatcaaaacaaggtggtacgcgtccaaaggccagccaagaacggaactgtcatggatgttatcagcagacgagaccagaggggatccgggcaagtcggcacctatgggctgaatacgttcacaaatatggaagcacaactgatacgacagatggagtccgaaggaatattcagcccaagcgaactagagacaccaaacctcgcggagcgcgcgctcgattggctagaaaaatatggagtggaaagactgaaaagaatggccattagtggagacgactgcgtcgtaaaaccgatcgacgatcggttcgccaccgctctaacagcgctcaacgatatggggaaagtcaggaaggatataccccaatgggagccctcgaaaggatggaacgactggcagcaagtaccgttctgctcacaccactttcatcaattgatcatgaaagacggaagggaaatcgtcgtaccatgtaggaaccaggacgagctagtcggcagagcacgcgtgtcacaaggcgccggatggagtctgagggaaacagcctgtctcggtaaatcatacgcacaaatgtggcaactgatgtactttcaccgtagagaccttagactcgctgcgaacgcaatatgcagtgcagtcccggtagattgggtacccacgagtagaacgacgtggtctatacacgctcaccaccaatggatgaccaccgaggacatgctatccgtatggaatagagtatggatcgaggaaaatccatggatggaggataaaacacacatcagcagctgggaggacgtcccatacctggggaagcgagaagaccaatggtgtgggtcgctcatcggtctgacagcacgcgccacatgggcgaccaacatacaagtagcgataaaccaggtcagacgactcatcggcaatgaaaactacctagactatatgacatcgatgaagcgtttcaaaaacgaatcggaccctgagggtgcactttggtaa

SEQ ID NO: 23821 - RNA, 9879 nt, synthetic construct
  misc_feature 1..9879: note = derived and/or modified CDS sequence (opt11) from DENV-1__GQ868618__SS-prME
  source 1..9879: mol_type = other RNA
agcgtgactatgttactcatgctgatgcccaccgcgctggcattccacctcacaaccaggggcggggaaccacacatgatcgtgtctaagcaggagcgaggcaaaagcttgctgtttaagacctccgccggggtcaatatgtgcacactcatcgccatggatttgggcgagttctgcgaggacaccatgacctacaagtgtccccgcatcactgaggcggagcccgacgacgtggactgctggtgcaatgccaccgacacgtgggtgacctacgggacctgcagccagacaggcgaacaccgccgggacaagcgctccgttgcactggcgccccacgtaggcctcgggctggaaacgcgcaccgagacctggatgagctctgagggcgcgtggaagcagatccagcgggtggagacctgggcactgcgccaccccggcttcacggtcatcgcccttttcctcgcgcacgcgattggcaccagcatcacccagaagggaattattttcatactgctcatgctggttaccccctccatggccatgcggtgtgttggcatcggtagccgagacttcgttgaggggctgtccggggccacgtgggtggacgtcgtgctcgaacacgggagctgcgtgacaacgatggcgaaggacaagcccaccttggacatcgagctcctcaagacggaagtcacaaatcccgccgtcctgcggaagctgtgcatagaggccaagatttccaacaccaccacggactcacgctgcccgacacagggggaagccacattagtggaagagcaggacgccaatttcgtctgcagacggacattcgtggacagaggatgggggaacggctgcggtctgttcggtaaggggtcactaatcacatgcgcaaagttcaagtgtgttaccaagctcgagggtaaaattgtccagtatgagaaccttaagtacagcgtgatcgtaaccgtccataccggggaccagcatcaggtgggtaacgagtccaccgagcatggaaccacggcgacgatcactccgcaggcgccatcgacagagatccaactgaccgactacggggcgctcaccttagattgcagcccccggaccggcctcgacttcaacgagatggtcctacttacgatgaaagaaaagtcctggctggtacataaacaatggttcctcgacctgccgctgccttggacgtctggagcctcgactagccaggagacctggaatcggcaagatctcctggtaacattcaagaccgcccacgctaagaagcaggaggtcgtggtacttggctcccaggagggcgccatgcacaccgcgctaaccggcgccacggagatccagaccagcggcaccaccacgatcttcgctggccatctgaagtgccgcttgaagatggacaagctgaccctgaagggcatgtcctacgtcatgtgcactgggagcttcaaactggaaaaagaggttgcggaaacccagcacggcacggtgctcgtccagattaagtacgaaggcaccgacgctccctgcaagatcccgttctccacccaggacgagaaaggtgtaacccagaacggtcgactgattacggcgaacccgatcgtgaccgataaggagaagcccgtcaacatcgaggccgagccgcccttcggggagagctacatcgtgatcggcgcgggcgagaaagccctgaagctgtcctggttcaagaaggggagctccatcgggaagatgttcgaggcaaccgcccgcggggcccgcaggatggcgatactcggcgacactgcctgggactttgggtcaatcggcggcgtgttcacgtccgttgggaagctggtgcaccaaatcttcggcaccgcttatggggtgctattcagcggcgtctcctggaccatgaagattggcattggggtgctcttgacctggctcggcctcaacagccgctccacgagcctctccatgacctgcatcgccgtggggctcgtcaccctctacctgggcgtcatggtccaggccgactcagggtgcgtcatcaactggaagggccgggagctgaagtgcgggagcggaatcttcgtgaccaacgaagtgcacacgtggaccgaacagtacaagttccaggcggattccccgaagcgcctcagcgccgcaatcggcaaggcctgggaggagggggtctgcggcatccgatccgccacccgcctggagaacatcatgtggaagcaaataagcaatgagctgaaccacatactcctcgagaacgatatgaagttcaccgtggtggttggtgacgtggcgggcatcctggcccaggggaagaagatgatccggccgcagcccatggagtacaaatactcctggaagagttgggggaaggccaagatcatcggcgcagacgtgcagaacacgacgttcatcatcgatggccccaacacaccggagtgccccgacgaccagcgcgcgtggaacatctgggaggtggaggactacggcttcgggatattcacaaccaacatctggctcaagttacgtgactcttacacccaggtgtgcgatcaccgcctgatgagcgccgcaattaaggactcgaaggccgtgcacgcggacatgggctactggatcgagagcgaaaaaaacgagacgtggaaactcgcgcgggcctccttcatcgaggtcaagacctgcatctggccaaaaagccacaccctgtggtccaacggcgtgctggaatcagagatgatcatcccaaagatttacgggggccctatctcccagcacaactaccgccctgggtacttcacgcagacagccgggccgtggcacctcgggaagctggagctggatttcgatctgtgcgagggcaccaccgtggtagtcgacgagcactgcggcaaccgggggccgagcctccggacaaccactgtcactggtaaaatcattcacgagtggtgttgccgatcctgcacgctgccgcccctgcgcttcaagggggaggacggctgctggtacgggatggaaatccgacccgttaaggagaaggaagagaacctggtcaagagcatggtcagtgccggtagcggagaggtcgacagcttctccctcggcctcctgtgcatcagcatcatgatcgaagaggtgatgcgctcccggtggagccgaaagatgcttatgacggggacgctcgccgtgttctttctgctgatcatggggcaactcacctggaacgacctgatccggctctgcatcatggtaggtgcgaacgcctccgaccgcatgggcatgggcacgacgtacctcgccctgatggcaaccttcaagatgcgcccgatgttcgccgtgggcctcctgttcaggcggctgacctctcgagaggtcctactcctgacgatcgggctctccctcgtcgcgagcgtggagctgcccaattccctggaggagttaggtgacgggctggccatgggcatcatgatcctgaagctgctgaccgacttccaaagccaccaactatgggccaccctcctgtccctgacgttcataaagacgaccttctcacttcactacgcctggaaaaccatggcgatggtcctgagtatagtgagcctgtttcccctctgcctgtccaccacgagccagaagaccacctggttaccagtgctcctaggatccctggggtgcaagccgctcaccatgttcttaatcgccgagaacaagatctggggccgcaagagctggccactgaatgaagggatcatggccgttggcatcgtgagtatcctcctgtcctcactgctcaagaacgatgtcccgttggccggccccctaatcgctggcggcatgctcatcgcctgctacgtaatctccgggagctccgccgacctgagcctggagaaagccgccgaggtgtcctgggaggaggaggccgagcatagcggcgcgagccacaacatcctagtggaggtgcaggatgatgggacgatgaagataaaggacgaagagcgggacgacacactgacgatactcctcaaggctaccttactagcggtaagcggcgtgtacccgctctcaatccccgccactctgtttgtctggtacttttggcagaaaaagaagcagcgtagcggggtgctgtgggatacgcccagcccacccgaagtagagagagccgtcttggacgacggcatctaccgcataatgcagcgtggactgctggggcggagccaggtgggcgtgggagtcttccaggagaacgtattccacacgatgtggcacgtcacccggggcgctgtcctgatgtaccaagggaaacgtctcgagccctcctgggctagcgttaagaaggacctgatctcctacggcggtgggtggcggctgcagggctcctggaacaccggggaggaagtgcaggtcatagcagtggagcccggcaaaaaccccaagaatgtgcagacggccccagggaccttcaagacctccgaaggcgaggtcggcgccattgcgctcgatttcaagcccgggacctcaggaagccccattgtcaaccgcgagggtaagatcgtgggcctgtacggaaacggtgtcgtcacgacctccggcacctatgtaagcgccatagcccaggccaaggcgtcccaggagggtcccctgccggagatcgaggacgaggtcttccggaagcggaacctcaccatcatggacctacaccccggctcgggtaagacgcgacgctacctacccgccatcgtgcgggaggccataaagcgcaagctccgtaccctgattctggcccctactcgcgtcgtcgcctcggaaatggcggaggccctcaagggcatgcccatccggtaccaaactaccgcggtaaagagcgagcacaccggcaaagagatcgtggacctgatgtgccacgccacgttcaccatgcggctcctcagccccgttcgcgtgcccaactacaacatgatcatcatggatgaggcccactttacggacccgagctccatcgcggcccgggggtacatctcaactcgagtgggaatgggggaggccgccgcgatctttatgactgcgactccgcccgggagtgtagaggcgttccctcaaagcaacgccgtcatccaggacgaagagcgggacataccagaacgctcgtggaacagcgggtacgagtggatcacggacttccccggaaagaccgtgtggttcgtcccctccatcaagagcggcaacgacatcgccaactgtctgcgaaagaacggtaagcgcgtgatccagctgtcccgaaaaacattcgacaccgagtaccagaagacgaagaacaacgattgggattacgttgtcaccacagatatctcggagatgggtgcgaacttcagagccgacagggtgatcgaccccaggcggtgcctaaagccggtaatcctaaaagatggccccgaacgcgtcatcctggccggccccatgccagtgaccgtagcatccgcggcacagcggcgcgggcggatcggccgcaaccacaacaaggagggcgaccaatacatatacatgggtcagcccctcaataacgacgaggaccacgcacactggacggaggcaaaaatgctgctggacaacatcaatactcccgagggcatcatccccgcactcttcgagcccgagcgggagaagtccgccgcgatcgacggggaataccgcctgcgcggcgaggcccggaagaccttcgtagagctgatgcggcgcggggacctcccggtgtggctgagctataaggtcgcgtctgagggcttccagtatagcgaccggcggtggtgcttcgacggcgagcgcaacaaccaggttctggaggagaacatggatgtggaaatttggaccaaggagggtgagcgcaagaagctgagaccccgctggttggatgcccgcacatacagtgaccccctggccttacgggaattcaaggagtttgccgctggccgccggagtgtctccggggacctgatcctggagatcggaaagctgccccagcacctgacccagcgcgcccagaacgccctggacaacctcgtgatgttacacaacagcgagcagggagggcgggcataccgccacgcaatggaggagctgccggataccatcgagaccctcatgctgctagcactcatcgccgtgctgacgggtggggtcacccttttcttcctctccggccggggactgggcaaaaccagtatcggcttactctgcgtgatggcctccagcgtgctgctttggatggcgtccgtggagccccactggatcgccgccagcattatcttggagttcttcctgatggtgctgctcatccccgagccggataggcaacgtaccccccaggacaaccagctggcctacgtggtaatcgggctcctcttcatgatactgaccgtggccgcgaacgagatgggccttctcgaaacgaccaagaaagatctcgggattggccacgtcgccgtcgagaaccaccaccacgccgccatgctggatgtggacctccatcccgcctcagcgtggaccctatacgctgtggccaccacgataatcacccccatgatgcgccatactatcgagaacaccacggccaatatcagcctgactgccatcgcgaaccaggccgccatcctcatggggttggacaagggctggccgatctccaagatggacataggcgtccccctactcgctctggggtgctacagccaggtgaaccctctgacacttaccgccgcggtcctaatgctggtggcccactacgctattataggccccggcctccaggcaaaagctactagggaggcccagaagcggaccgccgccggcatcatgaagaacccgaccgtggacggcatagtcgccatcgatcttgatcccgtcgtctacgatgcgaagttcgagaagcagttaggacaaattatgttactgatcctgtgcacctcccaaatactcttaatgcgcactacatgggcactatgcgagagtatcaccttagccaccggccccctgacgaccctgtgggaagggagtcccggcaagttctggaacacgaccatcgccgtgagcatggccaacatcttccgggggagctatctcgcgggcgccgggctggccttttccctgatgaagtccctcgggggcgggcgccggggaacgggggcccagggcgagactcttggagagaagtggaaacgccagctgaatcaactatccaagagcgagttcaatacttataagcgttccgggatcatggaggtagaccgtagcgaagcaaaggagggactgaagcgcggggagaccactaagcacgcagtgtcccgcggcactgccaagctgagatggttcgtggaacgcaacctcgtaaagcctgaaggaaaggtgatcgacctgggatgcggccgcggcgggtggagctattactgcgccggtctaaagaaggtgacagaagtaaagggttacaccaagggcggccccggccacgaggagcccatccccatggccacgtacgggtggaacctggtgaagctccactccgggaaggatgtgttcttcatcccgccagagaagtgcgacacactgttatgtgacatcggggagagctcccccaatcccaccatcgaagagggccggacgctacgggtcctgaagatggtggagccgtggctccgcgggaaccaattctgcatcaagatcctaaatccctacatgcccagcgtggtcgagacgctggagcagatgcagcggaaacacggggggatgcttgtgcgcaatcccctcagccggaacagcacccacgagatgtactgggtgtcgtgcggcacaggaaacatcgtcagcgcggtgaacatgacatctagaatgctcctgaatcgtttcaccatggcccaccgcaagccgacctacgaacgcgacgtcgacctcggggccggcacccggcacgtggccgtggagcccgaggtggccaacctagacatcatcggtcagcgcattgagaacatcaagcacgaacacaagtcgacctggcactacgatgaggacaatccctacaagacctgggcgtaccacgggtcctacgaagtaaaacccagcggcagcgcgtcgagcatggttaacggggtcgtaaagctgttgacgaaaccatgggacgtaatccctatggtcacccagatcgctatgaccgacaccaccccctttggccagcagcgggtgttcaaggagaaggtggacacacgcacccccaaggccaaacgggggaccgcccagatcatggaagttacagccaagtggctgtggggcttcctatccagaaacaagaagccgcggatatgcacgcgcgaggagttcacccggaaggtgcgctcaaacgccgccatcggggccgtctttgtcgacgagaatcagtggaactccgcgaaggaggcggtcgaggacgagcgattctgggacctcgtacaccgcgaacgggaactgcacaagcagggaaagtgcgcgacctgcgtctacaatatgatgggcaagcgtgagaaaaagttgggggagttcggcaaggccaaggggagcagagccatctggtacatgtggctgggcgcgcgctttttagagttcgaggccctgggcttcatgaacgaggaccactggttcagtcgggagaacagcctctccggggtagagggtgaggggctgcacaagttgggctacatcctgcgcgacatcagcaagatacccggaggcaatatgtacgccgatgacacggccggctgggacacccggatcaccgaggacgacctgcaaaacgaagccaaaattaccgatattatggagcccgagcacgcgctgctcgccaaatccattttcaagctgacgtaccagaacaaggtcgtccgcgtacagagaccggccaagaacgggaccgtgatggacgttatcagccgcagagaccagagagggtccggccaggtgggcacctacggcttaaacaccttcacgaacatggaggcccaactcatccgccagatggagagcgaagggatattttccccctcggagttggagaccccgaaccttgcagaacgggtcctcgactggctggagaaacacggtgtcgagcgcctgaagaggatggcgatctccggcgacgattgcgtggtaaagcccatcgatgatcgcttcgcgacggccctcaccgccctaaacgacatgggtaaagtccgaaaagacatccctcagtgggagccgtcgaaggggtggaatgattggcagcaggtccccttttgcagccaccacttccaccagctgatcatgaaggacggtcgtgaaatcgtggtcccctgccggaaccaggacgagctcgtgggccgcgcacgggtgtcccaaggggcaggttggagcctgagggaaacggcctgtctggggaagtcctacgcccagatgtggcagctcatgtacttccatcggcgcgacctgcgtcttgccgcgaacgcgatctgtagcgccgtcccggtggactgggtccccacatcccgtaccacctggagcatacacgcccaccaccagtggatgacgaccgaggacatgctgtccgtctggaacagggtgtggattgaggagaacccctggatggaggacaagacacacatctcttcctggggcgatgtaccctacctggggaaacgcgaagaccagtggtgcggctccctgatcggtctcacggcccgggcgacttgggcgacaaacatccaggtcgccatcaaccaggtgcgccgcctcatcgggaacgaaaactacctggactacatgacctccatgaagcggttcaagaacgagagcgatccggagggggccctatggtga

SEQ ID NO: 23822 - RNA, 9879 nt, synthetic construct
  misc_feature 1..9879: note = derived and/or modified CDS sequence (opt11) from DENV-1__GQ868619__SS-prME
  source 1..9879: mol_type = other RNA
tccgtgaccatgctgttaatgctgatgccgacggccttagcttttcacctcaccactcggggcggggagcctcacatgatcgtgtctaaacaggagcggggcaagagcttattgttcaagaccagtgcaggggtgaacatgtgcaccctcatcgcgatggatctgggtgagctgtgcgaggatacgatgacatacaaatgccctcgcatcaccgaagcagagcccgacgacgtggactgctggtgcaacgccacggatacgtgggttacttacgggacctgctctcaaaccggcgagcaccgccgagataagcggtcagtggcattagcaccccacgtgggcctggggcttgaaacgcgcaccgagacctggatgagctctgaaggtgcctggaaacagatccagcgggtcgagacctgggcccttagacaccccggtttcaccgtgatcgccctgttcctggctcacgccatcggcaccagcatcacccagaaggggatcatcttcatcttactaatgctggtgacccccagtatggcgatgcgctgcgtcggcattggcagccgcgacttcgtggaggggctgtctggcgccacgtgggtggacgttgtactggaacacgggagctgcgtgaccacaatggccaaagataagcccacactggatattgagctcctgaagacagaggtgacaaaccccgcggtactgcggaaactctgcatcgaagcaaaaatttcgaacacaaccactgacagccgttgcccgacccagggcgaggccaccctagtggaagaacaggacgccaacttcgtttgccgtcggaccttcgtggaccgcggctgggggaatggctgcgggctctttggcaagggcagcctcataacgtgcgccaagttcaagtgcgtcactaagctggagggcaagatcgtacagtacgagaaccttaaatacagcgtgatcgtgaccgtccacaccggtgaccaacaccaagtaggaaatgagtcaactgagcatggcaccacggcgaccatcactcctcaggcccccacgacagagattcagctcaccgactacggggccctgacattggattgcagcccgcgcactggcttagacttcaacgagatggtcctgctgaccatgaaggagaaatcctggctcgtacacaagcagtggttcttagacctacccctcccgtggacgtccggggcaagcacttcacaggagacgtggaatcgacaagacttactggtgaccttcaaaactgcccacgcgaaaaagcaagaagtcgtagtgctcggctctcaagagggcgcgatgcacaccgcacttacgggcgcgactgagatccagacgtctggaactacgaccatcttcgcaggacatctgaagtgtcgcctcaagatggacaagctgaccctgaagggcatgagctacgtcatgtgcacaggcagctttaagctcgaaaaggaggtggcggagacgcagcacggcacggtgctggtacagatcaagtacgagggcaccgacgcaccctgcaaaatccccttcagtacccaagacgagaagggggtgacgcagaacggccggttaatcaccgctaacccaattgtgaccgacaaggagaaacctgtcaacatcgaagccgagccaccctttggggagtcctatatagtaataggggcgggcgagaaagcccttaaactcagctggttcaagaaggggtccagtatcggcaagatgttcgaggccaccgcacgcggcgcccgcaggatggcaatcttgggagacactgcctgggactttgggtcgatcggtggcgtgtttaccagcgtcgggaagttggtgcatcaaatcttcgggaccgcctacggggtactattttccggcgtgagctggaccatgaaaatagggattggcgtactgttgacatggttgggattgaactcacgcagcacctctctgagcatgacgtgcattgccgttgggctcgtcaccctttatttgggcgtaatggtacaggcggactccgggtgcgtcattaactggaaggggcgggagctcaagtgcgggagcggcatcttcgtgacgaacgaggtgcacacctggaccgaacagtacaagttccaagccgactcaccaaagagattatccgccgccattggcaaggcttgggaggagggggtctgcggcatccggagcgccacccgcctggagaacatcatgtggaagcaaatttccaatgaactcaaccacatcctgctggagaacgacatgaagctaacagttgtggtcggtgacgttgcgggtatcctggcccaggggaagaaaatgatccgtccccagcccatggagtacaagtattcttggaaatcctggggcaaggccaagatcatcggcgccgacgcccagaacaccacctttattattgatgggcccaacaccccagagtgcccagacgaccagagggcctggaacatatgggaggtggaagactatgggttcgggatattcacgactaacatttggctcaagctaagagacagctacacccaggtctgcgatcatcgcctgatgtccgccgccatcaaggacagcaaggccgtgcacgccgatatgggttattggatcgagtccgagaaaaacgagacctggaagctggcccgggccagcttcatcgaggtgaagacttgcatctggcccaaatcgcacacactatggtctaacggggtcctggagtctgagatgatcattccaaaaatctacgggggccccatctcacagcataactaccgccccggctactttacccaaaccgccgggccttggcatctgggcaagttggagctggacttcgatttgtgcgagggaaccacggtggtagtcgacgaacactgtggcaaccgcgggccgtccctcaggaccaccaccgtgacgggtaagatcatccacgagtggtgctgccggagctgcaccttacctccactgaggttcagaggggaagacggctgctggtacgggatggagattcggcccgtgaaggagaaagaagaaaacctcgtcaagtccatggtcagcgccggcagcggcgaggtcgactccttcagcctcgggctgctctgcatctccattatgatcgaagaggtgatgcggagccgctggagtcggaagatgctgatgaccggaacccttgtggtgttcttcctgctaattatggggcagctgacttggaacgacctcatccggctgtgcatcatggtcggcgcgaacgccagcgaccgcatgggcatgggaacgacttatctggccctcatggccacgttcaagatgcggcccatgtttgccgttggtctcctgttccgccgattaacgtcccgtgaggtgctgttactcaccatcgggcttagcctggtcgcgtcggtagaattaccgaatagtctggaggagcttggtgacgggctcgccatgggcatcatgattctgaagctgctcaccgacttccagtcccaccagctgtgggcaacacttctctcactgacgtttatcaagacgaccttttcgctgcactacgcctggaagaccatggcaatggtcctcagcatcgtgtccctgttcccgttatgcctcagcacgaccagccagaaaacaacctggttgcccgtgctattgggcagcttaggatgtaagcctctaacaatgttcctcatcgccgagaacaagatctggggccggaagtcctggcccctgaacgaagggattatggccgtgggaatcgtcagcattcttctctcgagtctgcttaagaacgacgtgccgctcgcggggccattaatcgccggcggcatgctgatcgcgtgttatgtcatcagcgggtcgtccgcagacctctcccttgagaaggccgccgaggttagctgggaggaagaggccgaacactccggggcctcgcataacatcctcgtggaagtacaggacgacggtaccatgaagatcaaggacgaggagcgcgacgacactttaacaatactgctgaaggctacgctcctagctgtatccggggtgtacccgctgtctatcccggctaccctcttcgtctggtacttctggcagaagaagaaacagcgatccggcgtgctgtgggacacgcccagcccgccagaggtagagcgcgcagtcctggacgacggcatttaccggataatgcagcgcggcctgctcgggcgctcgcaagtgggtgtgggggtatttcaagagaacgtgttccacaccatgtggcacgtgacccgcggcgccgtccttatgtaccaggggaagcggctggagccctcatgggcctctgttaagaaagacctcataagctacggtggcggttggcgcctgcagggcagttggaacacgggggaggaggtacaagtcatcgccgtggagcccggcaagaacccgaaaaacgtgcagacggcacccggcacctttaaaacccctgagggcgaggtgggcgccatcgcacttgattttaagcccgggacatcgggctccccgatagtgaacagagagggcaagatcgtgggcctctatgggaacggagtagtgacaactagcgggacatacgtcagcgccatcgcccaggcgaaggcgtcccaggaagggcccctgccggagatcgaggacgaggtgttccgcaagcgaaacctgacgattatggatctccaccccggctccgggaagacgaggaggtaccttccggccatagtgcgcgaggcgatcaagcggaagttacgtaccctcatccttgcgcccacacgcgtggttgctagcgagatggcggaagccctgaagggtatgcccatccggtaccaaactaccgccgttaagagcgagcacacgggaaaggagatcgtggacttgatgtgccatgctaccttcacgatgcgcctcttatcccccgtgagagtgccgaactacaatatgatcattatggacgaggcccatttcacggacccaagcagcatcgcggcccgcgggtacataagcacacgggtgggcatgggggaggcagccgccatcttcatgaccgctacgcctcccgggagtatggaggccttccctcagagcaacgcggtcattcaggacgaggagcgcgacattccggagcggtcctggaactcggggtacgagtggataaccgacttccctggcaaaaccgtatggttcgttccctctatcaagagcggcaacgacatcgccaactgcctccgaaagaacggcaagcgggtaatccaactgtcccgcaagacgttcgacacagagtatcagaagaccaagaacaacgactgggactacgtagtgacgaccgatatatccgagatgggtgcgaacttccgggctgacagggtgatcgatccgcggcgatgcttaaagccgatcattctcaaggacgggcccgagcgggtaatcctagccggtccgatgccggtcacggtcgcgtccgccgcgcagcgccgggggcgtataggccggaaccacaacaaggagggcgaccagtacatctacatgggtcagccgttaaacaacgatgaggaccacgcccactggaccgaggccaagatgctattagacaatatcaacacccctgagggcatcatccccgccctctttgagccggagcgcgaaaagtctgctgcgattgacggtgagtatcgcctccggggcgaggcccgcaagacgttcgtggagcttatgcggcgcggagacttgccggtctggctctcatataaggttgccagcgaggggttccagtactctgaccggcgctggtgttttgacggggagcgtaacaaccaggttctggaagagaacatggacgttgagatctggacgaaggaaggggagaggaagaaactgcggccccgctggctcgacgcgaggacctactctgatcccctggcactgagggagttcaaggagttcgcagccggccggcgcagcgtgtcaggagatctcatcctagagataggcaagctgccgcagcatctaacgcagagggcccagaacgctctggataacttagtgatgctccacaacagcgaacagggcggccgcgcgtaccgccacgccatggaggagctgccggacacgattgagacgcttatgcttctggccctgatcgccgtcctcaccggcggggtgatgctgttctttctatccggacgcggactcggcaagaccagtatcggtttgttatgtgtgatggccagtagcgggctgctttggatggcgagcgtcgagccccactggatcgccgcctcaattatcctggagttctttttaatggtactgctgatccccgagccggaccggcagcggaccccacaggataaccagttggcctacgtcgttatggggctgttgttcatgatactgacagtggccgcgaacgagatggggctgctagagacgaccaaaaaggacttaggcatcgggcatgtggccgtggagaaccatcaccacgccgccatgttagatgtggacctacaccccgcttccgcgtggacactctacgccgtggccacgacaatcatcacaccgatgatgcggcacaccatcgagaacaccaccgccaacatcagcctgaccgccatcgctaatcaagcggcgattctgatgggcctggacaagggctggcccatctcaaagatggacatcggagtccccctgctggcgctcgggtgctactcacaagtgaaccccttaaccttaacagcggcagtactcatgctggtcgcacactacgccataatcgggccgggcctgcaggcaaaggcgacgagggaggcccagaagcgcacggccgctgggattatgaagaatccgactgtcgacggcattgtcgccatcgacttggaccccgtcgtgtacgacgcaaagttcgagaagcagctgggccagatcatgctgctcatcctgtgcactagccagatccttctcatgagaacgacttgggccctatgcgagtcaatcacgctggcgactgggccccttacgactctgtgggagggctcgccgggaaaattctggaacaccaccatcgccgtgagcatggccaacatattccgcggcagctacctggcgggcgccgggctcgcattcagcctcatgaagtccttaggcggcggccggcgtgggacgggcgcacagggcgaaaccctcggggaaaagtggaagcggcagctgaaccaactgtcgaagtcggagttcaatacctataaacgctcaggcattatggaggtcgaccggagcgaggcgaaagaggggctaaagagaggcgagaccacgaagcacgcggtgtcgcggggcactgcaaaactgcggtggtttgtagagcggaacttggtcaagcccgaagggaaagtgatagacctgggatgcgggcgcggcgggtggagctactactgcgccgggctcaagaaagtgaccgaagtaaaagggtatacgaaaggtggcccagggcacgaggagcccatccctatggctacttacggctggaatttggtgaagttgcacagtggcaaggacgtcttctttatacccccggagaagtgcgacacactcctttgcgacatcggagagagctccccaaacccgaccatcgaggaagggagaaccttacgtgtcctcaagatggtggaaccttggctgcggggcaaccaattttgcatcaaaatcctgaacccatacatgcccagcgtggtggaaactctcgagcaaatgcagcgcaagcacggcggaatgctggtgcggaaccccctgtcgcgcaactcgactcacgagatgtactgggtgagttgcgggacggggaatatcgtctcagcagtgaacatgacctcgcgtatgctgctaaaccgcttcacgatggctcaccgcaaacccacttacgaacgtgacgtggacctggggacgggcacccgccacgtcgccgtggagcccgaggtcgccaacctagacatcattgggcagcggatcgaaaacattaagcatgagcataaaagcacctggcactatgacgaagacaacccatataagacttgggcctaccacggaagttatgaggttaagccgtccgggtcagcgtccagcatggtgaacggcgtggtaaagctgctgactaagccgtgggacgtgatccccatggtcactcagatcgcaatgaccgacaccaccccctttgggcagcagcgcgtgttcaaagaaaaggttgacacccggacgccgaaagctaagcgaggcactgctcagatcatggaagtaaccgctcggtggctttggggattcctcagccgcaacaagaagccccggatatgtacccgggaggagttcacccgcaaggtgcgcagcaatgcagctataggggccgtctttgtagacgaaaaccagtggaacagcgccaaggaggcggtagaggacgaaagattctgggaccttgtacaccgcgaacgtgagctccacaaacagggcaagtgtgctacatgcgtctacaacatgatggggaagcgagagaaaaagctgggcgagtttgggaaagcaaagggcagccgggcgatctggtacatgtggcttggcgcccgctttctcgaatttgaggcgctagggtttatgaacgaggaccactggttttcccgcgagaactcgctgagtggcgtggagggggaggggctccacaagctgggctacatcctgcgtgacatcagcaaaatccccggcggcaacatgtatgctgatgacacggcggggtgggacacacggatcacagaggacgacctccagaacgaggcaaagatcacagacatcatggagccggagcatgccctacttgcgaaggccatcttcaaactcacctaccagaataaggtggtccgagtgcagcgcccagccaaaaacggcaccgttatggatgtcatttcccgccgcgaccaacggggtagtggccaggtgggcacgtacgggctgaacacctttaccaatatggaggcgcagctgatacgccaaatggagtccgagggcattttcagcccgagcgagctggagaccccaaacttggcggagcgggcgctagactggttagaaaagtacggagtggagcgtctgaagcgcatggccatcagtggcgatgactgtgtagtgaagcctatagatgaccgctttgccaccgccttaaccgcactcaacgacatgggaaaggtacggaaggacataccccaatgggagccctccaaaggttggaacgactggcagcaggttcccttctgctcccatcactttcatcagctgataatgaaggatggccgcgaaatcgtagtaccgtgtaggaaccaggacgagctggtcggacgcgcgcgagtgtcccaaggcgccgggtggagcctccgggaaaccgcctgcctgggcaagagctatgcccaaatgtggcagctcatgtacttccatcggcgcgatctcagacttgccgcaaacgccatctgttccgctgtgcccgtcgattgggtccccacaagccgcaccacgtggtcaatacacgctcaccaccagtggatgaccacggaggacatgctgagcgtgtggaaccgggtgtggatcgaggagaacccctggatggaggataagacccacatctcctcctgggaggatgtgccgtacctcgggaagcgcgaggaccagtggtgtggctcgctgatcggcctgacggctcgggctacttgggccactaacattcaggtggccatcaaccaggtccggcgcctaatcgggaacgagaactacctggattacatgacctcgatgaaaaggttcaaaaacgaatccgaccctgagggtgccctgtggtga

SEQ ID NO: 23823 - RNA, 9879 nt, synthetic construct
  misc_feature 1..9879: note = derived and/or modified CDS sequence (opt11) from DENV-1__FJ639678__SS-prME
  source 1..9879: mol_type = other RNA
agcgtgaccatgttactcatgctgatgcccaccgctttagccttccacttgaccacccggggcggagaaccgcacatgatagttagcaagcaagaacggggcaaggcgcttctgttcaagacgtcggcgggagtgaacatgtgcacactcatcgcaatggacctgggggagttatgcgaggacaccatgacttacaagtgcccgcgtatcacagaggtggagcccgacgacgtcgattgctggtgtaacgccaccgatacgtgggtaacctacgggacctgcccacagaccggggagcaccgaagagaccggcgctcagtggccctcgcgccccatgtcggcctgggcctagagacacgggcagagacgtggatgtcgtctgagggggcctggaagcagattcaacgcgtggagacctgggctctcaggcatcccgggttcaccgtaatcgcactgttcctggcccacgccatcggtaccagcatcactcagaaaggcatcatcttcatacttttaatgttggtcacaccgtccatggcaatgcgctgcgtcggcatcggtaaccgggatttcgtggaggggttaagcggcgccacctgggtagacgtggttctggagcacggatcctgcgtcacgaccatggcgaaggataagcccaccctggacatcgaactcctgaaaaccgaggtgacaaacccggcagtgctgcgcaagttgtgtattgaggccaaaatcagtaacaccaccaccgattctcggtgccccacgcagggggaggccacgctggtcgaagaacaagacgctaatttcgtatgccgacggacctttgtggacaggggctggggtaatggctgcgggctgttcggcaaggggtccctcattacgtgcgcgaagttcaaatgtgtcacaaagctggaggggaagatagtgcagtacgagaatttaaaatactccgtgattgtcaccgtgcacaccggcgaccagcaccaggtcgggaacgaaagtacagagcacggcacgaccgccacgatcacaccccaggcccccacctccgagattcagctaactgattacggggcgctcacacttgattgcagcccgcggaccggcctggacttcaatgagatggtgctgcttaccatgaaggaaaagtcctggcttgtgcacaagcagtggttcttagacctccccctcccatggacgagcggcgccagtaccagccaggaaacatggaaccgccaggacctccttgtgaccttcaagactgcacacgcaaaaaaacaagaggtcgtcgtactcgggagtcaggagggcgcaatgcataccgcgcttaccggggccaccgagatacagacttcgggtacgaccaccatcttcgcgggacacctaaagtgccggcttaagatggacaagctgacgctgaagggcatgagctacgtgatgtgcaccggatccttcaaactcgaaaaagaagtggccgagactcagcacggcactgtcctggtgcaaataaagtatgagggcacggatgccccttgcaagattccgttttcaacccaggacgagaagggggtgacccagaacggcagactcatcacagccaatcccattgtcacagacaaggagaaacccgttaatatcgaggcagagcccccgttcggggaatcctacatcgtgatcggggccggggaaaaggcactgaagctcagttggttcaagaaaggttccagcatcggcaaaatgttcgaggctacagcccgcggtgcccgccggatggcaatcctgggcgataccgcttgggacttcgggtccatcgggggcgtctttacctcagtcgggaagttggtgcaccagattttcggcacggcctatggggtgctatttagcggtgtctcgtggaccatgaagatcggaatcggtgtgctgttaacctggttaggcctgaacagtcggagcacctccctgagcatgacgtgcatagccgttggcctcgtgactctgtacctgggtgtgatggtacaggcggactccggatgcgtaatcaactggaaaggcagagagctcaagtgcgggtcgggcatcttcgtcaccaacgaagtacatacctggactgagcagtacaagttccaagccgactcccccaaacggctgagcgccgccattggcaaggcttgggaagaaggggtgtgcggcatccgttctgcgacccggctggagaacatcatgtggaagcagatctccaacgagctcaaccacatccttctagaaaacgacatgaagttcaccgtggtcgtaggtgacgtggtaggcatcctcgcccaggggaagaagatgattaggccccaaccaatggaatataagtatagctggaagtcctggggcaaggctaagatcataggcgctgatattcagaacacgacctttattatcgacgggcccaacacgcccgagtgtccggatgaccagcgggcgtggaacatctgggaagtggaagactacggcttcggtatctttaccaccaacatttggctgaagctgcgtgactcttacacgcaggtgtgcgaccaccgccttatgtccgccgcaatcaaggacagcaaagccgtccacgcagacatggggtactggatcgaaagtgagaaaaacgagacttggaaactggcgcgcgcctcgttcatcgaggtaaaaacatgcatctggcctaagtcccacacactatggagcaacggagtgttagagtccgagatgatcatcccaaagatatacggaggcccaatctcccagcacaactatcgacccgggtacttcacccaaacagccggtccgtggcacctagggaagcttgagcttgattttgacctctgcgagggcacaaccgttgtggtcgacgagcactgcggcaaccgcggtccctcattacggaccaccacggttacaggcaagatcatccacgagtggtgctgccgcagctgtactctaccgcccctccggtttaagggggaggacggctgttggtatggtatggagatcagaccggtaaaggagaaggaggagaatctggtgaagagcatggtatcggccggctccggcgaggtggattccttctctttaggcctgctgtgtatcagtatcatgatcgaggaagtaatgcggagtcgctggtcccggaagatgctcatgacgggcaccctggccgtcttcttcctgctcattatggggcagctgacctggaacgatctgatcagactctgcatcatggtgggcgccaacgcaagcgaccgcatgggaatgggcaccacatacctggccttgatggccacattcaagatgcggcctatgttcgccgtgggcttactgtttagacggctgacctcccgggaggtcctcctcctgaccattgggctcagcctggtggcgtcggtagagctgccgaacagcttggaggagctgggcgacgggctggccatgggcataatgatcctcaagttgctaacggacttccaatcgcaccagctatgggccactctgttaagcctcactttcataaagactacattcagcctgcactacgcctggaagaccatggccatggtgctgtcaatcgtatctctcctgcccttatgcctctcgacgacatcccagaagactacatggcttccggtcctgttaggcagcctggggtgcaagcccctgaccatgttcctgatcgcggagaacaagatctggggacgtaagtcctggcccctgaacgaggggattatggccgtcggtattgtgagcatactcctctcaagccttttaaagaatgatgtccccctggcaggcccgctgatcgccggcggcatgctgatcgcgtgctatgtcatcagcggaagctctgcagacttatccctggagaaggccgcagaggtgtcatgggaggaggaagccgagcactccggcgcgagtcataacatcctggtggaagtgcaggacgatgggaccatgaaaatcaaggacgaagagcgtgacgacacgttaactatcttgcttaaggctacactcctggcggtgtccggcgtctaccctctgagcatccccgccactctcttcctgtggtacttctggcagaagaagaagcaacggtcaggtgtgttgtgggacaccccgagcccgccagaggttgagcgcgccgtcctggacgacggcatctaccggattatgcagcgcggattactggggcggtcgcaggtgggcgttggggtcttccaggaaaacgtgtttcacacgatgtggcatgtgacccgaggagctgtcctgatgtaccaggggaagaggctcgaacccagctgggcctccgtgaagaaggacctgatctcgtacggcggcggttggcgcctgcagggttcctggaacaccggtgaggaggtgcaggtcatcgcagttgaacccgggaagaacccgaagaacgtgcagaccgcccctgggaccttcaaaaccccggaaggcgaagtgggtgccattgcgctcgacttcaagcccggaacttccggctccccgatagtaaaccgggaagggaaaatcgtgggcctgtacggtaacggggtggtgaccacgagcgggacctacgtatccgcaatcgcccaggccaaagcttctcaggaggggcccttgccggagatcgaggacgaagtctttaggaaacgcaacctcacgataatggacctgcacccgggcagcggcaaaaccaggcgctacctgcctgccatcgtacgcgaagctatcaagcggaaattacgcacgctgatcctggcgcccaccagggtggtcgcctccgagatggcagaggcgctcaaaggtatgcccatccggtaccaaaccaccgccgtaaagtcggagcacacggggaaggaaatcgtagacctgatgtgccacgccaccttcaccatgcgcctgctctctccggtccgggtccccaactacaacatgataatcatggacgaggctcactttaccgatcccagcagcattgcggcccgcggatacatttcgacgcgagtgggcatgggggaggcagccgccatcttcatgaccgcgaccccgccaggctcggttgaagcctttccccagtctaatgcagtcatccaggacgaggagcgagacatccccgagcggtcctggaattcggggtacgaatggatcacagacttcccgggaaagacggtgtggttcgtcccctccatcaagagcggcaacgacatcgcgaactgcctacgcaagaacgggaagcgggttatacagctgtcccgcaagaccttcgacaccgagtatcagaaaaccaagaataacgactgggactacgtggtcactaccgacatctctgagatgggcgccaactttcgggcagaccgtgtgatagacccccggcgttgcctgaagccggttatcttaaaggacggacaggagagggtcatcctggccggtcccatgccggtgacggtcgcttccgccgcgcagcgccgggggcgcatcggtagaaaccacaataaagaaggcgaccagtacatctacatggggcagcccctaaataacgacgaggatcatgcccactggaccgaggccaaaatgctgctggataacatcaacacgcccgagggaatcatccctgcgctcttcgagccggaacgcgagaagtccgccgcgatagatggggagtaccgactgcgaggtgaggcacgcaagaccttcgtagagctgatgcggcgaggggacctccccgtttggctgagctacaaggtcgccagcgaaggctttcagtactccgatcggcgttggtgctttgacggcgagagaaacaatcaagtactggaagagaacatggatgtcgagatctggaccaaggagggtgagaggaagaagctccgacccaggtggttagacgccaggacatatagcgacccactggccttgcgcgagttcaaggagttcgcggcggggcggcggtccgtgtcgggcgacctgatactcgagatcggcaagctcccgcagcacctgacgcagaaggcccaaaacgccctagataatctcgtcatgctgcacaacagcgagcaaggtggccgggcgtatcgccacgctatggaagagctacccgataccatcgagaccttaatgttgctggccctaattgcagtgctgacgggcggggtcacgctgttcttcctctccggccgtggactgggtaagactagcataggacttctctgcgtgatggcgtccagcgcgctcttatggatggcctccgttgagccgcactggatcgcggcctctatcatccttgagttctttctgatggttctgctcatacccgaaccggaccgccagcgtacaccacaggacaaccaactggcctacgtcgtgatcggcctcctgtttatgatcttaacagtcgctgcgaacgagatgggactgctcgagaccacgaaaaaggacctggggatcggccacgtcgccgtcgagaaccatcaccatgctactatgcttgacgtcgatctacaccccgcctccgcgtggaccctgtacgcagtcgccaccactatcataaccccaatgatgcgccacacaattgagaacaccacggctaacatcagcctgaccgccatcgcaaaccaggccgcaatcctcatggggctggacaagggctggccgatctccaagatggacatcggcgtgccactactcgccctagggtgctactcacaggtcaatcccctgacccttacagcggcggtactgatgctggtggcccactatgccatcatcggccctgggctccaggcgaaagctacgcgggaggcacagaagcgcacggcagccggcataatgaaaaaccccactgtcgacgggatcgtagctatcgacctggatcccgttgtctacgacgcaaagttcgagaagcagcttggccagatcatgctcctgatcctgtgcaccagccagatcctactgatgcgcacgacttgggcactgtgcgagagcatcaccttagccaccgggcccctgactactctgtgggaagggtcaccgggcaagttttggaacaccaccattgccgtgtccatggccaatatcttccggggctcctatttagcgggcgccggcctggcattcagcctcatgaagtcgctggggggaggacgaaggggcacgggtgctcagggggagacacttggagagaagtggaagcgccagctgaaccagttgagtaagagcgaattcaacacatacaagcggtccgggataatggaagtggacaggagcgaagccaaagagggtctgaagcgtggcgagacaacccgccacgcagtcagtcggggcaccgccaagttacgatggttcgtggagcgcaacctggtgaagcctgagggtaaggtcatcgacctcggctgcgggcgcgggggatggagctactactgcgccgggttgaagaaggtcaccgaggtgaagggctataccaagggcgggcctggccacgaagagccgatcccgatggctacgtacggttggaacctggtcaaactccattccggcaaggacgtgttcttcatcccgcccgagaagtgcgacacattgctgtgcgatatcggtgagtcttccccaaaccccactatagaggagggtaggaccctccgcgttcttaagatggtcgagccttggctgcgggggaaccagttttgcatcaagattctcaacccctatatgcccagcgtggtggagacgctggagcagatgcagcgcaagcacggcggcatgctggtccggaatccgctctcccgcaactcaacccacgaaatgtactgggtgtcctgtgggaccggcaacatagtgagcgctgtcaacatgacgtctcggatgctgctcaacaggttcaccatggcccaccgcaaaccaacttacgagcgcgatgttgaccttggggccggcacccgtcacgtggctgtggagcctgaggtggccaacctggacatcatcggccagcggatcgaaaacattaagcatgaacataagagcacctggcactatgacgaagacaacccctataagacgtgggcgtaccatggctcctacgaagtaaaaccgagcggctcagccagctcgatggtcaacggggtggtcaaactgctcacgaagccctgggacgtgattcctatggtgacccagatagcaatgaccgatacgacgcccttcggccagcagcgcgtgttcaaagaaaaggtggacacccggaccccgaaggcaaaacaggggaccgcccagatcatggaggtgacggctagatggctgtggggattcctgtctcggaacaagaagccccgcatatgcacccgggaggagttcacgcgcaaggtccgaagcaatgccgcgattggggccgtctttgtggacgagaaccagtggaactctgcaaaggaggctgtcgaggacgagcgcttctgggatctagtgcacagagagcgcgagctgcacaagcaaggaaagtgcgcgacctgcgtgtataacatgatgggcaagagagagaagaagctgggggagttcggcaaggccaaggggagccgcgcgatatggtacatgtggctcggtgctaggttcctggagtttgaagccttagggttcatgaacgaggatcactggtttagccgcgagaactctctctcaggggtcgaaggcgaaggcctgcacaagctgggctacattctccgagacataagcaaaatccctggtggcaatatgtatgccgatgacactgccggatgggacacgcgcatcacagaggatgacctgcggaacgaagccaagatcaccgacatcatggagcccgaacacgcgctcctcgccacgtcgatcttcaagctgacctaccagaacaaggtggtgagagtgcagcgcccggccaagaacgggaccgtgatggacgtgataagccggcgcgaccagcggggctccggtcaagttggcacctacggccttaacacatttaccaatatggaggcccaactcattcgccagatggaaagcgaagggatcttttccccgtcagagctcgagactcccaacttagctgagcgggtattagactggctggagaagtacggcgtggagcgcctgaagcgaatggcgatctcaggtgacgactgcgtggtcaagccgatagacgaccgtttcgcgactgcgctaactgcgctgaatgacatgggcaaggtccgtaaggacatcccccaatgggagccgagtaagggctggaacgactggcaacaggtccccttctgctcccatcacttccaccagttaattatgaaggacggccgcgagattgtggtgccgtgccgaaaccaggatgagctcgtgggtcgtgctcgggtgagccagggggcgggctggtccttacgcgagaccgcctgtctgggcaagagctacgcccagatgtggcagctaatgtatttccaccggcgcgacctgcggctggctgcaaatgccatctgtagcgctgtccccgttgactgggtgcccaccagcaggaccacgtggtccatccacgcgcaccaccagtggatgacgaccgaggacatgctctccgtgtggaatagagtctggatcgaagagaacccgtggatggaggacaagacccacatcagctcctgggaggacgtgccttacttaggcaagcgtgaagaccagtggtgcgggagcctgatcgggctgacggcccgcgccacgtgggcaaccaacattcaggtggcaataaaccaggtccggcgcctgatcgggaatgagaactatctggactacatgaccagcatgaagcggttcaagaacgagtcggaccctgagggagcgctctggtga

SEQ ID NO: 23824 - RNA, 9879 nt, synthetic construct
  misc_feature 1..9879: note = derived and/or modified CDS sequence (opt11) from DENV-1__FJ639679__SS-prME
  source 1..9879: mol_type = other RNA
agcgtgaccatgctgcttatgctaatgcccacggcactcgccttccacctcaccacccgcggcggggagccccacatgatagtctccaagcaggagcggggcaagtctctactattcaagacgagtgccggggtgaacatgtgcaccctcatcgctatggacctgggcgagctgtgcgaggacactatgacctacaagtgcccccggatcaccgaggcagagcccgatgacgttgactgctggtgcaacgcaaccgacacgtgggtgacctacgggacctgctctcagacgggcgaacaccggagagacaaacggtcggttgccctggcgccccacgtgggcttggggctagagacgcgcaccgagacctggatgagctccgagggcgcctggaagcaaatccagcgggtcgagacttgggccctccgccacccggggtttacggtgatagccttatttctggcgcacgctatcggcactagcatcacccagaaggggattatctttatcctcctgatgctcgtcactccctccatggccatgcggtgcgtcggcatcggcagccgcgatttcgttgaggggctctctggggccacgtgggtagacgtggtactggagcacgggagctgcgttaccacaatggccaaagacaagcccaccctggacatcgaactcctgaagacagaagtcaccaatcccgcgatcctgcgtaagctctgcatcgaggccaaaatctccaacaccaccacggacagccgctgcccgacacagggcgaagccacactggtggaggaacaggatgccaacttcgtgtgtcggaggaccttcgtcgaccgaggctgggggaatggctgcgggctgttcggaaagggatccctaataacgtgcgccaagttcaagtgcgtgaccaagttggagggcaagatcgtgcagtacgagaacctgaaatacagcgtcatcgtgacagtgcacaccggagaccaacaccaggtcgggaacgagtcgacggagcacggcacaaccgcgactatcacgccacaggcacccaccaccgagatacagttaacggactacggtgccctgaccctagactgcagcccccgcacgggcctcgatttcaacgaaatggtgctgctaaccatgaaagagaaatcctggctcgtccacaagcagtggttcctggatttgcccctcccctggacctcaggagcctcaacctcccaggagacgtggaaccggcaggacctgctggtgaccttcaagaccgcccacgcgaaaaagcaggaagttgttgtgctcggctcccaggagggcgccatgcataccgccctgacgggggccacagagatccagacctcaggcaccactaccatctttgccgggcacctgaaatgccgcttaaagatggataagctgaccctgaagggcatgagctatgtgatgtgcaccggttcctttaagctcgagaaggaggtggcagaaacgcagcacggcaccgtgctggtccagatcaagtatgagggaaccgacgccccatgtaagatcccgtttagcacccaggacgagaagggcgtcacgcaaaacggccggctgataaccgccaacccgatcgtgacagacaaggagaagcccgtgaacatagaggccgagccgccattcggggagtcctacatcgtcatcggagctggcgagaaggccctgaagctcagctggttcaagaaggggtcatcgatagggaagatgttcgaggccaccgcccgcggcgctcggcgtatggcaatactgggagacacggcctgggatttcgggtccattggtggcgtgttcactagtgttgggaaactggtccaccagatcttcgggaccgcctacggggtactattctccggggtgagctggacaatgaagatagggatcggcgtcctcctgacttggctcggcttaaattcccgcagcacgagtctgagcatgacctgcatcgccgtcgggctcgtgaccctgtacctgggcgtcatggttcaggccgactccgggtgcgtgatcaactggaagggccgggagctcaaatgcgggagcggcatcttcgtcacgaacgaggtgcacacgtggacggagcagtacaagtttcaggctgacagcccgaagcgcctgtccgccgccatcggcaaagcctgggaagagggggtgtgtgggattcggtcggccaccagactcgagaatatcatgtggaagcaaatcagcaacgagttgaatcatatcttacttgaaaacgacatgaagtttaccgtggtggtgggggacgtcgcgggcatcctcgcccaggggaagaaaatgatccggccgcagcccatggagtacaagtacagctggaagtcatggggcaaagccaagattatcggcgcggatgtgcagaacaccaccttcattatcgacgggcccaatacccctgagtgtcccgatgatcagcgcgcctggaacatctgggaggtggaagattacggcttcgggatcttcaccacgaatatctggcttaagctgcgggactcttacacccaggtatgcgaccacagactcatgtccgccgctattaaggacagcaaggccgtgcacgccgacatgggttactggatcgaatcagagaagaacgagacttggaagctagcgagggcctccttcatcgaagtgaagacgtgcatctggcccaagtcccatacgctgtggagcaacggcgtcctcgagtcggagatgatcatcccgaagatttacgggggtcccattagccagcacaactataggcccgggtactttacccagaccgccggcccctggcacctgggtaagttagaactcgactttgacctgtgtgagggcactaccgtggtggtcgacgagcactgcggcaataggggcccgtccctgcgcaccaccaccgtgaccggcaagataatccacgagtggtgctgccggtcttgcaccctgccccccctccgcttccgtggggaggacggctgctggtacggtatggagatacgcccagtaaaagagaaggaggaaaacctggtcaagtccatggtgagcgccggctcaggcgaggtggactccttctcactcgggctgctgtgcatctcaataatgatagaggaagttatgcggagccggtggtcccggaagatgctcatgactggtactctggccgtgttcctcctcttgatcatggggcagctaacatggaacgacctcatccgcctgtgcatcatggtgggcgccaacgcgagcgaccgcatggggatgggaaccacatacctcgccctcatggcaaccttcaagatgcggccgatgttcgccgtcgggcttctgttcagacggctcacctcccgcgaagtgctgctgctcaccatcggccttagtctcgtggcttccgtcgagctccctaatagcctggaggagctgggcgacgggctcgccatgggcataatgattctgaagttactcaccgacttccagtcccaccaactgtgggccacccttctatccctgacgttcatcaagaccacgttctcattacactacgcctggaagaccatggcgatggtattgagcattgtctccttattccccctttgcctctctacgacttcccaaaaaaccacatggctgcccgtgctgctgggctctctggggtgcaagccgctgaccatgtttctcatcgcggagaacaagatctggggtcggcgctcctggccgctgaacgaggggataatggccgtaggcatcgtcagcattcttttgagttcccttctcaagaacgacgtgccgctagcggggcccctgatcgcaggcggcatgctgatcgcttgctacgtgatcagcgggagcagcgcagacctctccttggagaaagccgcagaggtcagctgggaagaagaggcggagcacagcggcgcgagccataacatcctggtggaggtgcaggatgacggaaccatgaagataaaagacgaggaacgggacgataccctcaccatcctactgaaggcgaccctcctggccgtctccggagtgtacccgctgtctatccccgccaccctctttgtgtggtacttctggcaaaagaaaaagcagcgctccggggtcctgtgggacacccccagcccgcccgaagtggagcgggcagtgctagacgacggaatttaccggatcatgcagcgcggcctgctcgggcgttcccaggtcggcgttggggtgttccaggagaacgtcttccacaccatgtggcacgtcactagaggtgcggttctgatgtaccaggggaagcgcctggaacccagctgggcctcggtcaagaaggacctaatcagctatggcggcgggtggcgactgcaaggctcctggaacacgggggaggaggtccaggtgatagccgtcgagcccggcaagaacccaaagaacgtgcagacagcccccgggaccttcaagacccccgagggtgaggtgggggccatcgccctggacttcaagccagggacgagcgggagcccaatcgtaaaccgcgagggcaagatcgtaggcctctatggcaacggcgtcgtaacgaccagcggcacctacgtgagcgccatcgcccaagcgaaggcgtcccaagaggggccgttacccgaaatcgaggacgaggtcttccggaagcgcaaccttacgatcatggacctccatcctggcagcgggaaaacccggcgctatctgccggccatagtacgtgaggccatcaagcgcaagctgcgcaccctcatcctggcccccacccgggtagtggcgtccgaaatggctgaagccttgaagggcatgcccatccgctaccagacgaccgccgtcaagtctgagcacaccggcaaagagatagtggacctcatgtgccatgccaccttcactatgcggttactgtcccctgtgcgagtcccgaattacaacatgatcatcatggatgaagcccacttcaccgacccctcgagtatcgcggcccgtgggtacatctctacccgggtgggcatgggggaggccgccgctatcttcatgactgcgactccgcccggctccgtcgaggcgttcccgcagagcaatgccgtcattcaggacgaggaaagagacatccccgaacgctcctggaactcaggttacgaatggatcaccgatttccccggcaagaccgtgtggtttgtgccgagcatcaaaagcggtaacgatatcgccaactgcctccgtaagaatggtaaacgagtcatccagctttcccggaaaaccttcgatacggagtaccagaagaccaagaataacgactgggattacgtggttaccaccgacatttcggagatgggcgcgaactttcgcgccgaccgggtaatagacccgcgccggtgcctgaagcccgtcatcctcaaggatgggcccgagcgcgttatcctggccggccccatgccggtcaccgtggcctccgctgcccagcggcgcgggcggatcggccgcaaccacaacaaagagggcgaccagtacatctacatggggcagcccttaaataacgacgaagaccacgctcactggaccgaagcaaaaatgttactggacaacatcaacaccccggagggtatcatccccgcccttttcgagccggagcgtgaaaagtccgcagcgatagacggtgagtatcggctccgaggcgaggcccgaaagactttcgtcgagctgatgagacgcggggacctgccggtgtggctctcctacaaggtggccagcgagggcttccagtactcggaccgccggtggtgcttcgacggcgagcgcaacaaccaagtcctggaggagaacatggacgttgaaatctggacgaaggaaggggagcgcaagaagctgcgcccgaggtggctcgacgcccgcacctactcggaccccctcgccttacgggaattcaaggagttcgcggccggcaggcggagcgtgtccggggacctaatcctggagatcggcaagctgccgcagcacctcacccagcgcgcccagaacgccttggacaacctggtcatgctccacaacagcgagcaaggcgggcgcgcgtaccgccacgccatggaggagctgcccgacaccatcgagacgttgatgctcctggcccttattgcggtgctcaccggcggggtgaccctgttctttctgtccggccgggggctcggcaagaccagtatcggactgctgtgtgtcatggcctccagcgtcctattatggatggcgtcagttgagccacattggatcgccgcttccataatcctggagttcttcctcatggtcctgctcatccccgaacctgaccgccagcggacgccccaggacaaccagctcgcttatgttgtgattggcttgctgttcatgatcctgacggttgccgcgaacgagatgggcctgttggaaaccaccaagaaggacctcgggatcggccatgtagctgtcgggaaccaccaccatgcggccatgctggacgtcgacctgcaccccgcctcagcgtggaccctctacgcagtggccacgaccataatcacgcctatgatgcgccacaccatcgagaatacgaccgccaacatcagcttaacagccatcgcgaaccaggccgccatcctgatgggcctcgacaagggctggcccatatccaagatggacatcggggtgccgctgctagctctcggctgctacagccaggtcaaccccctgaccctgacggcagccgtgctcatgctggtggctcactatgctataatcgggccgggcctgcaggcaaaggcgacccgcgaggcgcaaaagcggacagcggccgggatcatgaagaaccccaccgtcgatggtatcgtggcgatcgatttagaccccgtggtctacgacgctaagttcgaaaagcagctgggccagatcatgcttctcatcctgtgcacttcgcagatcctgctcatgcgcacgacctgggccctttgcgagagtatcacactggctacgggccccctaaccaccctgtgggagggaagtccggggaagttctggaacaccacgatcgcggtaagcatggccaacatcttccgggggtcctacctggccggggccggtctcgcattcagcctgatgaagtccctgggcgggggccgccgggggaccggcgcccagggcgagaccctcggggagaagtggaagcgacagttgaaccagctgtccaaaagcgagttcaacacctacaagcgatccggcattatggaggtggatcgcagcgaggctaaggagggcctcaagcggggcgagacgaccaagcatgctgtctcccgcgggaccgccaagctacggtggttcgtggaacgcaaccttgtgaaacctgagggcaaagtcatcgacctgggctgtggccggggagggtggtcctactactgcgcaggcctcaagaaagtgactgaggtgaaggggtacacgaagggcggccccggtcacgaggagccgatcccgatggccacctacgggtggaacctggtaaagcttcactccgggaaagacgtgttcttcatcccgcccgagaagtgcgacaccctcctgtgcgacatcggcgagagttcacccaatccgacaatcgaggaggggcgcacgctgcgggtgctaaagatggtcgagccctggctgcggggcaaccaattctgcatcaagatccttaacccctacatgccctccgttgttgagacgctcgaacagatgcagaggaagcacggcgggatgcttgtccgcaaccctcttagccggaacagcacccacgagatgtactgggtgtcctgtggtaccgggaatatcgtgagcgcggtcaacatgacctcccgtatgctcctgaaccgcttcacgatggcccatcggaagcccacgtatgaacgcgacgtggacctgggtgccggcacccggcacgtggcagtcgagcccgaggtggctaacctcgacatcatcgggcagcgcatcgagaatataaagcatgaacacaagtcgacatggcattacgatgaggacaatccctacaagacgtgggcttaccacggctcctacgaggtcaagcccagcggatccgccagcagcatggtcaacggcgtggtcaagttgctgacgaagccttgggacgtgatccccatggtaacccaaatcgctatgaccgacacgacccccttcgggcagcagcgggtcttcaaggagaaagtggatacccgcacaccgaaggctaagcggggcacggctcagatcatggaggtcaccgcgaagtggctttggggatttctgtctcgcaacaagaagccccggatctgtaccagggaagagttcacccggaaggtccgcagcaacgccgccattggggcggtgttcgtggacgaaaatcagtggaactccgcgaaggaggccgtcgaggatgagcgattctgggacctggtgcaccgcgagcgggaactgcacaagcagggcaagtgcgccacgtgcgtgtacaacatgatggggaagagagagaagaagctgggggagttcgggaaggccaagggcagtagagcaatttggtacatgtggttaggggcgcgattcctagagttcgaggcgcttgggttcatgaacgaggaccactggttctcccgggagaattcactgtcaggtgtcgagggtgagggtctgcacaagcttgggtacatattgcgcgatatcagcaagatccccggtggtaacatgtatgccgatgacacggctgggtgggacacaaggatcacggaggacgatttacagaacgaagctcgaatcactgacatcatggagccggagcacgcgctccttgctaagtccatcttcaaactaacttaccagaacaaagtggtgcgcgtccaacggccggccaagaacggcaccgtgatggacgtgatcagccgccgggatcagcgcgggtcaggccaggtcggtacctacggactcaacacgttcacgaacatggaggcccagttaatccggcagatggagagcgagggcatcttctcccccagcgaattggagacccccaacctggccgcacgcgtgttggattggctcgagaagtatggagtggagcgactcaagcgcatggctatctccggcgacgattgcgtcgttaagccgatcgacgaccggttcgccaccgccctgacggccctcaacgacatggggaaagtgcgcaaggatattccacagtgggaaccctcgaagggctggaacgactggcagcaggtccccttctgctcccaccacttccaccagctgatcatgaaggacggccgggagatcgtggtaccctgccgcaatcaggatgagcttgtagggcgggcgcgcgtgtcgcagggcgccggctggagcctcagggagaccgcctgcctgggcaagtcgtacgcccagatgtggcagctgatgtacttccaccgccgggatctccgtctagcggccaacgctatctgcagcgcggtccccgtcgactggatccccacatcccggaccacatggagcatccacgcccaccaccaatggatgaccaccgaggacatgttgtccgtctggaaccgcgtgtggatcgaagagaacccctggatggaagataagacccacatctcgtcctggggtgacgtgccgtacctgggcaagcgcgaagaccagtggtgcggcagtctgatagggctgacagcgcgggccacctgggccaccaacatccaagtagctatcaatcaggtgcgccggctcatcggcaacgagaactatctggactatatgacctccatgaagcgcttcaagaacgagtctgaccctgagggggcactgtggtga

SEQ ID NO: 23825 - RNA, 9879 nt, synthetic construct
  misc_feature 1..9879: note = derived and/or modified CDS sequence (opt11) from DENV-1__FJ850069__SS-prME
  source 1..9879: mol_type = other RNA
agtgtgactatgctgttaatgctcatgcctacggccctggcctttcatctgaccacccgcggcggggagcctcatatgatcgtcggcaaacaagagcgtggcaaaagcctgctgttcaagacgagcgctggagtgaacatgtgcaccctcatagccatggacctcggcgagctctgtgaggacacgatgacctacaagtgcccccgcattaccgaggtggagcccgacgacgtagactgctggtgtaacactaccgacacgtgggtcacctatgggacctgcagccagactggagagcatcggcgcgacaagcggagcgtggccttggcgccccatgtcgggctgggcctggagacccgggctgagacctggatgagcagcgagggggcatggaaacagatccagcgcgtggagacatgggccctccggcatcccggcttcacggtgatcgcactgttcctggcccacgtcatcgggacatccatcacccagaagggaattatcttcatcctcttaatgctggtaacccccagcatggcaatgcggtgtgtgggaatcggctcccgcgacttcgtcgagggcttatccggagcaacttgggtagatgtggtcctggagcatggctcctgcgtcacaaccatggcgaaggacaagccgacgctggacatcgagctactgaagacagaagtgaccaaccccgctgttttgcggaaactctgcatcgaggctaagatcagcaacactaccacagactcccggtgcccgactcagggcgaggcgaccttagtggaagaacaagacgccaacttcgtgtgccgtcgcaccttcgtcgaccgggggtggggcaacgggtgcggcctgttcgggaagggctctctcatcacgtgcgccaagttcaaatgtgtgacgaagctggagggcaagatagtgcagtacgagaacctgaaatactccgtcatcgtgacagtgcacaccggggatcagcaccaggtaggcaacgagagcacggagcacggtacaactgccacgatcacgccccaggccccgacgagtgaaatccaactcactgattacggagcactaaccctggactgcagcccccgcaccgggctcgacttcaacgagatggtcctcttgacaatgaaggagaagtcctggctcgtacacaagcagtggttcctggacttacccttaccctggaccagcggcgccagcacctctcaggagacttggaaccggcaagacctgctggtgacgttcaaaaccgcccacgccaaaaagcaggaagtggtcgttcttggcagccaggaaggggccatgcatacagcgctgactggcgctacagagatccagacctccgggaccaccacgatcttcgcagggcacctgaaatgccgcctcaagatggacaagctgactttgaaagggatgagctacgtaatgtgcacgggctctttcaagttggaaaaggaggtcgccgagactcagcacggtacggtgttagtgcagatcaaatacgaggggaccgacgccccctgcaagatccccttctctacccaagatgagaagggggtcacccagaatgggaggctgatcacggcaaatcctatcgtgaccgacaaagagaagcccgtgaatatcgaggccgagccgccctttggcgaatcctacatcgtcattggcgcaggggagaaggccctgaagctcagctggttcaagaagggttccagcatcgggaagatgtttgaggcaaccgccagaggcgcccggcgcatggccattttaggagacacagcctgggacttcggctccattgggggggtatttacctccgtgggcaagcttgtgcatcagatcttcgggacggcgtacggcgttcttttttccggagtaagctggaccatgaagatcggcatcggagtcctgctgacctggttagggctgaactcccgatcgacaagtctttccatgacctgcatagccgtgggcctcgttaccctgtatctgggtgtcatggtacaggccgactcgggctgcgtgattaactggaagggtagagagctgaagtgcgggagtggaattttcgtgacaaacgaggttcacacatggaccgagcagtacaagttccaggccgacagccctaaacgcctgtccgccgcgatcgggaaggcctgggaggagggcgtttgcgggatccggagcgccacccgcctggagaacattatgtggcggcagatcagtaacgagctcaaccatattcttctggagaacgacatgaagttcacagtcgtcgtaggcgacgtcgtagggatccttgcccaggggaagaaaatgatccggccgcagcctatggagcataaatacagctggaagtcctggggcaaggccaagatcatcggggcggacgtccaaaacacgacgttcatcattgatggcccaaacaccccggagtgccccgacgaccagagagcctggaacatctgggaggtcgaggactacggtttcggcatcttcaccaccaatatttggctgaaactgcgcgacagctacacccaagtgtgcgaccaccgattaatgtctgccgccatcaaggacagcaaggccgtccacgcggacatgggctactggattgagagcgagaagaacgagacgtggaagctggcacgcgccagcttcattgaagtcaaaacatgcatctggccaaagtcccacaccctgtggagcaacggtgtgctcgagtcagagatgatcatacccaagatctacggcgggccgatcagccagcacaactatagacccggctatttcacgcagaccgccgggccctggcacctgggaaagctggagctcgacttcgacctttgcgaaggtaccactgtggtcgtggatgagcactgcggtaacaggggcccatctctgcggacgaccaccgttaccggtaaaatcattcacgagtggtgctgtagatcatgcacgctgccacccctccggtttaagggcgaagacgggtgctggtacggcatggaaatccgccctgtcaaggaaaaagaagagaacctggtgaagagtatggtgagcgcgggcagcggggaagtcgactccttcagcttaggactcctgtgcatctccatcatgatcgaggaagtgatgcgaagccgctggtcccgaaaaatgctcatgaccgggacactggcagtgttcttcctgttaatcatgggccagctcacatggaacgacctgatcaggctctgcatcatggtcggcgcgaacgcaagcgatcgcatgggcatgggaaccacctaccttgccctgatggcgactttcaagatgcgtccgatgtttgccgtagggctcctgttcaggcggctgacaagtagggaggttctcttgctgacaatcggtctcagccttgtggcctctgtagagctgcccaacagcctcgaagaactaggggacgggctggcgatggggataatgatcctcaagttgctgaccgacttccagagttaccagctttgggtcaccctgctcagcctcacctttatcaagacgaccttctccctgcactacgcctggaagactatggcgatggtgctatcgatcgtgagccttctgccactgtgcctcagcaccacgtcccagaagacgacctggttgcccgtcttactcggttcccttgggtgcaagccgctgacgatgttctttatagccgagaacaagatctgggggaggaaatcctggcccctcaacgagggcatcatggccgttgggatcgtgtccattttactgtcctccctcctgaagaatgacgtccccctagctggccccctcatcgcgggcggcatgttaattgcctgctatgtgatcagcggctccagcgcagacttgagcctcgagaaggccgccgaggtgagctgggaagaggaagcagagcactccggggcatctcacaacatcctcgtcgaggtgcaggatgacggcactatgaaaatcaaggacgaggaacgcgacgacacactgaccattctcctcaaggccaccctactcgccgtgtccggggtgtacccattaagcatccccgctactctattcgtgtggtacttttggcagaagaagaagcagcgaagcggcgtgctctgggacacgccaagcccgcccgaggtcgagcgcgcggttctggacgatggcatctaccggatcatgcagcgcgggttactgggccggtcccaggtaggcgtaggcgtgtttcaggagaacgtgttccacaccatgtggcacgttacccgcggcgccgtgctcatgtaccagggcaagcggctggagccctcatgggcctccgtgaaaaaggacttgatcagctatggcgggggttggagacttcagggctcctggaacaccggcgaggaggtgcaagtgatcgccgtggagccggggaagaatcccaaaaacgtccagacggctccgggtaccttcaagacccccgagggagaggtgggagcgattgccctagacttcaagcccggcaccagcgggtctcccattgtgaatcgggagggtaagatcgtcggcctgtacggaaatggcgtggtgacgacctcaggtacctacgtaagcgccatcgcccaggccaaggcatcccaggaaggcccactccccgagatcgaggacgaggtgtttcgcaagcggaacctgaccatcatggacctgcacccggggtccggaaagacgagaaggtacctcccggctatcgtgcgggaagccatcaaacggaagctgcgaaccctgatcctcgccccgacccgagtcgtggcgtccgagatggctgaggcgctgaagggcatgcccatccggtaccagaccacggctgtcaaaagcgagcacactgggcgggaaatcgtcgacttaatgtgccatgcaacctttaccatgcggctcctgtcccccgtgcgcgtgccgaactacaacatgatcatcatggacgaggcccacttcaccgacccttcctccatcgccgcccggggctacatcagcacccgcgtcgggatgggcgaggccgccgctatattcatgaccgccacgccgcctgggtctgtggaggccttccctcaaagcaacgccgttattcaagacgaggagcgtgacatccccgagcgctcctggaatagcggctacgagtggatcacggacttccccggcaaaaccgtctggttcgtgccctccattaagagcgggaacgacatcgccaactgcctgcggaagaacggcaagcgcgtgatccagctctcccggaagaccttcgataccgagtaccagaaaacgaagaacaacgactgggactacgttgtgaccacagacatcagcgagatgggagcgaactttcgcgcggatcgggtcatcgacccacgccggtgcctgaagcccgtgattctgaaggacggccccgagcgtgtgatcctcgccggacctatgccagtgaccgtggcatccgcggcccaacgtcgcggccgcatagggcgcaaccacaacaaggagggggaccagtatatctacatgggccagccgctgaacaacgacgaggaccacgcccactggacggaggccaagatgctgctcgacaatatcaataccccggaggggatcattcccgcactgttcgagccagagcgcgagaagtccgctgccatcgacggcgagtaccggctgcggggcgaggccaggaagaccttcgtggagctcatgcgcaggggagacctgcccgtgtggctgtcctacaaggtggccagcgagggcttccagtattcggaccggcgctggtgcttcgacggggaaaggaacaaccaggttctcgaagagaatatggacgtcgagatctggaccaaggagggtgagcgtaaaaagctgcgcccccggtggctggacgcccgcacgtactccgatccactcgcgctgcgcgagttcaaagagttcgccgcaggacgcaggagcatatcaggggacctgatcctcgagatcggcaagctgccgcagcatctgacacaacgcgcccagaatgccctcgacaatctggtgatgctgcacaacagcgagcagggagggcgggcctacagacacgccatggaggaactgcccgataccatcgagaccctgatgctgttggcactgatcgccgtcttgaccgggggggtcaccctcttcttcctgtccggccggggcctgggcaagactagtatcgggctcctgtgcgtgatggcgtctagcgccctgctctggatggcctccgttgagccccactggatcgccgccagcatcatcctggagtttttcctgatggtactcctcatccccgagccggaccgccagagaaccccccaggacaaccagctggcatacgtggttatcggtcttttattcatgattcttaccgtcgccgccaacgaaatggggctccttgaaacgaccaagaaagatctgggcattgggcacgtggccgtggagaaccatcaccacgcgaccatgttagacgttgacctgcaccccgcgagcgcatggaccttgtacgcggtggccacaaccatcattactccgatgatgcgccacacaatcgagaacacgacagcaaacatcagccttaccgcgatcgcaaaccaggccgccatactgatgggcctcgacaagggctggcccatctccaagatggacatcggggtgcccctcctggccctgggttgctacagccaggtcaaccccctcaccctgacggcggccgtgctgatgctggtggcccactacgccatcatcgggccggggctgcaggcgaaagcaacccgcgaagcccagaagcggaccgctgccgggatcatgaagaaccccactgttgacggaatagtggcgatcgacctggaccctgtggtctacgatgccaagttcgagaagcagttgggccaaatcatgctgctaatcctctgtacgtcccagatactgctgatgcgcaccacctgggccctctgcgagagcatcaccctggcgacggggcccctgaccaccctctgggagggcagtccagggaagttctggaacacaacgattgccgtgagcatggctaatatatttcggggctcgtacctggctggggccgggctggccttcagcttaatgaaatctttgggggggggcagacgggggaccggcgcccagggcgagaccctgggggagaagtggaagcggcagctgaatcaactttccaagagtgagttcaatacatacaagcggtcaggcattttagaggtggaccgcagcgaggccaaggaagggcttagaagaggggagacgaccaagcacgccgtctcccggggcaccgccaagttgcgatggttcgtggaaagaaacctggtgaagcccgagggaaaagtcattgatctgggctgcgggcggggtggatggagctactattgcgccggactcaagaaagtgaccgaggttaaaggttatacgaagggaggccccgggcacgaggagcccatcccgatggcgacctatggctggaatctcgtcaagctacattcgggtaaggacgtattcttcattccaccagagaagtgcgatactctactctgtgacatcggcgagagcagtcccaacccgaccatcgaagaggggcggacgctgcgcgtgctcaagatggtcgagccttggctgcggggcaatcaattctgtatcaagatcctgaacccctacatgcccagcgtggtggagaccctcgagcaaatgcagcgcaaacacggcgggatgttagtcagaaacccgctatcccgcaacagcactcacgaaatgtactgggtatcctgcggcactgggaacatagtgagcgccgtcaacatgacctcccgaatgctcctgaaccgctttactatggcccatcgcaagcccacctacgagcgagacgtggacttaggcgccggcacccgccatgtggcagtcgagcccgaggtggccaacctcgacatcatcgggcaaaggatcgagaacatcaagcacgagcacaagagcacctggcattacgatgaggacaacccctacaagacatgggcctaccacggctcctacgaggtcaagccgagcggaagtgcctcgagcatggtgaatggcgtggtgaagctgctgaccaagccctgggacgtgatccccatggtgacccagatcgctatgaccgatacgaccccctttggtcagcagcgcgtgttcaaggagaaagttgatacgcggaccccgaaggccaagcgcggcacggcgcagattatggaggtgacagccggctggttgtggggattcttatcgcggaacaagaagcctcgcatctgcacccgggaggagtttacccgcaaggtccgtagcaacgccgccattggcgcagtgttcgtggacgagaatcagtggaactccgcgaaggaggccgtggaggacgagcgcttctgggacctggttcatcgggagcgggaacttcacaagcaggggaagtgtgccacgtgcgtgtacaacatgatgggaaagcgtgagaaaaagttgggggagttcgggaaagccaagggaagccgcgcgatctggtacatgtggctgggcgcacggtttctcgagttcgaggccttgggcttcatgaacgaggaccactggttctcccgcgagaacagcctgtccggggtcgagggcgaggggctccacaagctgggctatatcttacgagacatcagcaagataccgggcgggaacatgtatgccgacgacaccgctggctgggacacccgaatcacggaggacgatctccagaatgaggcgaagatcacagacatcatggagccggagcacgcccttctggccacctccatcttcaagctcacctatcagaacaaggtggtgcgcgtccagcggcccgccaagaacgggaccgttatggacgtgatcagccgtcgggaccagcgcggctccggccaggtaggtacctacggactgaacacctttaccaacatggaagcccagttaatccgccaaatggaatcggagggaatcttttcccccagcgagctcgagacacccaacctggcggaacgcgtgctggactggctggagaagtacggcgtcgagcggctgaagagaatggccatctctggggacgactgcgtcgtgaagccgatagacgaccggttcgccacagccctaaccgccctcaatgacatgggcaaggtacgcaaggatatcccgcagtgggagcccagcaagggctggaacgattggcaacaggttcccttctgctcccaccatttccaccagctgatcatgaaggacggacgggagattgtggtgccgtgccgcaaccaggacgagctggtcggccgggcaagagtgagccagggggccggctggagcctccgcgagaccgcttgcctggggaagtcctacgcccagatgtggcagcttatgtatttccatcgccgggacctgaggctggctgcgaacgctatctgcagtgccgtgcccgtcgactgggttccgacctcccggacgacctggtccatccacgcgcaccatcagtggatgactaccgaggacatgctatccgtgtggaaccgggtctggatcgaggagaacccctggatggaggataagacgcacatcagcagctgggaggacgtcccgtatttaggcaagcgcgaagaccagtggtgcggttcattgatagggctgaccgctcgtgccacatgggccactaacatccaggtggcaattaaccaggtccgccgactcatcggcaacgaaaactacctggactacatgaccagcatgaagcgcttcaagaacgagtcagacacggagggggccctatggtga

SEQ ID NO: 23826 - RNA, 9879 nt, synthetic construct
  misc_feature 1..9879: note = derived and/or modified CDS sequence (opt11) from DENV-1__FJ639680__SS-prME
  source 1..9879: mol_type = other RNA
agcgtaacaatgctgctaatgctgatgcccacggcactagccttccatctcaccacgcggggcggtgagccccacatgatagtgtccaaacaggagcgcgggaagtccctgctgttcaaaaccagcgccggggtgaatatgtgcaccctgatcgccatggacctgggcgagctatgcgaggatacgatgacatacaagtgcccccgtatcacggaggccgagcccgatgacgtggactgttggtgcaatgccactgatacgtgggtgacttacgggacctgctctcagactggcgagcatcggcgcgataaacggtccgtggccctcgcgccccacgtgggtctggggctggagacgcgcaccgagacctggatgagctccgagggcgcctggaagcagatccagcgggtcgagacctgggcgctccgccaccccgggttcacggtgatcgccctgtttctggcacatgcaatcggcaccagtatcacccagaaggggatcatcttcatactcctgatgctggtcacaccctccatggccatgcggtgtgtcggcatcggcagccgcgacttcgtcgagggactttcgggggccacatgggtggacgtagtgctcgagcacgggagctgcgtaaccacgatggccaaggacaaacctactctggatatcgagctcctgaaaacggaggtgaccaaccccgcggttctgaggaagctatgtatcgaggccaagatctccaacaccacgacggatagtagatgtccgacccaaggggaggccacactggtagaggagcaggacgccaacttcgtctgccggcgcaccttcgtggaccgggggtgggggaatggctgcgggctgttcggcaaggggtccctcatcacgtgcgccaagttcaagtgcgtaaccaagctcgagggcaagatcgtgcagtatgagaacctgaagtacagcgtaattgtgactgttcacaccggagatcaacaccaggtggggaatgagtccaccgagcacggcaccacagccaccataacgccccaggcacccacgaccgaaatccaactcaccgactacggtgcgctgaccctggactgcagcccccgtacaggcctcgatttcaacgagatggtcctgctgaccatgaaggagaagtcgtggctcgtgcacaagcaatggtttttagacctgcccctgccctggacctctggagccagcacttcccaggagacgtggaaccgtcaagacctgctcgtgaccttcaagactgcccacgccaagaagcaggaggtcgtggtactcggctctcaggagggcgccatgcataccgccctgaccggggctactgaaatccaaacatctggtaccacgactatctttgcggggcaccttaaatgcaggctcaagatggataaactaactcttaagggcatgagctacgttatgtgcaccgggtccttcaagctggagaaggaggtggcggagacgcagcacggaaccgtgctggtccagatcaagtacgagggcaccgacgctccctgcaagatccccttctcgacccaggacgagaagggggtgacgcagaacggccggctgatcacggccaacccgatcgttaccgacaaggaaaagcccgtgaacatcgaggcagagccacccttcggggagtcctatatcgtgattggagctggcgagaaggcactgaagctctcgtggtttaaaaaggggtccagcataggcaaaatgttcgaggccaccgccagaggtgccaggcgcatggcgatcctgggcgacacggcctgggatttcgggtcgatcgggggcgttttcacatctgtcgggaagttagtgcatcagatcttcggcaccgcctacggagtgctgttcagcggcgtctcatggaccatgaaaatcgggatcggcgtgctgctgacatggctcggtctgaactcccgcagcacttcgctgtctatgacctgcatcgccgtggggctagttacgttatacctgggcgtgatggtacaggccgactccgggtgcgttatcaactggaagggcagggagctcaagtgcgggtcaggcatatttgttacgaacgaggtacacacctggaccgagcaatacaaattccaggcggatagcccgaagcgcttgtccgctgccatcggcaaggcgtgggaggagggtgtctgtgggatcaggtcggcaactcgccttgagaacatcatgtggaaacagatctccaacgagcttaaccatattctgctggagaacgacatgaaactcaccgtggtggtgggggacgtcgcgggcatactggcccaggggaagaagatgatccgtccccagcccatggagtacaagtacagctggaagtcctgggggaaggccaagatcataggcgccgacgcgcagaatacgaccttcatcatcgacgggcctaatacccctgagtgtccagacgaccagcgcgcctggaacatctgggaggtcgaggactacggcttcgggatcttcacaactaatatctggctgaagttacgtgatagctacacccaggtctgcgaccaccgcctgatgtccgccgccattaaggatagcaaagccgtgcacgcagatatgggctactggattgaatccgagaagaacgagacctggaagctggcccgggccagcttcatcgaggtgaaaacttgcatctggcccaagtcccacacgttatggagcaacggcgtactggagtccgaaatgatcatccccaaaatctacggaggccccataagccaacataactaccgcccggggtacttcacgcagaccgccggcccgtggcacctggggaagctcgagttggacttcgacctgtgtgaaggcacaacggtggtggtcgacgagcactgcggcaaccgggggccgagcctcaggaccaccaccgtaacgggtaagattatccacgagtggtgctgccggagctgcaccttaccgcccctgcgcttccgcggggaagacggctgttggtacggcatggagatacgccctgtgaaggagaaagaggagaacctcgtcaagtccatggttagcgccggctcgggcgaagttgactccttttccctggggctgctctgtatatccatcatgatcgaggaggtaatgcggagcagatggtcccggaaaatgctgatgacggggaccctggcggtgttcttcctcctgatcatggggcaattaacgtggaacgacctcatccgcctgtgcatcatggtcggggccaacgcctctgaccgcatggggatgggcaccacctacctcgcgttgatggcgaccttcaagatgcggccgatgtttgctgtcggcctgctgttccgcagactcacgagtcgcgaagtgctgctactcaccattgggctgagcctggtggcctccgtcgagcttcccaacagcctggaggagcttggggacgggttagcaatgggcatcatgatcctgaaactgctcaccgacttccagtcccaccagctgtgggccacgttgctgagcctgacgttcattaagaccaccttctcccttcattacgcgtggaaaactatggccatggtgctcagcattgtttcccttttcccgctgtgcctctctacaaccagtcagaaaaccacctggctcccggtactcctcggcagcctggggtgcaagccgctgacgatgttcctcatcgctgagaacaagatctggggccggaaatcctggccattaaacgaggggatcatggccgtgggcatcgtatctatcctgcttagctccctgctgaagaacgatgtgcccctcgctgggcccctgatcgcgggcggcatgctcatagcctgctatgtaatcagcggatccagcgccgacctctccctggagaaggccgccgaagttagctgggaggaggaggctgagcattcgggcgccagccacaacatcctggtggaggtgcaggacgatgggacgatgaagatcaaggacgaggagcgcgacgacactctcacgatccttctgaaggccaccctccttgctgtctccggtgtatacccgctgagcatccccgcaaccctcttcgtgtggtatttttggcagaagaagaaacagcgttccggcgttctctgggacacccccagcccgcccgaagtggaacgcgcggtgctggatgacggcatctaccggataatgcaacgcgggctgctcgggcggtcccaggtgggggtgggggtgttccaggagaacgtcttccacaccatgtggcacgtgacccgcggcgccgtgctgatgtaccaagggaaacggttggagcctagctgggcctcagtaaagaaagacttgatcagttacggcggagggtggagactgcagggatcctggaatacgggggaggaggtacaggtaatcgctgtcgaacccggcaaaaaccctaaaaacgtgcagaccgccccaggaaccttcaagacccccgagggcgaggttggagcaatcgccctggactttaagcccgggacatccggttcccccatcgtcaaccgggagggaaaaatcgtgggcctgtatggcaacggggtggtcaccacctcagggacctatgtgtccgccatcgcccaggccaaggcaagtcaagaagggccgctgcccgagatcgaagacgaagtgttcaggaagcggaacctgactatcatggacctccaccccggaagcgggaagacccgccgctacctccctgccatcgtccgcgaggccatcaagcggaagctacgcaccctcatcttagcccctacacgcgtggtggcgagtgagatggccgaggcactgaagggcatgcccatccggtatcagacaaccgccgtcaaatctgagcataccggcaaggagatcgtggacctcatgtgccacgccaccttcacgatgaggctactgtcccccgtccgggtcccgaactacaacatgattatcatggacgaggcgcattttactgaccccagctccatcgccgcccgcggatacatctccacgcgggtgggcatgggggaagcagccgccatcttcatgaccgccacgccgcccgggtccgtagaggcctttcctcagagcaacgccgtcatccaagatgaggagcgcgacatccccgagcggtcctggaacagcggatacgagtggatcaccgacttccccggcaagacggtgtggtttgtgccatccatcaagagcggcaatgacatagccaactgcttgcgcaagaacgggaagcgggtcatccagctgtcccgcaagaccttcgacacggagtaccagaagactaagaacaacgactgggactacgttgtgaccaccgatatcagcgaaatgggggccaatttccgggccgatcgcgtgatcgacccgcggcggtgcctgaagccagtgatcctcaaagacgggcccgagcgggtgattctggccggccccatgccggtcaccgtggccagtgccgctcagcgccgggggcgcatcggccggaaccacaacaaggagggcgaccagtacatctacatgggacaacccctgaataacgacgaggaccatgcccactggacagaggccaaaatgctcttggacaatatcaacacccccgagggcatcattcccgcactgttcgagcccgagagagaaaagagcgcagcaatcgacggggagtatcggctccgcggcgaggcccggaagactttcgtcgagctgatgcggcgtggggatctccccgtgtggttgagctacaaggtggccagcgaaggcttccagtacagcgacaggcgctggtgttttgacggagagcggaacaaccaagtgctggaggagaacatggatgtggagatttggaccaaggagggcgagcgcaagaagctgcggccgcgatggctcgacgcccggacctactccgaccccttggcgttacgcgagttcaaggaatttgccgcgggccggaggagcgtctccggggacttgatcctcgagatcgggaagctgccgcagcatctaacccaacgggctcagaacgcgctggataatctggttatgctccacaactccgagcagggcggtcgcgcctaccggcacgctatggaggaactgcctgataccatcgaaacactgatgctccttgccctgatcgccgtgctaacgggcggggtcaccctgttcttcctgtccggccgcgggctcggcaagaccagcatcggcctactgtgcgtcatggcgtctagcgtgctgctgtggatggcctccgtggagccccactggatcgctgccagcattatcctggagtttttcttgatggttttgctgataccggagccggaccgccaacgcactccccaggacaaccagctcgcctacgtggtgatcggtctgttattcatgatcctcacggttgccgcgaacgagatgggcctgttggaaaccactaagaaggacctcggaatagggcacgtggccgtggagaaccataatcatgcggccatgctggacgtcgaccttcatcccgcgtcagcgtggacactgtacgccgtcgccacgaccatcatcactccgatgatgcgacacaccattgagaacacgaccgccaatatcagcctgaccgctatcgccaaccaggccgccatactgatgggactcgacaaaggctggcccatttccaagatggacatcggcgtacccctgctcgcgctcgggtgctatagccaggtcaaccccttgacgctgacagccgcagtgctcatgctggtggcgcactatgcaatcatcggcccgggactgcaggcaaaggcaacgcgcgaagcccagaagagaaccgccgctggcataatgaaaaaccccacggtcgacgggatcgtggcaatagacctcgaccctgtggtctacgacgccaagttcgagaagcagctgggccagatcatgctgctcatcctgtgtacgtcacaaatcttgctcatgcggacgacctgggccttatgcgagagcattaccctggcaactggcccactcaccaccctgtgggagggaagcccggggaagttctggaacacgacgatcgccgtgagcatggcgaacatcttccgcggtagctacctggccggcgccggcctcgcctttagcctgatgaagtccttagggggcgggcgacgcgggaccggggcgcagggcgaaactctcggcgagaagtggaaacggcagctgaaccagctgtccaagtctgagtttaacacctacaagcgctccggtataatggaggttgatcggagcgaggccaaggagggccttaagagaggggagacgacaaaacacgccgtgagtcggggcaccgccaagctgcgctggttcgtggaacgtaatctggtaaagcccgagggcaaggtcatcgatctgggatgtggtcgcgggggctggagctactactgtgccggcctcaagaaggtgacagaggtcaaggggtacactaagggtggcccgggccacgaggagcccatcccgatggcgacatacgggtggaacctggtaaagctccactccggcaaggacgtgttctttatcccgcccgaaaagtgtgacaccttactgtgcgacatcggggagagcagtcctaacccgaccatagaggagggccggacgctgcgcgtgctcaaaatggtcgagccctggctgaggggcaaccagttctgcattaagatcctgaacccctacatgcccagcgtggtggagaccctcgagcaaatgcagcggaagcacggcggcatgctggtccggaaccctctaagcaggaacagcacccacgagatgtactgggtgtcatgcgggaccggcaacatcgtcagcgccgtcaacatgacctcccggatgctcctcaatcgattcacaatggcccaccgcaagcccacatacgagcgggatgtggacctgggcaccggcacccgccacgtagcagttgagcccgaggtggccaacctcgacatcatcgggcaaaggattgagaacatcaaacatgagcacaagtccacgtggcactacgacgaggacaacccctacaagacctgggcgtaccacggatcctacgaagtaaagcccagtggctctgcttccagtatggttaacggggttgtaaagctgctgaccaagccgtgggacgttatccccatggtaacccagatcgccatgacggacaccactcccttcggccagcagcgcgtcttcaaagagaaggtggacacacgcacgccgaaggccaagcgcgggaccgcccagataatggaagtgaccgcgcgatggctttggggcttcctgagccgcaataagaagccccggatctgcacacgcgaggagtttactcggaaagtaagaagcaacgccgcgatcggcgcggtctttgtggacgagaaccagtggaactccgcgaaggaggcggtagaagacgaacggttctgggatctggtgcaccgggagcgagagctccataagcaagggaaatgcgcgacctgcgtctacaacatgatgggtaagcgtgagaagaagttgggggagttcggcaaggccaaggggagccgggccatttggtacatgtggcttggtgcgcgctttctcgagttcgaggccttgggcttcatgaacgaggaccattggttctctcgggaaaattcgctatccggtgtggagggcgagggtctgcacaagctcggctacatcctgcgtgacatcagcaagatccccgggggcaatatgtacgccgacgacaccgccgggtgggatactcggatcacggaggacgacctccagaacgaggccaagattaccgacatcatggagccagagcacgcgctgctggctaaggctattttcaagctgacctaccagaacaaggtcgtgcgcgtccagcgcccggcaaagaacgggacagtgatggacgtgatctcccggcgcgaccagcgcggcagcggccaggttggcacttacggcctgaacactttcaccaacatggaggcccagctgatcagacagatggaatccgaagggatctttagcccctccgagctcgagacccccaatctggcagagagagccctagactggctcgagaaatatggagtggagcgcttgaagcgcatggccatcagcggggacgactgtgtggtcaagccaattgacgaccgcttcgctacggccctgaccgccctgaacgacatgggtaaagtgcggaaggatatcccccagtgggaaccctcaaaggggtggaacgactggcagcaggtccccttctgctctcaccactttcatcagctaatcatgaaagacggccgcgaaatcgtcgtgccgtgtcgaaaccaggacgagctggtcggccgggcccgcgtctcgcagggggcgggctggagcttacgcgagaccgcctgcctgggtaagagctacgctcagatgtggcagctgatgtacttccaccggcgcgacctccgactggctgccaacgccatctgcagtgccgtgccggtggactgggtccccaccagccgaacgacgtggtccatccacgcacaccaccagtggatgaccaccgaagacatgctgagcgtctggaacagagtgtggatcgaggagaacccctggatggaggacaagacccacatctcaagctgggaggacgttccgtacctcggcaagcgcgaagaccagtggtgcgggtctctgatcggcctaaccgcccgcgccacctgggccaccaacatccaggtggccatcaaccaagtgcggcgcctcattggcaacgaaaactacctcgattacatgaccagcatgaagcggttcaaaaacgagtccgatcccgagggggcgctgtggtag

SEQ ID NO: 23827 - RNA, 9879 nt, synthetic construct
  misc_feature 1..9879: note = derived and/or modified CDS sequence (opt11) from DENV-1__FJ639682__SS-prME
  source 1..9879: mol_type = other RNA
agcgtaacgatgctgctcatgcttatgcccaccgcactggcgttccacctcactacccggggtggggagccccatatgattgtgagcaaacaggagcggggaaagagcctgctatttaagacaagcgccggggtaaatatgtgcacgctgatcgcgatggacctgggtgagctgtgcgaggacacaatgacctacaagtgtccccgcatcaccgaggccgagcccgatgacgtcgactgttggtgcaacgcaaccgacacctgggtgacctatgggacctgcagccaaactggcgagcaccggcgggataagcggtccgtggccctcgcaccccacgtcggcctggggcttgagacgagaaccgagacctggatgagctccgagggcgcctggaaacagatccagcgggtggagacgtgggcactccgtcatcccgggttcacggtgattgctctgttcctggcgcacgcaatcggcacaagcatcacccagaaggggatcatatttatactcttaatgctggtcaccccctcaatggccatgcggtgcgtcggtatcggtagcagagacttcgtagaggggctctccggcgccacatgggtggatgtagtgctcgagcacgggagctgcgtcacaaccatggccaaggacaagcccaccctggacattgagctcctgaagacggaggtaaccaaccccgcagtgttgcggaagctctgcatcgaggccaagatatcgaatacaaccacagacagccgctgccctactcagggcgaggccaccctggtagaggagcaggacgccaacttcgtctgccggcgcaccttcgtggacaggggctggggcaatggttgcgggctgtttggcaagggttccctcattacgtgtgccaagttcaagtgtgtcaccaagctcgagggcaagatcgtgcagtacgagaacctaaagtacagcgtgatcgtcaccgtccacaccggcgaccagcaccaggtggggaacgaatccacggagcacggtactaccgccacaatcacgccccaggcccccacgaccgagatacagttaaccgactacggggccttaaccctagactgttcgccccgcacgggcctcgacttcaacgaaatggtcttactgaccatgaaagagaagtcctggctagtgcacaagcagtggttcctggacctgcccctgccctggacaagcggggccagcacctcccaagagacgtggaaccggcaggatctgctggtgaccttcaagaccgcacacgcgaagaagcaggaggtagtggtcctgggtagccaggagggagccatgcacaccgctctgaccggggccaccgagatccagacatccggcaccacgacgatcttcgccgggcacctgaagtgccgccttaaaatggacaagctgaccctgaagggcatgagctacgtcatgtgcaccggctccttcaagctcgagaaggaagtggcggagacgcagcacggcaccgtgctggtccagatcaagtacgagggcaccgacgctccctgcaagatccccttcagcacccaggacgagaagggggtcacgcagaatggccggctaattaccgccaacccgatagtcaccgacaaggagaagcccgtaaacatcgaggccgagccgcccttcggggagtcctacatcgtgatcggagcgggcgagaagactctgaagctcagctggttcaagaaagggtcctcgatcggaaagatgttcgaggccacagcacgcggggccaggcgtatggccatactgggcgatacagcgtgggacttcgggtccatcggcggcgtgttcaccagcgtcggcaagctggtgcaccagatcttcggaaccgcctatggtgtcctgttctccggcgtcagctggacgatgaagatcgggatcggggtactgctgacatggcttggcttaaattcccgctctacttcgttaagcatgacctgcattgcagttgggcttgtcacgctttatctgggtgtcatggtccaggccgactccgggtgcgtcattaactggaagggcagggaacttaaatgcgggagcggcatcttcgtgaccaacgaggttcacacctggaccgagcagtacaaattccaggccgacagcccgaaacgcctgtccgcggccattggcaaggcctgggaggagggggtttgcggcatccggagcgccacacgcctagagaacatcatgtggaagcagatctccaacgagctcaaccacatcctgctggagaacgatatgaagctgacggtggtcgtcggggacgtcgctggcatccttgctcaggggaagaaaatgatacggccccagcccatggagtacaagtacagttggaagtcctggggcaaagccaagattatcggcgccgacgctcaaaacaccacctttattatagatgggcccaacaccccggagtgccccgatgatcaacgcgcgtggaacatctgggaggtggaggattatggattcgggatcttcacgaccaacatctggctgaagctacgtgacagctatacccaggtctgcgaccaccgcctgatgtcggcagccatcaaggatagcaaggccgtgcacgccgacatgggctactggatcgagtccgaaaagaacgagacctggaagctggcaagggccagcttcatcgaggtgaagacttgcatctggccgaaaagccacaccctctggagcaacggcgtacttgagtccgagatgatcatccccaaaatctatgggggcccgattagccagcacaactaccgccccgggtactttacacagaccgcgggcccctggcacctagggaagctcgagcttgacttcgacctttgcgagggcacgaccgtcgtggtcgacgagcactgcggcaacagagggccgtccctccgcaccaccacggtcacgggaaagataatccatgagtggtgctgtcggagctgcaccctgccgcccttaaggttccgtggtgaggacggctgctggtatgggatggagatccgcccggttaaggaaaaagaggagaacctcgtcaagagtatggtcagcgccggaagcggcgaggtcgattccttcagccttgggctgctctgcatatccattatgatcgaggaggtaatgcggagccgttggtcccgtaaaatgctgatgaccggcacgctggccgtgttctttctcctgatcatggggcagctgacctggaacgacttgatccgcctgtgcataatggtaggcgcgaatgccagcgaccgcatggggatgggcaccacttatttggctctcatggctacgttcaagatgcggccaatgttcgccgtcgggttgctgttccgacggttaacctcccgcgaggttctgctgctcaccatcgggctgagcttggtggcgtctgtcgagctccccaatagcctcgaggagctgggtgacgggcttgccatgggaatcatgatactgaagctgctcaccgactttcagtcccatcagctgtgggccacgctgcttagcctgacctttattaagaccaccttctcactccactacgcatggaagacgatggcgatggtgctcagcattgtctccctgttccccctgtgcctctcaaccacctcccagaaaaccacgtggcttcctgtactgctaggcagcctcgggtgcaagccgctgaccatgtttctcattgccgagaacaaaatctggggcagaaagtcctggcctcttaacgaggggatcatggcagtcggaatcgtgagcatcctgctctcctccctactcaagaacgacgtgcccctcgccggccccctgatcgccgggggcatgctgatagcgtgctacgtgcttagtggttccagcgctgatctgtcgctggagaaggccgctgaagtctcctgggaagaggaggcagagcactccggcgcgagccacaacattctcgtggaagtgcaggacgacggtactatgaaaatcaaggacgaggagagggacgacactctgaccattttgctcaaggccactctcttggccgtctctggcgtttaccctctcagcatacccgccaccctattcgtctggtacttttggcagaagaagaagcagcggtccggggtcctgtgggacacccccagtccacccgaggtggagcgagctgtgctagacgatggcatatacagaatcatgcagcgcggccttctggggcggagccaggtcggggtgggggtgttccaggaaaacgtcttccataccatgtggcacgtaacgcgcggcgcggtcctgatgtaccaaggtaagcggctcgagcccagctgggcctcggtcaagaaggacctgatcagctacggcggagggtggcgcctgcaaggctcctggaataccggagaggaggtccaggtaatcgcggtggagcccggcaagaatcccaaaaacgtgcaaaccgcccccgggaccttcaagacgcccgaaggagaggtgggcgccattgcgctcgacttcaagccaggaaccagcggttcccctatagtcaaccgggagggaaaaatcgtgggactgtacggcaacggtgtggtcaccacatcgggcacgtacgtgtcggccatagcccaggccaaagcgtcccaggaggggccgctgcccgagatagaggacgaggtgtttagaaagcgaaatttaaccatcatggatctgcaccccggcagcgggaagacgcgccggtatctgcccgccatagtgcgcgaggctatcaagcggaagctccgcacactgattttggccccgacgagagtggttgcctccgagatggcggaggccctcaaggggattcccatccggtaccagaccacagccgtgaaaagcgagcacaccggcaaggagatcgtggacctgatgtgtcatgccacgttcaccatgcgtctgttatctcccgtgcgggtccccaactacaacatgattatcatggacgaggcacacttcaccgacccctcctccatcgcggcccgcgggtacatcagcacccgggtcggcatgggggaagctgccgccatcttcatgacggcgacaccgcccggctcggtggaggccttcccacagagcaacgcagtcatccaggacgaggagcgtgacatccctgagcggtcctggaacagcgggtacgagtggatcaccgatttcccaggcaagaccgtgtggttcgtgccttccattaagagcggcaacgacatcgccaactgtctgcggaagaacgggaagcgggtcatccaactgtctcggaagacgttcgacaccgagtaccagaagaccaagaacaacgactgggactacgttgtcacgacggacatcagcgagatgggcgcgaacttccgggccgatcgcgtcatcgacccgagacgctgcctcaaacccgtgattctgaaggacgggcccgagcgggtgattctggccggccccatgccagtaacggtggcctccgccgctcagcgacgggggaggatcggccggaaccacaacaaggagggggatcagtacatatacatggggcaacccctcaacaacgacgaggatcacgcccactggaccgaggccaaaatgctgttagacaacataaacaccccggagggcatcattccggccctcttcgaaccggagcgcgagaagtccgcggcgatcgacggggagtacagactgaggggcgaagccaggaagacgttcgtcgaactgatgcggcgaggggatctccctgtgtggctttcctacaaggtggccagcgaaggcttccagtatagcgaccggcgctggtgcttcgacggcgaacggaacaaccaggtgctggaggaaaacatggacgtggagatctggaccaaggagggtgagcgcaagaagctccgaccccgctggttagatgcgcgtacttactccgaccccttggccctccgagagttcaaagagttcgctgccggccggagaagcgtgagtggggacctgatcctggaaatcggcaagctcccccagcacctgacccagagggcgcagaacgccctggacaacctagtgatgttacacaacagtgagcagggtgggagagcgtaccggcacgccatggaggagctgcccgacacgatcgagacattgatgttattagcgctcatcgcggtgctgaccggcggggtaaccctgtttttcctctccggcagagggctgggtaagaccagcatcggcctgctgtgcgtcatggcatcctctgtgctgctgtggatggcaagcgtggagccgcactggatcgctgcaagcataatcctcgagttcttccttatggtcctgctgattcccgagccggaccggcagcgcacaccccaggacaaccagttagcctacgtggtaatcggcttgctgtttatgatcctgaccgtggccgcgaacgagatgggtttactcgaaacaaccaagaaggacctggggatcggacatgtggccgtggagaaccatcaccacgcggcgatgctggacgtcgatctccaccccgcctccgcatggacgctgtacgcggtggcaaccaccataatcaccccgatgatgcggcacacgatcgaaaacaccaccgccaacattagcttgaccgccatcgcgaaccaggccgccatcctcatgggcctggacaagggctggcccatcagcaagatggacatcggagtgcccctgctcgctctggggtgctacagccaggtcaaccctctgacgctcaccgcggccgtgctcatgttggtggctcactatgcaatcatcggaccaggtctccaggccaaggcgacacgcgaggcccagaagcgcaccgccgccggcatcatgaagaaccccacggttgacgggattgtggccatcgacctagacccggtagtctacgacgcaaagtttgagaagcagctcggtcagatcatgctcctgatcctgtgcacgagtcagatcttgcttatgcggacaacctgggccctgtgcgagagcatcacgctagccactggccccctgaccacactgtgggaagggagcccgggcaagttctggaacacgaccatcgccgtcagcatggccaatatattccgcgggtcctacctcgcgggcgccggccttgcttttagcctaatgaagtccctcggtggtgggcggagaggcaccggtgcccagggcgagaccctgggcgagaagtggaagcggcagctgaaccagctctccaaaagcgagttcaacacgtataagcgctccgggatcatggaggtggaccggagcgaggcgaaggaaggcttaaagagaggggagaccaccaagcacgccgtctcccgaggcactgccaagctccgctggttcgtggagcggaatctggtgaagcccgaggggaaggtcatcgacctcggttgcggcaggggcggctggtcatactactgcgccgggctcaaaaaggtgactgaagtgaagggctatacgaagggcgggcccggccacgaagaacccatccctatggctacctatgggtggaacttggtgaagctccactccggcaaagacgtgttcttcatcccgcccgagaagtgcgacactctgttgtgcgacatcggggagtcttcccccaacccgacgatcgaggagggcaggaccctccgcgtgcttaagatggtcgagccctggttgcgggggaatcaattctgtatcaagatcctaaacccttacatgcccagcgtggtggagacactggaacagatgcagcgcaagcacggcggcatgcttgtgcggaacccgctgtcccgcaacagcacccacgaaatgtactgggtttcctgcggaaccggcaacatcgtgagtgctgtcaatatgacgtcccggatgctactcaaccgcttcacgatggcccaccgcaaacccacctacgagcgggatgtggacttaggtaccggtaccaggcatgtggcggtagagcccgaagttgccaacctggatatcatcggccagcgaatcgagaatatcaagcacgagcacaaaagcacctggcactacgacgaggacaacccctacaagacctgggcctaccacgggtcctacgaggtaaagccgagcggctccgcgtcgagcatggtcaacggggtagtcaaactgctcaccaagccttgggacgtgatccccatggttacacaaatagccatgaccgacaccacacccttcggacagcagcgcgtcttcaaggagaaagttgatactcgaactccgaaggccaaacgcgggaccgcccagataatggaagtgactgcccggtggttgtggggctttttaagtcgcaacaagaagccgaggatctgcacgcgcgaggagttcacacggaaggtccgcagcaacgcggccatcggcgccgtgttcgtcgatgagaaccagtggaactccgccaaggaggccgtcgaggacgagcggttctgggacttggtgcacagggaacgggagctgcacaagcaggggaagtgcgcgacctgcgtttacaacatgatgggaaagcgcgagaagaagctcggtgagttcggcaaggccaagggcagccgggccatttggtacatgtggctcggcgcccgcttcctggagttcgaggcgctgggatttatgaacgaggaccattggttctcccgggaaaatagcctctccggtgtcgagggcgaagggctgcacaagctggggtatatcctccgagatatttcgaaaatccccgggggcaacatgtatgccgacgacaccgcgggctgggatacgcgaatcacagaggacgacctacagaacgaggccaagatcaccgacatcatggagccagagcatgccctgctcgcgaaggccatcttcaagctgacgtaccagaacaaggtagtgcgcgtgcagcgccccgccaagaacgggacagttatggatgtgatatccagacgcgaccagcgagggagcgggcaggtcggaacctatggcctaaacacgttcaccaacatggaagcccagctgatccgccagatggaatccgaggggatcttcagtccctccgagctggaaacccctaatctggccgagcgggcgcttgactggctcgagaagtacggtgtggagagactgaagcggatggccattagcggtgacgactgcgtggtaaagccgatcgacgacaggttcgccacggccctgaccgcgctaaacgacatgggcaaggtgcggaaggacatcccccagtgggagccctccaagggatggaatgactggcagcaggtccccttctgcagccaccatttccaccagctgataatgaaggacggcagggagattgtcgtgccgtgtcggaaccaggacgagctagtgggtcgcgcgcgggtctcccagggagcgggctggagcctgcgcgagaccgcctgcctgggcaagagctacgcccagatgtggcagctcatgtactttcaccgtcgtgacctgcggcttgcggccaacgccatctgttccgcggtgcccgtggactgggtccccacgagccgcaccacctggtccatccatgcgcaccatcaatggatgaccacggaggacatgctcagcgtgtggaacagggtctggatcgaggagaacccctggatggaagataaaacccatataagtagctgggaggacgtcccttacctcggcaagagggaagaccaatggtgtggttccctgatcggcctcaccgcgcgcgccacttgggccaccaacatccaggtggcgatcaatcaggtgcggcgtctgatcggaaatgagaactacttggattacatgacaagcatgaagagattcaaaaatgagagcgaccccgagggggccttatggtga

SEQ ID NO: 23828 - RNA, 9879 nt, synthetic construct
  misc_feature 1..9879: note = derived and/or modified CDS sequence (opt11) from DENV-1__JQ287664__SS-prME
  source 1..9879: mol_type = other RNA
agcgtgaccatgctgctcatgctgatgcccaccgccttagccttccacctcacgacccggggcggggaaccacacatgatcgtttccaagcaggagcggggcaaatctctgctcttcaagacctccgcgggggtgaacatgtgcaccctcatcgccatggacctgggcgagctgtgtgaggataccatgacctacaagtgcccccggatcacggaggtagagccagacgacgttgactgttggtgcaacaccactgacacctgggtgacctacgggacgtgcagccaaactggcgagcaccggcgggacaaacggtccgtggccctcgcccctcacgtcggactggggctcgagacccgcgccgaaacctggatgtcctccgaaggtgcctggaagcagatccagcgggtggaaacctgggccctccgccatcctgggttcacggttatcgccctgttcctggcccacgtaatcggcacaagcataacgcagaagggcatcatctttatattgttgatgctagtgacaccctcgatggccatgcgctgtgtgggcatcggcagccgtgatttcgtagaaggcctgtccggcgccacgtgggtggacgtggtcctggagcatgggagctgcgttaccaccatggcaaaggacaagcccaccctcgacatcgagctccttaagacggaggttaccaatccggccgtactgagaaagctctgcatagaggcaaagatctccaacaccacaacagacagccgctgccctacgcagggcgaggcgaccctggtggaggaacaggatgccaactttgtttgccggcgcaccttcgtggaccgtgggtgggggaacggctgcggtctctttgggaaggggtccctcatcacgtgcgccaagttcaagtgcgtcactaagctggagggcaagatcgttcagtacgagaacttaaagtacagcgtcatcgtgaccgtccacacgggcgaccagcaccaggtgggaaacgaatcgacggagcacggcaccaccgccaccatcacgccccaggccccaacgagcgaaatacagctcacagactatggagcgttgacgctggactgcagcccccggaccggactcgacttcaacgagatggttctgctcacgatgaaggagaagtcatggttggtgcacaagcaatggttcctggacctgcccctgccctggacctcaggagcctccaccagccaggagacctggaacaggcaggatctgctagtaactttcaagacggcccacgccaagaagcaggaggtggtggtgctcggctcgcaggagggcgccatgcacaccgcgctgacaggggctacggagatccagacgtctggcaccaccaccatatttgcagggcacctgaagtgccgtctcaagatggataaattaaccctgaagggtatgtcctacgtgatgtgtaccgggagcttcaagctcgagaaggaggtcgcggagacccagcacggcacggtgctggtgcagatcaagtacgagggcacagacgcaccctgtaagatccccttctccacacaggacgagaagggggtcacccagaacggcaggttgataacagcgaaccccatagtgacggacaaagagaagcccgtgaacattgaggccgagccgccgttcggggagagctacatagtcatcggggcaggcgagaaggccctgaagctctcctggttcaaaaaagggagctccataggcaagatgtttgaggcaactgcgcgcggagcacggcgcatggccattctgggcgacaccgcctgggacttcgggagcatcggcggagtgttcacttcggtggggaagctggtccaccagatcttcggcactgcatacggggtgctattctcgggcgtaagctggaccatgaagatcgggatcggcgtcctgctgacgtggttaggcctaaacagccgctcgacgtccctgtccatgacctgcatagctgtgggtctcgtgaccctgtacctgggcgttatggtacaagctgacagcgggtgtgtgattaactggaagggccgggagctcaagtgcgggagcggcatctttgtaaccaacgaggtgcacacctggaccgagcagtacaagttccaggccgattccccgaagcgcttgagcgcagcgatcggcaaggcgtgggaagagggcgtgtgcggcattcggtccgccacccgcctggagaatatcatgtggcggcaaataagcaacgagctcaaccacatcctgctggagaacgacatgaagttcaccgtcgtggtgggggatgtcgtgggcatcttggcccaggggaagaagatgatcagaccgcagcccatggagcacaaatactcctggaagtcctggggaaaggccaaaatcatcggcgcggacgtacagaacaccaccttcatcattgatgggcccaataccccggagtgtcccgacgaccagcgggcctggaacatttgggaggtcgaggactacggcttcgggatcttcaccaccaacatctggttaaagctgcgtgactcatacacccaggtctgcgaccaccgtttaatgagcgcggccataaaggactccaaggcggtgcatgcagacatgggctactggattgaaagcgagaagaacgagacctggaagcttgcccgcgcctccttcatagaggtcaagacttgcatctggcccaagagccacactctctggtccaatggcgtgctcgagagcgagatgatcataccaaagatctacgggggcccgatttcccagcacaactacaggcccgggtattttacccaaacggccggaccctggcacctgggcaagctcgagcttgacttcgacctctgcgagggcaccaccgtggtcgtggacgagcactgcggcaaccgggggccgagcctgcgcacgaccacagtcaccggcaagatcatccacgagtggtgttgcagatcctgcacgttgccgcccctccggttcaagggcgaagacggctgctggtatggaatggagatccgccctgtcaaggagaaagaggagaacctggtcaagagcatggtgagcgcgggttccggcgaagtcgacagcttctctctcgggctgctgtgtatcagcataatgatcgaggaagtgatgcgttcccgctggagccggaagatgttgatgaccggtaccctggcggtgttcttcctgctcatcatggggcaactaacctggaacgatctgatccgcctctgcatcatggtcggagccaacgcgtccgaccgcatgggaatgggcacgacatacctggccctgatggcgaccttcaagatgcggccgatgtttgcggtgggtctactgttccgcagactgaccagccgagaggtcctccttctgacgatcgggctgtcactggtggccagcgtggagctgcccaactccctcgaagagttgggcgatgggctggccatgggcatcatgatcctcaagctgctaaccgactttcagtcctaccagctctgggccacattgctttccctcaccttcatcaagacgacttttagcctgcactacgcatggaagaccatggccatggtcctgtccatcgtgagcctcctgcccctctgtctctcaaccacgagccagaagaccacctggctgcccgtgctgcttggctccttgggctgcaaaccgctgaccatgtttttcatcgccgagaacaaaatctgggggcggaagagctggccacttaacgaggggatcatggccgtcggcatcgtgagcatcctgctctccagcttactgaaaaacgacgtacccctcgcgggtcctctcatcgcaggtggtatgcttatagcgtgctacgtcatctccggttcatccgccgacctgagcttagagaaggccgcggaggtgtcctgggaggaagaagcagagcattcgggcgcctcccacaatattctggtggaggtccaggacgacgggacaatgaagatcaaagacgaagagcgcgacgacaccctgaccattctcctgaaagccacgctgctcgcggtcagcggcgtctacccgctgtccatccccgcgacgctattcgtttggtacttctggcagaaaaagaagcagcgatccggggtcctttgggacacgcccagcccgcccgaagtggagcgggcggtcctcgacgacggcatctatcggatcatgcagcgcggtctgctggggcggagccaggtgggcgtgggggtcttccaggagaatgtgttccacacaatgtggcatgtgacccggggggccgtcctcatgtatcagggaaagcggctggagccctcgtgggcctccgtcaagaaagatcttatctcttacggcggcgggtggcgtctccagggatcgtggaacacaggggaagaggtgcaagtcattgccgtggagcccggcaagaaccccaaaaacgtgcagacggcgcccgggaccttcaagacccccgagggcgaggtgggtgctatcgcgctggacttcaagcccggaacctccggcagccccatcgtgaaccgggaggggaagatcgtgggcctgtacgggaacggtgttgttacgaccagcggcacctacgtgtccgcaatcgcccaggcgaaagccagccaggaagggcccttgcccgaaatcgaggacgaggtgttccgcaagcggaacctgaccatcatggacctgcaccccggctcggggaagacgaggaagtacctgccggctatcgttcgggaggcaatcaagcgcaagctgcggaccctgatactcgcacccaccagagttgttgccagcgagatggcggaggcactgaaaggcatgccgatccgctaccagacaacggccgtgaagtccgagcataccgggcgggagatcgtggatctcatgtgccacgccacattcaccatgcgcctcctgtctcccgtccgtgtgccgaactacaacatgatcattatggacgaggctcacttcacagacccatcgagcatcgccgcccgtggttacatttctacccgagtgggaatgggggaggccgcggccatcttcatgaccgcgacgccgcccggcagcgttgaggcctttccgcagtctaatgctgtgattcaggacgaggagcgcgatatccccgagcgcagctggaactccgggtacgagtggatcacggatttccccggcaagacggtgtggttcgtccccagcatcaagtcaggaaacgacatcgccaactgccttcgcaagaacgggaagagggtgatccagctctcccgcaaaactttcgacaccgagtaccaaaagacgaagaacaacgactgggactatgtggtcaccacggatatctccgagatgggcgccaacttcagggcggaccgcgtgatcgacccgcggcgctgtctcaagcccgtcattctgaaggacgggcccgaacgagtgatcctcgccggacccatgccggtgaccgtcgcgagcgccgcccagaggcgagggcgcataggccgcaaccacaacaaggaaggcgaccagtacatctacatggggcagcccttaaataacgacgaggatcacgcccactggaccgaggccaaaatgctgcttgacaacatcaacacacccgagggcataatacccgcgctgttcgagccggagcgcgagaagtccgccgccatcgatggggagtaccgcctgcggggagaagccaggaagacgttcgtggagttgatgcgccgcggggacctgcccgtgtggctgagctacaaggtcgctagcgagggcttccaatactcggaccggcgctggtgtttcgatggtgagcggaacaaccaagtgctcgaggaaaatatggacgtggaaatctggaccaaggagggtgaacgcaagaagctgaggccccgctggctggacgcccggacgtactctgaccccctcgccctgcgcgagttcaaggaatttgccgcgggcagacgctccatatcaggagatctgattctcgagatcggtaagctgccgcagcacctgacccagagggctcagaatgcgctcgataatctagttatgctgcataattccgagcagggtgggcgcgcctaccgccacgccatggaggagttaccggacaccatagagacactgatgctgctcgccctgatcgcggttctgacgggcggagtgaccctgtttttcctgagcgggcgcgggctgggtaaaacctccatcggccttctgtgcgtcatggcgagctctgccttgctctggatggcaagcgtggagccccattggatcgccgcgtccatcatcctcgagttcttcctgatggtgctcttaattcccgagcctgaccggcagagaacgccacaagacaaccagctggcctacgtcgtcatcgggctcctgttcatgatactgaccgtggcagcaaacgagatgggcctcctggagacgaccaagaaagacctggggatcggccatgtcgccgtggagaaccaccatcacgctaccatgctcgacgtggacctacatccagcgagcgcctggacgctgtacgccgtcgccacaaccatcatcaccccgatgatgaggcacactatagaaaacacgaccgcaaacatctccctcaccgccatcgccaaccaggccgcgatccttatggggctggacaagggatggccaattagcaagatggacatcggcgtgcccctcctggccctggggtgctattcccaggtgaaccccctcaccctaactgctgcggtcctgatgctcgtggcccactacgcgataatcggcccggggcttcaggctaaagccaccagagaggcccagaagcgcaccgcggccggcatcatgaaaaatcccaccgtggacggaatcgtcgcaattgacctggaccctgtggtgtacgacgccaagttcgagaagcagctcggccaaataatgctgctgatactttgcacgtcgcagattctgctgatgcggacaacctgggcgctctgtgaatccatcacacttgcaacgggtccactgaccaccctctgggaggggagcccaggcaagttctggaacaccactatcgctgtctctatggctaacatctttcgcggaagctacctggccggagccggcctggcgttcagcctcatgaagtccctcgggggtgggagacgcgggaccggggctcagggcgagaccctaggcgagaaatggaaacggcagctcaatcagctcagtaagtcagagttcaacacctacaagcgctcgggtatcttagaggtggaccggtccgaggccaaggagggcttacgtagaggtgagacgaccaagcatgccgtcagccgcgggaccgctaaactgcggtggttcgtcgagagaaacctggtgaagcccgaggggaaggtgatcgacttgggctgtgggcgcggcgggtggtcctactactgcgcggggctcaaaaaggtgaccgaggtgaagggatatacgaagggcggccctggccacgaggagccaatcccaatggccacttatggttggaacctggtgaagctgcactccggcaaggacgttttcttcatccccccggagaagtgtgacaccctcctgtgtgacatcggggagtcctcccccaaccctacgatcgaggaggggcgcacgctacgggtgctcaagatggtagaaccctggctgagaggtaatcagttctgcatcaagatcttgaacccctacatgccctccgttgtcgagaccctcgaacagatgcagcggaagcatggcggcatgctggtgcgcaacccgctgtcgcggaactccacccacgagatgtactgggttagctgcggtacaggaaacatcgtgtccgctgtgaacatgaccagccgcatgctcttaaaccgcttcacgatggcccatcggaaacccacctacgagcgcgacgtcgacctgggggccggcacccggcacgtggcggtggagcccgaggtcgccaatttagacatcattggccagcgcatcgagaacatcaagcatgaacataagtccacctggcactatgacgaggacaacccttataagacgtgggcctaccacgggtcgtacgaggtgaagccgtccggaagcgcgtcgagcatggtcaacggtgtggtgaagctgctgaccaagccttgggacgttatacccatggtcacgcagatcgccatgaccgacacgacaccctttggccagcagagggtcttcaaggagaaggtcgacacccgaaccccgaaggcgaagcggggcaccgcccagatcatggaggtgacggcacgctggctgtggggcttcctgagccggaacaagaagccccgcatttgtacccgtgaggagtttacgcgcaaggttaggtccaacgccgcgattggcgcagtcttcgtggacgagaaccagtggaatagcgccaaggaggctgttgaggacgagcgcttctgggacctggtccaccgggagcgggagcttcacaagcaggggaagtgcgccacgtgtgtgtacaacatgatgggtaagcgggaaaagaagctgggggagttcggcaaggcgaaaggttccagagccatctggtacatgtggcttggcgcccggtttctcgagttcgaggcgctgggcttcatgaacgaggaccactggttcagccgcgagaactccctgagcggggtggagggcgagggactacacaaactgggctacatcctgcgggatatctccaagatccccgggggcaacatgtacgcggacgacaccgcgggctgggacacacgaatcacagaggatgaccttcagaacgaggccaaaataaccgacataatggagccagagcatgccctgctggccactagcatcttcaagctgacatatcagaacaaggtcgtgcgcgttcaacgacctgccaagaacgggactgtcatggacgtgatcagccgccgtgaccagcgcggaagcggccaggtgggcacgtacggcctgaatacgtttacaaacatggaggcccagctaatccggcaaatggagtctgaggggatattcagcccctccgagctcgagactcccaacctggccgagcgcgtcctggattggctcgagaagtatggcgtagagcggctgaagcgcatggccatcagcggtgacgactgcgtggtcaagccgatcgacgatcggtttgcaacggcgctcaccgcgctcaatgacatggggaaggtgcgtaaggacatcccccagtgggagccttccaaggggtggaacgactggcaacaggtccctttctgtagccatcacttccaccagctgatcatgaaggacgggagagagatcgtcgtgccgtgccgcaatcaggatgagctggtgggccgggcccgcgtcagccaaggagcaggctggagcctccgtgagactgcatgcctgggcaagagctacgcccagatgtggcagttgatgtatttccacaggcgggacctccggctagcggccaacgccatctgttccgccgttcccttcgactgggtgcccacctcgcggacgacctggtccattcacgcgcaccaccagtggatgaccaccgaagacatgttatcagtctggaaccgagtgtggatcgaggagaacccctggatggaagataagacgcatatatcctcatgggaggacgtgccgtacctcgggaagagagaagaccagtggtgcggttccctgatcggcttaaccgcgcgggcgacctgggccaccaacatccaagtcgccataaaccaggtaagacggctcatcggcaatgagaactacctagattacatgaccagcatgaagcgctttaagaatgagtccgacacggagggggcgctgtggtga

SEQ ID NO: 23829 - RNA, 9879 nt, synthetic construct
  misc_feature 1..9879: note = derived and/or modified CDS sequence (opt11) from DENV-1__FJ639683__SS-prME
  source 1..9879: mol_type = other RNA
agcgtgaccatgctgctcatgctgatgcctaccgccctggccttccacctcactacccggggcggtgaaccccacatgatcgtgagcaagcaggagcggggcaagtcgctgctgtttaaaacaagcgcgggggtgaacatgtgcacactgatcgccatggacctgggcgagctgtgcgaggatacgatgacctacaagtgcccacggatcaccgaggcagagcccgacgacgtggactgctggtgcaacgccactgacacgtgggttacctacgggacgtgcagccagaccggtgagcaccggcgcgacaagcggtccgtggccctcgcgccccacgttggtctggggctcgagacgcgcaccgaaacatggatgagctccgagggagcctggaagcagatccaacgggtggaaacctgggccctccgccaccccgggttcacggtgatcgccctgttcctggcgcacgccatcggcacatcaattacccagaaggggatcatattcatcctcttaatgctggtgaccccctccatggccatgcggtgcgtcggaatcggctcgcgagacttcgtggagggtctctccggcgccacgtgggtggacgtcgtactggagcacgggagctgcgtgaccaccatggccaaggacaagcccaccttggatattgagctcctgaagacggaggtcaccaacccagcgatcttacggaagctctgcatagaggccaagatttccaacaccaccacagacagccgctgccccacccagggcgaggccaccctggtggaggagcaggacgcaaacttcgtgtgccggcggacattcgtcgatcggggctgggggaacgggtgtgggctgttcggcaaggggtccctcatcacgtgcgccaagttcaagtgcgtgaccaaactggagggcaagatcgtgcagtacgaaaacctgaagtacagcgtcatcgtgaccgtgcacaccggcgaccagcaccaggtcgggaacgagtccacggagcacgggaccaccgccacgatcacgccccaggcccccacgaccgaaatccagctcaccgactacggggccctgaccctggactgcagcccccgcacaggcctcgatttcaacgaaatggtgctgctgacgatgaaggagaaatcctggctcgtccacaagcagtggttcctggatctgccgctcccctggaccagcggggccagcacatcccaagagacgtggaaccggcaggacctgctggtgaccttcaagaccgcccatgccaagaagcaggaggtggtcgtgctcggcagccaggagggcgccatgcacaccgcactgacgggggcaaccgagatacagaccagtggcaccacaaccatcttcgctgggcacctgaagtgccgcctcaagatggacaagctgaccctgaagggcatgagttacgtgatgtgcaccgggtccttcaagttggagaaggaggtggctgaaacgcagcacggcaccgtactggtgcagatcaagtacgagggtacagatgccccctgcaagattcctttcagcacccaggatgagaagggggtcacgcaaaacggccggcttatcaccgccaacccgatcgtgaccgacaaggagaagcccgtgaacatcgaggccgagccgcctttcggggagtcctacatcgttataggcgcgggcgagaaggcactgaagttgagctggttcaagaaggggagtagcatcggcaagatgttcgaggccaccgcccgtggggcccggcgcatggcaatcctgggcgatacggcctgggacttcgggtccatcggcggcgtgttcaccagcgtgggtaaactggtacaccagatcttcggcaccgcctacggggtcctcttctccggcgtgagctggactatgaagatcgggatcggcgtcttactgacatggctcggcctgaactctaggagcacctcctttagcatgacctgcatcgccgtggggctggtgaccctctacctgggcgtcatggtgcaggccgactccgggtgcgtgatcaactggaagggccgggagctgaagtgcgggagcggcattttcgtcaccaacgaagtacacacctggaccgagcagtacaagttccaggcggacagcccaaagcgactctccgccgctatcggcaaggcctgggaggagggggtatgcggcatccgttcagccaccagattagagaacatcatgtggaagcagatctccaacgagttgaaccacatcctccttgagaacgacatgaaattcaccgtcgtggtgggggacgtcgctggcatcctggcccaggggaagaagatgatccggcctcagcccatggagtacaagtacagctggaagtcctggggcaaggccaagatcatcggcgccgacgtgcagaataccaccttcatcatcgacgggcccaacaccccggagtgtcccgacgaccaacgcgcgtggaacatctgggaggtggaggactacggcttcgggatcttcacgacgaacatatggctgaagctgcgggacagctacacccaggtctgcgatcaccgcctgatgtccgccgccataaaggacagtaaagccgtgcacgccgacatgggctactggatcgagtccgagaagaacgagacctggaaactcgcgcgggccagcttcatcgaggttaagacgtgcatctggcccaagtcccacacgctgtggagcaacggcgtcctggagtccgagatgatcatccccaagatctacggagggccaatctcgcagcacaactaccgccccgggtacttcacccagaccgccggcccctggcacttggggaagctggagctggacttcgacctatgcgagggcaccacggtggtcgtcgacgagcactgtggcaaccgcgggccgtctctgcgcaccaccacagtaacgggcaagatcatccacgagtggtgctgccggagctgcaccctgcctcccctccgcttccgcggggaggacggctgctggtacgggatggagatcagacctgtgaaggagaaggaggagaatcttgtcaaaagccttgtgagcgccggcagcggtgaggtggattccttcagcctcgggctgctgtgcatctccatcatgatcgaggaggtcatgcggtctagatggtcccggaagatgctcatgaccggcaccctcgccgtgttcctgctcctgatcatggggcagctgacgtggaacgacctcatccgcctgtgcatcatggtgggcgctaacgccagcgatcgcatggggatgggcacgacctacctggccctcatggccacattcaagatgcgaccaatgttcgccgtagggctgctgttccggaggctcacgtcccgcgaggtgctgctgctcaccatcgggctcagcctggtggcgtcagtcgagctccccaacagcctggaggagctgggcgacggtctcgccatgggcatcatgatccttaagctgctcactgattttcagtcccatcagctgtgggcaaccctccttagcctcacgttcatcaagaccaccttctccctgcattacgcctggaaaaccatggcgatggtgctcagcattgtctccctcttcccattgtgcttaagcacgacctcccagaagactacctggctgcccgtgctgctcggcagcctggggtgtaaacctctgacgatgttcctcatcgcggagaacaagatctggggcaggcgctcctggccgctgaacgaggggatcatggccgtgggcatcgtctcgatcctgctcagctccctgctgaagaacgacgtgcccttagcaggacccctgatcgccgggggcatgctgatcgcgtgctacgtaatcagcgggtccagcgccgacctctccctggagaaagccgctgaggtcagctgggaggaggaggccgagcactcgggcgcgagccacaacatcctggtagaggtccaggacgacgggaccatgaagatcaaggatgaggagcgggacgacaccctcaccatcctgctgaaggccaccctcctggccgtctccggtgtgtacccgctgtcgatccccgccaccttattcgtctggtatttctggcagaagaagaagcagcgctccggggtcctgtgggacaccccctcaccgcccgaggtagagcgggccgtgctggacgacggcatctacagaatcatgcagcggggcctgctcgggcgatcccaggtcggcgtgggggtgttccaagagaatgtcttccacaccatgtggcacgtgacccggggcgcggtacttatgtaccaggggaagcgcctggaacccagctgggcttccgtcaagaaggaccttatcagctacggcggcgggtggcggctgcagggttcctggaacacgggggaggaggtgcaggtaatagccgtcgagcccggaaagaaccccaagaacgtgcaaactgcacccgggacctttaagacacccgagggcgaggtgggcgccatcgcgctggacttcaagcccgggactagcggaagccccatagttaaccgcgaggggaagatcgtgggcctctacggcaacggggtggtcaccacaagcgggacctacgtgtcagccatcgcccaggctaaggcgagccaggaggggccgctgcccgagatcgaggacgaggtctttcggaaacgaaacctgacgatcatggatctccaccctggaagcgggaaaactcgacgctatctgccggctatcgtaagagaggccatcaaaagaaagctgcgcaccctcatcttagcccccacccgggtggtggcctccgagatggcagaggcccttaagggcatgcccatacgctaccagacgaccgccgtcaagagcgagcacaccgggaaggagatcgtggacctcatgtgccacgccaccttcacgatgagactcctgtccccagtgcgcgtcccgaactacaacatgattatcatggacgaggcccacttcaccgacccctcgtccatcgcggcccgggggtacatcagcacccgcgtgggcatgggggaggccgccgccatcttcatgactgcgacgccgcccggctcagtggaggcatttccgcagagcaacgccgtcatccaggacgaagagcgtgacatcccagagcgcagttggaacagcgggcacgagtggatcacagacttcccgggcaagaccgtgtggttcgtgccatccatcaagtccggcaacgacatcgctaactgcctccggaagaacgggaagcgcgtcatccagctctcacggaagaccttcgacacggagtaccagaagactaagaacaacgactgggactacgtcgtgaccacagacatatcggagatgggcgctaactttcgcgcggacagggtcatcgacccgcgccggtgcctgaagcccgttatcctcaaggacgggccagagcgtgtgatcctagccggccccatgcccgtcacggtggcctcagccgctcagcggcgcgggagaatcgggcgcaaccacaacaaggagggcgaccagtacatctacatggggcagcccctgaacaacgacgaggaccacgcccactggaccgaggccaagatgctcctggacaatatcaacacccccgagggcatcatccccgccctgttcgagccggagcgcgagaagtcagccgcgatcgacggggagtaccggctccgcggagaggcccggaaaaccttcgtcgagctgatgcgccgcggggatctgccggtgtggctctcctacaaggtggcctctgagggttttcagtacagcgacaggcggtggtgcttcgatggtgagcgcaacaaccaagtgctggaagagaatatggacgtggaaatctggacgaaggagggggagcggaagaaactgcgcccccggtggttagacgcccgcacctactccgaccccctggccctgcgggaattcaaggagttcgcggccggcaggcggagcgtgtccggggacctcatcctggaaattggcaagctgccgcagcacctaacccagcgcgctcagaacgccctggacaacctggtcatgctccacaacagcgagcagggcgggcgggcttaccgccacgccatggaggagctccccgacaccatcgagacgctgatgctcctggccctgatcgccgtgctcaccgggggggttaccctattcttcctgtccggccgggggctcggcaagaccagcatcggcctcctgtgtgttatggcctcctcggtgctcctgtggatggcgtccgtggagccccactggatcgccgccagcatcatcctggagttcttcctcatggtcctgctgatacccgaaccggaccgccagcggacgccccaggacaaccagttggcctacgtggtcatcgggctgctgttcatgatcctcacagttgccgcgaacgagatgggcctgctggagaccaccaagaaggacctcgggatcggccatgtggccgtgggtaaccaccaccacgccgcaatgctggacgtggatttgcaccctgccagcgcgtggaccttatacgccgtggccacgaccatcatcacgccaatgatgcgccacaccatcgagaacacgaccgccaacatctcccttaccgccatcgcgaaccaggctgccatcctgatgggcctcgacaagggctggcccatctccaagatggacatcggggtgcccctgcttgccttaggctgctactcccaggtcaacccgctgactctgaccgcggccgtgctcatgctggtggcccactacgccataatcggaccgggcctgcaggccaaggcgacgcgcgaggcccagaagcggaccgccgccgggattatgaagaatcccaccgtcgatggcatcgtggccatcgacctcgaccccgtggtctacgacgctaagtttgagaaacagctgggccagatcatgctgctcatcctgtgtacgtcgcagatcctgctcatgcgcaccacctgggccctgtgtgagagcatcaccctggcgacggggcccctcaccaccctgtgggagggctccccggggaagttctggaacacaacgatcgccgtgagcatggccaacatcttccggggctcctacctggcgggcgccgggctcgccttcagcctgatgaagagcctgggcgggggccgccgggggaccggcgctcaaggcgagaccctgggagagaagtggaagcgtcagctaaatcaactgtccaagagcgagttcaacacctacaagcggtccggcatcatggaggtggaccgcagcgaggcgaaggagggcctaaagcggggcgagactaccaagcacgccgtctcccgtgggaccgccaaactgcggtggttcgtagagcgcaacctggtcaagcccgagggcaaggtcatcgacctgggctgcggtaggggcgggtggagctactactgcgcaggcctcaagaaggtgactgaggtgaagggatacacgaagggcggccccgggcacgaggagcccatcccgatggccacttacgggtggaacctagtcaaactgcactctgggaaggacgtgttcttcgtgccgcccgagaagtgcgataccctcctttgcgacatcggagagagctcccctaacccgaccatcgaagaggggcgcacgctgcgggtcttgaagatggtggagccctggctgcgcggcaaccagttctgcatcaaaattctgaacccctacatgccctccgtggtcgagaccctcgagcagatgcagcggaagcacggcgggatgctggtccgcaacccgctgtcgcggaactcgacccacgagatgtactgggtgtcctgcgggacgggtaacatcgtcagcgcggtgaacatgacctcccgcatgctcctgaaccgctttacgatggcccaccgaaagcccacctacgaacgcgacgtggatctgggcgccggcacccggcacgtcgcagtggaacccgaggtggccaacctggacataatagggcagcgcatcgagaacataaagcacgagcacaagagcacctggcactacgacgaggacaacccctacaagacgtgggcgtaccacggttcctacgaggtcaagccaagcgggtccgccagcagcatggttaacggcgtcgtgaagctgctgacaaagccctgggacgtgatccccatggtcacccagatcgcgatgaccgatacgacccccttcgggcagcagcgggtgttcaaggagaaggtggacacccgtacaccgaaggccaagcggggaacggcccagatcatggaagtcaccgccaagtggctctggggcttcctgtcccgcaacaagaagccccggatctgtacccgcgaggagttcacgagaaaggtgcgcagcaatgccgccatcggggccgtgttcgtcgacgagaaccagtggaactccgccaaggaggcggtggaggacgaacggttctgggacctggtgcaccgcgagcgggagttacacaagcagggcaagtgcgccacgtgcgtctataacatgatggggaagcgagagaagaagctgggcgagttcggcaaggccaagggcagccgggccatctggtacatgtggctgggggcgcgcttcctcgagttcgaggccctgggcttcatgaatgaggaccactggttctcccgggagaactccctgtccggcgtggaaggggaaggcttgcacaagctggggtacatactgcgcgacatcagcaagatccccggtggcaacatgtacgccgacgacaccgccgggtgggacacccggatcaccgaggacgacttgcagaacgaggctcgcatcacggacataatggagccggagcacgctctactggccaagtccatcttcaagctcacctaccaaaataaggtggtccgcgtgcaacggcccgccaagaacggcacagtgatggacgtcatctcccgccgggaccagcgcggttccggccaagtgggaacctacgggctgaacacgttcaccaacatggaggcccagctgatccggcaaatggagagcgagggcatcttttcccccagcgagctcgagacccccaacctggccgaacgcgttctggactggctcgagaagtacggggtcgaacggctgaagcgcatggcgatctccggcgacgactgcgttgtgaagccgatcgacgaccggttcgccaccgccctcacggccctaaatgacatggggaaagtccgcaaagatatcccccagtgggagccaagcaaggggtggaacgactggcagcaggtccccttctgctcccaccacttccaccagctgataatgaaggatggccgggagatcgtggtcccgtgccgcaaccaggacgagctggtgggacgcgcgcgtgtgagccagggtgcggggtggtcgctccgagagaccgcctgcttaggcaagtcctacgcccagatgtggcagctgatgtattttcaccgcagagacctccgcctggccgcgaacgccatctgtagcgccgtccccgtggactggatccccacctcccggaccacgtggagcatccacgcccaccaccagtggatgaccaccgaggacatgttgtctgtgtggaaccgcgtctggatcgaggagaacccctggatggaagacaagacccatatcagctcctggggcgacgtgccgtacctcggcaagcgcgaggaccagtggtgcggcagcctgatcgggctgacggcccgggcgacatgggcgaccaacattcaggttgccatcaaccaggtccgtcggctcatcggcaacgagaattacttggactacatgacctccatgaaacgctttaaaaacgagagcgaccccgagggggcactatggtga

SEQ ID NO: 23830 - RNA, 9879 nt, synthetic construct
  misc_feature 1..9879: note = derived and/or modified CDS sequence (opt11) from DENV-1__FJ639684__SS-prME
  source 1..9879: mol_type = other RNA
agcgtgaccatgctattaatgctgatgcccaccgcgctggccttccatctcaccacccgtggcggggagccacacatgattgtgtccaagcaggagcgcggcaagagccttttatttaagacctctgcgggcgtcaacatgtgcaccctcatcgccatggaccttggggaattttgcgaggatacaatgacctacaagtgcccccgcatcagcgaggccgagcccgacgacgtggattgttggtgcaacgcgaccgacacatgggtgacctacgggacctgctcccagaccggcgagcaccgacgcgataagagaagcgtggccttagcgccccatgtgggcctagggttggaaacccggacagagacctggatgtccagcgaaggcgcctggaagcagattcaacgggtcgagacatgggcgctacgccaccccgggttcaccgtcatcgccctcttcctggctcacgccatcggcacgtccatcacccagaagggtatcatcttcatcctgctcatgctggtaacccccagtatggccatgcggtgcgttgggataggctcccgggattttgtggagggtctgtccggcgcgacctgggtcgacgtggtgctggagcatggatcctgcgtgacgaccatggccaaggacaagcctactttagacatagagttgctcaaaaccgaggtcacgaaccccgcggtcctgcggaaactgtgcatcgaggccaagatatcaaataccaccacggactccagatgcccaacgcagggcgaggccaccttggtcgaggaacaagacgccaactttgtatgcagacgcaccttcgtggaccgggggtggggaaacggctgcggtctgttcggcaaggggagtttgatcacgtgcgccaagtttaagtgcgtgacgaaattggagggaaagattgtccagtacgagaacctgaagtacagcgtcatcgtgaccgtccacaccggagaccagcaccaggtggggaacgaaagtaccgaacacggcacgaccgcgaccatcacgccgcaagccccttccaccgaaattcagttaacggactatggagccctcaccctggactgttctccacgaacggggctggatttcaacgagatggtcctcctgacaatgaaggaaaagtcttggctggtacacaaacaatggttcctcgacctgccgctaccctggacgtcgggggcaagcacctcccaggagacctggaaccggcaggacctcctcgtgaccttcaagacggctcatgcgaagaagcaggaggtggtggtgctgggctcccaggaaggcgctatgcacaccgccttaactggtgctaccgagatccagacgtccgggacaaccactatctttgcagggcacctgaaatgccggctaaagatggacaaactcacgctgaagggtatgagctatgtaatgtgcactgggagctttaaactggagaaggaggttgctgagacccaacatggcaccgtgctcgtccagatcaagtacgagggaacagacgccccctgtaaaattcccttctccacccaggatgagaagggggtgacccagaacggccgactgataaccgccaacccgattgtgacggacaaggagaagcccgtcaacatagaggccgagccgccctttggggagtcgtatatcgtgatcggcgcgggcgagaaggcactcaagctgagctggttcaaaaaggggtcttcaatcgggaaaatgttcgaggccaccgcccgcggggcccgtcgtatggccatcctcggtgatacggcatgggatttcgggtccattggcggcgtgttcaccagtgttggaaagcttgtgcaccaaatcttcgggacggcctacggggtgttattctccggcgtctcttggacaatgaagatcggtatcggcgttctcctgacgtggctgggcctgaattcccgcagtacctctctgagcatgacgtgcatcgccgtggggctcgtcaccctctatctgggcgtaatggtacaggcggacagcggatgtgtcatcaactggaagggccgggaactgaaatgcgggtccggcattttcgtgaccaatgaggtgcacacatggacggagcagtataaatttcaggctgactcgcctaagcgcctctccgccgcgatcgggaaagcatgggaggaaggtgtctgcggcatacggagcgcgacacgcctggagaacatcatgtggaaacagatctccaacgagctgaaccacatattactagagaacgacatgaagttcacggtggtggtcggagacgtggcggggatcctggcccagggaaagaagatgatccggccccaacccatggagtacaagtacagctggaagtcttggggaaaagccaaaatcatcggcgctgacgtgcagaacaccaccttcatcatcgacggtccaaacacgccggagtgcccggacgatcaaagggcgtggaatatctgggaggtagaggactacgggtttggcattttcaccaccaacatttggctcaagctgcgggacagctacacccaagtttgcgaccatcggctgatgtctgctgccattaaggacagcaaggccgtgcacgccgacatggggtactggatcgagagcgaaaagaacgagacgtggaagctggcgcgggcaagcttcatcgaagtcaagacctgcatctggcctaagtcccacaccctctggagcaacggggtgctcgaatccgagatgattattcccaagatctacggaggcccgatcagccagcacaactatcgccccggttactttacccagacggcaggaccctggcacctcgggaagctggaactggacttcgacctctgcgagggtaccacggtggtcgtggacgagcattgcggcaacaggggcccttccctccgcaccacaaccgttaccggaaagatcatccatgaatggtgttgccggagctgtactcttccacccctccgcttcaagggggaagatggctgctggtacgggatggagatccgccccgtcaaggaaaaagaggagaacctggtgaagagcatggtctcggccggaagcggcgaggtcgactcgtttagtctggggctactttgcatctccataatgatcgaggaagtcatgcgctcacggtggtcccgcaagatgcttatgacgggcaccctcgccgtttttttcctactgatcatgggccaattaacctggaatgatctgatccggctgtgcatcatggtcggcgccaacgcgagcgaccgcatggggatggggatgacctatctcgcattgatggccacattcaaaatgcgcccgatgttcgctgtggggctcctcttccggcgcctaacctcacgggaagtgctgctcctcaccatcgggctgagcctcgtagcttcggtggagctgcccaatagcctagaggagctcggggatgggttggccatgggaatcatgatcttgaaactcttgaccgacttccagtcccaccagctgtgggccactcttctctctctgacctttatcaagacaaccttctcccttcactacgcctggaagacgatggccatggtcctgagcatcgtgtctctgttccccctctgtctgagcactaccagccagaagacgacctggcttcccgtgctcctgggctccctggggtgcaaaccgctcacgatgtttctcatagcggagaataagatctggggccgcaagagctggcccctgaacgaggggatcatggccgtcggcatcgtgtccatcttgctgtcaagtctgctgaaaaacgacgtgccactggccgggccgctgatcgcgggcggcatgctcatcgcttgctatgtcatctcagggtcctcggccgacctgtccttagagaaagccgccgaagtgtcctgggaagaggaggccgagcattcgggggcgagccacaacattttagtcgaggtccaggacgacggaaccatgaaaatcaaggatgaggagcgggacgacacgctgacgattctgctcaaggccacacttttggccgtgtccggagtctatccgctcagcatccccgccaccctgttcgtatggtacttctggcagaagaagaagcagcgctccggggtactgtgggatacaccctcaccccctgaagtggagagggcggtgctcgacgacggcatctaccgcatcatgcagcggggcctgcttgggcgctcacaggtgggcgtgggggtctttcaggagaatgtgttccacaccatgtggcacgttactcggggcgcggttctgatgtaccaagggaaacgccttgagcccagttgggcctctgtgaagaaggacttgatcagctacggaggcggctggcggctgcaggggagttggaacacaggtgaagaggtgcaggtcatcgccgtggagccgggcaaaaaccccaagaacgtccagactgcccccgggacctttaagacgagcgagggcgaggttggcgccatagcgctcgacttcaaacccgggaccagtggctcccccatcgtgaatcgtgagggaaagatcgtgggcttatacggcaacggggtcgtgaccacgagcggcacatacgtgtccgccattgcccaggcaaaagcgagccaggaggggcccctgccagagatcgaggatgaagttttccgaaagcggaacctcaccatcatggacctgcacccggggtccggcaagacgcggcgctacctgcccgcaatagtgcgggaggcgataaagcgcaagttgcgcactctcatcctggccccgacgcgagtagtcgccagcgagatggctgaggccctcaagggaatgccaatccggtaccagacgacagccgttaaatctgagcacaccgggaaagagatcgtggatctgatgtgccacgccaccttcacaatgcgactgctcagcccagttcgcgtgcctaactacaatatgattattatggacgaggcccacttcaccgatccctcaagcattgctgcccgggggtacatttccaccagggtgggtatgggcgaggccgccgctatctttatgacagcgacgcctcccggttcagtcgaggcctttccccagtcgaacgcagtgatccaggatgaagagcgtgacatccctgagaggagctggaatagcgggtacgagtggatcacagacttccctggcaagaccgtatggttcgtccccagcatcaagtctggaaacgacatcgcgaactgcctgcgcaagaacgggaagcgcgtcatccagctgtcaagaaagacgttcgacaccgagtaccaaaagaccaagaacaacgactgggactatgttgtaaccacggatatctccgaaatgggcgcaaacttcagagcagaccgggtgatcgacccccgccggtgccttaagccagtgatactgaaagacgggccggagcgcgtcatactcgccggccccatgccagtaaccgttgcctccgccgcgcagcggcgcgggcgtatcggccggaaccataacaaagagggcgatcagtacatctacatggggcaaccccttaacaacgatgaggaccacgctcactggactgaggccaagatgctgctggataatataaacacgcccgagggcatcatcccagccttgttcgaacccgagcgggaaaagagtgcagcgatcgatggggagtaccgcctgcgcggggaggccagaaaaacgttcgttgagctaatgaggcgcggagacctccccgtttggctgtcctataaagtcgccagcgagggcttccagtactccgaccgccgttggtgcttcgacggcgagagaaacaaccaggtgttagaggagaacatggacgtggagatctggaccaaggagggggagcgtaagaagctccgccccagatggctggacgcccgcacctactcagaccccctggccctccgcgagtttaaggagttcgccgccggccgcagaagtgtcagcggggaccttatcctggaaattggcaagctcccccaacacctgacccagcgcgcccagaacgccttagataacttggttatgctccacaattctgaacaaggtggccgggcgtaccgccacgcgatggaagagttgccggatacgatcgagacgctcatgctgttagccctcatcgccgtgctgacaggcggggtcacactgttcttcctttccggccgggggctcggtaagacgtctataggtctgctctgtgtcatggctagctccgttttgctgtggatggcgagcgtcgagccgcactggattgccgcttcgatcattctggaattctttctgatggttctgttaataccagaaccggaccgccagcggaccccgcaggacaaccagctggcctacgtggtcatcggcctcctcttcatgattctgacggtcgcggcgaatgagatggggctactagagactaccaagaaagacctgggcatcggccacgtggccgtcgaaaaccaccatcatgcagccatgctggacgtggacctccacccggcgagcgcgtggacgctgtacgctgtggcaaccactatcatcacccccatgatgagacacacgatcgagaacacgaccgccaacatctccctgactgcgatcgccaaccaggccgccattctcatggggttagacaaaggctggccgatctcaaaaatggatataggcgtcccccttttagccctggggtgctacagccaggtgaaccccctaactctcaccgcggccgttctgatgctggtcgcccactatgcaatcattggccccgggctccaggccaaggccacccgggaggcccaaaaacgcaccgccgccggaatcatgaagaacccaacggtggacgggattgtagcgattgacctagacccggtcgtgtatgacgcgaaattcgagaagcaattgggccagataatgctactgattctctgcacctcacagatcctcctgatgcgaacgacctgggcgctatgcgagtcaatcaccctcgcaaccggtccccttacaaccctgtgggaggggagcccggggaagttttggaacacaactattgccgtgagcatggccaacatattccgtggctcttacttagcaggcgccggcctggccttctccttaatgaaatccctcgggggcgggcgccgtggcaccggtgcccagggtgagacccttggcgaaaagtggaagcgccagctaaaccagcttagcaagtccgagttcaacacttacaagcggtcgggcatcatggaggtcgacaggtccgaagccaaggaaggcctgaaaagaggcgagaccaccaagcacgccgtttcacgcgggactgccaaactccggtggttcgtggagcgcaacctcgtcaagcccgaagggaaagtgatcgacctaggctgcggccgcggagggtggtcatattattgcgccgggctgaagaaggtgacggaggtcaaggggtacaccaagggcggacctggccacgaggagccaatcccaatggccacctatggttggaacctcgtgaagttacatagcggaaaggatgtgttcttcgtaccgcccgaaaagtgcgataccctactgtgtgacatcggggagtccagccccaacccgacgatcgaggagggccgcaccttacgtgtgctgaagatggtggaaccgtggctgcgcgggaaccagttttgcatcaagatcctcaacccttacatgccctccgtggtggagactctagagcagatgcagcgcaaacacggcggcatgctggtgcgcaaccccctcagccggaatagcacgcatgaaatgtactgggtcagctgcggtacgggtaacatcgtgtcggcggtgaatatgaccagccgcatgctgctgaatagattcaccatggcccaccgtaagccgacctacgaacgagatgtggacttaggggccggcacccggcacgttgccgtggaacccgaggtagccaatctggacataataggacagcgtatagagaacattaagcacgagcataagtccacatggcattacgacgaggacaacccctacaaaacttgggcgtaccacgggagctacgaggtgaagccctcaggctcggcctcatccatggtcaacggggtggtgaagctgctcacaaaaccatgggacgtgatcccaatggtgacccaaatcgctatgacggacaccacccccttcggccagcagcgggtgttcaaggagaaggtggacacacgcacgcctaaggccaagcgcggaaccgcgcagattatggaggtgaccgcgaaatggctatggggctttctgagccgcaacaagaagccgcgtatatgcactcgcgaggagtttacgcggaaggtgcggtccaacgccgccataggcgcagtatttgtggacgagaaccagtggaacagcgcgaaggaggcggtggaggacgagcgcttctgggatctggtccaccgggaacgggagctgcataagcagggaaagtgtgcgacctgcgtttacaacatgatggggaagcgagagaaaaagctaggggagttcggcaaagccaaagggtcccgagccatctggtacatgtggctcggcgcccgcttcctggagttcgaggccctgggtttcatgaacgaggaccactggttttcccgggagaattccctgagcggagtggagggagaggggctgcataaacttggctacatactccgggacatttccaaaatcagcgggggcaatatgtacgccgacgacacggctggctgggacacacggatcacggaagacgacttgcaaaacgaggcgaagattaccgacattatggagccagagcacgcactgctggccaaatcaatcttcaaactgacataccaaaacaaggtggtccgtgttcagagacccgcgaagaacgggacagtcatggatgtgataagccggagagaccagcggggctctggacaggtggggacttacggcctgaacaccttcaccaacatggaggcacagttgatccgccaaatggagagcgaaggaatcttctcaccgtcggaactggagacccccaatctcgccgagcgggctttagactggctggaaaagcacggcgtcgagcgtctgaagcgcatggccatcagcggggacgactgcgtggtgaagccgattgacgatcggttcgctaccgccctgacagccttgaacgacatggggaaggtccggaaagatataccccagtgggagccatccaagggttggaacgactggcagcaggtacccttctgctcccatcacttccaccaactgataatgaaggacgggcgcgagatcgttgtcccctgccggaaccaggacgagttggttggccgagcacgcgtgtcgcagggggcgggttggagcctgcgcgagaccgcctgcttgggaaaatcttacgcccagatgtggcagctcatgtacttccacaggagggacctgcgtctggcggccaacgccatttgctctgcggtcccggttgactgggtgccgaccagtcgcacaacctggagcatccatgcccaccaccaatggatgacaaccgaagacatgctttccgtatggaatcgggtgtggatagaggagaacccctggatggaggacaagacacacatcagcagttgggaggacgtgccctacctaggcaagcgcgaggaccagtggtgtgggtcactcatcggactcacagcacgggctacctgggctaccaacatccaggtagccatcaaccaggtcaggcgacttataggcaatgaaaattaccttgattacatgacgtcaatgaagcggttcaagaatgaatccgtgcctgagggagctctctggtga

SEQ ID NO: 23831 - RNA, 9879 nt, synthetic construct
  misc_feature 1..9879: note = derived and/or modified CDS sequence (opt11) from DENV-1__FJ639685__SS-prME
  source 1..9879: mol_type = other RNA
agcgtaactatgttgctcatgctgatgccaaccgccctggccttccacctcacaacgcggggaggggaaccacacatgatcgtgagcaagcaagagcggggaaagtcgctgctgttcaagacctcagcgggggtgaacatgtgcaccctcatcgccatggatcttggcgagctgtgcgaggacaccatgacctacaaatgcccccggatcacagaagccgagcccgacgacgtggactgctggtgcaacgcgaccgacacgtgggtcacatatggtacctgcagccagaccggcgagcaccggcgcgacaagcggtccgtggcactcgcgccccatgtcggtctggggctagagacgcgcaccgaaacctggatgagctccgagggcgcctggaaacagatccagagggttgagacttgggccctcaggcaccccgggttcacggtgatcgccctgttcttagcgcacgccatcggcacctcgattacccagaaggggatcatcttcatcctcctgatgctggttaccccctccatggccatgcggtgtgtagggatcgggtcccgcgacttcgtggagggattaagtggcgccacgtgggttgacgtagtgctggagcacgggagctgcgtgactaccatggctaaggataagccgacccttgacatcgaactcctgaagacggaggtcaccaacccggctatcctgcggaagctctgcattgaagccaagatctccaataccactactgactcgcgctgccccactcagggagaagccacccttgtggaggagcaggacgccaacttcgtgtgccgccgaaccttcgttgatcggggctggggaaacggatgcgggctgttcggaaaggggtccctcataacttgcgccaagtttaagtgtgtgacaaaactggagggcaagatcgtgcagtacgagaatctgaaatactccgttatcgtgaccgtacacaccggcgaccaacaccaagtcggcaacgagtccacggagcacggcaccaccgccacaatcacgccccaggcccccacgaccgagatccagctcacagactacggagctctgaccctggactgcagcccccgcacaggcctcgacttcaacgagatggtgttattgaccatgaaggaaaagtcctggctcgtccacaagcagtggtttctggatctgccgctcccgtggacaagcggggccagcacctcccaggaaacgtggaaccggcaagacctcctagtgacattcaagaccgcccacgcgaagaagcaggaggtggtggtgctcggcagccaggagggcgccatgcacaccgctctgacgggggccaccgagattcagacctccggcaccacgacgatctttgcagggcacttaaagtgccgcctgaagatggacaagctcactctcaagggcatgtcctacgtgatgtgtaccggatccttcaagctcgagaaggaggtcgcggagacgcaacacggcacggtgctggtgcagattaaatacgagggcaccgacgccccctgcaaaatcccctttagcacccaggatgagaagggggtgacgcagaacggccgtctgatcactgccaacccgatcgtgaccgacaaggaaaagcccgtgaatatcgaggccgaaccgcccttcggggaatcctacatcgtaataggagcgggcgagaaagcgctgaagctcagctggttcaaaaagggatccagtatcggaaagatgttcgaggctaccgccaggggggctcggcgcatggcgatactaggtgatacggcctgggactttgggtccataggcggcgtgtttacaagcgtggggaagctggtccaccagatcttcggcactgcctacggggtcctgttttcgggcgtaagctggaccatgaagatcgggatcggcgtcctgctgacgtggctcggcctaaattcccgcagcacctctttcagtatgacctgcatcgccgtggggttagtgaccttatacctcggtgtcatggtgcaggccgactccggatgcgtgatcaactggaaaggacgggagctgaagtgcgggagcggcattttcgtcacgaacgaggtgcacacctggaccgagcagtacaaattccaggctgacagccccaagaggttatccgccgccatcggtaaggcctgggaggagggagtgtgtggcatccggagcgccacccgcctcgagaacatcatgtggaagcagatctccaacgaactgaatcacatcctcctggagaacgacatgaaattcacggttgtggtgggcgacgtcgccggcatactggcccaggggaagaagatgatacggccccagcctatggagtacaaatacagctggaagtcctggggcaaagccaagatcatcggcgcggatgtgcaaaacaccaccttcatcatcgatgggcccaatacccctgagtgccccgatgaccagcgcgcgtggaacatctgggaggtggaggactacggcttcgggatcttcaccacgaacatctggctcaagctgagagacagctatacccaggtatgcgaccataggctgatgtccgccgccatcaaggacagcaaggcagtgcatgccgacatgggctactggatcgaatccgagaagaacgagacctggaaactggcgagagccagctttatcgaggtgaaaacctgcatctggcctaagtcacacacactatggagcaatggcgtactggaaagcgagatgatcatccccaagatctatgggggcccgatcagccagcacaactacaggcccgggtatttcacccagaccgccgggccctggcatctcgggaagcttgaactggactttgacctttgcgagggcaccacggtggttgttgacgagcactgtggcaatcgggggccgtccctgcgcaccaccacggtgactggcaagatcatccacgagtggtgctgccggagctgcaccttaccgcccctccgctttcgcggggaagacggctgctggtatgggatggagatccggcccgtgaaggagaaagaggagaacttggtcaagtccatggtgagcgccggctcgggcgaggtggactccttcagcctggggctcctgtgcatctcgatcatgatcgaggaggtcatgcgctcacgctggtcccggaagatgctgatgaccggcacccttgcagtattcctgctgctcatcatgggacagttgacttggaacgacctgatacgcctgtgcatcatggtgggtgcgaacgccagcgaccgtatgggtatgggaaccacgtacttggccctgatggccaccttcaagatgcgaccgatgttcgccgtcgggctcttgttccgccggctgacgtccagagaggtactcctgcttaccattggcctctcgctggtggcgtccgtcgagttgcccaactccctcgaggagctgggcgacgggttggctatgggcatcatgatcctcaagctgctgacagacttccagtctcaccagctctgggccaccctgctgagcctgacattcatcaagacgaccttttccctgcattacgcctggaagacaatggcaatggtgctcagcatcgtctccctcttccccctgtgtctgagcacgacctcccagaagaccacctggctccccgtgctcctgggaagccttggctgcaagccgctgacgatgttcctgatcgcggagaataagatctggggcagacgttcctggcccctgaacgaggggatcatggccgtgggcatcgtctcgattctactcagctccctcctgaaaaacgacgtgcctcttgcgggtcccctgatcgcgggcggcatgctgatcgcctgctacgtgatcagcgggtcctccgcagacctgagtctcgagaaggccgccgaggtcagctgggaagaagaggcagagcactccggcgcgagtcataacatcctggtcgaagtgcaagatgacgggactatgaagatcaaggatgaggagcgggacgacaccctgacgatcctcttgaaggccacactgcttgctgtgtccggcgtgtacccgctgagcatacctgccacgctgttcgtgtggtacttctggcagaagaagaagcaacgctccggtgtcttatgggacacgcctagcccgcccgaagtggagcgggccgtgctggacgatggcatctaccgcatcatgcagcgtggactgcttggtcgctcccaggtcggcgtcggggtcttccaggagaacgtcttccacacgatgtggcatgtgacgcgtggcgccgtcctcatgtaccagggtaagcgcctggagcccagttgggccagcgttaagaaggaccttatctcatacggcggcgggtggaggctccagggctcgtggaacacgggggaggaagtccaggtgatcgccgtcgagcctggcaagaatcccaagaatgtgcagaccgccccaggtaccttcaagacgcccgagggagaagtgggcgccatagctctggacttcaagccgggcacgagcggctcccccatcgtaaaccgcgaggggaagatcgtgggactgtacggcaacggagtcgtcaccaccagtggcacctacgtaagcgccatcgcccaggccaaggcttcccaggaggggccgctacctgagatcgaggatgaggtgttccgtaagcgaaacctaacgataatggacctgcaccctggcagtggcaagactcggcgctatctccctgccatagtccgcgaggccattaagcggaaactgcggacgttaatcctggcccccacccgggtggtggcgtccgagatggccgaggccctgaagggtatgcctatccgctaccagacgaccgccgtcaagtctgagcatactggtaaggagatcgtggacctgatgtgccacgcaaccttcacaatgcggctcctgagtccagtcagggtcccgaattataacatgatcatcatggacgaagctcatttcaccgacccaagctccatcgccgcacgggggtacatcagcacgcgcgtgggcatgggtgaggccgccgccatctttatgacagctacgccgccaggctccgtggaggccttcccgcagagcaacgccgtcatccaggacgaggaacgggacattcccgagcgatcctggaacagcgggtacgagtggataaccgacttccctgggaagaccgtatggttcgttccctccatcaagagcggcaacgacatcgccaactgcctgcggaagaacgggaagcgcgtgatacagctctcacggaagaccttcgacacagagtaccagaagacgaagaacaacgactgggactatgtggtcactaccgatatcagcgagatgggtgcgaacttccgcgccgaccgggtcatcgacccgcgacggtgcttgaagcccgtgatactaaaggacgggccagagcgcgtgatcctcgccggcccgatgccagtgacggtggcctccgccgcgcaacggcgcggtcgcatcggtcgcaaccacaacaaggagggagaccagtacatctacatgggtcagcccctgaacaacgacgaagaccatgcccactggaccgaggccaaaatgctactcgacaacataaacacacccgaaggcatcatccccgccctctttgaaccggagcgggaaaagtccgccgccatcgacggcgagtaccggctgcgcggagaggctcgcaagaccttcgtcgagctaatgcgccgcggcgacttgcccgtctggttatcctacaaggtggccagcgaaggcttccaatacagcgaccgtcggtggtgcttcgacggcgagcgtaacaaccaggtgcttgaggagaacatggacgtcgaaatctggacgaaggagggcgagaggaagaagttaagaccccgttggctggacgccagaacatactcagaccccctcgcgctgagggagttcaaggagttcgcagccggccgccggagcgtgagcggggacctgatactggagatcggcaagctgcctcagcacctcacccagcgcgcacaaaacgccctcgacaacctggtcatgctgcacaatagtgagcagggtgggagagcgtaccgtcacgccatggaggagctcccagacaccattgagacactaatgttacttgccctgatcgccgtgctgaccggcggcgtgaccctcttcttcctgtcaggcagaggactgggtaagaccagcataggcctcctgtgtgtcatggccagtagcgtgctgctctggatggcgagtgtggagccgcactggatcgccgcgagcatcatcctggagttcttcctaatggtcctcctgatccccgagccggaccgccagaggacgcctcaggacaaccagctggcctacgtggtgatcggcttactgtttatgatactgacggtagccgccaacgagatgggcctcctggagaccaccaagaaagatctggggatcggacacgtggcggccgggaaccaccaccacgccgcaatgttagatgttgacctgcatcccgcgtccgcctggaccctgtacgccgtcgcaacgaccatcatcaccccaatgatgcgccacaccatcgagaacacgaccgccaacatcagcctcaccgctatagcaaaccaggccgctatcctgatgggcctggacaaggggtggcccatcagcaagatggatatcggggtgccccttctcgcgctgggctgctactcacaggtgaacccactcaccttgacggcggccgtgctgatgctcgtggcccactacgccatcattgggcctggcctgcaggcgaaggctacccgcgaggcccagaagaggacagcggccgggatcatgaagaaccctaccgtggacggcatagtcgcgatcgacttagacccagtggtgtacgacgccaagttcgagaagcagctcggccagatcatgctgctaatcctctgcacctcgcagatcctgttaatgagaaccacctgggccctctgcgagagcatcaccctggccacggggcctctgactacgctctgggagggttcgccggggaagttctggaacaccacgatcgccgtaagcatggcgaatatcttccggggttcctacctggccggcgccgggctggccttcagtgtgatgaaatccttaggcgggggtaggcgggggaccggcgcgcaaggcgaaaccctgggggagaagtggaagcgccaattaaaccagctctccaagagcgagttcaacacatacaagcgatccggcatcatggaggtggaccgcagcgaggccaaggaggggctgaaacggggagagacgaccaaacacgccgtctcccgcgggacggccaagcttcggtggttcgtcgagcgcaacctcgtgaagcccgaaggcaaggtcatcgacctggggtgcgggcggggagggtggagctattactgcgccggcctgaagaaggtgacagaggtgaaagggtacacgaagggcgggcccggccacgaggagccgattccgatggcgacctacggctggaacctggtcaagctgcactccgggaaagacgtgtttttcgtgccgcccgagaagtgcgacactttgttatgtgatattggcgagagttcccccaaccctaccatcgaggagggacgcacgctccgcgtcctgaagatggtggagccctggctacgcggaaaccagttctgcatcaagatcctcaacccgtacatgccgagcgtggtagagacgctggaacagatgcaacggaagcatggcgggatgctcgtgcggaacccgctctcccggaactcgacccacgaaatgtactgggtttcttgcggcaccggtaacatagtctcagccgtgaacatgacttcccggatgttgcttaaccggttcacgatggcccaccggaagccaacctatgagcgtgacgtggacctcggcgcagggaccaggcacgtagccgtggagcccgaggtggcgaatctggacatcatcgggcagcgcatcgagaacatcaagcacgagcacaagagcacctggcactacgacgaggacaacccctacaagacgtgggcctatcacggctcatacgaggtaaagccgagcggctccgccagcagcatggtgaacggcgttgtgaagctgctcaccaagccctgggacgtcatccccatggtcacccagatcgccatgactgacacgacaccctttgggcagcaacgggttttcaaggagaaggtggacacccgcacaccgaaagccaaacgtggcactgcacagatcatggaggtcaccgccaagtggctgtggggcttcctgtcccggaacaagaagccccgtatttgcactcgcgaggaattcacccggaaggttcgctccaacgccgccatcggggcggttttcgtcgacgagaatcagtggaactccgccaaggaggccgtcgaggacgagcggttctgggacctagtgcaccgcgagcgggagctgcacaagcagggcaagtgcgccacgtgcgtatacaacatgatgggaaagcgcgagaagaagctcggagagttcggtaaagccaagggcagccgcgcgatttggtacatgtggctcggagcgcggttcttagagttcgaggccctgggattcatgaatgaggaccactggttctcccgtgagaatagcctctccggtgtggagggggagggcctgcacaagttggggtacattctccgcgacatctcaaagatccccggcggaaacatgtacgccgacgacactgcggggtgggatacccggataaccgaggacgacctccagaacgaggcccgaatcacggatatcatggaaccggagcacgcgctgctggccaagtccatcttcaagctgacctaccagaacaaggtagtccgcgtacaacggccggccaagaacggcaccgttatggacgtcatcagccgacgggaccagcgcgggagtggtcaggtgggcacctatgggctgaatacgttcacaaacatggaggcccagctcatccgacagatggagagcgagggcatcttctcccccagtgaactagaaaccccgatcctggctgagcgcgtgctcgactggctggagaagtacggcgtcgagcgcctgaagagaatggctatatccggcgacgactgtgtcgtaaagccgattgacgaccggttcgccactgcactcacggccctgaatgacatggggaaggtccgcaaagatattccccagtgggaaccctctaaaggctggaatgactggcagcaggtgccgttctgctcccaccactttcatcagctgatcatgaaagacggccgggagatcgtggtcccgtgccgcaaccaagacgaactcgtcgggagggcgagagtgtcacagggcgccggatggagcttacgggagacagcctgtttaggaaaatcttacgcccaaatgtggcagctcatgtacttccaccgcagagacctgcggcttgcagccaacgccatctgcagcgcagtccccgtagactggatccctacatcccggacgacgtggagcatccacgcccaccatcagtggatgaccactgaggacatgctctcggtgtggaaccgcgtctggatcgaggaaaacccctggatggaggacaagacccacataagctcctggggcgacgtgccctacctcggcaaacgcgaggaccagtggtgcggcagtctgatcggcttaacggcgagagccacctgggctacgaacatccaggtggccatcaaccaggtccgccgcttgatcgggaacgagaactacctagattacatgacctcgatgaagcgtttcaagaatgagagcgaccctgagggggccctctggtga

SEQ ID NO: 23832 - RNA, 9879 nt, synthetic construct
  misc_feature 1..9879: note = derived and/or modified CDS sequence (opt11) from DENV-1__FJ639686__SS-prME
  source 1..9879: mol_type = other RNA
agcgtgaccatgctgctaatgttgatgcccaccgcccttgccttccacctgactacccggggcggggaaccccacatgatcgttagcaagcaggaacgggggaaatcgctgcttttcaagacgtcagccggggtgaatatgtgcacccttatcgccatggacctgggcgagctatgcgaggacaccatgacctacaagtgcccccgcatcaccgaggcggagcccgatgacgtggattgctggtgcaatgccaccgacacttgggtgacctacgggacctgcagccaaaccggcgagcaccggagggacaagagatccgtggccctcgcgccccacgtggggctgggactggagacgcgcaccgagacctggatgtcatccgagggcgcctggaagcagattcagcgggtggagacctgggccctccgtcaccccggattcacggtgatcgcgcttttcctggcgcacgccatcggcaccagcatcacacagaaagggatcatcttcatcttgctgatgctggtgacccccagtatggccatgcggtgcgtcggaatcggctcgcgcgacttcgtggagggactctcaggagccacctgggtggatgtcgtgctggagcacggttcctgcgtgactacaatggccaaggacaaacctacgctggatatcgaactcctgaagacggaggttacaaatcccgcgatactgcgcaagctctgcatcgaggccaagatctcgaatacgaccacggacagccgctgtcccactcagggcgaggccaccttggtggaggaacaggacgccaatttcgtatgtcgacgcaccttcgtcgatcgggggtgggggaacggctgtgggctgttcggcaaggggagtctcatcacgtgcgccaagttcaagtgcgtgaccaagctggagggcaagatcgtgcagtacgagaacctgaagtacagcgtaatcgtgaccgtgcataccggcgatcagcatcaggtcggtaatgagtccaccgaacacggcaccaccgcgaccatcactccccaggcccccacgaccgagatccagcttaccgactacggggccctgaccctggactgcagcccccgcacgggccttgacttcaacgaaatggtgctcctgactatgaaagagaagtcctggctcgtacacaagcagtggttcctggacctgcccctaccctggaccagtggagccagcacttcccaggagacatggaaccggcaggacttactggtgaccttcaaaaccgcccacgcaaagaagcaggaggtcgtcgtattgggtagccaggagggagccatgcacaccgcgctgacgggggctacggagatccagacctccggcaccacgactatctttgccgggcacctgaagtgccgcctcaagatggataagttaaccctgaaggggatgagctacgtgatgtgtaccgggtcctttaagctggagaaggaagtcgcggagactcagcacggaaccgtgctggtgcagatcaggtacgagggcaccgatgccccatgtaagatccccttttctacccaagatgagcgcggggtaacgcagaacggccggctgatcaccgccaacccgatcgtgaccgacaaagagaagcccgtgaacatcgaggccgagccgccatttggcgaaagttacatcgtaatcggcgcgggcgagaaggccctgaagttgagctggtttaagaagggatccagcatcggcaagatgttcgaggccactgcccgcggcgcccgacgaatggcgatcttaggcgacacggcctgggacttcgggtccataggcggagtgttcaccagcgtaggtaagctggtccatcagatcttcggcactgcatacggagtcctcttctccggcgttagctggacgatgaaaataggcattggagtcctgttaacgtggctcggcctcaattcccgcagcacatcttttagcatgacctgcatagccgtggggcttgtcaccctctatctgggtgtcatggtacaggccgacagtgggtgcgttataaactggaaggggcgggaattaaagtgcgggagcggcatctttgtcacgaacgaggtgcatacctggaccgaacagtacaagttccaggccgatagccccaagcgcctgtccgccgccatcggcaaggcgtgggaggagggggtatgcggcatccggtccgccacccgactggagaacattatgtggaaacagattagtaacgagctgaaccacatcttgctagagaatgacatgaagtttaccgtcgtggtgggggacgtagcgggcatccttgcccaggggaaaaagatgatccggccccagcccatggagtacaagtacagctggcgctcctggggcaaggccaagatcattggcgccgacgtgcaaaacacgaccttcatcatcgacgggcccaacaccccggagtgccctgacgaccagcgggcgtggaatatctgggaggtggaggactacggttttgggatatttaccaccaacatctggctgaagctgcgcgattcctatacacaagtctgcgaccaccggctgatgagcgccgcaataaaggacagcaaggccgtgcacgccgacatgggctactggatcgagtccgagaagaatgagacctggaaactcgcgcgcgcgagcttcatcgaagtgaagacttgcatctggcccaagtcccatacgctgtggagcaacggcgtcctggaatccgaaatgattattcccaagatctacgggggccctatcagtcagcacaactaccgtcctgggtatttcacccagaccgccggcccctggcacctcgggaagctggagctggattttgacctctgcgagggaacgacggtggtcgtcgacgaacactgcggcaaccgcgggccgtccctgcggaccaccaccgtgacgggcaagatcatccacgagtggtgttgccgaagctgcacattacctcccctccgtttccgcggtgaggacgggtgctggtacgggatggagatccggcccgtcaaagagaaggaggaaaacctggtcaagtccatggtgagcgccggcagcggcgaggtggactccttctcgctcggactcctatgtatctccataatgatcgaagaggtcatgcgcagccgctggtccagaaagatgcttatgaccggcacattggccgtgtttcttctgctcatcatggggcaactgacgtggaatgatcttatccgactatgtatcatggtgggtgcgaacgcctcagaccggatggggatgggcaccacctaccttgccctgatggcaacctttaagatgcgtccgatgttcgcagtcgggctcctcttccggcgcctgacgtcgcgggaggttctattactgacaatagggctcagcttagtggcctccgtcgagttacccaatagccttgaggagctgggggacggcctggctatgggcatcatgatcctcaagctacttaccgactttcaatcccatcagctctgggccaccctgctgtcactcacgttcataaagacaaccttttccctgcactatgcctggaagaccatggcaatggtgctgtcaatcgtctccctctttccgctgtgcctctccacgacctcacagaagaccacctggctccccgtcctgttgggcagcctcggatgtaagccgctaaccatgttcctgatcgccgagaacaagatctggggccgccggtcctggcccctcaatgaggggattatggccgtgggtatcgtctcaatattactgtcgtcgctcctgaagaatgacgtgcccctggccgggcccctcatcgcgggcggcatgctgatcgcgtgctacgtaatctcggggtccagcgctgacctgtcgctcgagaaggccgccgaggtcagctgggaggaggaggccgagcattccggagcgagccataacatcctggtagaggtccaggacgacggaacaatgaagataaaggacgaggagagagacgacaccctcaccatcctcctgaaggccacgctgctcgcagtttccggagtgtacccacttagcatccctgcaacgttattcgtgtggtacttctggcagaagaagaagcagcgctccggagtcctatgggatactccttcgccgcccgaggtagagcgcgccgtgctggatgacggtatctaccgtatcatgcagcgtggcctgctggggcggtcccaggtcggagtgggagtgttccaggagaacgtctttcacactatgtggcacgttacccgtggcgccgtgctcatgtatcaaggaaaacggctggagccctcgtgggcctcagtcaagaaggacctcatttcctatggcggcggttggcgcctccagggatcctggaatacgggggaggaggtccaggtgatcgctgtcgagcccggcaagaaccccaaaaacgtgcagaccgcacccgggacctttaagacccccgagggtgaggtgggcgcgatcgcgctggacttcaagccaggaacgtctggctcccccattgtcaaccgggaagggaaaatagtgggcctctacggcaacggggtggtcacgaccagtggcacatacgtgagcgccatcgcacaggccaaagcatcccaagaggggcctctccctgagattgaggacgaggtgttccgcaagcggaacctgacgatcatggacctgcaccccggaagcgggaaaacccgccgctatctccccgctatcgtccgagaggccattaagagaaagctgcggaccttaatcctcgcccccacgcgcgtcgtagcctccgagatggccgaggcccttaaaggcatgccgatccggtaccagacgaccgccgtcaagagcgagcacaccgggaaggagatcgtggacctaatgtgccacgccaccttcaccatgcgcctcctgtcccccgtacgggtcccgaactacaacatgattatcatggacgaggcccactttaccgacccgagttccatcgcggcccgcgggtatatcagcacccgggtgggaatgggggaggccgctgcaatcttcatgaccgcgacgccacccggctccgtggaggcgttcccgcaaagcaacgcagtcatccaggacgaggagcgcgacatcccagagcggtcgtggaatagcggctacgagtggatcaccgacttccccggcaaaaccgtgtggttcgtgccatccatcaagagcggcaacgacatagcgaattgcctccgtaaaaacgggaagagagtcatacagttatcacgaaagaccttcgatacggagtaccagaagacaaagaacaacgactgggactacgtggtgaccaccgacataagcgaaatgggtgcgaacttccgcgccgaccgcgtcatcgacccgcggcggtgtctgaagcccgtgatcctgaaggacgggcccgaacgagtgatcctcgccggccccatgccggtcacggtggcttccgccgcacagcgccgcgggaggatcggccgcaaccacaacaaggaaggcgaccaatacatctacatggggcagcctctgaacaacgacgaggaccacgcccactggactgaggccaagatgctgttagacaacatcaacacgcctgagggcatcatccctgcgctgtttgagccggagagagagaagtccgccgcgatcgacggcgagtaccgtttgcggggcgaggcaagaaaaacctttgtcgagctcatgaggcgcggggatctgcccgtctggctgagttacaaagttgccagcgaggggttccagtacagcgatagacgctggtgtttcgacggtgagcggaataaccaggtcctcgaagagaacatggatgtggagatctggacgaaggagggggagcggaagaaactgagaccccgctggctggatgccagaacctactccgaccccctcgcgttaagggagttcaaggagttcgcggccggccgaagatctgtgtccggggacctgatacttgagatcggcaagctcccccagcacttgacccagcgcgcccagaatgctctcgacaatctagtcatgctgcacaacagcgagcaagggggtcgagcgtaccggcacgccatggaggagctccctgataccatcgagacgctgatgctactcgctctgatcgccgtgctgaccggtggggtgaccctatttttcctgagtggcagggggctgggcaagaccagcataggcctcctgtgcgtaatggcttcctctgtgctgctctggatggcctccgttgagccccactggatcgctgcctccatcatcctggagtttttcctgatggtcctcctgatccccgagccggaccgccaacggacaccccaggacaaccaacttgcgtacgtggttattgggttgctattcatgatactgacggtcgccgcgaacgagatgggccttttggagacaaccaagaaagacctgggcatcggccacgttgcagtggggaaccatcaccacgccgccatgctcgacgtcgacctgcaccccgcttccgcttggaccttatatgccgtggccacgactatcatcacccccatgatgcgccacaccatagaaaacacgaccgccaacatcagtctcaccgctatagccaaccaggccgcaatcttgatgggcctggacaagggctggcccatcagtaagatggacataggggtacccttgctggcccttggctgctatagccaggtgaacccattaacgctgacggcggcggtgctgatgctcgtagcacactatgccatcatcgggcctggcctgcaggcgaaagctaccagagaggcccagaagcgcaccgcggccgggatcatgaagaaccccaccgtcgacggcatagtggctatcgatctggaccccgtggtatacgacgcgaagttcgagaagcagctcggacaaatcatgctgctaattctctgcacgtcccagatcctgctaatgcggaccacctgggcgctctgcgagagcataacactggccactggccccttaaccacactctgggagggctccccggggaaattctggaacacaacgatcgccgtgagcatggccaacatcttccggggctcctacctggcgggcgccgggctggccttcagcctcatgaagtctctgggcggagggcgccgaggaaccggggcccagggcgagaccctaggtgagaaatggaaaagacagctcaaccagctgtccaagagcgagttcaatacatacaaacggtccggcatcatggaggtggatcggagcgaggctaaagaaggtctgaagagaggtgagatcacgaagcatgccgtctcccgggggaccgccaagctccgctggttcgtggagcggaacctggtgaaacccgaaggcaaggtcatcgacctgggctgcgggcgcggcgggtggtcctactactgcgccggcctgaaaaaggtgaccgaggtcaagggttacaccaagggcggtcctgggcatgaggagcccatcccaatggccacgtatggatggaaccttgttaaacttcactccggaaaggacgtgttcttcgtgccgcccgagaagtgtgacaccttgctctgcgacatcggcgagagctccccgaatccaaccatcgaagaggggcggacgctgcgagtcctgaaaatggtagagccctggctccggggcaaccagttctgcatcaagatcctgaacccctacatgccatctgtggtcgagacactggagcagatgcagcgaaagcacggtggtatgctcgtgcgcaacccgttatcccggaacagcacccacgagatgtactgggtatcatgtggcaccgggaacatcgtttccgctgtgaacatgacatcccgcatgttgctcaaccggttcaccatggcccaccgcaagcccacctatgaacgggacgtagacctgggcgccgggacccgccacgtcgccgtggagccggaagtggccaacttagacatcatagggcagaggatagagaacatcaagcacgaacacaaatcgacatggcactacgacgaggacaacccctacaagacctgggcgtaccacggcagttatgaggtcaagccatcaggctccgctagcagcatggtgaacggcgtggtgaagctcctgaccaagccctgggatgttatccccatggtcacccagattgccatgaccgataccacgccattcgggcagcagcgcgtgttcaaggaaaaagtcgacacccggaccccgaaggccaagcgcggcaccgcgcagatcatggaggtcacggcaaaatggctctggggctttctatctcgtaacaagaaaccccgtatctgtacccgtgaggagttcaccaggaaggtgcggagcaacgccgccatcggggccgtgttcgttgacgagaaccagtggaactctgcgaaggaagccgtagaggacgagcgcttctgggacctggtccaccgggagcgcgagttacacaagcagggcaagtgcgcgacctgcgtctacaacatgatggggaagcgagagaagaagctcggcgagttcggaaaggccaagggcagccgcgctatttggtacatgtggctaggcgcgcgattcctggagttcgaggcactcggcttcatgaacgaggaccactggttctcgcgggagaacagcctgtccggcgtggagggggagggtctgcacaagctcggatacatcctgcgcgacatcagtaaaatccctggcggcaatatgtacgccgacgacacggccggttgggacacacggattaccgaagacgatctgcagaatgaggctaggatcacagacataatggagccagaacacgccttattagccaaaagcatcttcaagctgacataccagaacaaggtggtccgggtgcagcgcccagctaaaaacggcaccgtgatggatgtgatcagccgacgcgaccaacgcgggtccggacaggtggggacctacggtctcaacacattcacgaacatggaggcccagctgatccgccagatggagagcgagggcatcttttccccaagcgagctcgagacgcccaaccttgccgagagggtgctggactggctggaaaaatatggggtagagcgcctcaagcggatggcgatatccggcgacgactgcgtggtgaagccaatagacgatcgcttcgcgaccgctctgactgccctgaacgatatggggaaggtccggaaggacatcccccaatgggagcccagtaagggatggaatgactggcaacaggtaccattctgtagccatcacttccaccaactcatcatgaaggacggcagggaaatcgtggtcccgtgtcgaaaccaggacgagttagtggggcgcgctcgggtttcccagggtgcgggatggagcctgcgcgagactgcctgcctcggcaaatcctatgcgcagatgtggcagctgatgtacttccaccggagggacctacgccttgccgcaaatgctatatgcagcgccgtccctgtggattggatccccacgagccggaccacctggagcatacacgcgcatcaccagtggatgactaccgaggacatgctgtccgtttggaatcgcgtctggatcgaggagaacccctggatggaggacaaaacccacatcagctcctggggcgacgtgccgtacttgggcaagcgggaggatcagtggtgcggcagcctaataggtctgaccgcgcgcgcgacatgggcaaccaacatccaggtggccataaaccaagtccgtaggctgatcggcaacgagaactacctcgactatatgacttccatgaagcggttcaagaacgagagcgaccccgagggggccctgtggtga

SEQ ID NO: 23833 - RNA, 9879 nt, synthetic construct
  misc_feature 1..9879: note = derived and/or modified CDS sequence (opt11) from DENV-1__FJ639687__SS-prME
  source 1..9879: mol_type = other RNA
tcagtgaccatgttgctgatgctgatgcccaccgccctggcattccatcttaccacacggggcggcgagccccacatgatcgtgtcgaagcaggagcgtggcaagagtctcctgttcaagaccagcgcaggagtgaacatgtgcaccctcatcgccatggatctgggcgagttctgcgaagataccatgacctataagtgtccgagaattagcgaggccgagccagatgacgtggactgctggtgcaacgcgacagatacctgggtcacttacgggacctgctcccagaccggggagcaccggcgcgacaagcggagcgtagcccttgcgccccacgttggactcgggttggagacccggactgagacgtggatgtcctccgagggggcctggaagcagatccagcgggtggagacgtgggccctgcgccacccagggtttacagtgatcgccctatttctggcccacgccatcggcacgtcgattacccagaagggcatcatattcatcctgcttatgctggtgaccccgagcatggctatgagatgtgtcggcatcggctccagagattttgtggaagggcttagcggcgctacctgggtggacgtcgtgctagagcacggatcctgcgtgacaaccatggccaaggacaagcccacactggacatcgagttgctaaagaccgaagtgacgaaccccgcggtattgcgtaagctgtgcatcgaggccaagataagcaatacgacaacagacagtcggtgccctacgcagggagaggcaacgctcgtggaggagcaagacgccaacttcgtctgccggcgcaccttcgtggacaggggctgggggaacgggtgcgggctgttcgggaagggaagcctgatcacgtgcgccaagttcaagtgcgtgaccaagcttgaaggaaagatcgtgcagtacgagaacctgaaatactccgtcatcgtgactgtgcataccggcgatcaacaccaggtgggaaacgagtcgactgagcacggcacgacagctaccatcacgccccaggccccttccacggagatccagctcacagattacggcgccttaaccctggactgtagcccacgcaccggactagactttaacgagatggtcctcctgacaatgaaggaaaagtcctggctggttcacaagcagtggtttctcgacctgccgctgccgtggacgtccggggcctccacctcccaggagacctggaaccggcaggacctcctggtgacctttaaaacggcgcacgcgaaaaagcaggaggtggtggttctgggaagccaagagggagccatgcacaccgcgctgaccggggccaccgagatccagacgtccggcaccaccaccattttcgcagggcacctcaagtgccgcctgaagatggacaaattgacgctgaagggcatgagttacgtcatgtgcaccgggtccttcaagctggagaaagaggtggcggagacccagcacggcaccgtgttagtccaaatcaagtacgagggcacggacgccccctgcaagataccgttcagcacgcaagacgagaagggagtgacccagaacggccggctgatcaccgccaaccctatagtgacagacaaagaaaagcccgtcaacatcgaagccgagccgccgttcggggagtcctatatcgttataggcgcgggcgagaaagccctgaagttgagctggttcaagaaagggtccagcatcggcaagatgttcgaggccaccgctaggggggcccggcgcatggctatcctcggagacaccgcctgggatttcgggtccatcggcggcgtattcactagcgtggggaaattagtacaccagattttcggcacggcctatggggtgctgttctcgggagtcagctggaccatgaaaatcgggataggcgtgctactaacttggctgggattgaatagccgtagcacgtcccttagcatgacctgcatcgcagtagggctggtgacactatacctgggcgtgatggtccaggcagatagcgggtgcgtcattaactggaagggccgggaattgaagtgcgggagcggcatattcgtaaccaacgaggtgcacacgtggacggagcagtacaagtttcaagcggatagcccgaagagattatccgccgctatcggcaaggcctgggaggaaggcgtttgcggcatccgtagcgctacacgccttgagaacataatgtggaaacaaatatctaacgagctgaaccacattctcctggagaacgacatgaagttcaccgttgtggtcggtgacgtcgcgggcatactggcgcaggggaaaaagatgatccgtccccagcccatggagtataagtatagctggaagtcatggggtaaggcgaaaatcatcggcgccgacgtgcagaacaccaccttcatcattgatggtccaaacacgccggagtgcccagacgaccagcgcgcgtggaacatctgggaggtcgaagactacggcttcgggatattcaccaccaacatctggctcaagctgcgggacagctacacccaggtatgtgaccaccgcttaatgtcagccgccatcaaggacagcaaggcggtgcacgccgacatgggctattggatcgagtccgagaagaacgagacctggaaactcgctcgggcttcgttcatcgaggtcaaaacctgtatctggcccaagtcccacaccctatggagcaacggggtgctggagtccgaaatgatcatccccaagatctatggggggcccatctcccagcacaactaccgccccgggtacttcacgcagacggctggcccctggcatctcgggaagctggagctggactttgacctgtgcgagggcaccactgtggtcgtggacgaacattgcggcaaccggggtccgagtctgcgcaccactaccgttactggcaagatcatacacgagtggtgctgcagaagctgtacccttcctcccctgcggtttaagggggaggacggctgctggtacgggatggagataaggcccgttaaggaaaaggaagagaacctcgttaagagcatggtgtccgcgggcagcggcgaagtcgacagtttcagcttagggctcctctgcatctccatcatgatcgaggaggttatgcgcagcagatggagtcgaaagatgctgatgacgggcaccctcgcggtgtttttcctgttgataatggggcagttgacgtggaatgacctgatccgtttgtgcatcatggtgggagcgaacgccagcgatcggatgggtatgggaatgacctaccttgccttaatggcgacgttcaagatgcggccgatgttcgccgtcggcttactattccggaggctgacctcacgggaggtgctgctcctgaccatcgggctgtcactcgtcgccagtgtggaactgcctaactcactggaggagctcggcgacggattggccatgggtattatgatcctgaaacttctgaccgacttccagtcccaccaactatgggctacactcctgagcctgactttcatcaagaccacgttctccctccattatgcctggaaaacgatggcgatggtcctcagcatcgtaagtctgttccccttgtgtctgagtaccacctcccagaagaccacctggctacccgtgctcctgggtagcctggggtgtaaaccgttgactatgttcctgatcgcggagaacaagatctggggccgcaagtcctggccactgaatgaggggataatggcggtcggtatcgtatccatcttgctcagctcgctcctcaagaacgacgtgccattggccgggcccctgatcgctggcggcatgttaatcgcgtgctacgtcatcagcggctcatcggcggacctatctttagagaaggcggccgaggtgtcatgggaggaggaggccgaacactccggcgcgtcccacaacatcctcgttgaggttcaagacgacgggaccatgaagataaaggacgaggagcgcgatgacacgctgaccatcctgctcaaagccacactgctggcggtttcaggcgtgtacccactcagcatcccggcgacactgttcgtgtggtatttctggcaaaaaaagaagcagcgctccggggtgttgtgggacaccccgagcccacccgaggttgagcgggccgtcttggacgacggtatctaccgcatcatgcaacggggcctactggggcgctcccaagtgggcgtgggtgttttccaggaaaacgtctttcatacaatgtggcatgtgacgcgtggcgcggttctgatgtaccaggggaagcgccttgagccaagctgggcctcagtgaagaaggacctgattagctatggcggtgggtggcggctgcaaggttcctggaacaccggggaggaggtgcaggtcatagccgtggagcccggtaagaaccccaagaacgttcagacagccccggggaccttcaagacttctgagggcgaagtaggcgccatcgcgctagatttcaaacccgggacaagtggctccccaatagtgaaccgcgagggtaagatcgtgggattgtacggaaacggcgtcgtcaccaccagcggcacgtacgtgtccgcaattgcccaggccaaggcgtctcaagaagggccccttccagaaatcgaggatgaggtcttccggaaacgcaaccttactatcatggacctgcacccgggctccggcaagacccggcgctacttaccggccatcgtgagagaggccatcaaacgcaagctccggaccttaatcctcgccccaacgcgagtggtagccagcgagatggcggaggccctcaaaggcatgccgattcgctatcagaccaccgccgtaaagtccgagcacaccggcaaggagatcgtggatctcatgtgccacgccacgtttaccatgcgcctgctcagcccagtccgcgtgcccaactataatatgatcattatggacgaagcccactttaccgacccttcgtcaatcgccgcccgggggtacatctctacgcgcgttggaatgggggaggccgccgcgattttcatgacggctactccacccggcagcgcagaggcctttccgcaatccaacgctgtcatccaggacgaagagcgagacatcccggaacgctcatggaactcagggtacgagtggatcacggacttccctggaaagacagtctggttcgtgcccagcatcaaatccggcaacgacattgcgaactgcctgcggaagaacgggaagcgcgtcatccagctcagccgaaagacgtttgatacggagtaccagaagaccaagaacaacgactgggactacgtagtgacaacggacatttccgaaatgggagccaacttccgagccgatcgggtaatcgaccctcgccggtgtttgaagcccgttatccttaaggacggacccgagcgcgtgattctggcggggcccatgcccgtgaccgttgcaagtgcggcgcagcgcagggggcggattgggaggaaccacaataaagagggagaccagtatatatacatggggcagccgctaaacaatgacgaggaccatgcccactggactgaagccaaaatgcttctagacaacatcaacacccccgagggcatcatcccggccctcttcgagcccgagcgagaaaagtccgcggcaattgacggggagtaccgcctgaggggcgaagcgagaaagacgttcgtggaactgatgcgccgcggggacctcccggtgtggctgtcctataaagtggccagcgagggcttccagtactccgacaggcgttggtgtttcgacggtgagcgtaataaccaagtcctggaagagaacatggacgtcgagatctggactaaggagggggagcggaagaagctccgaccccggtggctggacgcccgcacctacagcgacccccttgccttacgagagttcaaggagttcgccgcgggccgtcggtctgtgagcggggatctgatcctggagatcggcaagctccctcaacacctgactcaacgggcccaaaacgcgctggacaaccttgtcatgttacataatagtgagcagggaggccgggcctaccgccatgccatggaggagctcccagatactatagaaacactcatgctgctggccttaatcgccgtgctgactggcggggtgaccttgttctttctctcgggccgtgggctcggcaagacgtcaatcggcctgctttgtgtaatggccagttcggtgctcttatggatggcctccgtggagccgcattggatcgcggcgtccattatccttgagtttttcctgatggtcctgctcatacccgagcccgatcgccagcggaccccacaggacaaccagctagcctacgtagtgatcgggctgcttttcatgatcttaacagtcgcggccaacgaaatgggcctactggaaaccaccaagaaggacctgggaatcggccatgttgccgtggagaaccatcatcacgccgccatgctggatgttgacctccaccctgcctctgcgtggacgctctacgccgtcgccacaacgatcattacccccatgatgcggcacacgatcgagaacacaactgccaacatctccctgaccgcgatcgccaaccaagccgccatcttaatgggtctggacaaaggctggccaattagcaagatggacataggcgtacccctgctcgcgctggggtgctactcccaggtcaacccccttacgctcacggccgcagtgctaatgctggtcgcgcactacgccatcatcggacccgggctgcaagcaaaggccacccgggaggcccaaaagcgcaccgccgccggcatcatgaagaaccccacggtggacggaatcgtcgcgatagacctagaccctgtggtatacgacgccaagttcgagaagcaactgggtcagatcatgctcctgatactctgcaccagccaaatactcctgatgcgcacaacgtgggccctgtgtgagagcatcacgctcgccaccggccccctgacaactctgtgggaggggtcaccaggcaagttctggaacacgaccatcgccgtttctatggcgaatatcttccgggggtcctacctcgccggcgccggtttagcgttttctttgatgaagtctctcggtggcgggcggcggggtacgggggcgcagggcgagaccctgggggagaagtggaagcgccagctgaaccagctcagcaagtcggagttcaacacctacaagcgatctgggatcatggaggtagaccgctccgaggctaaagagggccttaagcgcggagaaaccacaaaacacgccgtttcgcgtggtacagctaaactgcggtggtttgttgagcgcaatctcgtgaagccggaggggaaggtcatcgacctcggctgcggacgcggcgggtggtcctactactgcgccggacttaagaaggtgacggaggtcaaggggtatacgaagggcgggcccggccatgaggaacccatcccaatggcgacctatgggtggaaccttgtcaagttacacagcggcaaagacgtgttcttcgtgccgcccgagaagtgtgataccctgttgtgcgacatcggggaatcttccccaaaccccacgatcgaagagggacgcactctccgagtcctgaaaatggtggaaccgtggctgcgcgggaaccagttctgtatcaaaatcctcaatccctacatgcccagcgtggtcgagactctggagcagatgcagcgaaagcacggcggaatgctggtccgtaacccccttagccggaactccactcatgagatgtactgggtttcgtgcgggacgggtaacatcgtcagcgcagtgaatatgacatcgcggatgttgctgaatcgcttcaccatggcccatcgcaagccgacctatgagcgggacgtggacctcggtgccgggaccaggcatgtcgccgtggagcctgaggtagcgaatttggatataatagggcagcgcatcgagaacatcaagcacgagcataagagtacgtggcactacgacgaagacaatccatacaagacgtgggcctaccacggaagctacgaggtcaagccttctggctccgccagctcgatggtgaacggtgttgtgaagctgctcacgaagccatgggacgtgatcccaatggtcacccagatcgccatgacggacaccacccccttcggccaacagagggtattcaaagagaaggtggacacccgcacgcccaaagccaagcgagggacggcacagataatggaggtcactgccaagtggctgtggggcttcttgagccgaaacaagaaaccgcgtatctgcacgcgcgaagagtttacgcgtaaagtgcgctccaacgccgcaatcggcgcggtattcgtcgacgagaaccagtggaacagcgccaaggaggccgtggaagatgaacgtttctgggacctcgtgcaccgcgagcgggaattacacaagcagggaaaatgcgcgacgtgcgtctacaatatgatggggaaacgtgagaagaagctgggcgagttcggcaaagccaagggatcacgggcgatttggtacatgtggttaggcgcccgcttcttagaattcgaagccctcggcttcatgaacgaggaccactggttctctagagagaactccctctctggcgtggagggggaagggctgcacaagctgggctacatactccgggatatctccaagatatcgggcggcaacatgtacgccgatgataccgccggctgggatacgcgcattactgaggacgacctgcagaacgaggcaaaaatcactgatatcatggagcccgagcatgcactgctcgccaagtctattttcaagttgacataccagaacaaggtagtccgagtccagcgccccgccaagaatggtacggtgatggatgtcattagcagacgggatcaacgtggctcgggccaggtcggaacgtacggcttgaacaccttcacgaacatggaagcccaactcatccgccagatggagagcgaggggatcttcagtccgagcgagcttgagaccccaaatttagctgagcgggccttggactggctggaaaaacatggagtggagcgcctgaagcgaatggcaatctctggggatgactgcgtcgtgaagcctatagacgaccgcttcgcaacagccctcaccgcgctcaacgacatgggcaaagtgcggaaagacatcccccagtgggaaccgtccaaggggtggaacgattggcaacaggtgcccttctgctcgcaccacttccaccagctgatcatgaaagatggaagggaaattgtagtgccctgccggaatcaagatgagttagttggccgcgccagggtttcccagggggccggttggtcactcaaggagaccgcctgcctgggtaagtcctatgcacagatgtggcagctgatgtactttcaccggcgggacctgcgactggccgcaaacgccatctgcagcgccgtgccggtagactgggtcccgacctcccgtacgacctggtccatacacgctcaccatcagtggatgaccaccgaggacatgctcagcgtgtggaaccgcgtgtggattgaggaaaacccgtggatggaggacaagacgcacatcagcagctgggaggatgttccatatctgggtaagcgggaggaccagtggtgcgggagtttaatcggactcaccgcgcgtgccacctgggccaccaatatacaagtggccatcaatcaggtgcgacgcctgatcggaaacgagaactacctggactacatgacgtccatgaagcgattcaaaaatgagtcagaccctgagggggcgttatggtga

SEQ ID NO: 23834 - RNA, 9879 nt, synthetic construct
  misc_feature 1..9879: note = derived and/or modified CDS sequence (opt11) from DENV-1__FJ639688__SS-prME
  source 1..9879: mol_type = other RNA
tcagtgaccatgctgctaatgcttatgcccaccgccctcgccttccacctcaccactcgaggcggcgagccccatatgatcgtgagcaagcaggagcggggcaaaagcctactgtttaaaactagcgccggtgtgaatatgtgcacgttgatcgccatggacctgggggagctatgtgaggacaccatgacatacaagtgcccacgcattaccgaggcagagcccgacgacgtggactgctggtgcaacgcgacggacacatgggtgacctacggtacctgcagccagaccggcgagcaccggcgtgacaagcggtccgtagccctggctccccacgtgggcttagggctggagacgcgaacggaaacctggatgagctccgagggcgcatggaagcagatccagcgggtggaaacgtgggccctccggcaccccgggttcaccgtgatcgcgcttttcctggcgcacgccataggcacctccatcacccaaaaagggatcatcttcatactcttgatgctggtgactccctcgatggccatgcggtgcgtcggcatcgggagccgcgactttgttgagggcctctccggcgccacgtgggtcgatgtagtgctggagcacggcagctgcgtgacaacaatggccaaagacaagccgaccctggacatcgaattgctgaaaacggaggtcaccaaccctgcggtgctgcggaagctgtgcatcgaggccaagatctccaacaccacgactgacagccgctgcccgacgcagggtgaagccaccctggtagaggagcaagacgccaacttcgtctgccggcgaaccttcgtggaccgggggtgggggaacggctgcgggctattcgggaagggcagtctcatcacgtgcgccaagttcaaatgtgtgactaagctggagggcaagatcgtccagtacgagaacttaaagtacagcgtgatcgtgaccgtccacaccggcgaccagcatcaggtgggaaacgagtccacggagcacggcaccaccgcaaccatcacgccccaggcaccgacgaccgagatccagctcaccgattacggggctctgaccttagactgcagcccccgcaccggcctcgacttcaacgagatggtcctgctgaccatgaaggagaaaagctggttagtacataagcagtggttcctggacctgcccctcccctggacatcaggggccagcacctcccaggagacgtggaaccggcaggacctgctggtgaccttcaagaccgcacacgcgaagaagcaggaggttgtggtgctcggcagtcaggagggggccatgcacaccgccttgaccggcgccaccgagattcaaacctccggcaccaccaccatatttgccgggcaccttaaatgccggctcaagatggataagctaaccctgaagggcatgagctacgtcatgtgcaccgggtcattcaagttagagaaagaggttgcggagactcagcacggcacggtactggtccagataaagtacgagggcaccgatgccccctgtaagattcccttcagcacacaggacgagaagggtgtgactcagaacggtcgtctgataactgccaacccgatcgtgaccgacaaggagaagccggtcaatatcgaggccgagccacccttcggggagtcttacatcgtgattggcgcgggcgagaaggccctgaagctcagctggttcaagaagggctccagcatcggcaagatgttcgaggccacagcccgcggggcccggcggatggcgatcctgggcgacaccgcctgggacttcgggtccatcggcggcgtgttcaccagtgtcgggaagttggtgcaccagatcttcggcaccgcgtatggggtactgttctccggcgtcagctggaccatgaaaatagggatcggcgtgctgcttacgtggctcggcctgaactcccgcagcacctcccttagcatgacctgcatcgccgtggggctcgtcacgctgtacctgggggttatggtgcaagccgactcagggtgcgtcatcaactggaagggtcgggagctgaagtgtgggagcggcatcttcgtaacaaacgaggtgcacacctggacggagcagtacaagtttcaggcggacagcccgaaacgcctgtccgcagccatcggcaaggcctgggaggagggggtctgcggcatccggagcgccacacggctggagaatatcatgtggaagcagatctccaacgagctcaaccatatcctactggagaacgacatgaagttcaccgtggtagtcggggatgtggcaggcatcctcgcccaagggaaaaagatgatacgaccccagccgatggagtacaaatacagctggaaatcctggggcaaggccaagataatcggcgccgacgtccagaacacgaccttcattatcgacgggcccaacacgcccgaatgccccgacgaccagagggcgtggaacgtttgggaggtggaggactacggcttcgggatcttcaccacgaacatctggctaaagctgcgggacagctacacacaggtgtgtgaccaccgccttatgtccgctgccatcaaagattccaaggccgtccatgccgacatgggctactggatcgagtccgagaagaacgaaacatggaagctggctcgggccagcttcatcgaagttaagacctgcatctggcccaagtcccatacattgtggagcaacggcgtgctcgagagtgagatgatcattcccaagatctatgggggacctatcagccagcacaattataggcccgggtacttcactcagaccgccggcccctggcacctcgggaagctggagctggacttcgacctgtgcgaaggcaccacggtcgtggtagacgaacattgcggaaaccgggggccgtccttgcggaccaccacagtcacgggcaagatcatccatgagtggtgctgccggtcctgcaccctgcctcccctcagattccgcggagaggacggctgctggtacgggatggagatcagaccggtgaaggaaaaggaggagaacttagtgaaatcgatggtcagcgccggcagcggcgaggtggactcctttagtctcgggctcctttgtatctccataatgatagaggaggtaatgcggagccgttggtcccggaagatgctcatgaccgggaccctggccgtcttcttcctgttaatcatggggcagctgacgtggaacgacctcatccggctctgcatcatggtgggcgcaaacgcctccgacagaatggggatgggcaccacctacttagccctgatggctacgtttaagatgagaccaatgttcgctgtgggactcctgtttagacggttaacatcccgcgaggtacttctgctgaccatcgggctgtcactggtcgcatccgtcgagctgcccacaagcctcgaggagctaggcgatgggctggccatgggcatcatgatcctaaagctgttgaccgactttcagtcccaccagctctgggccacgttattgtcactcaccttcatcaagaccacgttcagcctgcattacgcctggaagactatggcgatggtgctaagcatcgtgtccctcctgccgctgtgcctcagcaccacctcccagaagaccacgtggctcccggtcttactcgggtcgctggggtgtaagccgttaaccatgtttctcattgccgagaacaagatttggggccggcgctcatggcccctgaatgaggggatcatggccgtgggcatcgtctcgatcctgctcagctccctactgaagaacgatgtacctctcgccgggcccctgatcgccggaggcatgctgatcgcgtgctacgtgattagcgggtccagcgcagatctctccttagagaaagccgcagaagtgtcatgggaggaggaggctgagcactccggagcgagtcacaacatccttgtcgaggtgcaggacgacgggacgatgaagataaaggacgaggagcgggacgataccctcaccatactgctgaaggccacactcctggccgtttcaggcgtttacccgctgagtatccccgccaccctctttgtgtggtacttctggcaaaagaagaagcagcgatccggggttctgtgggacaccccaagccctcccgaggttgagcgggccgtgctggatgacggtatctaccgcatcatgcagcgtggcctgctcgggcgctcccaggtgggagtgggtgtgttccaggagaacgtgttccacaccatgtggcatgtcacgcggggcgcggtgctgatgtaccaggggaaacgcctggaaccctcttgggcttccgtaaagaaggatctaatctcttacgggggcggatggcggctgcaggggagctggaacactggggaggaggtacaggtgatcgctgtggagcccggcaagaaccccaaaaacgtccagaccgcccccgggaccttcaagactcccgaaggcgaggtcggcgcgatcgctctggacttcaagcccgggacctcaggcagccccatcgtgaatcgtgagggcaagatcgtcggcctctacggaaacggggtggtgaccaccagcggcacgtacgtctcagccattgcccaggccaaggcgtcccaggaggggccgctaccggagatagaagacgaggtgttcaggaagcgaaacctcacgatcatggacttgcatcccggcagcgggaagacccggcgctatcttcctgcgatcgtgcgggaggccattaagagaaagctgcgtactctcatactggcccccactagggttgtggcctcggaaatggcggaggccctgaagggcatgcccatccgttaccaaactaccgccgtgaagagcgagcacaccggtaaggagatcgtggacctcatgtgccacgctacgttcaccatgcgtctgctgtcccccgtacgcgtgcctaactataacatgatcatcatggacgaggcccacttcaccgatcccagctccattgcggcccggggctacatcagcaccagagtcggcatgggggaagctgccgccatcttcatgacggccacgccgcccggctccgtggaagccttcccgcagagcaacgccgtgatccaagatgaggaacgggacatccctgagcgcagctggaactccgggtacgaatggattaccgacttccctggcaagaccgtctggttcgtgccctccataaaaagcggcaacgacatcgccaactgcctccggaagaatgggaagcgcgtcatccagctgtcccggaagacgttcgacaccgagtaccagaagaccaagaataacgactgggattatgtagttaccactgacatctcggagatgggcgcaaacttccgcgctgaccgggtgatcgaccctcgccggtgcctgaaacccgtgatcctcaaggacgggcctgagcgtgtaatcctcgccggccccatgccggtcaccgtggcgtccgccgcgcagcggcgtgggcggataggccgcaaccacaacaaggagggcgatcagtacatctacatggggcagcccctgaataacgacgaagaccacgcacactggactgaggccaaaatgctccttgacaacatcaacacccccgagggcatcatccccgcgctgttcgaacctgaacgcgagaagtccgccgccattgacggggagtaccggttacgcggcgaggcccggaagacttttgtggagctcatgcgccgcggggatctgcctgtatggctcagctacaaggtggctagcgaggggtttcagtacagcgaccgccggtggtgctttgacggcgagcgcaacaaccaggtgctggaggagaacatggacgtcgagatctggaccaaggaaggggagcgcaagaagctgagaccccggtggctcgacgcccgcacctattccgatcccctggccctgcgggagttcaaggagtttgctgccggccgtcggagcgtgagtggggatctcatcctagagatcggcaaactgccgcagcacctcacacagcgcgcccagaacgctttggacaacctagtgatgctccacaacagcgagcaaggcggacgggcgtatcggcatgcaatggaagagctgccggatacgatagaaaccctgatgctcctggctctgatcgccgtcctcaccggcggagtgaccctgttcttcctgagtgggcgagggctcggcaaaacctcaatcggcctactgtgcgtgatggccagtagcgtgctcttgtggatggcgtccgtagagccccactggatcgctgccagcattatactggagttcttcctcatggtgctgctgatccccgaaccagaccgccagcgaacgccccaggacaatcagctcgcctacgttgtgatcggcctgctgttcatgatcctcacagtagccgcgaacgagatgggattactggagaccacaaagaaagacttaggcatcgggcatgtcgccgccgagaaccaccaccacgccgccatgctggacgtggatctacaccccgcttccgcctggacgctctacgctgtcgccacgacaatcatcaccccgatgatgcgccacacgatcgagaacaccaccgccaacatcagcctgaccgcgatcgcaaatcaggccgccattttaatggggctcgacaagggctggccgatcagcaagatggacatcggcgtcccattactagcgctcgggtgctactcgcaggtgaatcctctgacgctgaccgccgctgtgttgatgctcgtcgcccattacgccatcataggtccgggactgcaggcgaaggccactcgcgaggcgcagaagcgcaccgccgccggcatcatgaagaaccccacggtcgatggtattgtggcgatcgatctcgaccccgtcgtgtacgacgccaagttcgagaagcagctgggccagataatgttactcatcctgtgcacctcccagatccttctcatgcgcaccacgtgggccctgtgcgagtcgatcacgctggccaccggccccctcaccacgctgtgggaggggagtccaggtaaattctggaacacgaccatcgccgtgagtatggcgaacatcttccgcgggtcctacctggctggcgccggtctagcctttagcttgatgaagtccctcgggggcgggcgcagagggaccggcgcgcagggcgagaccctcggcgagaagtggaagcgccagctgaaccagctgtctaagagcgagttcaacacttataaacggtccgggatcatggaagtcgatcgctcggaggccaaggagggcttaaagcgtggggagaccaccaagcacgccgtttcacgtggcaccgccaagctgcggtggtttgttgagcgcaacttggtcaagcccgaggggaaggtgattgacctaggttgcggtcgcgggggctggagctactactgcgccgggctcaagaaggtaacggaggtcaagggctacaccaagggcggaccaggtcacgaggagcccatcccgatggcgacctacggatggaacctggtgaagctgcactccggcaaagatgtgttctttatcccgccagagaaatgcgacaccttactgtgtgacatcggggagagctcccccaatccgacaatcgaagagggccgcacactgagggtcctcaagatggtggaaccctggctgcgcgggaatcagttctgtatcaagatcctcaacccctatatgcccagcgtggtagagactctcgagcaaatgcagagaaagcacggcggtatgttagtccgcaaccctctgagtcggaacagcactcacgaaatgtactgggtttcctgcggtaccggcaacatcgtcagcgccgtgaatatgacaagtcgaatgcttctgaaccgttttaccatggcccaccggaaacccacctacgagagagacgtggaccttggggccggaacgcggcacgttgccgtggagcccgaggtggctaacctcgacatcataggccagcgtattgagaacatcaagcacgaacacaaaagcacttggcactacgacgaggacaacccttataagacctgggcctaccacgggtcctacgaggtcaagccgagcggctccgcctctagcatggtgaacggggtcgtgaagttactgacgaagccttgggacgtgatcccaatggtcacgcagatggccatgaccgacacgaccccctttggccagcagcgggtgttcaaggagaaagtggacacacggacgccgaaggcaaagcgggggaccgcgcaaatcatggaggtcaccgccaaatggctctgggggttcctgtcccgcaacaagaagcccaggatctgcacccgcgaggagttcacgcggaaggtgcgctcaaacgccgccatcggcgcggtgttcgttgatgagaaccagtggaactccgccaaggaagccgtggaggatgagagattctgggatttagtgcatcgcgagcgggagctacacaaacagggcaaatgcgcgacctgcgtctataacatgatgggcaagcgcgagaagaaactgggcgaatttgggaaagctaaggggtcgcgggctatctggtacatgtggctgggcgcccgcttcctcgagttcgaagccctgggcttcatgaacgaagaccattggttttcccgggagaactcgctgtccggggtggagggcgaaggactccacaagctgggatacatcctgcgcgacatcagcaaaatccccggaggcaacatgtacgcggatgacaccgcgggttgggacacacgaatcaccgaggacgacctccagaacgaggcgaggattaccgacattatggagccagagcacgccctattagcgaagtccatcttcaagctcacctaccagaacaaggtcgtccgcgtgcagcggcccgctaagaacgggactgtgatggacgtgatcagccgcagagaccagcgcggctccggccaggtggggacgtacggcctgaacaccttcaccaacatggaggcccaattgatccggcagatggaaagcgaggggatcttctcgcccagcgaattggagacccccaacctggcggagcgcgttctggactggctcgaaaaatacggagtagagcggcttaagcgcatggccatatctggggatgactgtgtcgtgaagccgatcgacgaccgcttcgccaccgctttaacagcactcaacgacatgggcaaggtccgcaaagacatcccccagtgggagcccagcaaggggtggaacgactggcagcaggtccccttttgcagtcaccacttccaccagctgattatgaaggatggtcgcgaaatcgtagtcccgtgcagaaaccaggatgagctcgttggccgggcgcgcgtgagccaaggggccggctggagcctacgggaaaccgcctgtctggggaaatcctatgcccagatgtggcagctgatgtacttccaccgccgggacctccgcctggcagccaacgcgatctgcagcgctgtccccgtggattggatccccacctcccggactacttggagtatccacgcacatcaccagtggatgaccaccgaggacatgctttccgtgtggaaccgtgtatggatcgaggagaatccttggatggaggacaagacgcacatcagttcctggggtgatgtgccatacttagggaagcgcgaggaccaatggtgcggcagccttatcggcctgaccgcgcgagcaacctgggcgaccaacatccaagtggcaatctatcaagtccgccggctcattggtaacgagaattacctggactacatgacctccatgaagaggttcaagaatgagagcgaccccgagggcgccctgtggtag

SEQ ID NO: 23835 - RNA, 9879 nt, synthetic construct
  misc_feature 1..9879: note = derived and/or modified CDS sequence (opt11) from DENV-1__FJ639689__SS-prME
  source 1..9879: mol_type = other RNA
agcgttaccatgctgctcatgctgatgcccaccgccctggccttccacctcacgattcggggcggggagccccacatgatcgtgagcaagcaggaacggggcaaaagtttgctgttcaagacgtccgccggggtgaacatgtgcacgctaatcgccatggacctgggtgagttgtgcgaggacaccatgacctacaaatgccctcgcattaccgaggccgagccggacgacgtggattgctggtgcaacgccaccgatacctgggtgacctacggtacatgcagccaaaccggcgaacaccgtcgggataagcggtccgtggccctcgctccccacgtgggactagggctggagacccgcaccgaaacctggatgtcctcggagggcgcctggaagcagatccaacgggtcgagacgtgggccctccgccacccgggcttcaccgtgatcgccctgttcctggcgcacgccatcggcacgtcaatcacccagaagggtatcatcttcatcctcctgatgctggtgacgcccagtatggccatgcgttgcgtcggcatcggcagcagggacttcgtggaagggctctccggcgccacctgggtggatgtagtgctggagcacgggagctgcgtgacgaccatggccaaagacaagcccaccctggacatcgagctcctgaaaaccgaagtcaccaatcccgccatcttgcggaagctctgcatcgaggccaagatttccaacaccacgaccgacagcagatgcccaacgcagggcgaggccaccctggttgaagagcaggacgcgaacttcgtctgccggcgcaccttcgtcgaccgtggctgggggaacggctgcgggctgttcggcaaggggtcgctcatcacgtgcgccaagttcaaatgtgtgacgaagctggagggtaagatcgtccagtatgagaacttaaagtactcggtcattgtgaccgtgcacacgggcgaccagcaccaggtcgggaacgagtccacagagcacggcacgaccgcgaccatcacgccccaggcgcccaccacggagatccagctcaccgactacggggccctgaccctcgactgctccccccgcaccggcctggacttcaacgagatggtgctgttgacgatgaaggagaaatcctggctcgtccacaagcagtggtttttggacctgcctctaccctggaccagcggggccagcacgtcccaggagacctggaaccggcaggacctgttggtgacgttcaagaccgcccacgctaagaagcaagaggtggttgtactcggcagccaggagggcgctatgcacaccgccctgaccggggccaccgaaattcaaacatccggaaccaccacgatctttgccggccacctaaagtgccgccttaagatggacaaactgaccctgaagggcatgagctacgtgatgtgcaccgggtccttcaagctcgagaaggaggtcgcggagactcagcacggcacggtattagtgcagatcaaatacgagggcactgatgccccctgcaagatcccctttagcacccaggacgagaagggggtcacccagaacggccggctaatcactgccaacccaatagtaaccgacaaggagaaacccgtgaatatcgaagccgaaccgccattcggggagtcctacatcgtgatcggcgcgggcgagaaggccctgaagctcagctggttcaagaaggggtcaagcatcggtaagatgttcgaagccacggcacggggggcgcggcgcatggcgatcttgggcgacaccgcctgggactttgggtccatcggcggcgtgttcacgagcgtcgggaagctggtgcaccaaatcttcggaaccgcctacggggttctgttctccggcgtgagctggaccatgaagatcggaatcggcgtccttctgacctggctcggcttgaacagccgcagcacgtccttcagcatgacctgcatcgccgtggggctggtaaccctctacctgggcgtcatggtgcaggccgactctgggtgtgtgatcaactggaaggggcgggaactgaagtgcgggagcggtatattcgtcaccaacgaggtgcacacgtggaccgagcaatacaagttccaggcggacagcccgaagcgcctgtccgccgctatcggcaaggcctgggaggagggggtgtgcggcatcagaagcgccaccagactggagaacatcatgtggaaacagatctccaacgaactgaaccacatcctgctggaaaacgacatgaaattcaccgtcgtggttggggacgtggcgggcatcctggcccagggaaagaagatgatccggccccagccgatggagtacaaatacagctggcgctcctggggcaaggccaagatcatcggtgccgacgtgcagaacacaacgtttataatcgacgggccgaacactccggagtgtcccgacgaccagcgggcgtggaatatctgggaggtggaggattacgggttcgggatcttcaccaccaacatctggctcaagctgcgcgacagctacacccaagtctgcgaccaccgtctgatgtccgccgccatcaaagatagcaaggccgtgcacgccgacatgggctactggattgagtcggagaagaacgagacttggaaactcgcgcgcgcatctttcatcgaggtgaagacctgtgtctggcccaagagtcacaccctttggagcaacggcgtgcttgagtccgagatgatcatccccaagatctacgggggccccatcagccagcataactaccggcccgggtactttacgcagaccgctggtccctggcacctcgggaagttggagctggacttcgacctctgcgagggaacgaccgtggtcgtggacgagcattgcggcaaccgcgggccttcactgaggactaccactgtcaccggcaagatcatacacgagtggtgctgtcgcagctgcacgttgccgcccttacggtttcgcggggaggacggatgctggtacgggatggagatcagacccgtcaaggagaaagaggagaacctggtgaagtccatggtgagcgccggctctggcgaggtcgactcgttcagcctggggctgctgtgcatctccataatgaccgaggaggtaatgcgcagccggtggtcccgcaaaatgctgatgaccggcactctcgcggtgttcctgctgctcatcatggggcagctgacgtggaacgacctgatccgcttatgcataatggtcggcgcgaacgcaagcgaccggatggggatgggcaccacctatctggccctgatggcaacattcaagatgcgcccgatgtttgccgtggggctccttttcaggaggctaacgtcccgggaagtactgctgctgaccgtcggtctctcattggtggcgtccgtcgagctccccaacagcctcgaggagcttggcgacgggctggctatgggcattatgatcttaaagttattgaccgacttccagccccaccagctctgggccaccctgctgtccctcactttcatcaagaccaccttcagcctgcactacgcctggaagaccatggcgatggttctgtctatcgtgagcctctttcccttatgcctgtccacgacctcccagaaaaccacctggttacctgtactactcggctccctagggtgcaagcccctgactatgtttctgattgccgagaacaaaatctggggccgcaggtcttggccactcaacgaggggattatggccgtggggatcgtttccatactgctcagctcactcctgaagaacgacgttccgttagcagggccgctcattgccggcgtgatgctgatcgcgtgctacgtaatctccggcagctcggccgacctgagcctcgagaaggcggccgaggtctcctgggaggaggaggccgagcactcaggggcgtcccacaacattctggtggaggtgcaggacgacggaaccatgaagatcaaggacgaagagcgggacgacaccttaacaattctcctgaaggccaccctgctcgccgtcagcggggtgtacccactttccatccccgccacgctgttcgtgtggtacttctggcagaaaaagaagcagcggagcggcgtgctctgggacaccccttccccgcccgaggtcgagcgcgcggtgctggacgacggaatctaccgcatcatgcagcgcggcctattgggccggtcgcaggtcggggtgggcgtctttcaggagaacgtcttccacaccatgtggcacgtgacccggggggctgtgctcatgtaccagggcaagcggctggagccctcctgggccagcgtcaagaaggacctgatcagttatgggggcggctggcggttacaggggagctggaacacgggcgaggaggtccaggtgatcgccgtcgaaccagggaagaaccctaagaacgtgcaaaccgcgccaggcaccttcaagacccccgagggggaggtgggcgctatcgcgctcgatttcaagcctggtacgagtggcagcccgatcgtcaaccgcgagggcaagatagtggggttgtacggcaacggtgtggtaacgacctccgggacctatgtgagcgccatcgcccaagccaaggcgagccaggagggacccctacctgagatcgaggacgaggtgtttagaaagcggaacctgactataatggacctgcatcctgggtcaggtaaaacccggcggtacctacccgccatcgtccgcgaggccatcaaacgcaagctgcggaccctgatcctcgccccaacccgcgtcgtagccagcgagatggcggaagcgctgaaggggatgcccatccggtatcaaacgaccgctgtcaagagcgaacacacaggcaaggagatcgtggacctgatgtgccacgcgactttcacgatgcgcctcctatccccggtgcgggtccccaactacaacatgattatcatggacgaggctcacttcaccgacccctccagcatcgctgcacgcggctatatcagcacccgggtgggtatgggcgaagcggccgccatcttcatgaccgcgacgcccccggggtccgtggaggccttcccccagtccaacgctgtcatccaggacgaggagcgcgacatcccggagcggagttggaactccggctacgaatggatcaccgactttccagggaagacggtgtggttcgtgccgagcatcaagtccggcaatgacatcgcgaactgcctgcgtaagaacggcaaacgggtcatacagctctcacgcaagacctttgatacggagtaccagaagacgaagaacaacgactgggactacgtagtgactaccgatatatccgagatgggtgcgaacttcagagcagatcgcgtcatcgacccaaggcgctgtctgaagcccgtcatcctgaaggacggacccgagagagttatcttggcggggccgatgccagtgacagtcgcgagcgccgcgcagcgtcggggccgcattgggagaaaccacaacaaggagggcgaccagtacatatacatgggacagcctctgaataacgacgaggaccacgcacactggacggaggccaagatgctgctcgacaacatcaataccccggaggggatcatcccggccctattcgaacccgaacgggagaagtccgccgcgatcgacggcgagtaccgcctgcgcggggaggccaggaagaccttcgtcgagttaatgcggcgcggcgaccttcccgtgtggttgagctacaaggtggcatccgaggggttccagtacagcgaccggcgctggtgtttcgacggcgagcggaacaatcaggtccttgaggagaacatggacgtggagatctggactaaggagggcgagcgcaaaaagctgcgaccccgctggttggacgcgcggacctatagcgatccgttagccttgcgcgagttcaaagagttcgcggccggccggcgctccgtgagcggcgacctcatactggaaattggcaagctgccccagcaccttacccagagggcccagaacgccctcgacaacctggtaatgctgcacaattctgagcagggcggacgcgcgtaccggcacgccatggaggagctccccgacaccatcgagacgctgatgctgcttgccctgatcgccgtgcttaccgggggcgtgactctcttcttcctctccgggcgcggcctggggaagacctcgatcggccttctgtgcgtcatggcctcgtccgtgctactctggatggcgagcgtggagccccactggatcgccgcctccatcatcttggagttcttcctgatggtcctcctgatcccagagcccgatcggcagcgcacgccccaggacaaccagctggcatatgtggtgatcggcctcctgttcatgatcctaacggtcgccgcgaacgagatggggctcctcgagaccaccaagaaggacctgggcatcgggcacgtggccgtgggcaatcaccaccatgccgccatgctcgacgtcgacctgcacccggcaagcgcgtggaccctgtacgcagtggccacgactatcataacccccatgatgcgccacaccatcgagaacacgaccgccaacatctccctcaccgccattgcaaaccaagcagccattcttatgggactcgacaagggctggcccattagcaagatggacatcggcgtacccctcctggcccttggatgctactcccaagtaaacccactcaccttgacagcagccgtgctgatgctcgtggcacactacgccatcattggccccggactccaggccaaggcgacgcgggaggcacagaagcgtaccgccgccggcatcatgaagaaccccaccgtcgacgggatcgtcgcaatcgatttagatcccgtggtctacgacgcgaagttcgagaagcagctcggccaaataatgttgctgatcctctgcacgagccagatcctgctcatgcggaccacctgggccctctgtgagagtatcaccttggccacgggcccgctgacgacattgtgggaggggagccccggtaagttttggaataccacgatcgccgtgtccatggccaacatcttccgtggttcctacctggcgggggcgggcctggcgttttctctcatgaagtccctcgggggcgggaggcgcgggaccggggcccagggcgagaccctgggggagaagtggaagcggcagttgaaccagctgagcaagtccgagttcaacacttacaagcgctcgggaattatggaggtggacaggtccgaggcaaaggagggtctgaagcgtggtgagatcacgaaacacgccgtcagccggggcaccgccaagctccgctggtttgtcgaacggaatctggtgaagcccgaggggaaggtcatagacctgggctgcggccggggggggtggtcctactactgcgccggtctgaagaaggtgaccgaagtgaagggctacaccaaaggcgggcccggccacgaggagccgattcccatggccacgtacgggtggaatttggttaagctacacagcggcaaggacgtgttctttgtgccgcccgagaaatgcgacaccctgctctgcgacatcggggaatccagcccgaaccccacgattgaggagggacggacccttagggtcctgaagatggtggagccttggctgcgggggaaccagttctgcatcaaaatcctgaacccctatatgccgtccgtggtcgagacgctagagcagatgcagcgcaagcacggcggcatgctggtgcggaaccccctgtcgcgcaactccacccacgaaatgtactgggtgagctgcggtaccggcaacatcgtatccgcagtgaacatgaccagccgcatgctcctcaaccggttcacaatggcccaccgcaaacccacgtacgaacgggacgtggacctgggggccggcactcgccacgttgccgtggagcccgaggttgcgaacctcgacatcatcggccagcggattgagaacataaaacacgagcacaagagtacgtggcactacgacgaagacaacccgtacaagacatgggcgtaccacgggagttacgaggtgaagccctccggcagcgcgtccagcatggtgaacggggtcgtgaagctcctcacgaagccttgggacgtgatcccgatggtcacccagatcgccatgaccgacactacgccgttcggccagcaacgcgtgttcaaggagaaggtggatacccggacccccaaagccaagagagggaccgcccagatcatggaggtcacggcgaagtggctgtggggctttctctctcggaataagaagccgcgcatctgtacccgtgaggagttcacgcgcaaggtgcggtccaacgccgccatcggcgccgtgttcgtcgacgagaaccaatggaacagcgcgaaggaggccgtggaggatgaacgcttttgggacctggtgcatcgggaacgcgagctgcacaagcaggggaagtgcgcgacctgcgtctacaacatgatgggcaagcgggagaagaagttgggagagttcggaaaggccaaggggtcccgcgccatctggtacatgtggctgggcgcgcggttcctggagttcgaagcactcggcttcatgaacgaagaccactggttttcacgcgagaactccctcagcggggtggagggcgaggggctgcacaagcttggctacatcctgcgggacatctccaagatccccggcgggaacatgtatgctgatgatacggccgggtgggacacccggatcaccgaggacgatctgcaaaacgaggcccgcataacggacatcatggagcccgagcatgcgctcctggccaagagcatcttcaagctgacgtaccagaacaaggtggtccgggtacagcgcccagccaagaacgggaccgtgatggacgtcatctcacggcgcgaccagcggggcagcggccaggtgggcacctacggcttaaacaccttcacgaatatggaggcccagctgatccgccagatggagtccgaggggatctttagcccgtccgagctggaaacaccgaaccttgccgagcgcgtgttggactggctagagaagtacggagtcgaacgcctcaagcggatggcgatctctggggacgactgcgtggtgaagccgatcgacgaccgcttcgcgaccgccttaaccgccctgaacgacatggggaaggtccggaaggatatcccccaatgggagccctccaaggggtggaacgactggcagcaggtcccgttctgcagccaccacttccaccagctcatcatgaaggacggccgcgagatcgtggtcccctgtcggaaccaggacgagctggtgggccgcgcccgggtgtcccaaggggcaggctggtctctgcgcgaaacggcctgtttgggcaaaagctacgcccaaatgtggcaactaatgtacttccaccggcgcgacctgcgactcgccgctaacgccatatgcagcgccgtccccgtggactggatccctaccagccgaaccacctggtccatacacgcacaccaccagtggatgacgaccgaggacatgctgagcgtgtggaaccgggtctggatcgaggaaaacccatggatggaggacaagacgcatatctccagctggggcgacgtgccgtacctggggaaacgggaggaccagtggtgcggctccttaatcgggctgaccgccagggctacgtgggccaccaacatccaggtggccatcaaccaggtccggcgcctgatcgggaatgagaactacctcgactatatgaccagcatgaagcggttcaagaacgagagcgaccccgaaggcgccctatggtga

SEQ ID NO: 23836 - RNA, 9879 nt, synthetic construct
  misc_feature 1..9879: note = derived and/or modified CDS sequence (opt11) from DENV-1__FJ639690__SS-prME
  source 1..9879: mol_type = other RNA
agcgtgaccatgctgttaatgctgatgcccaccgccctggcctttcacctcaccatccgcgggggcgagccacatatgatcgtgagcaaacaggagcggggcaagtccctgctgttcaagacctccgcgggggtgaacatgtgcaccctcatcgcaatggacctgggcgagttgtgcgaggacaccatgacctacaaatgccctaggataacggaggccgagcccgacgacgtggattgttggtgcaatgccaccgacacctgggtcacatacgggacatgcagccagataggagaacaccgacgcgacaagcggtccgtggccctcgcgcctcatgtgggtctcgggcttgaaacgcgcacagaaacctggatgagctccgagggtgcctggaagcagatccagcgggtcgagacctgggccctcaggcatcccgggttcaccgtgattgccctgttcttggcccacgccatcggcacaagtatcactcagaagggtattattttcatcctcctgatgctggtgaccccctccatggccatgcggtgcgtcggaatcggcagccgcgactttgtggaagggctcagtggcgccacctgggtggacgtcgtgttggagcacgggtcctgcgtcaccacaatggccaaggacaagcccaccctggacatcgagctcctaaagaccgaggtcaccaaccccgcgatcctgcgcaagttatgtatcgaggccaagatcagtaacacgacaaccgacagccgctgtccgactcaaggcgaggccacgctggtggaggagcaggacgccaacttcgtgtgtcggcgcaccttcgtagaccggggctgggggaatggctgcggcctgttcggaaaggggtccctcatcacgtgcgccaagttcaagtgtgtcaccaagttagaggggaagattgtccagtacgagaacctgaagtactcagtgatcgtgacggtgcacaccggagaccagcaccaggtcggcaacgagtccaccgagcacgggactacggcgaccatcacaccacaggcccctactaccgagatccagctcacggactacggagccctaaccttggactgcagcccccgcaccggcttggacttcaacgaaatggtgttactcaccatgaaagaaaagtcctggttagtccacaaacagtggttcttggacctgccgctcccctggacgtcgggggccagcacgtcccaagagacctggaaccggcaggacctcctcgtcacttttaagacggcccatgcgaagaagcaagaggtggtagtcctcggcagccaggagggcgccatgcacaccgccctaaccggggcaacagagatccagacatccggaaccacgactatctttgccgggcacctgaagtgccgtctcaaaatggacaagctgacgctgaagggcatgagctacgtgatgtgcaccgggtccttcaaactcgagaaggaggtagcggagacccagcacgggaccgtgttggtgcagatcaagtacgaaggcacggacgccccctgcaagatccccttctcaacgcaggatgagaagggtgtcacccagaatggccggctgatcactgccaacccgattgtgacggacaaagagaagccagtgaacattgaggccgagccgcctttcggggaatcctacatcgtcattggcgcgggcgagaaggctctgaagctcagctggttcaagaaagggtccagcatcgggaaaatgttcgaggccaccgcccgcggggcccggcgcatggcgatcctgggagacacagcctgggacttcggatccatcggcggcgtgttcaccagcgtaggcaagctggtccaccagatcttcggcactgcctacggtgtcctcttctccggtgtgagctggaccatgaagatcgggatcggcgtccttttgacgtggctcggcctgaattcccgcagtaccagtttcagcatgacgtgcatcgcggtggggctggtgactctctaccttggcgtcatggtgcaagctgattcggggtgcgtgattaattggaagggccgggagctgaagtgcgggagcggcatcttcgtcaccaacgaggtgcatacctggacggagcagtacaagttccaagcggacagcccgaagaggctttccgccgccattggcaaggcctgggaggagggggtgtgcggcatccggagcgccacccgcctggagaacattatgtggaaacagatttccaacgagctgaaccacatcttgttggagaatgacatgaagttcacggttgtagtgggagacgttgccggcatcctcgcccaggggaaaaagatgatccggccccagcctatggagtacaagtacagctggcgttcctggggcaaggccaagatcatcggcgccgatgtgcaaaacaccaccttcattatcgacggccccaacacaccggaatgtcccgacgaccagcgcgcatggaatatctgggaggttgaggactacggctttgggatcttcacaaccaatatttggttaaagctgcgcgactcgtacacccaggtctgcgatcaccggctgatgtcagcagctatcaaggatagcaaagctgtgcacgccgacatgggctactggatcgagagtgaaaaaaacgagacttggaagctcgcccgcgctagctttatcgaggtgaaaacctgcgtctggcccaagtcccatacactctggtccaacggcgtgctggagtcggagatgatcatccccaagatatacgggggtcctatcagccagcataactaccgtcccggatacttcacccagacggccggcccctggcacctgggcaaactggagcttgacttcgacctctgcgagggcaccaccgtagtcgtcgatgagcactgtggcaaccgcgggccgtccttgcggaccacgaccgtgacggggaagatcatacatgagtggtgctgccgcagctgcaccttaccgcccttgcggttccgcggagaggacggttgctggtacgggatggagatacgccccgtcaaggagaaggaagagaaccttgtcaagagcatggtatctgccggaagcggcgaggtagattccttcagcctggggctcctttgcatttcgatcatgacggaggaggtgatgaggagccggtggtcccgcaagatgctcatgactggcaccctcgctgtgttcctgctgctcattatggggcagcttacttggaacgatttgatccgcctgtgcatcatggtcggcgcaaacgccagcgaccggatgggcatgggcacgacctacctggccctgatggcaaccttcaagatgcgccccatgtttgctgtgggcctcctgtttcgaaggctgacctcccgggaggtgctcctactcacggtcggactgtcgctggtggcatctgtcgagttacccaacagcctggaagagctgggcgacgggctggccatgggcattatgatcctcaagctgttaaccgactttcagccccaccagctttgggccaccttactgtccttaaccttcatcaagacgaccttctctctgcactacgcatggaagaccatggcgatggtgctgtccatcgtgagtctcttccccctgtgcctgtccaccacgagccagaagacgacatggctcccggtcctgctgggctctttggggtgcaagcccctgaccatgttcctgatcgccgagaacaagatttggggtcgccggagctggccacttaatgagggtatcatggctgtgggcattgtgtccatcctgttgagcagcctcctgaagaacgacgtcccgcttgccggcccgttgatcgccggcggcatgctgattgcttgctacgtaatctcagggagctccgccgacctgtcgctcgagaaggccgccgaggtgtcctgggaggaggaggccgaacatagcggcgcgtcccataacattttggtcgaagtgcaggatgacgggacgatgaagattaaggacgaggagcgtgacgacaccctgaccatacttctgaaggccacgcttctcgctgtcagcggcgtctatccgctgtccatacccgccaccttattcgtgtggtacttttggcagaagaagaagcagcggagcggcgtcctttgggacacgccctccccgcccgaagtcgagcgcgccgtactagacgacggcatctaccggatcatgcagcgcggcctgctggggagatcgcaggtgggcgttggcgtgttccaggagaacgtgtttcacacgatgtggcacgtcacccgcggcgctgttctcatgtaccaagggaaacggctggagccctcctgggccagcgtgaagaaagacctaatctcctacggcggcgggtggcgtctccagggaagctggaataccggggaagaggttcaggtgatcgctgtggagcccgggaagaacccgaagaacgtacagacagcacccgggacattcaagacccccgaaggcgaggtcggcgcaattgccctggacttcaagcccgggacctcgggcagcccgatcgtgaatcgagaggggaagatcgtcggcctgtacggcaacggggtggtgacgacctccggaacgtacgtctccgccatcgcccaggccaaggcgagccaagaggggcccctccccgagatcgaggacgaggtattccgaaagagaaacctgacgataatggatctgcaccctggctccgggaagacgcgccggtaccttcccgccattgtgcgcgaggccatcaaacgtaagctgcggacactgatcctcgccccaacccgcgtcgtggccagcgaaatggcggaggcgctgaagggcatgccaatccggtatcaaaccacagcagtcaagtccgagcataccggcaaggagatcgtcgacctgatgtgccacgccaccttcaccatgcgtctcctgagcccggtgcgggttccaaactacaacatgatcatcatggatgaggcccatttcacggaccccagtagcatcgcggccagaggctacatctccaccagggttggcatgggggaggccgccgccatcttcatgacagcaaccccgcccggaagcgtagaagcattcccccaatccaacgccgtgattcaagacgaggagcgggacatccccgagcgatcatggaactccggatatgagtggatcacggactttcccggaaaaaccgtttggttcgtcccgagcatcaagtccggcaacgacatcgccaactgcctgcgaaagaacgggaagcgggtgatccagcttagccgcaagaccttcgacacggagtaccaaaagacgaagaacaacgattgggactacgtcgtgaccactgatatcagcgaaatgggcgcgaattttcgggctgatagggtgatcgaccccagacggtgcctgaagcccgtcatcctgaaagacggccccgagcgggtgatcctcgccggaccgatgccggtcacggtggctagcgctgcgcagcgccgggggcggataggccgcaaccacaataaagagggcgatcagtacatctacatggggcagcccctgaacaacgacgaggaccacgcccactggacagaagccaagatgttactcgacaacatcaatacccccgagggcatcatcccggctttgttcgaaccagagcgggagaagtccgcggccatagacggtgagtatcgcctacggggcgaggcaagaaaaaccttcgtggaactcatgaggcgcggggacctgcccgtctggttaagttacaaggtggcctccgagggctttcagtacagcgatcgccgctggtgcttcgacggcgagcgcaacaaccaagtgctcgaggagaacatggatgtcgaaatctggaccaaggagggggagcgcaagaagctgagaccccgctggctggatgcgcggacctacagcgatccgctcgccctgcgggaattcaaagagttcgctgccggcagacgctcggtgtctggggacctgattctcgagatcggcaagctgccccagcatcttacccagcgggcccaaaacgccttagacaacctggtgatgctgcataactccgagcagggcgggcgcgcgtaccgtcatgcgatggaggaattgcccgacactatcgagaccctgatgctactcgccctgatagcggtcctgacaggcggggtgacactcttcttcctgagcggccgaggtcttgggaagacgtccatcgggctactgtgcgtgatggcgagctccgtcctgctttggatggcaagcgtggaaccacactggatcgccgcctccatcatactggagttcttcctgatggtgctcctgatcccggagcccgatcggcagcgaacgccccaggataaccaactggcctacgtcgtgatcggtctcctgttcatgatcctgacggtggccgctaacgagatgggcttgctggagactaccaagaaggacctggggataggccatgtcgccgtggggaaccaccaccacgccgcaatgctcgacgtggacctacacccggccagcgcgtggaccctgtacgccgtcgcaacgacgatcatcacccccatgatgcgccacacgatcgagaacaccacggccaatatatccctcaccgcgatcgcgaaccaggcagcgatcctgatgggcctggacaaaggctggccaatcagcaagatggacatcggggtgcccctcctggcactgggctgctacagtcaggtgaaccctctcaccctaaccgcggccgtcctgatgctcgtagcccactacgcgatcatcgggcccgggctgcaggccaaggcgacgcgggaggcccagaaacgcacagccgccggaatcatgaagaatcccaccgtggacggcatcgtcgccatcgacctggaccctgtggtgtacgatgcgaagttcgaaaagcagctcggccagatcatgctactgatcctctgtactagccagatcctgcttatgcggacgacatgggccctctgtgaaagtatcaccctggccaccggcccgctgacgaccctctgggagggcagccccggtaagttctggaacaccaccatcgcagtctccatggcaaacatcttccgaggcagctacctggcgggcgccggcctggccttctccctgatgaagtccctgggagggggacggcgcgggacgggcgcccagggcgagactctgggggagaagtggaagcggcagctcaaccagctctcgaagtccgagttcaacacttataagcgcagcggcatcatggaagttgatcgatcagaggcgaaagagggcttgaagcgcggcgagatcaccaaacacgccgtgagccgtgggacggccaagctccgctggttcgtcgagcggaatctagtgaagccggaggggaaggtgatcgacctggggtgcgggcgcggcgggtggtcctactattgcgccggcctgaagaaggtcaccgaggtcaagggatacaccaagggcggcccggggcacgaggagccgatcccaatggccacctacggctggaacttggtgaagctgcatagcgggaaggacgtgttctttgtcccgccagagaagtgcgacacactgctatgcgacataggcgagtctagtccgaaccccaccatcgaggaagggcggaccctgcgcgtacttaaaatggtggagccctggctccggggcaaccagttttgcatcaagatactgaacccctacatgccgtccgtggtggagaccctagagcaaatgcagcgtaagcacggagggatgctcgttcggaaccctctgagccgcaactccactcacgagatgtactgggtgagctgcgggaccggtaacatcgtatccgctgttaacatgaccagccgcatgctgcttaaccggttcaccatggcccaccgcaagcccacctatgagcgggatgtagacctgggcgccggcactcgccacgtggccgtggaacccgaggtggcaaacctggacataatcgggcaaaggatagagaacatcaagcacgagcataagtccacctggcattatgacgaggacaatccgtataagacctgggcctatcacggcagctacgaggtcaagccctccgggagcgcttccagtatggtgaacggcgtcgtcaagctcctgaccaagccctgggatgtcattcctatggtgacgcagatcgcaatgaccgacaccactccgttcgggcagcagcgcgtcttcaaggagaaggtcgacacgcggacccccaaggccaagcgcggtaccgcccagattatggaagtgaccgcgaagtggctgtggggattcctcagccggaacaaaaagccccgcatatgcacgcgagaggagttcactcgcaaagttcggtccaacgccgctatcggagccgtgtttgtggacgaaaaccagtggaacagcgcgaaggaggccgtcgaggacgaacgcttctgggacctggttcaccgggaacgcgagctgcacaagcagggcaagtgcgccacctgcgtctataacatgatggggaagcgggagaagaaactcggcgagttcgggaaagccaagggctcccgcgccatctggtacatgtggctgggcgcgcggttcctggaatttgaagccctcgggttcatgaacgaagatcactggttcagcagggagaactccctgtcaggcgtcgagggggagggtttgcacaagttagggtatatcctgcgcgacatctccaaaattccgggaggcaacatgtacgccgacgacaccgctggatgggacactaggatcaccgaggacgacctgcagaacgaggcaagaatcaccgacatcatggagcctgagcatgcgctcctggcgaaatcaatcttcaagctaacctaccagaataaggtggttcgggtccagcgccccgccaagaacggcacggtgatggacgtgatcagtagacgcgaccaacgggggtcaggccaggtcggcacgtacggccttaacacctttaccaacatggaggcccagctgatccgccagatggagtccgagggcatcttcagtccgagtgagctggagacgccgaacctcgccgagcgcgtgctggactggctggagaagtacggggtggagaggttaaagcggatggcgatcagcggcgacgactgcgtcgtgaagcccatcgacgaccgctttgccaccgccctgaccgctctgaacgatatggggaaggtgaggaaagacatcccccagtgggaaccatccaagggatggaacgactggcagcaggtcccgttctgcagccaccacttccatcagctcatcatgaaggacggccgcgagatcgttgtgccctgccggaatcaagacgagctggtcgggcgcgcacgggtctcacagggagccgggtggagcctacgggaaaccgcctgtctcggcaaaagctacgcccagatgtggcagctcatgtactttcaccggcgcgatctgagacttgcggcgaacgctatctgcagcgccgtgcccgtcgattggatacccacgagtcgcaccacctggtcaatccacgcacaccaccagtggatgaccacggaggacatgctgagcgtgtggaaccgcgtgtggatcgaggagaatccgtggatggaggacaagacccacatctccagctggggcgatgtaccctacctgggcaagcgcgaagaccaatggtgcggttcactaatcgggctgaccgctcgtgcgacctgggctacgaacatccaggttgccatcaatcaggttcggcggctaatcggcaacgagaactatctcgattacatgaccagcatgaagcggttcaagaacgagagcgacccagagggcgctctgtggtga

SEQ ID NO: 23837 - RNA, 9879 nt, synthetic construct
  misc_feature 1..9879: note = derived and/or modified CDS sequence (opt11) from DENV-1__FJ639691__SS-prME
  source 1..9879: mol_type = other RNA
agcgtgactatgctgctcatgctgatgcccaccgccctagccttccacttgacaacacggggcggggaaccccacatgatcgtgagcaagcaggaacggggtaagagcctgctgtttaagacttctgccggggtgaatatgtgcaccctcatcgcgatggacctgggcgaattttgcgaggacaccatgacctataagtgcccccggataagcgaggccgagcccgatgacgtagattgctggtgcaacgcaacggacacctgggtgacctacggaacctgctcccaaacaggagagcaccggcgtgacaagcggtcggtggccctagcgccgcatgtgggcctaggtttggaaacacgtacggagacctggatgtccagtgaaggcgcatggaagcagatccagcgggtcgaaacctgggctctgcgccaccccgggttcaccgtgatcgccttatttctcgcgcacgccattggtacatccatcacccagaaggggatcatctttatcctgctcatgctggtgacccccagcatggccatgcggtgcgtcggcatcggctcccgggatttcgttgaaggtctatcgggcgccacctgggtggacgtcgtgctcgagcacgggtcctgcgtgacgaccatggccaaggataaacctaccctcgacatcgaactgctcaaaaccgaagtcacaaaccccgcggtgctgcgtaagctgtgcatagaggccaagatcagcaacaccaccaccgactcccgctgcccgacgcagggtgaggccacgttagtggaggagcaagacgccaacttcgtttgccggcgcacattcgtggatcggggctggggcaacggatgcgggctgtttggaaagggcagcctcatcacttgcgccaaattcaagtgcgtaacaaagctcgagggcaagatcgtgcagtacgagaacttgaagtactcagtcatcgtgaccgtccacaccggggaccagcaccaggtggggaacgagagcaccgaacacggcacgaccgcgaccattactccccaggccccctccaccgagatccaactgacggactacggggccctcaccctggactgctcgcccagaacgggccttgacttcaacgagatggtcttactgactatgaaagagaagtcctggctggtgcacaagcagtggttcctcgacctcccgctgccctggacgtcaggggctagcacctcccaggaaacgtggaaccggcaggatttgctggtgaccttcaagacggcccacgcgaaaaaacaggaggtagtggtactgggttcacaggagggggctatgcacaccgccctcacgggggccacagagatacagacgtccggcactaccaccatcttcgcggggcaccttaagtgcaggctgaagatggacaagctcacgctgaagggcatgagctacgtgatgtgcaccggatcctttaagctggagaaggaggtagcggagacccagcacggtacagtattagtccagatcaaatacgagggcacggatgccccctgcaagatacccttttctacgcaagacgaaaagggcgtgacccagaatggcagactgataaccgccaacccgatcgtgacggacaaggaaaagccggtaaacatcgaggccgagccgcccttcggggaaagctacatcgtaatcggcgcaggcgagaaggccctgaagctgagttggttcaagaaagggtcctcgattggaaagatgttcgaggccaccgcccgaggagcaaggaggatggcgatactgggcgataccgcctgggatttcggcagcataggcggagtgttcacctcggtcggtaagctggtccatcagatcttcggcacggcctatggggtgttgttctctggcgtgagctggacgatgaagatcggaatcggcgtgttactgacctggctgggccttaactcccgtagcacctccttgagcatgacgtgcatcgccgtcgggctggttaccctctacctgggcgtcatggtgcaagccgactctgggtgcgtcatcaactggaaaggacgcgagctgaagtgcgggtccggcatcttcgtgactaacgaggtgcacacctggacggagcagtacaagttccaggcggactcaccgaagcgactttcggccgccatcggcaaggcatgggaagagggggtctgcggtatccggagtgccacccgactagagaacataatgtggaagcagatctccaacgagctgaatcacatcctcctggagaatgatatgaagtttaccgtggtagtcggggatgttgcgggcatcctcgcgcagggtaagaagatgatacggccccagcccatggaatacaagtacagctggaaatcctggggcaaggccaagatcatcggcgccgacgttcagaacaccacctttatcatcgatgggcccaacactccggagtgccccgacgaccagcgcgcctggaacatctgggaggtcgaggactacggcttcggtatcttcaccacaaacatctggctaaagctgcgtgactcgtatactcaggtgtgcgaccaccggctgatgtccgccgccatcaaggacagcaaggccgtgcacgccgacatgggctattggatcgagtccgagaaaaacgagacgtggaaactcgcgcgggcctcgttcatcgaggtcaagacctgcatctggcccaagtcccacaccctctggtctaacggcgtgctggagtctgagatgatcattcccaaaatatacgggggcccgattagccagcacaactacaggcccgggtacttcacccaaacggcgggcccctggcacttgggcaagctggagttggactttgacctctgcgagggcacgaccgtggtcgtggacgagcactgcggcaaccgggggccgtccttgcgcactacgaccgtgactggcaaaatcatccacgagtggtgctgccgatcatgcaccctgccgcctctgcgcttcaagggtgaggacggctgctggtacgggatggagatacggcccgtcaaggaaaaagaggagaatctggtaaaaagcatggtgtccgccggcagcggcgaggtggactccttcagcctggggctcctgtgcatctccatcatgattgaggaggtgatgcgcagccgatggtcccgcaagatgctgatgacgggcactctcgccgtatttttccttctgattatggggcagcttacctggaacgacctgatacggctgtgcattatggtcggcgcaaacgcctctgaccgcatgggtatgggcatgacctacttggcgctgatggcaacgttcaagatgcgcccgatgtttgctgtgggcctcctgttccggcgtctgacctcccgggaggtgctgttactgacgatcgggctgagcctcgttgcgtccgtggagctgcccaatagcctggaggagcttggcgacgggctggctatgggcattatgattctgaagctcctgaccgacttccagtcctaccagctgtgggccacgctcctcagcctgactttcatcaagacgaccttctccttgcactacgcctggaagacaatggcgatggtactgagcattgtctccctgttccccctctgcttgagcacaacctcccaaaagactacgtggttgccggtactcctgggcagcctgggctgcaagccgctcaccatgtttctgatcgcggagaacaagatctggggccgcaaaagctggcccctgaatgagggcataatggcagtgggcatcgtgtccatcctcttaagctccttactcaagaacgatgtacctctggccgggcccctgatcgccggcgggatgttaatcgcgtgctatgtcattagcgggtctagcgccgacctgtccctggagaaggcagccgaagtgagctgggaagaggaagccgagcactccggcgcgagccacaacatcctcgtggaggtccaggacgacgggacaatgaagatcaaggacgaggagcgggacgacaccctgacgatcctgctcaaggcgaccctgctggccgtatccggagtgtacccgctcagcatacccgccacccttttcgtctggtatttctggcagaagaagaagcagcgctctggggtgctgtgggatacgcccagcccacctgaggtggagcgggcagtcctcgacgacggcatctacagaataatgcagcggggcttgcttgggaggtcccaggtaggcgttggggtatttcaggagaatgtgttccacaccatgtggcatgtgacgaggggggcggtcctgatgtaccaggggaaacgcttggaacctagctgggcctccgtgaagaaggacttaatcagctacggcggaggctggcggctccagggctcctggaataccggggaagaggttcaggttatagccgtggaacccggcaagaaccccaaaaatgtgcagaccgcccccgggacgtttaagactagcgagggcgaggtcggcgccatcgcgcttgatttcaagcccgggacgagcggctcgcccatcgtaaatcgcgaggggaagattgtcggcctgtacgggaacggggtggttaccacctcaggcacttacgtgtccgccatcgcccaagctaaagcaagccaagaggggcccctgccggagatcgaagacgaggtcttccggaagaggaacctcaccatcatggatctgcaccccggctccgggaagacccgccgctacttacccgccatcgtccgggaggccattaaacggaaactccggaccctaatcctggccccgacgcgtgtggtcgccagcgaaatggcggaagcccttaagggcatgccaatcaggtaccagactaccgctgtgaaatccgaacataccggcaaggagatcgtcgacctgatgtgccacgccacgttcacgatgcggctgctcagccccgtacgcgtgcccaactataacatgatcatcatggacgaggcccacttcaccgacccgtctagcatcgcggcccggggttatatctcgaccagagtgggcatgggggaggccgccgccatcttcatgacggcgaccccgcccggctccgtcgaggccttcccccagagcaacgcggtgatccaagacgaggagcgggacatcccggagcgatcttggaactcaggatacgagtggattaccgacttccccggcaagaccgtctggtttgtcccaagcatcaaatccggcaacgacatcgctaactgcctgcggaagaatgggaagcgcgtgattcagctgtcccggaagacgttcgacactgagtaccagaagacgaagaataacgactgggactatgtggtgaccactgatatatccgagatgggcgccaacttccgcgccgacagagtgattgacccccgcaggtgcctaaaaccggtgatcctgaaggacgggcccgaaagagtcatacttgctggccccatgcccgtgactgtcgccagtgccgcccagcgtcgcgggaggatcggccgcaaccacaacaaggagggtgaccagtacatctacatgggtcagccgctcaacaacgatgaagatcatgcccactggaccgaagcaaagatgctgcttgacaatatcaacacccctgagggtatcatccccgccctcttcgagcccgaacgggagaagtccgccgctatcgacggggagtaccgcctgaggggcgaggcccggaagaccttcgtcgagctaatgcggcgcggagacctcccggtttggctctcctacaaggtcgcaagcgagggcttccaatactctgaccgccgttggtgcttcgacggcgagcgcaacaaccaggtgctagaggaaaacatggacgtggagatctggaccaaggagggggagcggaagaagctgcgcccccggtggttagacgctaggacctacagcgacccgcttgcactccgggagttcaaggagttcgcggcaggccgccggagtgtcagcggggacctgatcctggagatcgggaagctcccccaacatctgacccagcgcgcccagaacgcactggacaacctcgtgatgctgcacaattccgagcagggcgggcgagcttaccgccacgccatggaggagctacccgacactatcgagaccctcatgcttctggccctcatcgcggtgttgaccggcggtgtcaccctgttctttctcagcggtcgggggctcgggaagacgtccatcggcctgctctgcgtgatggcctcttcggtgctactgtggatggcttccgtcgagccccactggatcgccgcctccatcatcctcgagttcttcttgatggttttactcatccccgaacctgaccgccagcggaccccgcaggacaaccagctggcctacgtggttattggcctcctcttcatgattctgaccgtggccgcaaacgaaatgggcctgctcgaaaccactaagaaggacctgggaatcggtcacgtggccgttgagaaccaccatcacgcagccatgctggacgtggacctccatcccgcatctgcgtggacgctgtacgccgtcgccaccaccattataacccccatgatgaggcacaccattgagaacaccactgccaacatctccctgacggccatcgcgaatcaagccgctatactcatggggctggacaagggctggccgatcagcaagatggacatcggcgtgcccctgctagctctgggatgttactcccaagtgaacccactgacgttaacggcggcggttctgatgttagtcgcccactacgctatcatcggacccggcctgcaagccaaagccacgcgggaggcccagaagcgcacagccgcaggcatcatgaagaatccgactgtggacgggatagttgctatcgacttggaccccgtagtgtacgacgcgaagttcgagaagcagttgggccagatcatgttgttaatcctgtgcaccagccagatcctcttgatgcgcaccacctgggccctgtgcgagtccatcacacttgccaccggcccactgactacactgtgggaggggtcccccggcaagttctggaacacgacaatagcagtgagcatggccaacatcttccgggggtcctacctcgccggcgccggtctggccttcagcctcatgaagtccctcgggggcggccgccggggcacaggagcccagggcgagaccctgggcgagaagtggaagcggcaactgaaccagctcagcaaatccgaatttaacacgtacaagcgtagcgggattatggaggtcgaccgctcggaggcgaaggagggtctgaagcgaggggagaccaccaaacacgccgtcagccgcggaaccgccaagctacggtggttcgtggaacgcaatctcgttaaaccggagggtaaagtgatcgacctgggctgcggccgtggcgggtggtcctactactgcgccgggctcaaaaaggttacggaagtcaaggggtatactaagggggggcccggccacgaggagccaatccctatggccacctacgggtggaacttggtgaagttacatagcggaaaggacgtgttcttcgtcccgcccgagaagtgcgacaccctgctttgcgacatcggggaatccagcccgaaccctactatcgaggagggtcgcaccctacgggtgctgaagatggtagagccgtggctgcgcgggaaccagttctgcatcaaaatcctcaacccctacatgccctccgttgtcgaaaccctggaacagatgcagcggaaacacggcggcatgctggtgcgcaatccgctcagccggaactccacacacgagatgtactgggtctcctgcgggacgggcaacattgtatccgcggtgaacatgaccagccgcatgctgctgaaccgattcaccatggcccatcgcaagccgacctacgagcgcgacgtcgacctcggggccggcacccggcacgtggccgtggagcccgaggtagcaaacctggacatcatcggccaacgcatagagaacatcaaacatgagcataaatccacctggcactacgacgaggacaatccctacaagacctgggcatatcacggctcctacgaggtgaaaccgtctggctcagcctccagtatggtcaacggagtggtgaagttgctcactaagccttgggacgttatccccatggtaacccagattgcgatgacggacaccaccccatttggccagcagcgagtcttcaaggagaaggtggacaccaggacgcccaaggccaagcgtggcactgcccagatcatggaggtgaccgcgaaatggctgtggggcttcctgagccgcaataaaaagccgcggatctgcacccgcgaggagttcacgcgtaaggtgcgctccaatgccgccattggcgccgtgttcgttgacgagaaccagtggaatagcgcaaaagaggccgtggaggacgaacggttctgggacttagtccaccgcgagagagagctccataagcaggggaagtgcgcgacttgcgtgtataacatgatgggcaagcgcgagaagaagttaggcgagttcggaaaggcaaaggggagtcgggccatctggtacatgtggctcggcgcgcgcttcctggagttcgaagccctcggcttcatgaacgaggatcactggttcagccgggagaactctctctcaggggtggagggcgaggggttgcacaagctgggctacatattgcgcgacatcagcaagatcagcggtggcaacatgtacgccgacgacaccgccgggtgggacacccggatcactgaagatgatctgcagaacgaagcaaaaatcacggacattatggagcccgagcacgcgctgttggcaaagtccatctttaagctgacctaccagaacaaggtcgtaagggtgcagcgccccgcaaagaacgggactgtgatggacgtgatctctcgccgcgaccagcgcggcagtggccaagtgggaacgtatggcctgaacacgttcaccaacatggaggcccagcttatccgccagatggaaagcgaagggattttcagccccagcgagctggaaacacccaacttagccgaacggacgctcgactggctggaaaagcacggcgtggagcgactgaagcgaatggcgatctcgggggacgactgtgtggttaagcccatcgacgacaggttcgccaccgctcttaccgccctgaacgacatgggcaaagtccggaaggacatcccccagtgggagccctccaaggggtggaacgactggcagcaggtccccttctgcagccatcacttccatcagctgatcatgaaagacggccgcgagatcgttgtcccttgcagaaaccaagacgagctggtgggccgggcccgggtgtcgcagggagcaggttggagcctgcgcgaaactgcatgcttgggcaagtcctacgcccagatgtggcaactcatgtactttcaccggagagatttgcggttagctgcaaacgccatatgcagcgccgttcccgtggactgggtgcctacgtcccgcaccacctggagcattcacgcccaccaccagtggatgaccacggaggacatgctctcagtctggaaccgcgtgtggatcgaggaaaatccctggatggaggacaagacccacatatcatcatgggaggacgtgccctatctgggcaagcgcgaggaccagtggtgcgggagcctgatcggactgaccgcacgggcgacctgggccacgaacatccaagtcgctatcaaccaggtacgtcgtctgattggcaacgagaactacttggactacatgacgtccatgaagcggttcaagaacgaaagcgatctcgagggggccctgtggtag

SEQ ID NO: 23838 - RNA, 9879 nt, synthetic construct
  misc_feature 1..9879: note = derived and/or modified CDS sequence (opt11) from DENV-1__FJ639692__SS-prME
  source 1..9879: mol_type = other RNA
tccgttaccatgctgctcatgttgatgcccaccgcgctggctttccacttgactacccggggcggcgagccacatatgattgtctcgaagcaggagcggggcaagtctctgctcttcaaaacctccgcgggggtaaacatgtgtaccttgatcgcgatggaccttggcgagctgtgcgaggacacaatgacctacaagtgtccccgaattaccgaggcagagcccgacgacgttgactgctggtgtaatgccaccgacacttgggtgacatacggcacttgttcgcagaccggagagcaccggcgagataaacggtccgtggctctcgcgccccacgtgggactgggtctggagacgcgcaccgagacctggatgagctctgagagcgcatggaaacagatccagcgggtggagacatgggccctacgccacccgggcttcactgtgatcgccctgttcctggcgcacgccattggtacctctatcacccaaaaaggcattatcttcattctcctgatgctggtgaccccctctatggcaatgcgctgcgttgggattggcagtcgcgacttcgtggagggcctttcaggggccacatgggtggacgtcgttctcgagcacggatcttgcgtgaccaccatggccaaggataagcccacactcgacattgaacttctgaagacggaggtaacaaaccccgcgatcctgcggaagctctgcatcgaggccaagattagcaacaccaccacggattccagatgcccgacccagggcgaggccaccctggtggaggaacaggacgctaacttcgtatgccggcgcaccttcgtagaccggggttggggcaatggttgcggtctgttcggtaagggctctctcataacgtgcgcaaagttcaaatgcgtcaccaagctggaggggaagatcgtgcaatacgagaatctgaaatactcggtgatcgtcaccgtgcacaccggtgatcagcaccaagtcggcaatgagagcacggagcacggcaccaccgcgaccatcacgccccaagcccctaccacggagatccaactcaccgactacggcgcccttaccctggactgctccccccggacggggctcgacttcaacgagatggtgctgctaacaatgaaggagaagagttggttggtccacaaacaatggttcctggatttgcccctcccctggacaagcggcgcctccaccagccaggaaacgtggaaccgccaggacctgctggtcacctttaagaccgcacacgcaaagaagcaggaggttgtcgtgctcggatcacaggagggtgccatgcacactgcgctcaccggggccaccgagatccagacctcggggaccacaaccatcttcgccggacacctgaagtgccgcttgaagatggacaagctgaccctcaaggggatgtcctacgtgatgtgtacagggtctttcaagctggaaaaggaggtggcggagacacagcacgggaccgtgctagtccaaataaaatacgagggcaccgacgccccctgcaagatcccattctccacccaggacgagaagggagtcacgcagaacgggcggctgatcaccgccaacccaatcgtcactgacaaggagaagccagtgaacatcgaggcagagccgccattcggcgagagctacatcgtcatcggggcaggggagaaagccctgaagctctcctggttcaaaaagggcagttccatcgggaagatgttcgaggccaccgcccgcggagcacgccgcatggcgatcctgggggacacggcttgggactttggcagcattgggggcgtgttcacttccgtgggcaagttggtacaccagatcttcgggaccgcttatggcgtgctgttctccggggtgtcctggactatgaagatcggcatcggggttttgctgacgtggctcggccttaacagccgaagcacctccctctctatgacctgcatcgctgttggtttagttacgctctacctgggggtgatggttcaggcagactcgggatgtgtcatcaactggaaggggcgggagctcaagtgtgggagcgggatcttcgtcaccaacgaggttcacacctggaccgaacagtacaagttccaggcggactccccaaagcgcctgagcgcggcgatcgggaaggcctgggaagaaggcgtttgtggtatacggtctgctacccggcttgagaacattatgtggaagcagatcagtaacgagttgaaccacatcctcctggagaacgacatgaagtttaccgtggtggtcggcgacgttgcgggtatacttgcccagggcaagaaaatgatccgaccccagcccatggaatacaagtactcctggaaatcctggggcaaggccaagatcataggggctgatgtgcagaacacgacctttatcattgatggccctaacactccggaatgcccggacgaccaacgcgcttggaacatctgggaggtggaagactacggctttggcatcttcaccacaaacatctggttgaagctgcgggacagttatacccaggtctgcgatcaccggctcatgtcagctgctatcaaggactccaaggccgtccacgctgacatgggctactggatcgagagcgagaagaacgagacctggaagctggccagggcttccttcatcgaggtgaagacctgcatttggcccaaaagtcacacgctttggtctaacggtgtcctcgagagcgagatgatcatcccaaagatctacggagggccaatctcacaacacaactaccgtccgggctacttcacccagaccgccgggccgtggcacctgggtaaactggagttggacttcgacttgtgcgaagggactacggtggtcgttgatgagcactgtggaaaccggggccccagcctacgcaccacgacggtgacagggaaaatcatccacgaatggtgctgccggtcatgcacactgccccccctgcgctttcggggcgaagacggatgctggtacggcatggagatacgtcccgtgaaggagaaggaggaaaatctggtcaaaagcatggtgagcgcggggtcgggcgaagtggattcattttccctcggcttgctgtgcataagcataatgatcgaggaggtaatgcgatcccggtggagccggaaaatgctcatgaccgggaccctggccgtgttcctgctccttatcatggggcagctgacatggaacgacctcatccgcctgtgcatcatggttggggcaaacgcctccgaccgcatgggtatggggaccacctacctggccctgatggccaccttcaaaatgcggccgatgttcgccgtggggctgctcttccgccggttaacgagccgagaggtactattactcaccataggtctatccttagtggcgagcgtcgaactccccaactccctggaagagttaggtgacggcctcgccatgggtataatgatcctgaagctcctcaccgacttccagagccatcaactgtgggccaccctgctctccctgactttcatcaagaccacctttagcctgcactatgcctggaaaaccatggcgatggtgctctctatcgtaagcctgttccccctgtgcctctccacgacaagccaaaaaactacctggctgcccgtgctgctgggctccctaggctgcaagcctctaacgatgttcctcatcgccgaaaacaagatatgggggagacgcagctggccgctgaacgagggtataatggccgtggggatcgtctctatcctgctctcctctctcctgaagaacgatgtgcccttggccggtcctctgattgccggcggcatgctgatcgcgtgctatgtgataagtggctcatccgccgacctgtcgctggaaaaggccgccgaggtctcctgggaggaagaagccgagcacagcggggcgtcccacaacatcctggtggaggttcaggacgatggtaccatgaagattaaggacgaggaacgggatgacacgctcactatcctcttaaaggccaccctcctcgcagtgagtggggtttacccactgtcaattcccgccaccctctttgtgtggtacttctggcagaagaagaaacagcgctcgggcgtcctgtgggacactcccagcccacccgaggtggagcgggccgtgcttgacgatgggatctaccgcatcatgcagcgtggccttctcggccgctctcaggtcggggtgggagtgttccaggagaacgtgttccataccatgtggcacgtgacccgcggcgcggtactgatgtaccagggcaaaaggctggaaccaagctgggccagcgtcaagaaggacctcatatcctacggcggcggctggcggttgcaggggtcctggaacactggcgaggaggtccaggtgattgccgtcgagccagggaagaaccccaagaacgtgcagactgcgcctggcaccttcaaaacccccgagggggaggttggagcaatcgcgctggacttcaagcccggcacatccgggtcacccatcgtcaacagagaaggcaagatagtcggtttatacggcaatggggtggtcacgacctcaggcacctacgtgtcggccatcgcccaggctaaagcgagccaggagggccctctgcccgagatcgaggatgaagttttcagaaaaagaaatctcacgatcatggacctccaccctgggtcaggcaaaacgcggcgctacctgcccgctattgtacgtgaggccataaagagaaaactgcgcacactgatcctggcccccacccgggtggtggcctctgagatggcggaggccctgaaggggatgcccatccgttaccagacgaccgcggttaaatccgagcacaccggcaaggagattgtagatctcatgtgccacgccacattcaccatgcgcctgctcagccccgtgcgcgtgccgaactacaatatgatcattatggacgaggcccacttcaccgatccctccagtatcgcggcacgtggctatatctctacccgcgtgggcatgggtgaggctgccgccatttttatgaccgcgacgcctcccgggtcagtggaggccttcccgcagtccaacgcactaatccaggatgaggagcgagacatcccggaacgttcatggaactcgggctacgagtggattacggatttccccgggaaaaccgtatggttcgtccccagcatcaagtctgggaacgacatcgcgaactgcctacggaagaacggaaagcgtgtcatccagctgtctcggaaaactttcgacacggagtaccaaaagacaaagaacaacgactgggattacgttgtgacaacagatattagtgaaatgggggcgaacttccgcgcagaccgggtgatcgaccctcgccgctgcctcaagccggtaatcctgaaagatggccccgagcgagtgattcttgccggccccatgccggtgacggtcgcctccgccgcgcaacggagggggcgcattggacgcaatcacaataaagagggcgaccaatacatctacatgggccagcccctcaacaatgacgaggaccacgctcattggactgaggccaagatgttgttagacaacatcaatacccccgaagggatcatacccgccctctttgagccggagcgggagaagtccgctgcgatcgacggcgagtatagactgcggggcgaagcgcgtaagaccttcgtggagttgatgcgccgtggcgacctccccgtctggctgagctacaaggtcgccagcgaggggttccaatactccgaccgccggtggtgcttcgacggcgagcgaaacaaccaggtgttagaggagaatatggacgtcgagatctggacgaaggagggagagagaaagaagttacgcccccggtggctggacgcccgcacatacagtgacccgctagcgctacgtgagttcaaggaattcgcggccgggcgccgttctgtcagcggcgacctaatcttagagattgggaagttaccgcagcacctgacccagcgcgcccagaacgccctcgacaatctcgtgatgctgcacaattcagagcaaggcggccgcgcgtaccggcacgccatggaggagttaccggacacaatagagacgttgatgctgcttgccctcatcgctgttctgaccgggggcgtgacactgtttttcctcagcgggcgaggcttaggcaaaacctccatcggcctcctctgcgtaatggccagcagcgtcctcctttggatggcgagcgtggaaccccactggatcgccgcctccatcatcctcgaatttttcttgatggtgctgctcatcccagaaccggaccggcagagaacgccacaggataaccagcttgcctacgttgtgattggcctcctctttatgatcctaacggttgccgcgaacgagatgggtctgctcgagaccaccaagaaggacctcggcattgggcacgtagcagttggaaaccaccaccacgcggcaatgctggacgtggacctccacccagcctcagcttggacactgtacgccgtcgccaccaccataattacccctatgatgcgccacaccatcgagaacacgaccgcaaatattagtctgacggccatcgccaaccaggccgccatccttatgggcttagataaggggtggccaatcagcaagatggatataggcgtgccgctgcttgcgctggggtgctactcccaggtgaaccccctgaccctcacggccgccgtcctgatgctagtggcccattacgccattatcggcccggggttacaggccaaggcaacccgggaggcccaaaagcgcaccgccgccggcatcatgaagaaccccacagttgacgggattgttgccattgacttggaccccgttgtctatgacgcgaaattcgagaagcaacttggccagatcatgctcctgatcctgtgcacgtcacagatcctcctgatgcgcacgacctgggccctgtgcgagtcaatcaccctcgccacgggccccctgaccaccctttgggaggggagcccaggcaagttctggaacaccacgatcgcagtcagcatggctaacatatttcggggttcttacctggcgggcgcggggctggcttttagcctgatgaagtccctcggcggggggcgccggggcaccggcgcccagggcgaaacactgggcgagaagtggaagcgacagctgaaccagctctcgaagtccgagttcaacacatacaagcggagcggaatcacggaagtggacaggtccgaggcgaaagagggcctgaagcgcggagaaaccaccaagcacgccgttagccgcggcaccgcaaaacttcggtggttcgttgagcgcaacctggtgaagcccgagggaaaggtgatcgacctcggctgcggccgcggtggatggtcttactactgcgccggattgaagaaggtcacggaggtgaaagggtacacgaagggcgggccaggccatgaggagccgatcccaatggccacatacggctggaatttggtgaagctacacagcggcaaggacgtcttcttcatcccgcccgagaagtgcgacaccctgttatgcgacatcggggagtcctcacccaaccctacgatcgaggagggccgcaccctccgggtgcttaagatggtggagccctggcttagagggaaccagttttgtatcaagatcttaaatccatacatgccttctgtcgttgagaccttggagcagatgcagcggaagcacggcggcatgctcgtgcgcaacccgctctcgaggaactcaacccacgagatgtactgggtgtcgtgcgggaccggcaatatcgtctcggcggtgaacatgacgagccgcatgctgctaaaccgcttcaccatggcccaccgcaagcccacttacgaacgcgacgttgacctcggggctggcacgcggcacgtggccgtagagcccgaggttgcgaacctagatatcataggccagcgcatcgagaacatcaagcacgagcacaagagtacctggcactacgacgaggacaatccctacaaaacgtgggcgtaccacgggagctacgaggtgaagccgtcaggaagtgcaagctcaatggtgaacggggtggtgaagctgttaaccaagccgtgggacgtcatccccatggtgacccagattgccatgacggacactaccccctttggccagcagcgggtgttcaaagagaaggttgatacacggacgccgaaggcaaagcgggggacggcccagatcatggaggttaccgcaaagtggctgtggggcttcctgagccgaaacaagaagccgcggatctgcacgcgcgaggagttcacgcgaaaggtgcgcagcaatgcagccatcggcgccgttttcgtggatgagaaccaatggaacagcgcgaaggaggccgtggaggacgagcggttctgggacctcgtccaccgcgaacgggagctgcacaagcagggaaagtgtgcgacgtgcgtgtataacatgatgggcaaacgggaaaagaagttgggtgaattcggcaaggcgaaggggtccagggccatctggtacatgtggctcggcgccagattcttggagttcgaggcgctggggttcatgaacgaggaccactggtttagccgggagaactccttgagcggggtggaaggcgaggggctgcacaaactcggctacattcttcgcgacatctccaagatccccgggggcaatatgtacgccgacgataccgccggctgggacactcggattacggaggacgacttacagaacgaggccaggatcaccgacatcatggagccggagcacgcgctactcgccaaaagcatcttcaagttgacgtaccagaacaaagtcgtgcgcgtgcagcggcccgccaaaaacgggaccgtcatggatgtgatctcccgccgggatcagagaggcagcggccaggtgggaacgtacggccttaacacctttactaacatggaggcccaactcatccggcagatggaatctgagggtatcttctcaccttccgagctggagacacccaacctggcggaacgcgtattagactggctggaaaaatacggcgtggagcggttaaagagaatggcgatttcgggagacgactgcgtggtcaagccgatcgacgaccggttcgcgacagccttgaccgccctgaacgacatgggcaaggtacgcaaagacatcccccagtgggagccctccaagggctggaatgattggcagcaggtccctttctgcagccaccacttccaccagctgatcatgaaggacggccgggagatcgtagtgccgtgtcgcaaccaggacgagctcgtcggccgcgcccgcgtctcccagggggctggctggtccctacgggagacagcctgcctgggcaaaagctatgcacagatgtggcagctcatgtactttcaccggcgtgacttgcgcttagcggcgaatgccatctgcagcgctgtgcccgtggactggatccctaccagtaggacgacctggagcatccacgcccatcatcagtggatgacgactgaggatatgctcagcgtgtggaaccgcgtgtggatcgaggagaacccctggatggaggataagactcacatctccagttggggcgacgtgccgtacctcgggaagcgcgaggatcaatggtgtgggtctttaatcgggctcacagcacgggcgacctgggccaccaacattcaagtcgccatcaaccaggtgcgccggctgatagggaatgagaattacctggactacatgaccagcatgaaacgcttcaaaaacgagagcgacccagagggcgccttgtggtga

SEQ ID NO: 23839 - RNA, 9879 nt, synthetic construct
  misc_feature 1..9879: note = derived and/or modified CDS sequence (opt11) from DENV-1__FJ639693__SS-prME
  source 1..9879: mol_type = other RNA
agcgtgaccatgctactcatgctcatgcctaccgccctggccttccatctcaccacccggggcggcgagccccatatgatagtgagcaagcaggaacggggcaagagcctcttattcaagaccagcgcgggggtaaatatgtgtaccctgatcgccatggacctgggcgagttctgcgaggacactatgacttacaagtgcccccggataagcgaggccgaacccgatgacgtggactgctggtgcaacgccaccgacacctgggtcacctacgggacctgcagccagacgggtgagcatcggcgcgacaagcggagcgtggccctggcgcctcacgtgggcctcgggctggagacccggacggagacctggatgtccagcgaaggggcctggaagcagatccagcgggtcgagacctgggccttgcgccacccggggttcaccgttatcgccctctttcttgcacacgccatcgggacctccatcacacagaagggaataatcttcatcctgttaatgctagtgacccccagcatggccatgcggtgtgttggtatcggctcccgtgacttcgttgaggggctgagcggcgccacctgggtcgacgtcgtccttgaacacgggtcctgcgtgaccacaatggccaaagacaagcccaccttggatatcgagctgctcaagaccgaggtcacgaatccggcggtcctgaggaagctctgtattgaggccaaaataagcaacacgaccaccgactcccgctgcccaacgcagggggaggccaccctcgtcgaggaacaagacgccaattttgtatgccggcgcacattcgtggaccgcggctggggcaacgggtgcgggctgttcggaaaggggagcctgatcacatgcgccaagtttaagtgcgtgacaaaactcgagggcaagatcgtccagtacgaaaacctgaagtactccgtgatcgtgactgtccacaccggtgaccagcaccaggttgggaacgagagcactgagcacggcacaaccgcgacgatcacgccccaggcgccctccaccgagatccagctgacggattacggggccctcaccctggattgtagccctcgcaccgggctggacttcaatgagatggtcctcctgaccatgaaggagaagtcctggcttgtgcacaagcagtggttcctcgacctgccgctgccctggacgtccggggcgagcacctcccaggagacctggaatcggcaggacctcttagtgaccttcaagacggctcatgcgaaaaagcaggaggtggtggtgttaggcagccaggagggcgccatgcacaccgccctcacaggggccaccgagatccaaacgtccggcaccaccaccattttcgccgggcacctaaagtgcagactgaaaatggacaaacttacactgaagggcatgagctacgtcatgtgcaccgggagtttcaagctggagaaggaagtggcggagacacaacacggcaccgtcctcgtccagatcaaatacgagggaacggacgctccctgcaagatacctttcagcacccaggacgagaaaggggtcacgcagaatggccggctgatcaccgccaacccgatcgtaacagataaggagaagcccgtgaacatcgaagcagaaccgcccttcggggagtcctacatcgtaattggcgcgggcgagaaagccctgaagttaagctggttcaagaaggggtccagtatcggcaagatgttcgaggccaccgcccgcggcgccaggaggatggcgatcctcggcgacacggcctgggatttcgggtctatcggcggcgtgttcaccagcgtcgggaagctggttcaccagatcttcggcaccgcctacggcgtgctgttctccggcgtcagctggaccatgaagattgggatcggcgtgctactgacctggctcggcttgaactcccgcagcacctcgctgagcatgacgtgcatcgccgttgggctggtgaccctctacctgggcgtgatggtccaggcggacagcggatgcgtcatcaattggaagggccgtgagctgaagtgcgggtccggcatattcgtgaccaacgaggtgcacacctggacggagcagtacaaattccaagcggacagccccaagcgtctctccgccgccatcgggaaggcctgggaggaaggcgtctgcggtatccggagcgccacacggctggagaacatcatgtggaaacaaatctccaacgagctgaatcatatcctcctggagaacgacatgaagttcaccgtggtcgtcggggatgtagcgggcattctggcccaggggaagaagatgatacggccccagcccatggagtacaaatacagctggaaaagttggggcaaggcaaagattatcggggccgacgtgcagaacacaaccttcatcatagacgggcctaacactcctgagtgccccgacgaccagcgcgcgtggaatatctgggaggtcgaagactacggcttcggaatctttaccaccaacatctggctcaagctgagagatagctacacccaggtttgtgatcaccgcctgatgtccgccgccatcaaggacagcaaggccgtgcacgctgatatgggctactggatcgagagtgaaaagaacgagacttggaagctcgcgcgggccagcttcattgaggtcaagacctgcatctggcccaagtcccacaccctatggtcaaacggcgtgctggagtccgagatgataatccccaagatctatgggggccccatatcgcagcacaactatcgcccggggtacttcacacagacggcgggcccctggcacctcgggaaactcgagctggacttcgacctctgtgagggcactaccgtggtggtggacgagcactgcggtaaccgggggccgtccctgcgcactacgacggtgacgggcaagatcatccacgagtggtgttgccgtagctgcaccttgccgcccctacgcttcaaaggagaggacggctgttggtacgggatggaaatccggcccgtcaaggaaaaagaagagaacttagtcaagagcatggtgtccgccggcagcggagaagtagactcgttcagcctgggcctcctgtgcatctccatcatgatcgaggaggtgatgcgcagccggtggtcccgcaaaatgctgatgacgggtaccttagccgtgttcttcctcctgatcatggggcagctcacgtggaatgacttgatccgcctgtgcatcatggtcggtgctaatgccagtgatcgcatgggtatgggcatgacgtacctcgctctaatggccacctttaagatgaggccgatgttcgccgtgggcctcctgttccggcgcctgacctcccgggaagtgctgctgctgaccatcgggctgagcctagtcgcgtccgtggagttgccgaatagccttgaggagctcggagacggcttagccatgggtatcatgatcctgaagttgctgaccgacttccagtcccaccagctttgggccacgcttctgtcactgaccttcatcaagaccacgttttccctccactatgcctggaaaaccatggcgatggtcctcagcatagtgtccctgtttccgctctgcctgagcaccacctcccagaagaccacgtggctacccgtgctgctgggtagccttgggtgcaagccgctaaccatgtttctgatcgcggaaaacaagatctggggccgcaaaagctggccactcaacgagggaattatggcagtgggcatcgtgtcgattctcctgagctccctgctcaagaacgacgtgcctctggctgggcccctgattgctgggggtatgctgatagcgtgctacgtcatctctgggtccagcgccgatctgtcattagagaaggccgcagaggtgagttgggaggaggaggcagagcactccggggcgagccacaacatcctcgtcgaggtccaggacgacgggacaatgaagatcaaggacgaggagcgggatgacaccctgaccatcctgctcaaggctaccctgctcgccgtgtccggcgtgtacccgcttagcatccccgccacactattcgtctggtacttttggcaaaagaaaaagcagcgttccggggttttgtgggacacccccagcccgcccgaggtggagcgggctgtcttagacgacggcatctacagaattatgcaacgaggcctgctggggcgctcccaggtgggcgtgggggtctttcaagagaacgtgttccacaccatgtggcacgtcactcgaggcgcggtcctcatgtaccaggggaagcgcttagagccctcctgggcgtccgtgaagaaagacctgatcagctacggcggagggtggagactgcagggctcctggaacacaggcgaggaggtgcaggttatcgcagtggagcccgggaagaaccccaaaaatgtgcagacagcccccggcaccttcaagacgagcgagggcgaggtcggcgccatcgctctcgactttaagccagggaccagcggctctcccatcgtgaaccgcgagggtaagatcgttggcttgtacggcaacggggtcgtaacaacaagcggcacgtacgtaagtgccatagcccaagcgaaggcgtcccaggagggtcccctgccggaaatcgaagacgaagtatttcgtaagagaaatttaaccattatggatctgcaccccggctccgggaagacccgtcgctacctgcccgctatcgtgcgggaagccatcaagcgcaaactccggaccctgatcttggccccgacgcgcgttgtagccagcgagatggcggaggctctcaagggaatgcctatcagataccagaccactgccgtgaagtccgagcacaccggcaaggagattgtcgacttgatgtgccacgccactttcaccatgcggctgctcagccctgttagggtacccaattacaacatgatcatcatggacgaggcccacttcaccgacccgagttccatcgcagcccggggttacatctccacccgcgtgggaatgggggaagccgctgccatcttcatgacggcgacgccgcccggcagcgccgaagccttcccccagtccaatgccgtcatccaggacgaggaacgtgacatcccggagcggagctggaactccgggtatgagtggatcaccgactttcccggcaagacagtctggttcgtgcccagcattaagagcggcaacgacatcgcaaattgcctgcggaagaacggaaagagagtcatccagctgagccggaagacgttcgacaccgagtaccagaagaccaaaaacaacgattgggattacgtggtgaccaccgacatctccgaaatgggcgccaacttccgggccgaccgggtgatagacccccgccgctgcctcaagccggtgatcctcaaggacggccctgagcgcgtgatcctcgccggccccatgcccgtcaccgtcgcctccgcggcccagaggcgcgggcgcattggccgcaaccacaacaaggagggcgaccagtacatttacatggggcagccgctcaacaacgacgaagatcatgcccactggactgaggccaagatgctgctggacaatattaacacccccgagggcatcatccccgccctgttcgagccggagagggagaagtccgcggccatcgatggagaataccgcctgcgcggcgaggcccggaagacgttcgtagagctgatgcgccgcggggacctcccggtgtggctgtcctacaaggtcgccagcgaggggttccagtattccgaccgcagatggtgcttcgacggcgagaggaacaaccaggtgctggaagagaatatggacgtggagatctggaccaaggagggggagcgtaagaaacttcggccccgttggctggacgcccgcacttacagcgatcccctagcgttgcgggagttcaaagagttcgccgccggccgcaggtccgtgagcggcgacttaatcctggaaatcggcaaactaccccagcacctgacccagcgcgcccagaacgcgctggacaacctcgttatgttgcacaactccgagcagggcgggagggcttaccgccacgccatggaggaactgccggacacgatagagaccctcatgctgctggccctcatcgccgtgctgaccggcggagttaccttattcttcctcagcggccgggggctaggcaagacgtccataggactgctctgcgtcatggcgagctcggtgctgctgtggatggccagcgtggagcctcactggatcgctgccagtatcatcctcgagttcttcttaatggtactgctcatccccgagcccgatcgccagcggaccccgcaagacaatcaactggcatatgtggtgatcggcctgctgttcatgatattaaccgttgcggccaatgaaatgggccttctcgaaacaaccaagaaggacctggggataggccacgtggccgtggagaaccaccaccacgccgctatgctagacgtcgatctccatcccgcgtccgcttggactctctacgccgtggccaccaccattattacccccatgatgcgccatacgatcgagaacaccaccgccaacatatcactgacggcgatcgccaaccaggccgccattctcatggggctggacaagggctggccgatcagtaaaatggacatcggcgtgcccctgctcgcgctgggatgctactcccaagtcaaccccttaactctcaccgctgccgttctcatgttagtcgcccactacgccatcataggccccgggctccaggctaaagccactcgggaagcccaaaagcgaaccgctgccggcattatgaagaacccgacggtggacgggatcgtggcgatcgacctggaccccgtggtgtacgacgccaagttcgagaaacagcttggacagataatgctcctgatcctgtgcacgagccagatccttctgatgcgcaccacctgggctctgtgcgaaagcatcactcttgccgtgggcttccaaactaccctatgggagggaagccccggcaagttctggaacaccactatcgcggtgagcatggcgaatatttttaggggctcctacctggccggcgccggcctcgctttcagcctgatgaagtccctgggtggcgggcgccgcgggaccggggcacaaggcgagacactcggcgaaaagtggaagaggcagctcaaccagctcagcaagtctgaatttaacacttacaagcgtagcggcatcatggaagtcgacaggagcgaagccaaggaaggactcaagcgcggtgagacgaccaaacacgcagtcagccgcggcaccgccaagttgaggtggttcgtggagcgcaacctggtcaagcctgaggggaaggttattgacctcggctgcggcagaggagggtggtcctactactgcgcggggctgaagaaagtaaccgaagtcaaggggtatacaaagggtggcccgggtcacgaggagcccatccccatggcgacttacgggtggaacctggttaagctgcacagcgggaaggacgtattcttcgtacccccggagaaatgcgacaccctcttatgcgacataggcgagtccagccccaaccctaccatcgaggaaggccgaactttgcgagtgctcaaaatggtggagccttggctgcgcgggaaccagttctgcattaagatcctcaacccctacatgccctcggtcgtggagaccctcgaacagatgcaacggaagcacggcggtatgctggtgcgcaacccactgagccggaactccacacacgagatgtattgggtaagctgcgggaccggcaacatcgtgtctgccgtaaacatgacaagccgcatgctcctgaacagattcaccatggcacatcgcaaacccacctacgaacgcgacgtcgacctgggggccggtacccggcacgtcgctgtggagccggaggtagcgaacctcgacattatcggccagcgcatcgagaatattaagcacgagcacaagtccacctggcattacgacgaagacaacccttataagacttgggcttaccacgggagctacgaggtcaagccctcaggctcagccagctccatggtcaacggggtggtgaagttactgacaaagccgtgggacgtcatcccgatggtgacacagatcgccatgaccgacacaacccccttcgggcagcagcgggtgttcaaggagaaggtagacacacgaacccccaaggctaaaagaggcacggcgcagatcatggaggtcacagccaagtggctgtggggcttcttaagccgcaacaagaagccgcggatttgcacacgcgaggagttcactcggaaggtgcggtccaacgccgccataggcgctgtcttcgtggatgagaaccaatggaacagcgctaaggaggccgtggaagacgagcggttttgggacttggtccaccgcgaacgggaattgcacaaacaagggaaatgtgccacgtgcgtgtacaacatgatgggcaagcgggagaagaagctgggggagttcggcaaggccaagggctcccgggcgatatggtatatgtggctgggcgccaggttcctcgagtttgaggccctcgggttcatgaacgaagatcactggtttagccgggaaaattccttgagcggggtggagggcgaggggctgcacaagttaggctacatcctgcgggacatttccaaaatcagcgggggcaatatgtacgctgacgacaccgctggctgggacacgcggataaccgaggacgacctgcaaaatgaggcaaagataacggacatcatggagcccgaacacgcgttgctggccaagtccatcttcaagctcacctaccagaataaggttgtgcgcgtgcagcggcccgccaagaatgggacggtcatggatgttatcagccgccgcgaccagcgtggctccggccaagtggggacctacggccttaatacgtttaccaacatggaagcccagctgatcagacagatggagagcgaggggatcttctcccccagcgagctcgagacgccgaacttagcggaacgagcactggattggctcgagaagcacggcgtcgagcgcctgaaacggatggccatcagcggggacgactgcgtagtgaagccaatcgacgatcgctttgccaccgccctgacggccctgaacgacatgggcaaggtcaggaaggacatcccccagtgggagccctcaaagggctggaacgattggcaacaggtgccgttttgcagccatcacttccaccagctgataatgaaggacggccgcgaaatcgtggttccctgcagaaaccaggacgagctggtggggcgcgcccgggtttcccagggagcaggctggagcctaagagagactgcctgcttaggcaagtcctacgcgcagatgtggcagctgatgtacttccaccggcgcgatctacggctggccgccaacgcaatctgcagcgctggccccgtcgattgggtgccaacctccaggaccacgtggagcatccacgcgcaccaccagtggatgaccaccgaggacatgctgagcgtgtggaacagagtctggatcgaggagaacccgtggatggaggacaaaactcacatcagctcctgggaggacgtgccgtacctgggcaagcgcgaggatcaatggtgcggcagcctgatagggcttaccgctcgggccacctgggcaaccaacatccaggtggctatcaaccaagtccgccgtctcatcgggaacgaaaactacctggactacatgacttccatgaaaagattcaagaacgagagcgaccccgagggtgcgctgtggtaa

SEQ ID NO: 23840 - RNA, 9879 nt, synthetic construct
  misc_feature 1..9879: note = derived and/or modified CDS sequence (opt11) from DENV-1__FJ639694__SS-prME
  source 1..9879: mol_type = other RNA
tcggtgactatgctgctcatgcttatgcccactgccctcgcttttcacttgaccacacgcggcggggagccccacatgatagtgtcgaagcaagagcgcgggaagtccctgctgttcaagacctccgccggggtgaacatgtgcacactcatcgctatggacctgggtgagctttgcgaggacaccatgacatacaagtgcccccgcatcaccgaggccgaaccagacgacgtggattgctggtgcaatgccaccgacacatgggtgacgtatgggacgtgtagccagaccggcgagcaccggcgtgacaagcggtccgtggctctcgcgccccacgtcggcctgggccttgaaacgcgcacagaaacttggatgagctccgagggcgcttggaagcagatccagcgtgtggagacctgggccttgcgccatcctgggttcaccgtgatcgccctcttcctggcgcacgcgatcggcaccagcatcacgcaaaaggggatcatcttcatcttgttaatgcttgtgaccccctccatggctatgcggtgcgtcggcatagggtcgcgcgacttcgtggaggggttgtccggcgccacgtgggtagacgtcgtgttggagcacgggagctgcgtgacgaccatggctaaggacaagcccactctggacatcgagctcctgaagacagaagtgaccaaccccgcgatcctgcggaagctctgcatcgaggcgaagatatccaacacaaccacggacagccgctgccccacgcagggcgaggccaccctggtcgaggagcaggacgcgaactttgtgtgcaggcgcaccttcgtcgaccggggttgggggaatggctgcggtttgtttggcaaggggtccttgatcacgtgcgcgaagttcaagtgcgtgactaagctcgaggggaagatcgtgcagtacgagaacctgaaatactcggtcatcgtgaccgtgcacacgggcgaccagcaccaggtcgggaatgagtccacggagcatggcaccaccgcgaccatcactccccaggcccccaccaccgagattcagctcaccgattatggggccctgactctggactgctctcctcgaactggacttgacttcaatgaaatggtgctgctgacgatgaaggagaagtcgtggctcgtccacaagcagtggttcctggacctgccgttgccatggacgagcggagctagcacatcccaggaaacttggaacaggcaagacctgcttgtcaccttcaagaccgcccacgccaagaagcaagaggtggtcgtgctcggatctcaggagggagcgatgcacaccgccctgacgggggccaccgagatccagacctccggaaccacgaccatctttgctgggcaccttaagtgccgcctcaagatggacaagttgaccttgaagggcatgagctacgtgatgtgtaccgggtccttcaagctcgagaaggaggtagcggagacacagcatggcacagtgctggtgcagataaagtatgagggcaccgatgcgccctgcaaaatcccgttctcaactcaggacgagaagggcgtcacgcagaatggtaggctcattaccgccaacccaatcgttacagataaagagaaacccgtaaacatcgaggccgagccgcctttcggggagtcctacatagtcatcggcgctggcgagaaggccttgaagctaagctggtttaagaaggggtcgagcatcggcaaaatgtttgaggccaccgctcgcggcgcacggcgtatggcgatcctgggggacacggcctgggatttcggttccatcggcggcgtcttcaccagcgtaggaaaacttgtacaccagatcttcggcaccgcttacggggtactcttctccggcgtgagctggaccatgaagatcggtatcggcgtcctgctgacgtggttgggactgaactccagaagcacctcctttagcatgacctgcatcgccgtggggcttgtgacgctctacctgggcgtcatggtgcaggccgactccgggtgcgtgatcaactggaagggccgggagctaaaatgcgggtcaggcattttcgtcacgaatgaggtgcacacctggaccgagcagtacaagttccaggcggatagcccgaagcgccttagcgccgccattggcaaggcttgggaggaaggcgtgtgcggcatccggagcgccacccgcttagagaacattatgtggaagcagatctcaaacgaactaaaccacatcctcctggagaacgacatgaaattcaccgtcgtagtcggagacgtagctgggatcctggcccaggggaagaagatgatccggccccagccgatggaatacaagtatagctggcgctcctggggtaaagccaaaatcatcggagctgatgtgcagaacacgaccttcatcatcgacgggcccaacaccccggagtgtccagacgaccagcgtgcgtggaacatatgggaggtggaggactacggcttcggaatctttaccacgaacatctggctgaaacttcgcgacagctacacccaggtatgcgaccatcggctgatgtccgccgccattaaggactccaaagccgtgcatgccgatatgggctactggatcgagtccgagaagaacgagacctggaagctcgcgcgcgccagcttcatagaggtgaagacatgcatctggccgaagtcccacacgctctggagtaacggcgtcttggagtccgaaatgatcatccccaagatatacggtggcccgataagccagcacaattaccggcccggctatttcacccagactgccggtccctggcacctggggaaacttgagctggacttcgacctctgcgagggtaccactgtggtggtggacgagcactgcggcaatcgggggccaagcctgcggacaaccaccgtaacgggcaagatcatccacgagtggtgctgccgcagctgcactctaccgcccctccggtttcgaggagaggatggctgctggtacgggatggagatccggcccgtgaaggagaaagaggaaaatctggtaaaatcgatggtgagcgccggcagcggcgaggtagactcattcagcttggggctcctatgcatctccatcatgatcgaggaggtcatgaggagccggtggtctcgcaagatgctgatgaccggcaccctcgccgtgttcctcctattaatcatggggcagctgacgtggaacgacctgatccgcttatgtatcatggtgggagcgaacgcgagcgaccggatgggcatgggcaccacctacctggcgttgatggccaccttcaagatgcgcccgatgttcgccgtcggccttctgttccggcgcctgacgtccagggaggttctcctcctgaccataggcttgagcttggtggcgagtgtcgagctgccaaacagcctcgaggagctaggtgacgggctggccatgggcattatgatcctaaaactgttaaccgacttccagtctcaccagttatgggccacgctgctgagcctcacgtttattaagacaaccttctccttacactatgcctggaagaccatggcgatggtgctgagcatagtctccttatttcccctgtgtctgagtacgacatcccaaaagacgacctggctccctgtacttctgggatctctcgggtgcaagccgctgacgatgttcttaatcgccgagaataagatctgggggcgccgctcctggcccctgaacgaggggatcatggccgtcggcattgtctcgatactgctgtcatccttactgaaaaacgacgtgccattggccgggccgctgatcgccggcgggatgctgatcgcgtgctacgtgatcagcgggtccagcgctgacctgtcccttgaaaaggctgccgaggtcagctgggaggaggaagccgagcacagtggcgcgagtcacaatattctcgtggaagtgcaggatgacgggaccatgaaaattaaggatgaggagcgtgacgacacactaactattctcctgaaggccaccctgctcgcggtatccggcgtgtaccccctgtctatccccgccacgctgttcgtgtggtacttctggcagaagaagaagcagcggagcggtgtcctctgggacaccccttctccgcccgaggtggagcgcgccgtactggacgatggcatctaccgaatcatgcaacgcggcctgcttgggcggtcccaggtcggagtgggagtgttccaggagaacgtctttcacaccatgtggcacgtgacccgaggagccgtgctcatgtaccaggggaagcggttggagccaagctgggcctctgttaagaaggaccttatcagctacggtgggggctggcgcctccaaggctcctggaacacgggggaggaggtgcaggtaatcgccgtcgagcccggcaagaatcctaagaacgtgcagacggccccagggaccttcaagaccccagagggcgaggtgggcgctattgcgctcgacttcaagccagggacgagcggctcccccatcgtcaaccgggagggcaaaattgtcggcttatacggcaacggtgtggtcaccactagcggtacatacgtaagcgccattgcccaggccaaggcgtcccaggaggggccactccccgagatagaggacgaggttttccgcaaacggaaccttacgatcatggacctgcatccgggcagcggcaagacccgccggtacctgccggccatcgtccgcgaagccataaaacgcaagctgcggaccctgattctcgctcccacccgcgtggtggcctccgaaatggcggaagcccttaagggcatgcctattcggtaccagacaacagctgttaagagcgagcacaccggcaaggagatcgtggatctaatgtgtcacgccacattcaccatgagactcctgtcccccgtgcgggtgccaaactataacatgataatcatggacgaggcccacttcaccgaccctagctcgatagcggccagaggatacatcagcacccgggttggtatgggggaggccgccgctatcttcatgacagcgacgccaccaggctcagtggaggccttcccgcagagcaacgccgtaatccaagacgaggagagagacatcccggaacgatcctggaactcaggctacgagtggattaccgactttcccggcaagacagtgtggttcgtgccctccatcaaatcgggcaacgatatcgctaactgcctgcgtaagaacgggaagcgggtgatccagctctcccgaaagacatttgacacagagtaccagaaaacaaagaacaacgactgggactacgtagtgaccaccgacatctccgagatgggggcgaacttccgagcggaccgcgtcatcgacccccggcgctgcctgaagcccgtgatactgaaggacgggccggagagagtaatcctcgccggtccgatgccggtcacggtcgcttcagcggcacagagacggggccgaatcggccgcaaccacaacaaggagggagaccagtatatctacatgggccagcccctgaacaacgacgaggatcatgcccactggaccgaggccaaaatgctgcttgacaacatcaacacccctgaaggaataatccccgctcttttcgaaccggagcgggagaagtccgccgcgatcgacggggagtaccgcctgcggggcgaggcccgcaagaccttcgtcgaacttatgagacgcggtgatctgcccgtttggctgtcctataaggtggccagcgagggcttccagtactctgatagaaggtggtgcttcgacggggagcggaacaaccaggtcctcgaggaaaacatggacgtggagatctggacgaaagagggggagcgaaagaaactgagaccccgctggctagacgcccggacgtactccgaccctttagccctgcgcgagtttaaagaatttgcagccggccggcggtctgtcagcggcgacctgatcctcgagatagggaaacttccgcagcatctgacccaacgggcccaaaatgccttagacaacctagtcatgctgcacaacagcgagcaaggcgggcgcgcgtaccggcacgccatggaggagcttccagacacgatagaaactttgatgctgctcgccctcatcgctgtgctaaccggcggtgtgaccttattcttcttaagtggccgaggcctgggaaaaaccagcatcggcttgctgtgcgtcatggccagtagcgtgcttctctggatggcgtcggtcgagcctcactggatcgcggctagcattatcctagagttcttcttgatggtccttctgatccccgagccggaccgacagaggacaccacaggacaaccagctagcctacgtagtcatcgggctcctgttcatgatcctgacggtagccgcgaacgagatgggactactagagaccacgaagaaggatttggggatcgggcacgtggctgtggggaatcaccaccacgccgccatgttggacgtcgacctccaccccgcttccgcgtggaccctatacgctgtggcaacgaccatcataaccccaatgatgagacacaccatcgagaacacaaccgccaacatctccttaaccgccattgccaaccaggccgccatcctgatggggctggacaagggctggcccatatcaaagatggacatcggtgtgcccctcctggccttgggctgctatagccaggtcaaccctcttacgctgacggcggccgtgctgatgcttgtggcccactacgctatcatcggcccgggactgcaggccaaggcgaccagggaggcacagaagaggaccgccgcggggatcatgaagaatcccactgtcgatggcatcgtggcaatcgatttagaccccgtggtgtatgacgcgaagtttgaaaagcagttagggcaaataatgctgcttatcctatgtacctcccagatccttctgatgcggactacgtgggccctctgcgagagcataaccctggccacggggcccctgacaaccctctgggagggctccccggggaagttctggaataccacaatcgccgtgagcatggccaacatcttccgaggatcgtacctggcgggtgccgggttggccttctccctaatgaagtccctaggaggagggaggcgcggcaccggcgcccagggcgagactctgggggagaagtggaaacggcagctgaaccaactgtccaagagcgagtttaacacctacaagcgctccggcatcatggaggtagaccgcagcgaggcgaaggaagggctgaagcgcggtgagatcacaaagcacgccgtatcccgggggaccgccaagctccgatggtttgtggagagaaacctggtgaaaccggaaggaaaggtcatcgacctgggatgtggacgaggagggtggagctactactgtgccggcctgaagaaagttaccgaggtgaagggttacaccaagggcgggcccggtcacgaggaaccaatccctatggcaacctacggatggaacctcgtgaagctccactcaggaaaggacgtgttctttgtcccgcccgagaagtgcgacaccttgctttgtgacattggagagagctcccctaacccgacaatcgaggaaggccggacgctccgcgtcctgaaaatggtagagccctggctcagaggcaaccagttctgcatcaaaattctgaatccatatatgccgtctgtggtcgagactctggaacagatgcaacgcaagcacggcgggatgctcgttcggaacccgctgtcccgcaatagtactcacgagatgtactgggtttcctgcggcactggtaatatcgtttcggcggtcaacatgacttccaggatgctgctgaaccgattcacgatggcccaccgcaagcccacgtacgagcgggacgtggacctgggcgccggcacccgccatgtcgcggtggagcccgaggtggctaacctggacatcatcgggcagcggatagagaacatcaagcatgagcacaagtcaacgtggcactatgacgaggacaatccctacaagacctgggcctaccacgggtcgtacgaggtcaaaccgagcgggagtgcctcgtcaatggtaaatggcgtagtgaagctcctgactaagccttgggacgtgatcccgatggtaacccagatcgccatgaccgataccacccccttcgggcagcaacgcgtgttcaaggaaaaagtggacactcggactcctaaagccaaacgcggcaccgcccagatcatggaggtgacggcgaagtggctgtggggcttcttgtcccggaacaagaagccccgcatctgcaccagagaagaatttacccgcaaggtgaggagcaacgccgccatcggcgccgtgttcgtcgacgagaaccagtggaactccgccaaggaggccgtcgaggacgaacgcttctgggacctggtgcacagagagcgcgagctgcacaaacagggcaaatgcgcaacatgcgtctacaacatgatggggaagcgggagaagaagctcggcgagttcggcaaggccaagggaagccgcgcgatttggtatatgtggttgggcgcgagattcctggagttcgaggccctcgggtttatgaacgaagatcattggttcagcagagagaacagtctgtcgggggtggagggcgagggcctgcacaagctcggctacatcttaagagatataagcaagattcccggcggcaatatgtatgccgacgatactgccgggtgggacaccaggatcacagaggacgacctgcagaacgaggcccgcatcaccgatataatggagccggagcacgcgctcctggccaagtccatcttcaagctgacataccagaacaaggtggtgcgggtgcagcggcccgctaagaatggcaccgtcatggacgtaatcagccggagggaccagcgcgggtcaggccaggtaggcacctacgggctcaacaccttcacgaatatggaggcccagttgattcgccagatggaaagcgagggcatcttcagccccagcgaactggagacgcccaaccttgcggagagggtgctggattggctggagaaatacggagtggagcgactcaagcggatggcgatcagcggtgacgattgcgtggtgaagccgatcgatgaccgcttcgctacggcgctgacagccctgaacgacatggggaaggttcggaaggatatcccgcagtgggagccaagcaagggctggaacgactggcagcaggtcccattctgcagtcatcacttccatcagctcattatgaaggacggacgcgagatcgtagtcccctgccggaaccaagacgagttagttggccgcgcccgggtgtctcagggcgcgggttggtcacttcgggagactgcctgtcttgggaagtcctacgcccagatgtggcaactaatgtacttccatcgacgcgacctgcggctcgccgcgaacgccatctgcagcgccgtccccgttgattggatccccacctcccgcaccacctggtcaatacacgcccatcaccaatggatgacgacagaggacatgctgtccgtgtggaacagagtgtggatcgaggagaacccatggatggaagacaagacccacatctcgaactggggcgatgtgccgtaccttggcaaacgggaagaccagtggtgcggctcactcatcgggttgaccgcacgcgctacgtgggccaccaacatccaggttgccatcaatcaagtacggcgcctgatcgggaacgagaactacctcgactatatgacatcaatgaagcgtttcaagaacgaatccgatcccgaaggggcgctgtggtga

SEQ ID NO: 23841 - RNA, 9879 nt, synthetic construct
  misc_feature 1..9879: note = derived and/or modified CDS sequence (opt11) from DENV-1__FJ639695__SS-prME
  source 1..9879: mol_type = other RNA
agcgtaacgatgctgctgatgcttatgccgaccgcacttgcattccacctgaccacacgcggaggagaaccgcacatgatagtctctaaacaagaacgcggcaagtccttactatttaaaacgtcggcaggcgtaaacatgtgtaccctcatagcaatggacctcggagaactttgcgaagacactatgacttataagtgcccgcgaataaccgaagcagaacccgacgacgtagactgttggtgtaacgctaccgacacctgggtgacatacgggacctgtagccagaccggcgaacatcgtcgggacaaaaggagcgtagcactagctccgcacgtcggactcggactagaaacacgaacagaaacgtggatgagctcagaaggggcatggaaacaaatacagcgcgtcgaaacctgggcactgcgtcacccgggattcaccgttatagccctttttctggcacacgctataggaacctcaatcacgcaaaagggtataatattcatattactcatgcttgtcactccctctatggctatgcggtgtgtaggcatcggaagtagagacttcgtcgaggggctttccggggcgacgtgggtagatgtagtcctggagcacggctcttgcgtcacgacgatggctaaggacaagccaaccttggatatcgagctattgaagaccgaggtaacaaaccccgcaatattaagaaaactatgcattgaggcgaaaatatctaatacaacaacagacagtcggtgcccgacccaaggagaggcaacgctagtggaggaacaggacgcgaacttcgtctgccgtcgcacattcgtcgaccgcgggtggggaaacgggtgcggactcttcgggaaaggatcactaatgacatgcgcaaaattcaaatgcgtaactaagctcgaaggaaagatcgtccagtacgagaacctaaaatacagcgtaatcgtcaccgtacacaccggtgaccaacaccaggtgggcaacgaaagtacggaacacgggacgacagcgacaatcaccccacaggcacccacaacagaaatacaactaacggactatggcgccttaacactcgattgcagcccgcgaaccggcctagacttcaacgaaatggtcctattgacaatgaaggagaaatcatggctagtccacaaacagtggttcctcgaccttcccctaccatggacctccggggcgagtaccagccaggagacgtggaaccgtcaggacctactcgtgactttcaagacggcacacgcgaagaaacaggaagtggtagtactgggctctcaggaaggggcaatgcacacggcgctcaccggcgcaacggagatccaaactagcggtacaacaaccatttttgcgggccacctcaaatgcaggttaaaaatggataaactcacactgaagggaatgtcgtacgtcatgtgcacaggctccttcaaactcgagaaagaggtggccgagactcagcatgggaccgtccttgtacaaataaagtatgaggggacggacgcaccctgcaagatacccttctccacgcaagatgaaaagggggttacacagaacggacggctaatcacagcaaatccgatagtcaccgacaaggagaaaccggtgaacatagaagcggaacctcctttcggagaaagctacatagtgatcggagcaggggaaaaagcactgaaattgagctggttcaagaaggggagctccatcgggaagatgttcgaggcaaccgcgagaggcgcgcgtagaatggcgatactaggggacacggcctgggactttggctccataggtggggtcttcacatcagtaggtaaactggtacaccagatttttggcacagcttacggagtactattctcaggcgtctcctggaccatgaaaatcggccttggggtgcttcttacatggctcggattaaactcccggagcaccagtctatcaatgacctgcatagccgtgggactggtcacgttatatctcggcgtcatggtgcaagcagacagcggttgcgtgatcaactggaaaggcagggaacttaagtgcggatcgggcatattcgtaacaaacgaggttcacacttggacagaacaatacaagttccaagcagacagcccaaagcggctctcagccgcgatcgggaaggcctgggaagaaggcgtctgtggaatacgctctgccacgaggctggaaaatattatgtggaaacaaataagcaatgaactcaaccacatcctcctcgagaacgatatgaaattcacggtcgtggtcggagacgtagccggtatactcgcccagggaaagaagatgattcggccacaacccatggagtataaatactcctggaaatcgtggggaaaggcaaaaataatcggcgcagacgtccaaaatacaacgttcatcatcgacggaccgaacacacccgaatgcccggacgaccagagagcatggaacatatgggaggtggaagactatggttttggaatattcaccacaaatatttggcttaagttacgcgacagctacacccaagtatgcgaccaccgactcatgagcgcagccatcaaagactctaaggccgtccatgcagatatgggctactggatagagagcgagaagaacgaaacatggaaactcgcccgagccagcttcatagaagtgaaaacttgcatatggcccaaatcccatacactgtggagcaacggcgtacttgaatcagaaatgattatccctaaaatctacggagggccgatctcccaacacaactaccgtcccggctacttcacacagacggcagggccctggcatctagggaaattggaactagacttcgacttatgcgaaggcacgactgtagtggtagatgagcactgtggcaacagagggccgtccctgagaacgacgactgtaactggaaaaattatacatgaatggtgctgccggtcctgcacactaccgcccctgaggtttagaggggaagacggctgctggtacggaatggaaatccggccggtgaaggaaaaagaagaaaacttagtcaagtctatggtgtcagcgggctccggcgaagtcgactctttcagcctggggttgctctgcatcagcatcatgatcgaagaagtaatgaggagccgatggtcacgcaaaatgttaatgaccgggacactggcagtattcctgctcctcattatgggccaactgacttggaatgaccttatacgcctttgcatcatggtaggcgccaacgctagcgaccgcatgggaatggggacgacataccttgccctaatggctacctttaaaatgagacccatgttcgcagtcggcctactcttccggagactcacatccagggaggtacttctactgaccatcggcctttcacttgtagccagcgtagaactacccaacagtctcgaagaactgggagatggcttggccatgggaattatgatcttgaaactactgaccgatttccagtcccatcaactatgggcaacattactctccctaacgttcatcaagaccactttctccttacactatgcctggaagaccatggcgatggtgctcagcatcgtgtcattatttcccctatgtctcagcacgacctcccagaagaccacatggttaccagttctactgggatccctcgggtgcaagccactgacgatgtttctgatagctgagaataaaatatggggccgccgaagctggcccctcaatgaaggaataatggcagtagggatcgtctctatacttctttcaagcctcttgaaaaacgatgtgcccctagccggcccgctaatagccggaggaatgttaatcgcctgctatgtaataagcggctcatcagcagacctttcactcgagaaagcggcagaggtctcatgggaagaagaagccgaacacagcggcgcgtcacataacatcctagtcgaagtacaagacgacggaacaatgaaaattaaggacgaggagagagacgatacgctaactatcctactaaaagccacattgctagcggtaagcggagtgtatccattgtcaatccccgctactctgtttgtatggtacttctggcaaaagaagaaacaacggagcggtgtgctctgggatactccgagtcccccggaagtcgagagagccgtattagacgacggaatctatcggatcatgcagagggggttattgggacgaagccaggtgggcgtcggcgtcttccaggagaacgtctttcacaccatgtggcacgtgaccagaggggccgtgctaatgtaccaaggaaagcgactagaaccatcgtgggcaagcgtaaagaaagatctcatatcctacggaggcggatggaggctccaaggatcatggaatacaggggaggaagtccaggtaatagccgtagaaccaggcaaaaaccccaaaaacgtccagacagctcccggcactttcaaaacacctgaaggggaagtgggggcaatagcgctggacttcaagcccggaacatccggaagtccaatcgtcaaccgagaaggaaaaattgtcggtctttacgggaacggggtagtaacaacgtcgggcacttacgtaagcgcaattgcacaagcaaaagcaagccaagaaggacccctccccgaaatcgaagacgaagtttttcggaagagaaaccttacaatcatggacctccacccaggcagcggtaagacgagaaggtacctaccagcaatcgtgagggaggccatcaaaagaaaattacgcacgctaatactagcgcccacccgagtcgtggccagcgaaatggcagaggccctaaagggaatgccaatccggtaccagaccacagcggtgaaaagcgaacacacaggcaaagaaattgtggacctgatgtgccacgccacctttacaatgagactgctaagcccggttagggtcccaaactataatatgatcataatggatgaggcccacttcaccgacccaagctcaatcgcagcacgaggctacatctcaacgcgcgtcggaatgggagaagcggcggccatcttcatgacagctacaccacccggtagtgtcgaggcttttccacaatcaaacgccgtcatacaggacgaggaaagagacatcccggagcgatcctggaatagtggctacgagtggataacggatttccccgggaagacggtatggtttgtcccctcaatcaaaagcggcaatgacatcgctaactgtctacgcaaaaatgggaaaagagtaatccaattgagcaggaagaccttcgataccgaatatcagaaaaccaagaacaacgactgggactacgtagtcaccaccgacattagcgagatgggagccaatttcagagcagatagagtgatcgacccacgtagatgcttgaagccagtcatactcaaagacggtccggaacgcgtcatactagccgggcctatgccagtcacagtcgccagcgcggcacagcggaggggccgaataggccggagtcataataaagaaggggaccaatatatctacatggggcagcccctcaataatgacgaggatcacgcccactggaccgaggccaagatgctgctcgacaacatcaatacccccgaaggcataatcccggccctattcgaaccggagagagagaaaagcgccgccatcgacggggaatatcgtctacgaggagaagcgcgaaaaacgttcgtggaattgatgcgccgcggagacctaccagtatggctatcgtacaaggtggcatcagagggattccaatactcggaccgcagatggtgctttgacggcgagcgaaacaaccaagtgctagaagagaacatggacgtggaaatatggacgaaagagggtgaacgcaagaaactacggccccgatggttggatgcccggacctactccgatccactcgccctgagggagtttaaagagttcgccgccggacgaagaagtgtctcgggggacctaatcctcgaaataggaaaactgcctcagcacctaacccaacgggctcagaatgcattggacaacttagtaatgctccataatagcgagcagggcgggcgggcataccggcacgcaatggaggaactaccagacacaatcgaaacccttatgctactagccctcatcgcggtgctcacagggggcgtcacactcttctttctgagtgggaggggcctgggaaaaaccagtatcgggctcctatgcgtcatggccagcagtgtactactttggatggccagcgtcgaaccacactggatcgccgcatcgatcatcctagagttctttctaatggtcctactgataccagagccagacagacaacgaactccgcaagacaaccaactcgcctacgtagtgataggactactattcatgatcttaactgtagcagccaacgagatgggccttctcgaaactactaagaaagatctcgggataggtcacgtagcggttggcaatcatcaccacgcagctatgctcgatgtcgacttacacccggcgagcgcctggacactctacgctgtcgcgactacaatcatcacacccatgatgagacacacgatcgagaatactaccgcaaacatcagtctaacagccatcgcaaaccaggcggccatcctaatgggacttgacaaggggtggccgatatccaagatggatatcggcgtgccccttctggcacttgggtgctatagccaggttaacccgctcacattgacagcagctgtgctcatgctggttgcccattacgcaataattggtccgggacttcaagcaaaggcaacgcgcgaggcacagaaacgaacagcagccggaataatgaaaaacccgaccgtggacggcatcgtcgcaatagacctggatcccgtagtttacgacgccaagttcgagaaacagctaggccaaattatgctgctaatactatgcaccagtcagattctcctaatgagaaccacatgggcactatgtgaaagcatcacgcttgcgaccggcccactcacgactctgtgggagggttcgcctggcaaattttggaacaccaccatcgcagtctccatggccaacattttccgaggatcgtacctggcaggcgccggactagccttctccctaatgaagagtctcggtggcggaaggagaggaacgggcgcccagggcgagacgcttggcgaaaagtggaaacggcaactaaaccaattatcaaaaagcgagttcaatacgtacaagcggtcagggatcatggaagttgatcgctcggaagcgaaagaggggctcaagcgcggggaaacaacaaaacacgccgtatcccgaggtacggccaagttacgctggttcgtggagagaaatctggtaaaaccagaaggcaaggtaatcgatctcggctgcggcagaggcgggtggtcatactactgcgccggactgaagaaagtgacggaagtgaaaggatatacaaaaggcggccccggccatgaagaacccattcctatggcaacgtatggttggaacctagtaaaactacactcaggcaaagacgtattctttataccgccagaaaaatgcgacacgttactctgcgacataggagaatcatcccctaaccccaccatagaggaaggaagaacactccgggtactcaagatggtcgagccgtggctgcgtgggaaccaattctgcataaagatccttaatccatatatgccatctgttgtggaaacgttagaacaaatgcaacgcaaacacgggggaatgcttgtcagaaacccgctaagtcgcaactcaacgcatgaaatgtattgggtaagctgcggcaccggaaacatagtcagtgcagttaacatgacgagcaggatgctgctcaatagatttacgatggctcaccgaaaaccaacctacgagcgcgacgtagacctcggtgccgggaccagacacgtcgccgtcgagccggaagtagcgaacctagacatcataggtcaaagaattgaaaacataaaacatgagcataaaagcacgtggcactacgacgaagacaacccgtacaagacctgggcctaccacggctcgtacgaagtaaagccaagcggcagtgcatcctcaatggtgaacggcgtggtaaagctactcacaaagccatgggatgtcattccgatggtcacacagattgcgatgacggacactacgcccttcgggcaacagagagtctttaaagaaaaagtggacacacgtacgccgaaagcaaagcgtgggacagcgcaaataatggaagtcacagctaagtggctatggggatttttgtcgagaaacaaaaagccccgtatatgtacaagggaggagttcacgcgaaaagtccggagcaacgccgcaataggggcagtcttcgtcgacgaaaaccagtggaacagcgcgaaggaggcggtcgaagatgaaagattctgggacctagtacacagggaaagagaactgcacaaacaaggaaagtgtgccacctgtgtatacaatatgatgggaaaaagagagaaaaagctaggagagtttggtaaagcaaaaggaagccgggctatatggtacatgtggctgggcgcgaggttcctcgagttcgaagccttaggttttatgaacgaagaccactggttctctcgcgagaatagcctgtcgggggtagaaggcgagggcctccacaagttagggtacatcctgagggatatatccaaaataccaggaggcaatatgtatgccgacgacacagccggatgggatacacgtataaccgaagatgatttgcaaaacgaagcacgaatcactgacataatggagccggagcacgcgctgttagccaagtcaatatttaagttgacgtaccagaacaaagtcgttcgcgtacaaaggccagcgaagaatgggaccgtaatggatgtcataagtcgacgagaccaacgcgggtcgggccaggtaggtacttacggactaaacacattcacaaacatggaggcacaactcatccgacagatggaatccgaagggatcttttcaccctctgaactcgaaacgccgaacctagcggagagagtgctagtatggttggaaaagtacggagtggaaagactaaagcgcatggccataagtggagacgactgcgtagtgaaacccatcgacgaccgcttcgcaacggccctcacagcattaaatgacatgggcaaagtacgcaaagacattccacagtgggagcctagcaagggatggaacgactggcagcaagtacctttctgcagtcaccacttccaccagctcatcatgaaagacggacgcgagatagtggtaccttgtcgcaaccaagacgagctagtaggcagggcacgagtcagccagggcgccgggtggtctcttagggaaaccgcatgcctaggtaaaagctacgcacagatgtggcagctcatgtactttcatcgtagggacttacgattagcagcaaacgcaatctgcagcgcggtgcccgttgattggataccaaccagcagaactacatggagcatacacgctcatcaccaatggatgacaaccgaagacatgctttcagtctggaaccgcgtctggatagaggaaaacccctggatggaggataaaacccacatctcaagctggggtgatgtcccctatctgggtaaaagggaagaccaatggtgtggctcacttatcggactaacggcacgcgctacgtgggcaacaaatattcaggtagctataaaccaggtacgacggcttattgggaacgagaactatctagactacatgacctccatgaaaaggttcaagaacgagtcggacccagagggggccttatggtga

SEQ ID NO: 23842 - RNA, 9879 nt, synthetic construct
  misc_feature 1..9879: note = derived and/or modified CDS sequence (opt11) from DENV-1__FJ639696__SS-prME
  source 1..9879: mol_type = other RNA
agcgtgaccatgttactcatgctgatgcccaccgccctcgccttccacctcaccacccggggaggtgagccccatatgatcgttagcaagcaagagcggggcaagtctctgcttttcaagaccagcgcaggggtgaacatgtgcactctcatcgccatggacctgggggagttctgcgaggataccatgacctacaaatgcccacgtatcagcgaggcggagcccgacgacgtggactgctggtgcaacgccacagacacctgggtgacctacggtacatgctcacagaccggtgagcaccggcgcgataaacggagcgtcgccctggcccctcacgtgggcctcgggctggagacccggacggagacatggatgtccagcgaaggcgcttggaagcagatccagcgggtagagacctgggcccttcgccaccccgggttcaccgtgatcgccctcttcttagcgcacgccatcggcacgtctatcactcagaaggggataatcttcatactgctcatgctggtgacgcccagcatggccatgcggtgcgtaggcatcggctcccgtgacttcgttgaggggctgagcggcgccacctgggttgacgttgtgctagagcacgggtcctgcgtgactaccatggccaaggacaagcccaccctggacatcgagttactcaaaactgaggtcacgaaccccgcggtgctgcgcaaactgtgcatcgaggccaagatcagcaacactaccaccgactctcgctgcccgacacagggcgaggccaccctcgtggaggagcaggacgcaaacttcgtctgccggcgcaccttcgtggatcgggggtgggggaacggctgcgggctgtttggcaaggggtcactgataacttgcgcgaaatttaagtgcgtgacgaagttagagggaaagatcgtccagtacgaaaacctgaagtactccgtgatagtgaccgtccacaccggcgaccaacaccaggtggggaacgagagcacagagcatggaacgaccgcgaccatcaccccccaggccccatccaccgagattcagctgacggactacggggccttgacactggattgcagccccaggactggcttagacttcaacgagatggtattgttgacaatgaaggagaagtcctggttggttcacaagcagtggttcctcgacctgccgctgccctggacgtccggggccagcacttcacaggagacgtggaaccggcaggacctgctggtgaccttcaaaacggcccatgccaagaagcaggaggtcgtggtgctgggcagccaggaaggcgccatgcacaccgcactcaccggagcaaccgaaattcagacatcaggcaccaccacgatcttcgccgggcacctgaagtgccgcctgaagatggacaaactcacgctgaaaggcatgagctacgtcatgtgcaccgggtcttttaagctggagaaggaggtggccgagacccagcacggcaccgtgctcgttcagatcaagtatgagggaacagacgcgccctgcaagatccccttcagcacccaagacgaaaagggcgtgacgcagaacgggaggctgatcaccgcgaacccaatcgtaacggacaaggagaaacccgtaaacatcgaggccgagccgcccttcggggagtcatacatagtaatcggcgcgggcgagaaggccctgaaactgagctggttcaagaagggttccagcatcggtaagatgttcgaggccaccgcccgcggggcccgtcgaatggcgatactcggcgacacggcttgggacttcgggtccatcggaggcgtgttcactagcgtcgggaaactggtgcaccagatcttcggcacggcctacggggtgttgttctccggcgtcagctggaccatgaagatcgggattggcgtgctcctcacctggttaggtctcaactcccgctcgacctccttgagcatgacgtgcatagccgtgggtctggtcaccctctatctgggcgtgatggtccaggccgacagtgggtgcgtcataaactggaagggccgggagctgaaatgcgggtcgggcatcttcgtgaccaacgaggtgcacacctggacggagcagtacaagttccaggcggatagcccgaagcgcctatccgccgccataggcaaggcctgggaggagggggtctgcggcatccgctcagcgactcgcctggagaacattatgtggaagcaaatatccaacgagctgaaccacatcctcctggaaaacgacatgaagttcaccgttgtggtcggagacgtggctgggatcttagcacaagggaagaagatgatccggccccagcccatggagtacaaatacagctggaagtcctggggcaaggccaagatcatcggcgccgacgtacagaacactaccttcatcatagacgggccgaacacgccggagtgtcccgacgaccagagagcgtggaacatctgggaggtcgaggactacggcttcgggatcttcaccactaacatttggcttaagctgcgggacagctatacccaagtctgtgaccaccgcttaatgtccgccgccatcaaggacagcaaggccgtgcacgctgacatggggtactggatcgagagtgaaaagaacgagacgtggaagctcgcacgggctagcttcatcgaggtcaagacatgcatctggcccaaatcccacaccctttggtctaacggcgtgctggagagcgagatgataattcccaagatttacgggggcccgatcagccagcacaactatcgccccgggtactttacccagacggccggaccctggcatctcgggaagctggagctggacttcgacctctgcgagggcaccaccgtggtcgtggacgagcactgcggcaaccggggtccgtccttacgcaccacgacagtaaccggcaagatcatccacgagtggtgttgccggagctgcaccctaccgcccctgcgcttcaaaggtgaggacgggtgctggtacgggatggagatccggcccgtcaaggagaaagaggagaacctggttaagagcatggtatccgccggcagcggcgaggtcgattccttcagcctggggctcctgtgcatctccatcatgatcgaggaggtcatgagaagccggtggtcccgcaagatgctgatgacgggtaccctcgccgtgtttttcctgttgatcatgggacagctcacctggaatgacctgatacgtctttgcatcatggtcggcgcaaatgcctccgatcgcatggggatgggcatgacctatctagcgctgatggcgacgttcaaaatgcgtccaatgttcgccgtgggtctcctgttccgtcgcttaacctcccgggaagtactgctgctgaccatcggtctgagcctggtcgcgtccgttgagttacccaatagcctggaggagctcggcgatgggctggccatgggcataatgatcttaaagttgcttactgacttccagtcccaccaattgtgggccacgctcctgagcctgaccttcatcaagacgaccttctccctccactacgcctggaagacgatggcgatggtgctgtcaatcgtgtccctgttcccactctgtctgagcaccacctcccagaagaccacatggctgcccgtgcttttaggcagcctggggtgtaagccgctcaccatgttcttaatcgccgagaacaagatctggggtcgcaagagctggccccttaacgagggtatcatggctgtcgggatcgtgtcgatcctcctgtctagtctgcttaagaatgatgtgccgctggccgggcccctgatcgcgggcggcatgctcatcgcatgctacgtcatcagcgggtccagcgccgacttgtctctggaaaaggccgccgaagtgagctgggaagaggaggctgagcactctggcgcgagccacaacatcctcgtcgaagtccaggacgacgggaccatgaagatcaaggacgaggagcgggacgacaccctgacgatcctgctcaaggctaccctgctggccgtgtccggtgtgtacccgctcagcattcccgccaccttattcgtctggtatttctggcagaagaaaaaacagcgctccggggtgctgtgggacaccccgtcgccgcccgaagtggagcgggccgttctcgacgatggcatctaccgcatcatgcagcggggactattagggagatcccaggtgggcgtgggtgtcttccaggagaacgtgttccacaccatgtggcacgtgacacggggcgcggtcctgatgtaccaggggaagcgcctagagccaagctgggcttccgtgaagaaggacctgatcagctatgggggcgggtggcgactacagggctcctggaacaccggggaggaggttcaagtcatcgcagtggagcccggcaagaaccccaagaacgtccagaccgcccctgggacgtttaagacgagcgagggcgaagttggcgccatcgcgcttgacttcaaacccgggaccagcggctcccccatcgtgaaccgcgaggggaaaatcgtgggcctttacggcaacggtgtagtgactaccagcgggacgtacgtgagcgccatcgcgcaggccaaagcgtcgcaagaggggccactgccggagatcgaggacgaggtcttccggaagcgcaacctcaccattatggacctgcaccccggctccgggaagacccggagatacctgccggccatcgtgcgggaggccatcaagcgcaagctccggaccctgatactggccccgacgcgcgtagttgccagcgagatggcggaggccctcaagggcatgcccatcaggtatcagaccaccgccgtgaagtccgaacacaccggcaaggagattgtggacctgatgtgccacgccacgttcaccatgcggctgctaagccccgtccgcgtgcccaactacaacatgataatcatggacgaggctcacttcaccgatccgtctagcatcgctgcccgggggtacatttccactcgcgtgggaatgggagaggccgcagccatctttatgacggcgacgccgcctggcagcgtagaggccttcccccagtccaatgcagtgattcaggacgaggagcgtgacatccctgagcgctcttggaactccgggtatgagtggatcaccgacttccccggcaagaccgtatggttcgtcccaagcatcaaatccggcaacgacatcgccaactgcttacggaagaacgggaaacgcgtgatacagctgtcccggaagactttcgacaccgagtaccagaagaccaagaacaacgactgggactacgtggtcacgacggacatcagcgaaatgggcgcgaacttcagagccgacagggtgattgacccccgccggtgcctcaagccggtgatcctgaaggacggtccagaacgggtcatcctggccggccccatgcccgtgaccgtcgccagcgccgcgcagcggcgcgggcggatcggcaggaaccacaacaaggagggcgaccagtatatctacatgggccagccactcaacaacgacgaggaccacgcccactggaccgaggccaagatgctgctggacaacatcaacacccccgagggcattattcccgccctcttcgagcccgagcgggagaagtccgccgcgatcgacggtgagtaccgcctgcgcggcgaggcccgtaagacgtttgtggagctgatgcggcgcggggacctccccgtgtggctgtcttacaaggtggcctcggagggcttccaatacagcgaccgccggtggtgcttcgacggggagcgcaacaatcaggtgttagaggagaacatggacgtggagatctggactaaagagggggaacggaagaaactccgcccccggtggctggacgcccgcacctacagcgaccctttagccctccgggaattcaaagagttcgcggccggccgacggtccgtcagcggggacctgatcctggagatcggcaagctgccccaacacctgacgcagcgtgcccagaacgccctcgacaacctcgtgatgctgcacaactccgagcaaggtggccgggcgtatcgccacgccatggaggagctgccagacacgattgagaccctcatgctgctggccctcatagcggtcctgaccggcggggtcaccctgttctttctcagcggccgggggctgggcaagacatcaataggactgctctgtgtgatggccagttccgtgttgctgtggatggcaagcgtcgagccccactggattgccgcctctataatcctcgagttcttcctgatggtgctgcttatccccgagcccgaccgccagcggaccccgcaggacaaccagttagcctacgtggtcattgggctcctcttcatgatcttgaccgtagccgcgaacgagatgggcctgctcgagactaccaagaaggacctggggatcggccacgtagccgtcgagaaccaccatcacgccgctatgctggacgtggacctccaccccgccagcgcgtggacgctgtacgccgtggcaaccactattatcacgcccatgatgcgccacacgatcgagaacacaacagccaacatctccctaaccgctatcgcgaatcaagccgccatcctcatggggttagataaaggctggccaatttcaaagatggacatcggcgtcccacttctagctctggggtgctactcccaggtgaaccccctgacgctcaccgcggccgttttgatgctggtcgcacactacgccatcataggccccgggctccaggccaaggctacccgggaggcacagaagcgcaccgccgccgggataatgaaaaatccgacggtggacgggatcgtcgctattgacctggatcccgtcgtatacgacgcgaaattcgaaaagcagctgggccaaattatgctcttgatcttgtgcaccagccagatcctgctgatgcgcaccacctgggccctgtgcgagtcaatcacgctcgccacaggccccttgaccaccctgtgggagggaagcccaggtaagttctggaacacgaccatcgccgtgagcatggctaacatcttccgggggtcctatctcgctggtgccggcctggccttcagcctgatgaagtccctcgggggcggccgtcgcggcaccggggcgcagggcgagaccctgggcgagaagtggaagcgccagctgaaccaactcagcaagtcggagttcaacacgtataaacggagcgggatcatggaggtggaccgctccgaggcgaaggaaggcctgaagcgcggggaaaccaccaagcatgccgtgagccgcggcactgccaagctaaggtggtttgtcgagcgcaacctcgtcaagccagaggggaaggtcatcgacctgggctgcggccgcggcggatggtcctactactgcgcggggttaaagaaggttacggaggtcaaagggtacaccaagggcgggcctggccatgaggagcctatacccatggccacctacgggtggaacctggtgaaactccacagcggcaaggacgtgttcttcgtcccgccagagaaatgcgacacactactgtgcgacatcggggagtcctctcccaatcccacaatcgaggagggacgcacactcagagtgctaaagatggtcgagccgtggctgcgcgggaaccagttctgcatcaagatcttgaacccctacatgccgagtgtcgtggagaccctggagcagatgcagcgcaagcacggaggcatgctcgtgcgcaaccccctcagccggaactccacccacgagatgtactgggtcagctgcggaacgggcaacatcgtgtccgctgtgaacatgaccagtcgcatgctgctgaaccggttcaccatggcccaccgcaagccaacctacgagagagacgtcgacctcggggccgggacacggcacgtcgccgtggagcctgaggtagccaacctggacatcataggccagcgcatcgagaacatcaagcacgaacacaagtccacgtggcattatgatgaggacaacccgtacaagacctgggcgtaccacggtagctacgaggtgaagccctcaggcagcgccagctccatggtcaacggagtggtgaagctgctcactaagccttgggacgtgatccctatggtgacccagatcgcgatgacagacaccaccccctttggccaacagcgggtatttaaggagaaggtcgacacccgcacgcccaaggccaagcgaggtaccgctcagataatggaggtgaccgcgaaatggctgtggggtttcctgagtcggaacaagaagccacgtatctgtacccgcgaagaattcactcggaaggtgcgctccaacgcggctatcggggccgtcttcgtggacgagaaccaatggaacagcgcgaaagaggccgtggaagacgagcggttctgggatctcgtccaccgtgagcgggagctgcataagcaggggaagtgtgcgacctgcgtatacaacatgatgggcaaacgcgaaaagaagcttggcgagtttggcaaggccaaaggctcccgggctatctggtacatgtggctcggcgcgcgttttcttgagttcgaggccctaggattcatgaacgaggatcactggttctcccgggagaactccttaagtggggtagagggcgaggggctgcacaagctgggctacatactccgcgacatctccaagatctccgggggcaatatgtacgccgacgacaccgccggctgggacacccgtatcacggaggacgacctgcagaacgaggcgaagatcacagacatcatggagcctgagcatgcgctgctcgcgaagtcaatctttaaactgacctaccagaacaaggtggttcgcgtgcaacggcccgccaagaacgggacagtcatggacgttataagcagacgcgaccagcggggctccggccaggtgggcacgtacgggctgaacaccttcaccaacatggaggcccagctcatccgccaaatggagagcgaggggatattctccccgagcgagctggagacccccaacttagccgaacgcgcgcttgactggctggagaagcatggtgtagagagattaaagcggatggccatcagcggggacgactgcgtcgtgaagcccatcgacgatcgtttcgcaacggccttgaccgccctcaatgatatgggcaaggtccggaaggacatccctcagtgggagccatccaaggggtggaatgactggcagcaggtccccttctgcagccatcacttccatcagctgataatgaaggacggccgcgagattgtggtcccctgccggaaccaggacgaactcgtgggccgcgcgcgggtaagtcaaggggccggctggagcctgcgcgagaccgcctgtctgggaaaatcgtacgcccagatgtggcagctcatgtactttcaccggcgcgatctgcggctggcggcaaacgccatctgtagcgccgttcccgtggattgggtgccgacctcccgcacgacctggagcatccacgcccaccatcagtggatgactaccgaagacatgctctccgtctggaaccgggtgtggatcgaggagaacccctggatggaggataagacgcatatcagctcctgggaggacgtgccctacttaggcaagagagaggaccagtggtgcggcagcctgatcggcctcaccgcgcgggctacgtgggccactaacatccaagtcgccatcaaccaggtacgccgcctgatcggcaatgagaactacctggactatatgacgtccatgaaacgcttcaagaacgaaagcgatctcgagggggccctgtggtga

SEQ ID NO: 23843 - RNA, 9879 nt, synthetic construct
  misc_feature 1..9879: note = derived and/or modified CDS sequence (opt11) from DENV-1__HM181937__SS-prME
  source 1..9879: mol_type = other RNA
agcgtgacgatgctgctcatgctgatgcccacggctctagctttccacctcaccacccgggggggggagccgcacatgatcgtcagcaagcaggagcggggcaagagtttactgttcaagaccagcgcgggtgtgaacatgtgcaccctaatcgcaatggacctgggcgagctgtgtgaggacacgatgacttacaagtgcccccgcatcaccgaagcggagcccgacgacgtggactgctggtgcaacgccaccgacacgtgggtcacctacggaacgtgctcccaaaccggtgagcaccggcgcgataagcggtccgtggcccttgcgccccacgtaggcctgggactggagacgcgcaccgagacttggatgagctccgagggcgcgtggaagcaaatccaacgggtcgaaacctgggccctccgccaccccgggttcaccgtgattgctctgttcctggcgcacgcgatcggtacgagcattacacagaaggggataatcttcatcctcctgatgcttgtgaccccctccatggccatgcggtgtgttggcatcggaagccgagacttcgtagagggactcagtggcgccacctgggtcgacgtcgtgctggagcacgggagctgcgttaccaccatggcaaaggacaagcccacactggacatagagctcctgaagacggaggtcaccaatcctgcgatactacggaagctctgcattgaggctaagatttccaacaccaccacggacagccgctgcccgacacagggcgaagctactctggtggaggagcaggacgccaactttgtgtgccgccgcactttcgtcgaccggggctgggggaacggctgcgggctgttcggcaaggggtcactcattacgtgcgcgaagttcaagtgcgtgaccaagctggaaggcaagattgtgcagtacgagaacctcaagtacagcgtcatcgtgaccgtgcacaccggcgaccagcaccaggtcgggaacgagtccacggagcacggtacgaccgcgaccatcactccccaagcacccaccaccgagatccagctgaccgactacggggccttgaccttagattgctctccccgcaccggcctcgacttcaatgagatggtactgttgaccatgaaggagaagtcttggctcgtgcacaagcagtggtttctggacctgccactcccctggaccagcggggcctcaacctcccaggagacatggaatcggcaggacctgctggtgacctttaagaccgctcacgcgaagaagcaggaggtggtggtgttaggcagccaggagggggccatgcacaccgccctgaccggggccaccgagatccaaacgtccggcacaacgaccatcttcgccgggcacctgaagtgccgactcaagatggacaagttaaccctgaagggcatgagctacgtgatgtgcaccggctccttcaaactcgagaaggaggtcgcggagacgcagcacggaaccgtgctggtgcaaatcaagtatgaaggcaccgacgccccctgcaagatccccttcagcacccaagacgagaagggggtcacgcagaacggccggctgatcaccgctaacccaatcgtgaccgacaaggagaagcccgtgaacatcgaggccgaaccgcccttcggggagtcctacatcgtcatcggcgcgggagagaaggccctgaagctcagctggttcaaaaagggctcaagcattggcaagatgttcgaagccaccgcacgcggggcccggcgcatggcgatattgggcgacacggcctgggacttcgggtccattggcggcgtgttcaccagcgtggggaagctggtccaccagatcttcggcaccgcctacggggtcctcttctccggcgtaagctggaccatgaaaatcggtatcggcgtcctgcttacgtggctgggcctgaactcccgcagcacctccctaagcatgacctgtatcgcggtggggcttgtaacgctgtacctgggcgttatggtgcaggccgactccgggtgcgttataaactggaagggccgggagctcaagtgcgggagcggcatcttcgtcacgaacgaggtccacacatggaccgagcagtataaattccaggcggacagccctaagagactgtctgcggccatcggcaaggcctgggaggagggggtgtgcggcatacggtccgccaccagactggagaacataatgtggaagcagataagtaacgagctaaatcacatcctgctggagaatgacatgaaattcaccgtcgtggtgggggacgtggcgggcattctagctcaaggaaagaagatgatcaggccccagcccatggagtacaagtattcgtggaagtcttggggcaaggccaaaatcatcggcgctgacgtgcaaaacacgaccttcatcatcgacgggcccaacacgcccgaatgcccggacgaccagcgcgcttggaatatttgggaggtggaggactacggattcgggatcttcactaccaacatttggctgaagctgagggacagctacacccaggtatgtgaccaccgcctcatgtccgctgccattaaagactctaaggccgtacacgccgacatgggctactggatcgagtcagaaaaaaacgagacctggaagctggcgcgggccagcttcatcgaggtgaagacatgtatctggcctaaatcgcacacgctgtggagcaacggcgtcctcgagtccgagatgatcatccccaagatctacggggggcctatctcccagcacaactaccgccctgggtatttcacccagacggccgggccttggcacctggggaagctggagctcgacttcgacctgtgcgagggcacaacggtggtggtcgacgagcactgcggtaaccgggggccgtccctgcgcaccaccaccgtgaccgggaagatcatccatgagtggtgctgccggtcgtgcaccttaccgccactccgatttcgaggagaggacggctgctggtacgggatggaaatccgccccgtgaaggaaaaggaggagaacctggtaaagtccatggtgagcgccggcagcggcgaggtggactccttcagcctcgggctgctatgcatctccatcatgatcgaggaggtcatgcggagccgctggtcccggaagatgctcatgaccggtaccctggcagtgttcctgctcctgatcatggggcagctgacgtggaatgacctcatccgcctgtgcatcatggtgggcgctaacgcctcggacaggatggggatgggcaccacgtacctggccctcatggccaccttcaagatgaggccgatgttcgccgtcgggctgctgttccgccggctcacgtctcgcgaggtgctgctgctaaccatcgggctgagtctggtggcgtccgtggagctccccaacagcctggaagagctaggcgatggactcgccatgggcatcatgatcctcaagcttctcactgatttccagtcccaccaactgtgggcgacactgctgtctctgacgtttatcaagaccactttctccctgcactacgcctggaagaccatggcgatggtgctctccatcgtcagcctgtttccgttgtgcttaagcacgacctcacaaaagaccacttggctgcccgtgctgttaggctcactggggtgcaagcctctgaccatgttcttaatcgccgagaacaagatctggggacgaagatcttggcccttgaacgaagggatcatggccgtagggatcgtttcaatcctgttatcttcccttctgaagaacgacgtgcccctcgccgggcccctaatcgccggaggcatgctgatcgcgtgctacgtgatcagcgggtcctccgccgacctctccctggagaaagcggcagaggtcagctgggaggaggaggccgagcactccggcgcgagccacaacatcctggtggaggtgcaggatgacgggaccatgaagatcaaggacgaggagcgggacgacaccctcacaatcctgctgaaagccaccctactggccgtgtccggcgtgtaccccctaagcatccccgccaccctcttcgtttggtacttctggcagaaaaaaaagcagcgctccggggttctgtgggacacccccagcccgcccgaggtggagcgggccgtgctggacgacggcatctaccgcatcatgcagcggggccttctcgggaggtcccaagtcggggtcggggttttccaagagaacgtcttccacaccatgtggcacgtcacccggggcgcggtgttaatgtaccaggggaaacgtctggagccctcttgggcctccgtcaagaaggacctcatcagctacggcggcgggtggcggctgcagggctcgtggaacacgggggaggaggtccaggtgatcgccgtcgagcctggcaagaaccccaaaaatgtgcagaccgcccccgggaccttcaagacgcccgaaggcgaggtgggcgccatagcgctggactttaaacccgggacgtcagggtcccccatcgtcaaccgcgaggggaagatcgtggggctctacggaaacggggttgtgaccaccagcggcacctacgtatcggccatcgcccaggccaaggcgtctcaggaggggccgctgcccgagatcgaagacgaggtgttccggaagcgcaacctgacgatcatggacctccaccccggcagcggtaaaacgcgtcgctacctgccggccatcgtccgcgaggccataaaacgcaagctgcgcaccctcatactggccccgaccagggtggtggcctccgaaatggctgaggccctgaagggcatgcccatccgctaccaaacgaccgccgtgaagagcgaacacaccggcaaggaaatcgttgacctcatgtgccacgccaccttcaccatgcggctgctgtcccccgtccgcgtcccgaactataatatgatcatcatggacgaggcccacttcaccgaccccagctcaatcgcagcacgtgggtatatctccacccgcgtgggcatgggggaggcagccgcaatcttcatgactgcaacgccgcctggcagcgtggaagcattcccacagagcaacgccgtcatccaggacgaggagcgagacatccccgaacgctcctggaacagcgggtacgagtggatcactgactttccaggtaaaactgtgtggttcgtgccctccatcaaaagcggcaacgacatcgccaattgcctccggaagaacgggaaacgcgtgatccagctgtcccggaagaccttcgacacggaataccaaaagaccaagaacaacgactgggactacgtagtcaccaccgacattagcgagatgggcgctaatttccgcgccgaccgagtaatcgacccccgccggtgcctaaagcccgtcatactcaaggacggccccgagcgcgtgatcctggccggccccatgccggttacggtggcgtccgccgcgcaacggcgcgggcggatcggccgtaatcataacaaggagggcgaccagtacatctacatgggacagcccctgaacaacgacgaggaccacgcgcactggaccgaggccaagatgctactggacaacatcaacacgcccgaggggatcatccccgccctgttcgagcccgaacgcgagaagtccgccgcgatcgacggcgagtaccggcttcgcggcgaagcgcggaaaaccttcgtcgagcttatgcgccgcggggatctgcccgtgtggctatcttacaaggtggccagcgagggcttccagtacagtgacaggcggtggtgcttcgacggagaacgaaacaatcaggtcctggaggagaacatggacgtggaaatctggaccaaggagggcgagcggaagaagctgcggccccggtggctcgatgcgcgcacatactccgaccccctggccctgagggagttcaaggagttcgcggcaggccgccggtcagtgtccggagacctcatcctggagataggcaagctgccgcagcacctcacccagcgcgcccagaacgccctggacaacctggtcatgctccacaacagcgaacagggcgggcgggcgtaccgccacgccatggaggaattaccagacactatcgagacgctgatgctcttagcactgattgccgtcctcacaggcggggtgaccctgttcttcctgtccggccgggggctcggaaagaccagcatcggcctgctgtgcgtcatggcctccagcgtcctcctgtggatggcgtccgtggagccccactggatcgccgccagcatcattctggagttcttcctcatggtcttacttatccccgagccggacaggcagaggacgccccaggacaaccagctggcctacgtggtgatcgggctgctgttcatgattttgacggtcgccgcgaacgaaatgggcctgctggagacaactaagaaggacctcggcatcggccacgtggccgtggggaaccaccaccacgccgccatgctggacgttgacctgcaccccgccagcgcgtggaccctatacgcagtggccacgaccatcatcacccctatgatgcgccataccatcgagaacacgaccgccaacatcagcctgaccgcgatcgcgaaccaagccgccatcctgatggggctcgacaagggatggcccatatccaagatggatatcggggttcccttactggccctcggctgctactcccaagtcaacccattgaccctgacggcggccgtgctcatgttagtggcacactacgcgatcataggtccgggcctgcaggccaaggcgacccgtgaggcccagaagcggacggccgccgggatcatgaagaaccccaccgtcgacggcattgtggccatcgatctcgaccccgttgtatacgacgcgaagttcgagaagcagctgggccagatcatgctgctcatcttgtgtacgtcccagatcctgttgatgcgtaccacctgggccctgtgcgagagtatcacgctggccacggggcctctcaccaccctgtgggagggctccccggggaagttctggaacaccacgatcgccgtgtcgatggccaacatattccgcggcagttacctggcgggagccggcctcgccttcagcctgatgaagtcgttaggcgggggccgccggggtaccggtgcccagggcgagacccttggggaaaagtggaagcgccagttaaaccagctgtccaagagcgagtttaacacgtataagcggtccggaatcatggaagtggaccggagcgaagcaaaggaggggctcaagcgcggcgagacgacgaagcacgccgtctcccgcgggaccgcaaagttgcggtggttcgtggagcgcaacttagtgaagcctgaggggaaggtcatcgacctcggctgcgggcggggcgggtggagctattactgcgccggccttaagaaagtgaccgaagtgaaggggtacacgaagggtggccccgggcacgaggagcccatcccgatggccacctacggctggaacctggtcaagctgcactcaggaaaggacgtctttttcatcccgcccgagaagtgcgacaccctcctgtgcgacatcggggagagcagtcccaacccgaccatcgaggaggggcgcacgctgcgggtcctcaagatggtagagccctggctgcgcggcaaccagttttgtataaagattttaaacccctacatgcccagcgtagtggagaccttagagcagatgcagcggaagcacggcgggatgctggtccgtaacccgctgtcccggaacagcacccacgagatgtactgggtgtcctgcggcactgggaacatcgtgagcgcagtcaacatgacctcccgcatgctcctgaatcgcttcacgatggcccaccgcaagcccacctatgagcgcgacgtggacctgggcgccggtacccgacacgtggccgtagagcccgaggtagcgaacctcgacattattgggcagcgcatcgagaacatcaagcacgagcacaagagcacatggcactacgatgaggacaacccctacaagacatgggcgtaccacggctcctacgaggtgaagcccagtgggtccgccagcagcatggtaaacggcgtagtcaagctactgacgaagccctgggacgtgattcccatggtcacccaaatcgccatgaccgacacgacccccttcggccagcagcgggtgtttaaggagaaggtggacacccgcaccccaaaggcgaagcggggcacggcccagataatggaggtgaccgcgaagtggctctggggattcctgtcccgcaacaagaagcctcggatctgcacccgggaggagttcaccaggaaggtccgcagcaatgctgccattggggcagtgttcgtagacgagaaccagtggaactccgcaaaagaggccgtagaggacgagagattctgggacctggtgcataaggagagagagctccataagcagggcaagtgcgccacgtgcgtgtacaacatgatgggtaagcgggaaaagaaactgggcgaattcgggaaggccaagggcagtagggccatctggtacatgtggcttggagcccggttcctcgagttcgaggccctgggcttcatgaatgaagaccactggttctcccgcgagaacagcttgtctggcgtcgagggggagggcctccacaagctggggtacatcctgcgggacatcagcaagattcccggcggcaacatgtacgcagacgacaccgccgggtgggacacccgcatcacggaggatgacctccagaacgaggcccggatcacagacatcatggagccggaacacgcgctgctggccaagtccatcttcaaactcacctaccagaacaaggtggtgcgcgtccagcgccccgccaagaacggtaccgtgatggacgtgatcagccggcgtgaccagcgagggtccggccaggtcggcacctacgggctgaacaccttcaccaacattgaggcccagctgatcaggcaaatggagagcgagggcatcttctccccctcagagctcgaaacgcctaatctggcggagagagtactggactggctagagaagtacggggtggagcgcctgaagcggatggcaatctccggggacgactgcgtagtgaagccgattgacgaccgcttcgccaccgccctgacggccctcaacgatatggggaaggtgcggaaggacatccctcagtgggagccctccaagggctggaacgactggcagcaggtccccttctgctcccaccacttccaccagctgatcatgaaggacggccgcgagatagtggttccgtgccggaaccaggacgagctagtcgggcgcgcccgggtgagccagggcgcggggtggagcctccgcgagaccgcctgcctggggaagtcctacgcccagatgtggcagctgatgtatttccaccgcagagacctcagactggccgcgaacgctatctgcagcgccgtgcccgttgactggatccccacctctcgcaccacttggagcatacacgcccaccaccagtggatgactacggaggacatgctgtccgtgtggaatagagtttggatcgaggagaacccctggatggaggacaagacgcacatctcgagttggggcgacgtcccttacctcggcaaacgcgaagaccagtggtgcggcagcctgatcggcctgaccgcgcgggcgacctgggccaccaacatccaggtggccatcaaccaagtacgccgcttaatagggaacgaaaactacctcgactacatgacctccatgaaacggttcaagaacgagtcggaccccgagggggccctgtggtga

SEQ ID NO: 23844 - RNA, 9879 nt, synthetic construct
  misc_feature 1..9879: note = derived and/or modified CDS sequence (opt11) from DENV-1__HM181939__SS-prME
  source 1..9879: mol_type = other RNA
agcgtgaccatgctgctcatgctgatgcccaccgccttagctttccaccttaccacccggggcggtgagccccacatgatcgttagcaagcaggagcgaggtaagagcctgctgtttaagactagcgccggggtgaacatgtgcaccctcatagccatggacctgggcgagttctgcgaagacaccatgacctacaaatgtccccggatctctgaggccgagcccgacgacgtggactgctggtgcaacgctaccgacacctgggttacctacgggacctgctcccagacgggtgagcaccgtcgtgacaagcggagcgtggccctggcgccccacgtgggcctcgggctagagacccggacggaaacctggatgtccagcgaaggcgcctggaagcagatacagcgagtcgagacctgggccctgcgccaccccgggtttaccgtgatcgcgctcttcctggcgcacgccatcgggacgagcattacacagaaggggatcatcttcatcctgctcatgctggtgacgccctcaatggccatgcggtgcgtcgggatcggctcccgcgacttcgtggagggactgagcggcgccacttgggtagacgttgtgctcgagcacggctcctgtgtgacgaccatggctaaagacaagcccactctggacatcgagttacttaagacggaagtaacgaacccagcggtgctgaggaagctttgcatcgaagccaagatcagcaacaccacaaccgactcccgctgcccgacgcagggcgaagccaccctcgtggaggagcaggacgccaacttcgtatgtcggcgcaccttcgtggaccggggctgggggaacggctgcgggctgttcggcaaggggagcctgatcacttgcgctaagttcaaatgcgtgacgaaactcgaaggcaaaatcgtccagtacgaaaacctgaaatactccgtgatcgtgacagtccataccggagaccagcatcaagtggggaatgagagcactgagcacggcacgaccgcgaccatcacgccccaggctcccagtaccgagatccaactgaccgactacggggccctaaccctggactgcagcccccggaccggcctggatttcaacgagatggtcctcctgaccatgaaagagaagtcatggctggtgcacaagcaatggttcctcgatctgccgctgccctggacatccggtgctagcacctcccaggagacgtggaacagacaggacctcctagtgactttcaagactgcccatgctaagaagcaggaggttgtcgtcttaggaagccaggagggtgccatgcacaccgccctcaccggggccaccgagatccagacgtccggcacgaccactatcttcgctgggcacctgaagtgccgcctgaagatggacaagctcactctgaagggcatgtcctacgtcatgtgcaccgggagcttcaaactggagaaggaggtggcggagacccaacacgggaccgtcctcgtccagatcaagtacgagggcacggacgccccgtgcaagattcccttcagtacacaggacgaaaagggggtgacacagaacggcagactgatcaccgccaaccccatcgtcacggataaggagaagcccgtcaacattgaggccgagccacccttcggggagagctacatcgtaatcggcgcgggcgagaaggccctgaagttaagctggtttaagaaggggtcgagcatcggcaaaatgttcgaggccacggcccgcggggcccggcgcatggcgatcctcggagacaccgcctgggacttcgggagtatcggcggcgtattcacctcagtcgggaagcttgttcaccagatcttcggcacagcctacggggtcctgtttagtggcgtcagctggaccatgaagatcgggatcggcgtgttactcacctggttaggccttaacagtcgcagcaccagcctgagcatgacgtgcatcgccgtggggctggtcaccctctacctgggcgtgatggtacaagccgacagcgggtgtgtcatcaactggaagggccgggagctgaagtgcgggagtggcattttcgtgactaacgaggttcacacctggacggagcagtacaaattccaggcggacagcccgaaacgcctatccgccgccatcggcaaggcatgggaggagggggtctgcggtatccgtagcgcgacccgcctggaaaacatcatgtggaagcagatctccaatgagctgaaccacatcctcctggagaacgacatgaaattcaccgtagtagtcggtgacgtggcgggcatcttagcccaggggaaaaagatgatccggccacagcccatggaatataaatacagctggaagtcgtggggtaaagcgaaaatcatcggcgccgacgtgcagaacaccacctttataatcgacgggcccaacacgccggagtgccccgacgaccagcgcgcgtggaacatatgggaggtcgaggactacggctttgggatctttacaaccaacatctggctgaagctgcgggacagctacacccaagtgtgcgaccaccgcctgatgtccgccgccattaaggatagcaaggcagtgcatgcagacatgggctactggatcgaatctgagaagaacgagacgtggaagctggcgagagccagcttcatcgaggtcaagacctgcatctggccgaagtcccacaccctctggtccaacggcgtgctagagtcagagatgatcatccctaaaatctacgggggccctatctcccaacacaattaccgccccggctatttcacccagacggccgggccctggcacctgggtaagctggagctagacttcgacctctgcgagggcactacggtggtcgtggacgagcactgcggaaaccggggtccttccctgcgaaccacaacggtgaccggcaaaatcatccatgaatggtgctgtcggtcttgcactttaccgcccctacgcttcaagggggaggacggttgctggtatggcatggagattcggcccgttaaggagaaggaggaaaaccttgttaagtctatggtgtccgcaggcagcggcgaggttgactccttcagcctgggactcctatgcatcagcatcatgatcgaggaggtcatgcgcagccggtggtcccgcaaaatgctgatgacgggcaccctcgcagtgttcttcctgcttatcatgggccagctaacctggaacgacctgatccggctgtgcataatggtcggggctaacgccagcgatcgcatggggatgggcatgacctacctcgccttgatggccacgttcaagatgcgcccgatgttcgctgtgggcctcttgttccggcgtctgaccagccgggaagtgctgctcctgacgatagggttaagccttgtcgccagcgtggaacttcccaacagcctggaggagctcggtgacgggctggcgatgggaatcatgatcctgaagctcctcaccgacttccagtcccatcagctttgggccacgctcctgagcctgaccttcatcaagaccaccttcagcctacactatgcctggaagacgatggcgatggtcctgagcatcgtgtccctgttccccctctgcctgagcactacctcccaaaagaccacatggctgcccgtgctcctgggcagcttggggtgcaagccgctaacaatgttcctgatcgccgagaacaagatctggggccgcaagagctggcccctgaacgaaggcatcatggccgtgggcatcgtgtccatcctccttagctcgctgctcaagaacgatgtgccccttgccggacccctgatcgccggcggcatgctcatcgcgtgctacgttatcagcggttcctcagctgacctgtccctggagaaggccgcggaggtgagctgggaagaggaggccgagcacagcggcgccagtcacaacatcctcgtggaggtccaggatgacggtaccatgaaaatcaaggatgaagaacgggacgacaccctgactattctgcttaaagccaccctgctggccgtgtccggcgtgtatccgctgagcatccccgcgaccctgttcgtctggtacttctggcaaaaaaaaaagcaacgctccggggtgctgtgggacacaccctcgcctcccgaggtggagcgggccgtcctggacgacggcatctaccgcatcatgcagcggggccttctggggcgcagtcaggttggcgtgggcgttttccaggagaatgtgtttcacactatgtggcacgtaacgcggggcgcggtcttaatgtaccaggggaaacgcctggagcctagttgggcctccgtgaagaaggacctcatcagctacggcggcgggtggcggctgcaaggatcctggaataccggggaggaggtgcaggttatcgccgtggagcccggcaagaaccccaagaatgtgcagaccgcccccgggaccttcaagacgtcagagggcgaggtcggagcgatcgcgctcgacttcaagcccgggacaagcgggtcccccatcgtgaatcgcgaagggaagatcgtgggcctgtacggcaacggggtcgtgaccaccagcggcacgtacgtgtccgctatcgcccaggcgaaggccagtcaggagggccccctgccggagatcgaggacgaagtcttccggaagcgcaacctcaccatcatggaccttcaccccggctcggggaagacccggcgatatctgcccgccatcgtgcgggaggccatcaagcgcaagctccggaccctgatcctggccccgacgcgcgtggttgccagcgagatggcggaggccttaaagggcatgcccatccgctatcagaccaccgccgtaaaatcagagcacactggcaaagagatcgtggatctcatgtgccacgccacgttcaccatgcggctgctcagccccgtcagagtgcccaactacaacatgatcatcatggacgaggcccacttcacagacccgtccagcatcgcggcccgggggtacatatccaccagggtcggcatgggcgaggccgccgccatattcatgacggcgacccccccaggctccgtcgaagcgttcccccagtccaatgctgtgattcaggacgaggagcgggacatcccagagcgcagctggaactccgggtacgagtggatcaccgacttccccggcaagaccgtctggttcgtgcccagcatcaagtccggcaacgacattgccaactgcctgcggaaaaacgggaagcgcgtgatccagctgtcacggaagaccttcgataccgaataccagaagacgaagaacaatgactgggactacgtggtgaccacggatatctccgagatgggcgcgaacttcagggccgaccgggtcatcgacccccgccggtgcctaaaaccggtgatccttaaggacgggcccgagcgcgtcattctggccgggcccatgcccgtcaccgtagccagcgctgcgcagcggcgcgggcgcatcggccgcaatcacaacaaggagggcgatcagtacatttacatgggtcagccgctcaacaacgacgaggaccatgcccattggaccgaggccaagatgctgctggacaacatcaacacccccgagggcattatccccgctctcttcgaacccgagcgggaaaagtccgcggcgatcgacggggagtaccgcctgcggggagaagccagaaagacgttcgtggagctgatgagaagaggggacctacctgtgtggctgtcctacaaggtggccagcgaaggcttccagtactccgaccgacgctggtgcttcgatggagagcgcaacaaccaagtgctggaagagaacatggacgtggagatctggaccaaggagggggagcggaaaaagctccgcccccggtggctcgacgcccgcacctacagcgaccccctagccttacgagagtttaaggagttcgcggccggccgccgctccgtcagcggggacctgatcctggagatcggaaagttaccccagcacctgacccagcgcgcccagaacgccttagacaacctcgtgatgctgcacaactctgagcagggtggtagggcgtaccgacacgccatggaagagctgccggacacgatcgagacactcatgctgcttgcactcatcgccgtgctaaccggcggggtcaccctgttcttcttaagcggtcgagggctgggcaagacgagcatcggcctactctgcgtgatggccagctccgtcctgctttggatggcgtccgtggagccccactggatcgcggcctccatcatcctcgaattctttctgatggtgcttttgatccccgagcctgaccgacagagaaccccgcaggacaaccagctggcctatgtggtcatcgggctcctctttatgatcctgaccgtggccgctaacgagatgggcctgctcgagaccacaaagaaagatctgggtatcggccacgttgctgtcgagaatcaccaccacgccgccatgcttgacgtagatctccaccccgccagcgcgtggacgctatacgccgtggctaccaccatcatcacccctatgatgcggcacacgatagagaacaccacagcaaacatctccctgaccgcgatagccaaccaggccgccatcctcatggggctggacaagggctggccgatctctaagatggacatcggcgtccccctgttagccctgggatgctactcccaggtgaatcctctgacgctaaccgctgccgttctgatgcttgtcgcccactacgcaatcatcggccccggattgcaggccaaggcaacccgggaggcccagaagcgcaccgctgccgggatcatgaagaacccgacggtggacggtatcgtggcaatagacctcgaccccgtcgtgtacgacgcgaagttcgagaaacagctgggacaaatcatgctgctgatcctgtgcaccagccagatcctcctgatgcgcaccacctgggcattatgcgaatccatcaccttggccaccggccccctgaccactctttgggaggggagccccggaaagttttggaatacgaccattgccgtgagcatggccaacatcttccgggggtcctacctcgcgggggccggtctagccttcagcctgatgaaatccctcggaggggggcgccggggcaccggggcacaaggcgagaccctgggagaaaagtggaagcgccagttgaaccagttgagcaagtccgagttcaacacgtacaagcggagtgggatcatggaggtagaccgttccgaagcaaaggagggactgaagcgaggggagacgaccaaacacgcggtgagccgtggaaccgccaagcttcggtggtttgtggagcgcaacctagtcaagccagagggtaaagtaatcgacctgggctgcggcaggggcgggtggtcctactactgcgccgggctgaagaaggtgacggaggtcaaggggtacaccaagggcgggcccggccacgaggagcccatcccgatggccacctacggatggaacctggtgaagctgcacagcggtaaggacgtgttcttcgtcccgcccgagaagtgcgatacccttttatgcgacatcggggaatccagccccaaccccacgatagaggaaggccgtaccctccgagtgctgaaaatggtggagccgtggctacgcggtaaccagttttgcatcaaaatcctcaacccctacatgcccagtgtagtagagaccctcgagcagatgcagagaaagcacggcgggatgctggtgcgcaacccgctcagccggaactccacccacgaaatgtactgggtctcgtgcggcacgggcaacatcgtgtcagcgatcaacatgaccagccgcatgcttctgaacaggttcacaatggctcaccgcaaacctacctacgagcgcgacgtggacctaggggccggcacccggcacgtcgccgtagagcccgaggtggccaatttagacatcatcggccagcggatagaaaacatcaaacacgagcacaagtccacttggcactacgacgaagacaatccctacaagacctgggcgtaccatgggtcttatgaggtcaagcccagcggctccgcgagctccatggtcaacggggttgtgaagctgctcacaaagccgtgggacgtgatccccatggtcacccaaatcgccatgaccgacaccacccctttcggccaacaacgggtattcaaagagaaggtggacacgcgcacgcccaaggccaagcggggtaccgcccaaatcatggaggtcaccgcgaagtggctgtggggcttcttaagccgcaacaaaaaaccgcggatatgcacccgcgaggagttcacgcggaaggttcgctccaacgccgccatcggtgccgtgttcgtcgacgagaaccagtggaacagcgcgaaggaggccgtggaggatgaacggttctgggacctcgtacaccgcgagcgggaactgcataagcaggggaagtgcgccacgtgcgtctacaacatgatgggcaagcgcgagaagaagctgggggagttcggcaaggccaaggggtcccgggccatttggtacatgtggctcggcgcgcgctttctagagttcgaggccctgggtttcatgaacgaggaccactggttcagccgggagaattccctcagcggggtggaaggcgagggactgcacaaactgggctacatcctcagagacatctccaagatcagtgggggcaacatgtatgccgacgatacagcaggctgggacacccggatcacggaggatgaccttcagaacgaagccaagatcaccgacattatggagcccgaacacgcgctgctcgccaatagtatcttcaaactgacctaccagaacaaggtggtccgcgtgcagagaccggcgaagaacgggaccgtgatggacgtcatcagccgccgcgaccagcggggctccggccaagtgggcacgtacgggctgaataccttcacgaatatggaggcccagctcatccgacagatggagagcgaggggattttctccccgagcgagctggagacccccaatcttgccgagcgggtgctcgactggctggagaagcacggcgtcgagcgcttgaagcggatggcgatcagcggtgacgactgcgtggtgaaacctatcgacgaccgcttcgctactgccctcaccgccctgaacgacatgggcaaggtccggaaggatatccctcagtgggagccgtcaaaaggctggaacgactggcagcaagtccccttctgcagccaccactttcaccagctgatcatgaaggacggccgcgagattgtggtcccgtgtcggaaccaggacgagctcgtggggcgcgcgagagtgtcccagggggcgggctggagcttgcgcgagaccgcctgcctggggaagtcctatgcccagatgtggcagctcatgtacttccaccggcgcgacctgcggctagctgcgaatgcgatctgctcagcagtccccgtggactgggtgcccacctcccgaacgacctggagtatacacgctcaccaccagtggatgacaaccgaggacatgctctccgtctggaaccgggtgtggatcgaggagaacccctggatggaggacaagacgcacatcagctcctgggaggacgtgccctacctgggcaagcgcgaggaccagtggtgtgggagcctgatcgggttgaccgcccgcgctacgtgggccaccaacatccaggtcgcaataaaccaggttcgccgcttaatcggcaatgagaactacctggactacatgacgtccatgaaaagattcaagaacgagagcgacccggagggggccctctggtga

SEQ ID NO: 23845 - RNA, 9879 nt, synthetic construct
  misc_feature 1..9879: note = derived and/or modified CDS sequence (opt11) from DENV-1__HM181942__SS-prME
  source 1..9879: mol_type = other RNA
agcgtgaccatgctgttgatgctaatgcccaccgccctggccttccacctcactacccggggcggggaaccgcatatgatcgtcagtaagcaagagcgtggaaagtctcttctgttcaagaccagcgcgggggtgaacatgtgcacgctcatcgcaatggacctgggcgagttctgcgaagacaccatgacctacaagtgcccccggatctccgaggccgagcccgacgacgtggactgctggtgcaatgccaccgacacctgggttacgtatgggacttgtagccagacgggcgagcaccgtcgcgataagcggagcgtggccttggcgccccatgtgggcttgggtcttgagacccgcacagagacctggatgagtagcgaaggggcgtggaagcagatccagcgggtcgagacctgggccctgcggcacccgggcttcaccgtgatcgccctcttcctggcacatgccattggcacatccataacgcagaaggggatcatcttcatcctgttaatgttagtgactcccagcatggccatgcggtgcgtgggcatcggaagtcgcgacttcgttgaggggttatctggcgcgacctgggttgatgtcgttctcgagcacgggtcgtgcgtgacgaccatggccaaggataagccgactcttgacattgagctcctaaagaccgaggtcacaaatcccgcggtgctccgaaagctgtgtattgaggctaaaatctcgaataccaccaccgactcccgctgccccacacagggcgaggccaccttggtggaggagcaggacgctaacttcgtttgccggcgcacctttgtggaccggggctgggggaatggttgtgggctctttggcaaagggagtctgataacttgcgccaaattcaaatgtgtgacgaagctcgagggtaagatcgtccagtatgagaacctgaaatattcagtaatcgtgaccgtccacaccggcgatcaacaccaggtggggaacgagagcactgaacacgggacgaccgcgaccataacgccccaggccccctccacagagatccagctgacggactacggggccctcacattagactgttcaccgaggaccggcctagactttaacgagatggtcctgcttaccatgaaagagaagtcctggctcgttcacaagcagtggttcttagatctgccgctgccgtggacttccggggccagcacatctcaggagacctggaaccgacaggacctcctggtaacgttcaagacagcccacgctaaaaagcaggaagtcgtggtgctgggcagccaggagggcgccatgcacaccgccttaacgggggccaccgagatccagacgtccggcaccaccaccatattcgctgggcacctgaaatgccgcctgaagatggacaagctgacactgaagggcatgagctacgtcatgtgcacaggtagtttcaaactggaaaaggaagtggcggagacccagcatggcacagtcctggtacagatcaagtatgaaggtacagacgcaccctgcaagatcccctttagcacccaggacgagaagggagtaacccagaacggccggcttatcactgccaaccccatcgtgacggacaaggagaagcctgtaaacatagaggctgagccgcccttcggcgagtcctacatagtgattggcgcgggcgagaaggccctcaagctgtcttggttcaaaaaggggtccagcattgggaagatgttcgaggcgaccgccagaggggcgcggcgcatggccatactaggcgacacggcctgggacttcgggagcataggcggcgtgttcaccagcgttggcaagttagtgcaccagatcttcggcacggcctacggggttcttttctccggtgtgtcgtggacaatgaaaatagggatcggcgttctattaacttggttaggtctaaactccagaagcacatccctgtcgatgacctgcattgccgtggggctagtaaccctgtacctaggcgttatggtgcaggcagatagcgggtgcgtaatcaattggaagggccgggagctaaaatgtggatccggcatctttgttactaacgaggtgcacacttggacggagcaatacaagttccaggcggatagcccgaagcgcctctccgccgcgatcggaaaagcctgggaggagggtgtatgcgggatccgtagcgctacccgcctggagaatatcatgtggaaacaaatctccaacgagctcaaccacatcctcctggagaacgacatgaagtttaccgtggtggtcggtgacgtcgcgggaatcctggcccagggcaagaagatgatccggccgcaacctatggagtacaagtacagctggaaatcctgggggaaggcaaaaatcatcggagcggacgttcagaacaccaccttcattattgatggccccaacactccggagtgcccagacgatcaacgggcgtggaacatctgggaagtcgaggactatggtttcggtatcttcaccaccaacatctggttgaagctgcgggacagctacacccaagtgtgcgaccatcgcctgatgtccgccgccatcaaagacagcaaggccgtgcacgccgacatgggctattggatcgaatccgagaagaacgagacgtggaagctcgcgcgagcttctttcatcgaggtgaagacctgtatatggccaaagtcccacacgctgtggagcaatggcgtgctggagtccgagatgataatccccaagatctacgggggcccgatctcacagcacaactatcgccccggatacttcacccaaacggccggcccttggcacctcgggaagttagagctggactttgacctctgcgagggcacgacagtggtcgtggacgagcactgcggaaatcgcggtccgtcgttgcgaaccaccaccgtgaccggcaagatcatccatgagtggtgctgccggagctgcaccctaccgccgctgagattcaagggggaggatggctgctggtacgggatggagatccgtcccgtaaaggaaaaggaagagaacttagtcaagtctatggtatcagcagggagcggggaggttgactcattctcgctggggctcctgtgtatctccatcatgatcgaagaggtaatgcgcagccgctggtcgcggaagatgctgatgacgggcacattagcggtgtttttcctgctgatcatggggcagctcacctggaacgacctgatccgtctgtgcattatggttggcgcaaacgccagcgaccgcatgggcatgggtatgacctacttagcgctcatggccacgttcaagatgcggccgatgttcgccgtgggcctcctgttccggcgtctgacctctcgggaagtgctgctcttaaccatcgggctgtcgcttgtcgcgtccgtggaactgcccaatagcctggaggagctcggagacgggctggcgatgggtatcatgatcttgaagctcctgacagactttcagtcccaccagctgtgggcaactctcctgagccttaccttcataaaaaccaccttctctttacactatgcctggaagacgatggcgatggtcctgagcattgtatcgctgtttcccctctgtttaagcaccacttcacagaagaccacctggctgccggttctcctggggagcctaggatgcaagccgctaaccatgttcttgatcgcagagaataagatctggggccgcaaaagttggcccctgaacgaaggcatcatggccgtcggcatcgtgagtatcctactgagctccctcctcaaaaacgatgtccccctggccgggccgctgatcgccggcggtatgctcatcgcatgctacgtaatctctgggtcgtctgcagacctgtccttggagaaggccgcggaggtcagctgggaagaggaggctgagcactcaggcgctagtcataacatactcgtggaagtccaggacgacgggaccatgaagatcaaggatgaggagcgggacgataccctgacgatcctcctcaaggccaccctgctggcggtctcgggcgtgtacccgttgagcatacccgccacactgttcgtctggtatttctggcagaagaagaaacagcgctccggagtgctgtgggacaccccctcgccaccagaagtcgaaagggcagtgcttgacgacggaatctatcgcatcatgcagcgcggcctgctggggcgcagccaagtgggcgtcggagtctttcaggagaacgttttccacaccatgtggcacgttacccggggcgcggtcctaatgtatcagggcaaacgcctcgagcccagctgggcctccgtaaagaaagacctgatcagctatgggggtgggtggcgtttacagggatcctggaacacaggggaggaagtacaagtcatcgcagtggagcccggcaagaaccccaagaatgtgcagaccgctccgggtacatttaagaccagcgaaggagaggtcggcgccatcgcgctcgacttcaaaccgggcaccagcggctcccctatagtaaacagggagggaaagatagtgggcctgtatggaaacggagttgtgacgacctctggtacgtacgtgtccgccatcgcccaggccaaagctagccaggagggtcctctgccggaaatagaggatgaggtcttccggaaacgcaacctaacgattatggacctgcaccctggcagcgggaagacgcggaggtacctccccgcaatcgtccgggaggccattaagcgcaaactccggaccttgatccttgctccgacgcgcgtggtcgcatccgaaatggcggaggcgctcaagggcatgcccatacgctaccagacgactgcagtgaaaagcgagcacacgggcaaagaaatcgtggaccttatgtgccacgccaccttcacgatgcgacttttgtcgccagtccgcgtccctaactacaacatgatcatcatggacgaagcccacttcaccgaccccagcagcatcgcggctcggggatacatcagcaccagagtaggcatgggggaagccgcagccatattcatgacggcgacaccgcccggcagcgtcgaggctttcccccaatccaatgccgtaatacaagacgaggagcgggatatccccgaacgaagttggaacagcgggtacgaatggatcaccgacttcccgggcaaaacagtctggttcgtccccagcataaaatccggcaacgacattgctaactgcttgcggaaaaacgggaagagagtgatccaattatcgcggaaaacgttcgacacagagtatcaaaagacaaagaacaacgattgggattacgtggtaaccacggacatctccgagatgggcgcgaatttcagggctgaccgcgtgatcgacccccgccggtgcctcaagccagtgatactcaaggatggccccgagagagtcatcctggccggccccatgcctgtgaccgttgcgagcgcagcacagcggcgcgggcgtatcgggcgcaaccacaataaggagggggatcagtacatctatatggggcagccgttgaacaatgatgaggaccacgcccactggaccgaggccaaaatgctgctggataacatcaacacacccgaaggtatcatccccgccctgtttgaaccggagcgtgagaagtccgcagcgatcgatggggaatatagacttcgcggcgaggcccggaagacgttcgtggaattaatgcgcaggggcgatctcccggtgtggttgtcctacaaggtcgccagcgagggattccaatacagtgaccgccggtggtgtttcgacggcgagcgcaacaaccaggtcctggaggaaaacatggacgtggagatctggacaaaggaaggggagcggaagaagttgcgcccgcggtggctggacgcccgcacctactcagaccccctggctctcagagagttcaaggagttcgcggccgggaggaggtccgtcagcggcgacctgatcctggaaatcggcaagctccctcagcacctgacccagagagcccagaatgcgctggacaatttagtcatgttacataactccgagcagggagggagagcttaccgccacgccatggaggagctgccggacacgatcgagactctcatgctgctagctctaatcgccgtcctgaccggcggggtcaccctcttcttcttaagcggtcgtgggctcggcaagacgtctatcggtctgctctgcgtaatggccagctccgtcttactgtggatggcatcggtagagcctcactggatagccgcgtccataatcctcgagttcttcctgatggtgctgttgatccccgaacccgaccgccagcggacgccgcaggacaaccagctggcctacgtggtcatcgggttactcttcatgatccttactgtggccgcgaacgagatgggcctgctagaaaccaccaaaaaggacttagggatcggacatgtggccgtggagaatcaccatcacgccgcaatgctggacgtggacctccaccccgccagcgcgtggacgctgtacgcggtggccaccaccatcatcacccctatgatgcggcatacgattgaaaataccaccgcgaacatatccctgaccgcaatcgcgaaccaggcagctatcctcatggggctggacaagggttggccgatctcaaagatggacatcggtgtgcccctgctcgccttgggctgctactcgcaagtgaatcccttgacgctcacagcggccgtgctgatgctggtcgctcactatgcaattatcgggcctgggctccaggccaaggcgacccgggaggcccagaagcggacggccgccggcatcatgaagaatccgacagtggatggaatagtggccatcgacctggaccccgtcgtatacgacgcgaaattcgagaagcagttgggccagataatgctcctgatcctttgcacttcgcaaatcctcttgatgcgcaccacctgggccctgtgcgagtctataacgctcgccactgggcccctaaccaccctgtgggaaggctcacccgggaagttctggaatacgaccatagcggtgagcatggcgaatatcttccgtgggtcctacttggccggtgccggcctggccttcagcctgatgaaatcactgggaggcgggcgccggggtacgggggcccaaggcgaaacacttggcgaaaagtggaaacgccagttgaaccagctcagcaagtccgagtttaacacatataagcggagcgggataatggaggtcgacaggtccgaggcgaaggagggtttgaaacgcggggagaccactaaacacgccgtgtcacgcggcaccgctaagctgcgttggttcgtggagcgcaacttggtcaaaccggaggggaaggtgattgatctgggctgtggccgcggtggctggtcctattattgtgccggtctgaagaaagtcacggaggtaaaggggtatacaaaaggcggtcccggccacgaggaaccaatccccatggccacctacgggtggaacctggttaaactacacagcggcaaggacgtgttctttgtaccgcccgagaaatgcgacaccctgctgtgcgacatcggggaatcctcgccaaacccaacgatcgaagaaggacgcaccttgagagtcctgaagatggtggagccgtggctgcgcgggaaccagttctgcatcaaaatcttaaatccctacatgccatccgtcgttgagaccctggagcaaatgcagagaaaacacggcggtatgctggtccggaaccccctctcgcgcaactcgactcacgagatgtactgggtctcatgtgggacaggcaacatcgtgtccgcggtgaacatgacctcgcgcatgctgctgaatcggttcaccatggcccaccgtaagccgacatacgagcgcgacgtagacctcggggcgggtacccggcatgtggccgtggaacccgaggtcgccaatctggacatcatcggccagcgcatcgagaacatcaagcatgagcacaagtccacgtggcactacgacgaggacaacccctacaagacctgggcgtaccacgggagctacgaagtgaagccatcgggctccgctagcagcatggtgaacggggtcgtcaagctgttaaccaagccgtgggacgtcatacccatggtaacccagatcgcaatgaccgacactactcccttcgggcagcagcgggtgttcaaagagaaggtcgacacgcgcacgcctaaggccaagcgcggcaccgcacaaatcatggaggtgaccgccaagtggctatggggcttcctgagtcgcaacaaaaagccacggatctgcacccgcgaggagtttacgcggaaggtgcgttccaacgccgccatcggcgcggtgtttgtggatgaaaatcagtggaacagcgcgaaagaggccgtcgaggatgagcggttctgggacctggtccatcgtgagcgggagctgcacaaacaggggaagtgcgcgacatgcgtctacaacatgatgggcaagcgagagaagaagctgggggagtttggaaaggccaaggggtcgcgggctatatggtacatgtggctgggcgctcggttcctagagttcgaggcacttggtttcatgaacgaggaccactggttctcacgggagaacagcctcagtggggtggaaggcgagggactacataaacttggctacatcctccgtgacatttctaaaatcagcgggggcaacatgtatgcagacgacaccgccggatgggatacccggatcacagaggacgatttacagaatgaggcgaagataacagacattatggagcccgagcacgctctgctcgctaattcaatcttcaaactcacttatcagaacaaagtagtgagagttcagcgcccagcaaagaacgggaccgtcatggacgtgatcagccgtagggaccaacggggctccggccaggtgggcacgtacggcctgaacacctttaccaatatggaggcacagttaatcagacaaatggaaagcgaagggatcttctccccgtctgagctcgagacccccaaccttgccgagcgggtcctggactggctggaaaaacacggcgtggagcgattgaagcgcatggccatcagcggggacgactgtgtagtgaagcccatcgacgaccgctttgccacggccttaaccgccctaaatgacatgggcaaggtgcgcaaggacatcccccaatgggagccgtcgaaggggtggaacgattggcagcaggtcccattctgctcccaccatttccatcagttaatcatgaaagacggccgcgagatcgttgtgccctgccggaaccaggacgagctggtcggaagggcccgcgtctcccagggggccggctggtctttacgggagaccgcctgcctagggaagtcgtacgcgcaaatgtggcagctcatgtatttccacagacgcgacctgcgactggccgcgaatgccatctgcagcgccgtgccggtggactgggtccccacaagtcgcactacctggagcatccacgcgcaccatcagtggatgacgactgaggatatgctcagcgtgtggaacagagtgtggatcgaggagaacccgtggatggaggacaagacgcacatttcctcctgggaggacgtgccctacctaggcaaacgagaggaccagtggtgcgggagccttatcggtctcaccgcgcgggccacctgggccaccaacattcaggtggccatcaaccaggtgcgccgcctgatcggcaatgaaaattatctggactacatgacgtctatgaaacgctttaagaacgaaagcgaccccgagggggccctctggtaa

SEQ ID NO: 23846 - RNA, 9879 nt, synthetic construct
  misc_feature 1..9879: note = derived and/or modified CDS sequence (opt11) from DENV-1__HM488255__SS-prME
  source 1..9879: mol_type = other RNA
agtgtcaccatgcttctgatgttaatgcccactgccctcgcgttccatctgactacacgaggaggtgaacctcacatgatcgtctcgaaacaagaaaggggaaagagcctgctctttaagacaagcgccggagtcaatatgtgcacgcttatcgcaatggacctgggtgaactgtgcgaggacactatgacgtacaagtgtcccaggataacagaagccgagccggacgatgtcgattgctggtgcaacgctacagacacttgggtcacgtacggtacatgctcgcaaacaggtgaacaccgccgcgataagaggagcgtcgccctggcaccccacgtaggtcttggcctagagacacgaacagagacatggatgtcatcagagtccgcatggaaacaaatacaacgagtcgagacttgggccctacgccacccaggatttacggtcatagccttgttccttgcacacgctatcggcacctctattacacaaaagggaatcatatttatcttgctgatgctcgtaacacctagcatggctatgaggtgcgtcggaataggatcacgagacttcgtcgagggactgagcggagcaacttgggtcgacgtagttctcgaacatgggtcatgcgtaacaacaatggcaaaggacaaacccacattagacatcgaactgctaaagaccgaagtgacaaatccagccatactacggaaactctgtatcgaggcgaagatctcgaacaccaccacagacagccgctgtccaacccaaggcgaggcaaccctagtagaggaacaagacgcgaactttgtatgtagaagaaccttcgtcgatcgcggatggggaaacggatgcggcctgttcggcaaaggcagccttattacgtgcgcaaaatttaagtgcgtcacaaaactcgaaggaaagattgttcaatacgaaaacctcaaatactccgtaatagtaacggtccacaccggggaccagcatcaagtaggcaacgagagcactgaacacggaacaacggccacaataacgccacaggcacccacaacagaaatacaattgacagattacggagccctaacgctcgactgcagcccccgcactggcctggactttaatgaaatggtactgctaacaatgaaagaaaagagctggctggttcataagcaatggttcctcgacctaccactaccctggacttccggtgcaagcacatcgcaagagacatggaacaggcaagacctgctagtcacctttaaaacggcacacgccaaaaagcaagaagtggtggtgctcggctcacaggaaggcgctatgcatacagcgctgacaggagcgaccgaaatacagacaagcgggacaacgacaatatttgcaggacacctaaagtgccggttgaaaatggataagctcacactcaaggggatgagctatgttatgtgcacgggcagctttaagttagagaaagaagttgccgaaactcaacacggaaccgttttggtccaaatcaagtacgaaggtaccgatgccccttgcaaaatacccttcagcactcaagacgagaagggggtcactcagaacgggaggctaatcacggcgaaccccatcgtaacagacaaggagaaacccgtcaatatagaagcagaacccccgtttggcgagagctacatcgtcataggagctggcgaaaaggccctgaaactcagttggttcaagaagggctccagcatcggcaagatgtttgaagcaaccgcaagaggggcccgaaggatggcaatcctaggcgacaccgcgtgggacttcggcagcatcggaggcgtattcacctccgtcgggaaactcgtacatcagatctttggaaccgcctatggagttctcttcagtggcgtaagctggacaatgaagataggaatcggtgtattattgacatggctcggcctgaacagccgtagcacgagcttgagtatgacctgcatcgctgtaggcttagtcacgctgtacttaggggtaatggtacaggcggactcgggttgcgttataaattggaaaggaagagaactcaaatgcggaagtgggatcttcgtgaccaatgaagtacacacgtggacggagcaatacaagttccaagcagattcaccaaagcgtctctccgccgcaataggaaaggcctgggaggaaggcgtgtgcggcatacgttccgcaacccgattggagaacataatgtggaaacagatatcgaacgagctcaaccacatattactggagaacgacatgaagtttactgtagtcgttggcgacgtcgcggggatattagctcaaggcaagaaaatgatccgcccacaaccaatggagtataaatacagttggaaaagttgggggaaggcgaaaatcatcggcgcggatgtacagaacacgaccttcataatagatggcccgaataccccagagtgtccggacgaccagcgggcctggaacatatgggaagttgaggactacggattcggcatcttcaccaccaacatctggctcaaacttagagactcctatactcaagtatgcgaccacaggctaatgtcggcagccataaaagactccaaagcagtacatgcagatatggggtactggatcgaatcggaaaagaacgagacctggaagctggctcgtgcctccttcattgaagtcaaaacatgtatctggccaaaatcacacacactgtggagtaacggcgtactagaaagcgaaatgataatcccaaaaatatatggcggccccataagccagcacaactacagaccagggtatttcacccagactgctggcccatggcatttgggaaagctcgagctggatttcgacctatgtgaaggaacgactgtcgtagtcgatgagcattgtggcaatcgcggaccatccctacgcacaacaacggtaacagggaaaattatacatgagtggtgctgcagatcctgtaccttaccacctcttaggttccgcggcgaagatgggtgctggtacggcatggaaataagacccgtcaaggaaaaagaagaaaacctggtgaaaagcatggtgagcgccggcagcggtgaggtagacagcttctccctaggactgctctgcataagcatcatgattgaagaagtaatgcgttctcggtggagccggaagatgctaatgacaggtacactcgctgtcttcttgctactaataatggggcagttgacgtggaacgacttgattcggctatgcatcatggtgggagccaacgcaagcgacaggatgggaatgggaacgacctacctcgcactcatggcaacgttcaaaatgaggcccatgttcgcagtaggcctactcttcaggcgactgacttcccgggaagtcctactactgaccatcggcctatctctggttgctagtgtggaactcccgaactccctagaggaattgggcgatggactagctatgggcataatgatactcaaattactaaccgacttccaaagtcaccaactatgggcaaccctcctaagcctcaccttcataaagacgacgttcagcctacattacgcgtggaaaaccatggcaatggtcctctcgattgtcagcctttttccactctgcttgtcaacgacaagccagaaaacaacatggctgccggtcctactcggcagcctcggatgcaagcccctgacaatgttcctaatagccgagaacaaaatatgggggagaagaagctggcctctgaatgaaggcataatggcggtcggtatcgtgagcatactactcagttccctattgaaaaacgacgtacccttagcagggccgctcatagcaggaggcatgctcatcgcatgctacgtaatctcgggtagtagcgccgatctgtctctggaaaaagcagcagaagtcagttgggaagaagaggcagaacactctggtgcctctcacaacatactggtcgaggtgcaagacgatggcacaatgaaaataaaagacgaagaacgcgacgataccttaacaatactcttgaaggcgacacttctagcagtaagcggggtctacccactctctatacccgccacgctgttcgtttggtatttttggcagaaaaagaagcagagaagcggggtcctgtgggacacacctagtccacccgaagttgagcgggcagtactcgacgacggcatatatcgaataatgcagcgtggattacttggccgctcacaggttggggtcggagtgttccaagaaaatgtatttcacaccatgtggcacgtcacaagaggtgccgtactgatgtaccaaggaaagcggttggaaccaagttgggcctccgttaagaaggatctcatatcatacggtggcgggtggaggctccaggggagctggaacacgggtgaggaagtgcaagtcatcgcggtagagccaggtaaaaaccctaaaaatgtccagacggcacccggtacgttcaagactcctgaaggcgaagtaggtgcgatagcccttgacttcaagcccggtaccagcggaagtccaatagtgaaccgggaaggaaaaattgttggactatacgggaacggagtggtcacgacaagcgggacgtacgtctccgcgattgcacaagcgaaagcatcacaggaagggcccctgcccgaaattgaagacgaggtatttcgaaaacgcaacctcactataatggacctccatccgggctctggcaagacgcggcgatacctcccagcaatcgtcagggaggccataaagagaaaattgcgtacgctaattctagccccaaccagggtagtagcgtcagaaatggcggaagccctaaaaggaatgccgatacgataccaaacaacggcagtgaaatcagaacacaccggcaaggagatagtcgacctaatgtgccacgcgacgttcactatgcgactcctatcgccagtgagggtccctaactacaacatgataataatggacgaggctcacttcactgatccttcatcgatagctgctagaggctacatttccactcgagtaggaatgggcgaagccgctgccatttttatgaccgccacacccccgggatcagtggaagcgttcccacagagcaacgcggtgatacaagatgaggaacgagacataccagaaaggtcatggaacagcggttatgagtggataactgactttcccgggaaaacagtgtggttcgtacccagcataaaatcaggaaacgacatagcaaactgcttacgcaagaacggaaagcgcgtcattcaactaagccggaaaaccttcgacaccgaataccagaaaacgaagaacaacgactgggactacgtcgtgaccacggatatctctgaaatgggtgctaactttcgagccgatagggtgatagacccacggcgttgtttgaagcccgtaattctcaaggacggcccagaacgcgtaatactagcagggcccatgccggtcacagtagccagcgcagcccagcgacggggccgaatcgggcgcaaccataacaaggaaggcgatcagtacatctacatgggacagcccctaaacaacgatgaagaccatgcccattggaccgaggccaaaatgctgctcgacaacataaacaccccagaagggataataccagccctatttgaacccgagcgcgagaaaagcgcagccatagacggcgaataccgactccgcggggaggcacgaaaaacattcgtcgaattgatgcgcagaggggatctaccagtctggctaagctataaagtcgcaagcgaaggcttccaatacagcgaccgccgctggtgtttcgacggagaacggaacaaccaggtattagaagaaaatatggacgtcgagatctggacgaaggaaggcgagcgcaagaaattgagaccccggtggctggacgccagaacttactccgacccactagcgttaagagagttcaaagaatttgccgcaggtagaaggagtgtaagtggcgacctcatactagaaatagggaaactccctcagcacttgacgcagagagcacagaatgcactggacaacctggtaatgctccacaactcagaacaagggggacgcgcgtataggcatgctatggaagaacttccagacacaatcgaaactctcatgctgctcgctcttatagcggttctcaccggtggcgtgacactcttctttctcagtgggagggggttaggtaagacaagtatcggattgctctgcgtaatggcatcaagcgtgctgctttggatggcgtccgttgagccacactggatcgccgcctccatcatcttggagttctttctgatggtcctactgataccggagcccgaccgtcagcggacgccccaagacaaccaactcgcgtacgtagtcattggtctgctattcatgatccttacggtagcggctaacgaaatggggctactcgaaacaaccaagaaagaccttggaataggacacgtcgcggtagggaaccaccaccacgctgcgatgctggacgtggatttacacccagccagcgcatggacgctctacgcagtcgcgacgacaattatcacgccaatgatgcggcacactatagagaacacgacagcgaacatctctttaaccgcaatcgcaaatcaagcagctatcttaatgggactcgacaaaggatggcctatctcgaaaatggacatcggcgttcccctgctggccctaggatgctacagccaagtcaatcccctcacactaaccgccgccgtactaatgttagtcgcgcattacgcgattataggccccggcctgcaggccaaggcaacccgtgaagcgcagaagcgtaccgctgcgggcatcatgaagaatccaacggttgatgggatagtcgcaatcgatctggatccagtcgtctacgacgcaaagttcgaaaaacaactcggacaaatcatgctcttaatactgtgcaccagccaaatactgcttatgcgcacgacgtgggcactctgtgaaagtataacgctagcgaccggacccctgacaacgctttgggaaggatcaccaggtaaattttggaacacaacgatcgcggtgtccatggcgaatattttccgcggcagctacctggctggagcgggattggccttctcacttatgaaatcactaggaagaggaagaagaggaacgggagcgcaaggagaaactctcggagaaaaatggaagcgacaactcaatcagctcagtaagagtgaatttaacacctacaagcgaagcggcatcatggaggtcgacagaagtgaagcgaaagaaggtcttaaacgaggcgagacaactaagcatgctgttagccgaggaacagcaaaactccgatggttcgtcgaacgaaacctagtcaaaccggaggggaaagtaatagacctaggttgtgggcggggcgggtggtcatattattgcgcaggcctcaaaaaggtaacagaagtcaaggggtacacaaagggaggcccaggtcacgaagaaccgataccgatggcaacgtacggctggaacctagtcaaactgcactcagggaaagacgttttcttcattcccccagaaaaatgtgacactctgctgtgtgacataggggagtcctccccaaaccccacaatagaggaagggcggactcttcgagtactaaagatggtagagccctggttgcgcggtaaccaattctgcataaagatccttaatccctacatgccaagcgtagtagagacgctggagcaaatgcaacgaaagcacggaggcatgctggtccgcaaccccctctcgaggaatagcacacacgaaatgtactgggtctcttgcggaactggaaacatagtatccgcggtcaacatgacgtctaggatgctactgaataggttcacaatggctcacaggaaacccacctacgaaagggatgtggaccttggggcagggaccaggcatgttgcagtcgaaccagaggtagcaaatctcgatataataggccaacgtatagagaatattaagcacgagcataagtcgacgtggcactatgacgaggacaatccgtacaaaacctgggcctaccatggcagctacgaagtgaagcccagcggaagcgcctcaagcatggtgaacggcgtcgtgaaactgttgaccaaaccgtgggacgtgatacccatggtgacccaaattgcaatgacagataccacaccattcggccagcaacgagtattcaaagagaaggtggatacgagaacaccgaaggccaaacgcggaacagcccagatcatggaagttacagccaagtggttgtggggcttcctatcaagaaacaagaaaccgcggatttgcacgcgggaggagttcacccgcaaggtgagaagtaacgcagccatcggcgcagtcttcgtggacgagaaccaatggaactccgcgaaggaggcagtggaggacgagagattttgggacctcgtgcatagagaacgagaactccataagcaaggaaagtgtgccacatgcgtctacaatatgatgggaaaaagagaaaagaaactcggggagttcggcaaggcaaagggcagccgggccatatggtatatgtggctgggtgccaggtttctagagttcgaggcgctcggcttcatgaacgaagatcactggttctcacgggagaacagcctatctggcgtagaaggtgaaggcctccacaagctcggatacatcctaagggacatatccaaaatcccgggcgggaacatgtatgccgacgacacggctggatgggacacccgcataacagaggacgatctgcaaaacgaagctcgcataaccgacataatggagcctgaacacgcgctactagcgaagtcaatatttaaactaacctaccaaaacaaggtagtacgtgtacaaagaccagcgaaaaacgggacagtaatggacgtcatttcccgacgcgaccagagaggaagtggccaagtcgggacgtacggcctcaatacgttcacgaatatggaagcacaattaatacggcagatggagagtgaaggaatattcagcccgagtgaactggagacacccaatcttgccgagcgggtattggattggctggaaaagtacggggtggagcggctaaaaagaatggcaattagcggagacgattgcgttgtaaagcccatcgacgaccgattcgccacagctctgaccgcgttaaatgatatgggaaaagtgcgtaaagacattcctcaatgggagccctcgaaagggtggaacgactggcaacaggtaccattctgcagccaccactttcaccagctcatcatgaaggacgggagggaaatcgtagtcccgtgccggaaccaggacgaattagtcggccgggcccgagtaagtcaaggggccggttggtcactccgagaaacagcctgtttgggaaagagctatgcgcaaatgtggcagctaatgtactttcaccgaagagacctacgcttagcagcgaacgccatctgcagcgcagtgccagtagactggatcccaacatcaagaaccacatggagcattcacgcgcaccaccagtggatgacaaccgaagacatgctatctgtgtggaaccgcgtatggatcgaagagaatccttggatggaagacaaaacccacatatccagctggggagatgtgccctacttaggcaaacgagaggatcaatggtgtggaagtctcataggactgaccgcaagagccacctgggccacaaatatacaggttgcaatcaaccaggtgaggagattgatcgggaacgagaactacttggactacatgaccagcatgaaaaggtttaagaacgaatccgatcccgaaggggctctatggtag

SEQ ID NO: 23847 - RNA, 9879 nt, synthetic construct
  misc_feature 1..9879: note = derived and/or modified CDS sequence (opt11) from DENV-1__HM181944__SS-prME
  source 1..9879: mol_type = other RNA
agcgtgaccatgctgctcatgctgatgccgactgccttagccttccacctcaccacccgggggggggagccccacatgatcgtgagcaaacaggagcggggtaagagcctgctgttcaaaacctccgccggcgtgaacatgtgcaccttaatcgccatggacctgggcgaactatgcgaggataccatgacctacaagtgccccaggattagcgaggccgagccagacgacgtggactgctggtgcaacgcaaccgatacctgggtgacgtacgggacctgctcccaaaccggggaacaccggcgcgataaacggagcgtggccctcgcgccccacgtcggcctgggattagaaacccggacggagacatggatgtcctcagagggcgcctggaaacagatccagcgcgttgagacctgggccctccgccaccccgggtttaccgttatcgccctgttcctagcccacgccatcggtacttccatcacccagaaggggatcatcttcatccttctgatgttagtgaccccgagcatggccatgcggtgcgtcggcatcggctcccgcgatttcgttgagggtctcagcggcgcgacctgggtggacgttgtgctagagcacgggtcctgcgtgactaccatggccaaggacaaacctaccctggacatcgagctcctgaaaaccgaggtcacgaaccccgcggtgcttaggaagctctgcatcgaggcgaaaatcagcaacaccaccaccgactcgcgctgtccgacgcagggcgaggccaccctggtggaggagcaggacgcaaacttcgtctgccggcgcacattcgtggatcggggctggggtaacggctgcggtctattcggcaaagggagcctcatcacgtgcgccaagttcaagtgcgtgaccaagctggaggggaagatcgtccagtacgagaatctgaagtactccgtaatcgtgactgtccataccggagatcaacaccaggtggggaatgaaagcaccgagcacggcacgactgcaaccatcacgccccaagctccatccactgagatccagttgacggactacggggcgctgacactggattgctcgccccgcaccggcctcgacttcaacgagatggttttgttaacaatgaaggagaagtcctggctggtgcacaaacagtggttcctagacctaccgttgccctggacgtccggggccagtacttcccaggagacatggaaccggcaggacctactggtgaccttcaagacagcccacgcgaagaaacaggaggtcgtagtgcttggctcacaggagggcgccatgcacaccgcccttaccggggccaccgaaatccaaacttccggcaccacaaccatattcgccgggcatctgaagtgccgactcaagatggacaagttaaccctgaagggcatgtcttacgtcatgtgcaccgggtcattcaaactcgagaaggaggttgcggagacccagcacggcaccgtgctggtccagatcaagtacgagggaacggatgccccgtgtaaaatccccttctcaacccaggacgagaagggggtaacccagaacggcagactaatcaccgccaacccgatcgtgacggacaaggagaagcccgtcaacatcgaggccgaaccaccctttggggagtcctatatcgttatcggagcgggcgagaaggccctgaagctctcttggttcaaaaaggggtccagcatcgggaagatgttcgaggcaaccgcccgcggagcccggcgcatggctatccttggtgatacggcatgggacttcgggtccatcggcggagtgttcaccagcgtcggtaagctggttcaccagatctttggcacggcatacggggtgctgttctccggcgtcagctggaccatgaagatcgggattggtgtgctgctgacctggctcggcctgaactcccgctcaacctccttgagcatgacgtgtatcgccgtggggctcgtcacactgtacctgggcgtgatggtgcaggcggacagcgggtgtgtgatcaactggaagggccgagagctcaaatgtggttccggcattttcgtgaccaacgaggtgcacacctggacggagcagtacaagtttcaagcagactctccgaagcggctgtccgccgccataggcaaggcgtgggaggagggggtctgcggcatccggagcgccacacgtctggagaacatcatgtggaagcagatctccaacgagctcaaccatattcttctggagaatgatatgaagttcaccgtggtggttggggacgtggcgggcatcctcgcccagggtaagaagatgatacgcccccaacccatggagtacaagtattcctggaaatcctggggcaaggccaaaatcatcggggccgacgtacagaacacgacattcatcatcgacgggcccaacacgccggagtgccccgacgaccagcgcgcctggaacatctgggaggtcgaggattacggcttcggaatcttcactaccaacatctggctcaagttgcgggatagctacacgcaggtgtgcgaccaccgcctcatgtcagccgcaatcaaggatagcaaggccgtgcacgccgacatgggctactggatcgagtccgagaagaatgagacgtggaagctcgcacgggcgagctttatcgaagtcaaaacctgcatctggcccaagtcccacacgctgtggagcaacggcgtcctcgagtccgagatgattatccccaaaatttacgggggacctatcagccagcacaactaccgccccgggtatttcacacaaacggccggcccctggcacttgggcaagctggagctggacttcgacctatgcgaaggcaccactgtggtcgtggacgagcattgtggcaatcgggggccgtcgctgcgcaccacaaccgtgaccggcaagatcatccatgagtggtgctgccggagctgcaccctgccgcccctccgcttcaagggggaggacggctgctggtacgggatggagatcaggccagtaaaggagaaggaggaaaacttagtcaagagcatggtgtccgccggcagcggcgaggtcgactccttctccctcgggctgctgtgtatctccatcatgatcgaggaggtgatgcgttcacggtggtcccgcaagatgctcatgacgggaaccttggccgtcttcttccttctcatcatggggcagctgacatggaatgacctgatacggctctgcataatggtcggagctaacgccagcgaccgcatggggatgggaatgacctacctggccctgatggccacctttaagatgcgccctatgttcgccgtgggcctcctcttccggcgcctgacctccagagaagtgttactactgaccattgggcttagcctcgtggcgtcagtggagcttccgaacagcctcgaggagctgggcgacgggctagctatgggcatcatgatcctgaagttgctgaccgactttcagtcccaccagctctgggcaacacttctttccctcaccttcatcaagaccaccttcagtctgcactacgcctggaagacgatggcgatggtcttgagcattgtgagtttattccccctgtgcctgtcaaccacctcccagaagacgacgtggctgcccgttctactgggtagcctcgggtgcaagccgttgactatgttcctaatcgccgagaacaagatctggggccgcaagagctggcccctcaacgaagggatcatggccgtcggcatcgtgtccatactgctgagctccctactgaaaaatgacgtgccactggctgggccactcatcgcaggcggcatgctgatcgcgtgctacgttatcagcggttccagcgcggacctgtcccttgagaaggcagctgaggtaagctgggaggaggaggccgagcacagcggggcgtcccacaatatcctggtcgaagtccaggacgacgggaccatgaagatcaaagacgaggagcgggacgacaccctgacgatcctcctgaaagccaccctgctcgccgtgtcaggcgtatacccgctgagcatccccgccaccctgttcgtctggtacttctggcaaaagaaaaaacaacgctccggggtactctgggacacccctagcccgccagaggtggaacgggccgtgctggatgacggcatctaccgtatcatgcagcggggtttattggggcgctcccaggttggcgtgggcgtattccaggaaaatgttttccataccatgtggcatgtgacgcggggagccgttctcatgtaccagggtaagcgcctagaacccagctgggcctccgtgaaaaaggacctgatcagctacggcggcgggtggcggctccaagggtcctggaacaccggggaggaggtgcaggtcatcgccgtagaacccggcaagaaccccaagaacgtacagacggcgcccggcaccttcaagacgagcgagggcgaggtcggcgccatcgccctcgacttcaagccaggtacctccggctcccccatagtaaatcgggaggggaagatagtgggcctatacggtaacggggttgttaccaccagcggcacgtacgtgtccgccatcgcccaggccaaggccagccaggaagggcccctcccggagatcgaggatgaagtcttccggaaacgcaacctgacgatcatggacctgcaccccggctcggggaaaacccggcgctatctgcccgccatcgtgcgggaggctattaagcggaagcttcggaccctgatcctcgcgccgacgagagtggtcgcaagcgagatggctgaggccctgaagggcatgccaattcgctaccaaactaccgcagttaagtctgagcacaccggcaaggagattgtagacctcatgtgccacgcaactttcaccatgcggctcctgagcccagtccgcgtccccaactacaacatgataataatggacgaagcccacttcacagacccgtcctccatcgcggcccgagggtacatctccacccgtgtgggcatgggcgaggccgccgccatcttcatgactgcgacaccccccggcagcgtcgaggcctttcctcagtccaacgccgtaatccaagacgaggagcgggacatcccggaacgtagctggaactccgggtacgagtggatcaccgacttccccggcaagaccgtgtggttcgttcccagcatcaagtccggcaacgatatcgcgaattgcctgcggaagaacgggaagagggtcatacagctcagccggaagacgttcgacaccgagtaccagaagacgaaaaacaacgattgggattacgtggtcaccacggacatttccgagatgggcgctaacttccgcgcagaccgggtgatagaccctcgccggtgcctgaagcctgtgatactgaaggatggtcccgagcgcgtcatattagcaggccccatgcccgttaccgtagccagcgccgcgcaacggcgtggacggatcggccggaatcacaacaaggagggcgaccagtacatttacatggggcaaccgctgaataacgatgaggaccacgcccattggaccgaggcaaaaatgttgctcgacaacatcaataccccggagggaatcatccccgccctgttcgagcccgagcgagaaaagtccgccgcgatcgacggggagtaccgcctgcgcggcgaggcgcggaagaccttcgtggagctcatgcgccgcggggacctaccagtgtggctgtcctacaaggtcgccagcgagggcttccagtactcggaccgccggtggtgcttcgacggcgagcgcaacaatcaagtgctcgaggaaaacatggacgtggagatctggactaaagagggggagcggaagaagctgcgcccgcggtggctggacgcccgtacgtacagcgaccctctcgccctgcgggagttcaaggaatttgcggccggccggcgatcagtctccggggaccttatcttagagatcggcaaactcccccagcaccttacgcagcgcgctcagaacgcccttgacaacctggtgatgctgcacaactccgagcaaggcggtcgggcttaccgccacgccatggaggagctaccggataccatcgagaccctgatgctgctcgccctgatcgctgtgctgacagggggggtaacgcttttcttcttgagtggccgggggctggggaagacgtccatcggcctcctgtgcgtgatggcaagcagcgtgctgctgtggatggccagcgtcgagccccactggatcgccgcctcgatcatcctggagttcttccttatggtgctcctaatcccagagcccgatcgtcagcggaccccgcaggacaaccagttggcgtacgtggtaatcggtctcctgttcatgattctgactgtggccgcgaacgagatgggcctcctcgagaccacaaagaaagacctggggataggccatgtggctgtagagaaccaccatcacgccgcaatgctagatgtggacctgcaccccgctagcgcgtggacgctgtacgcagtggccaccaccatcatcacccctatgatgaggcacaccattgagaacaccaccgcgaacatctccctcactgccatcgcgaaccaggcggccatcctgatggggttagataagggttggccgataagtaagatggatatcggcgtccccctcctggccctgggatgctactcccaagtgaacccactcaccctcaccgcggccgtgctgatgctcgtcgcccactacgccatcatcggccccgggttgcaagccaaggccacccgggaggctcagaagcgtaccgcagcgggcatcatgaagaacccgacggtggacggtatcgtggccatcgatctggaccctgttgtttacgacgctaagtttgagaagcagctcggccagattatgctcctgattttgtgcaccagccagatccttctaatgcggaccacttgggccctctgcgaatccatcacgctggcaactggcccgctgactaccctctgggaggggagtcccggaaaattctggaacactaccatcgccgtgtctatggccaacatcttccggggatcctacctggcgggcgcaggcctcgccttcagcctcatgaagtccctcgggggggggcggagggggaccggggcccagggagagaccctaggcgaaaagtggaaacgccagctcaaccagctatcgaagtccgagttcaacacatataaacgtagcgggatcatggaggtcgatcgctccgaagccaaggagggcctgaagcgcggggaaacgactaagcatgccgtgtcacgaggcaccgccaagctccggtggtttgtggagaggaacctggtcaagccggaggggaaggtgatcgatctgggctgcggccgcggcgggtggtcttactattgcgccgggctgaagaaggttacggaagttaaagggtacaccaagggcggccccggtcacgaggagcccatccccatggctacctacgggtggaatctcgttaagctgcactcaggcaaggacgtatttttcgttcccccagaaaaatgtgacaccttactttgtgatatcggcgagtcaagccccaatcccacaatcgaggaaggtcgtaccctacgagtcctgaagatggtggagccgtggctgcgcggcaaccagttctgcataaagatcctgaacccgtacatgcccagtgttgtggagaccctggagcagatgcaacgcaagcacggcggcatgctcgtgcgcaacccactgagccggaactccacccacgagatgtactgggtcagctgcggcacgggcaatatcgtgtccgccgtgaacatgaccagtcgcatgttgctcaatcggttcaccatggcccaccgaaaaccgacctacgagagagacgtggacctgggggccggcacccggcacgtggctgttgagcctgaggtcgccaacttggacatcatcggccagcgcatagagaacattaagcacgaacacaagtccacatggcactacgatgaggacaacccctacaagacctgggcttatcacggatcgtacgaagtgaagccctcaggctctgcgagttccatggtcaacggggtggtgaagctccttaccaaaccgtgggacgtcatccccatggtgacccaaatcgccatgacggacactacccccttcggccagcagagggtgttcaaggagaaggtagacactcgcaccccaaaggccaagagagggaccgcacagatcatggaggtgacggccaagtggctatggggcttccttagccgcaacaagaagccgcgtatttgcacccgggaggagttcacgcggaaagtacgctccaacgccgccatcggcgccgtctttgtggacgagaaccagtggaactcagcgaaggaggccgtggaggacgagcggttctgggacctggtccaccgcgagcgggagctgcacaagcaagggaaatgcgcgacctgcgtgtacaacatgatgggaaagcgcgagaaaaagctgggtgagttcgggaaggccaaggggtcccgggccatctggtacatgtggctgggcgcacgctttctggagtttgaggctctcggcttcatgaacgaggaccactggttcagccgggaaaactcgctgagcggagtagaaggggaagggctgcacaagctcggttacattctgagagacatctccaagatcagcgggggcaatatgtacgccgacgacaccgctggctgggatacccggattactgaggatgacctgcagaacgaggccaagataaccgacatcatggaacccgagcacgcgcttctggccaactccatatttaagctgacctaccagaacaaggtcgtgagagtgcagcggcccgccaagaacgggaccgtcatggatgtgatcagtagacgcgatcagcgcgggtccggccaagtcggtacatacggcttaaacaccttcaccaacatggaggcccagctgattcgccagatggagagcgaggggatcttttccccgtccgagctggagacccccaacctcgctgagcgggtcctggactggctggagaagcatggcgtggagcgcctcaagcggatggcgatcagcggggatgactgcgttgtcaaacccatcgacgatcgcttcgcaacggctctgaccgccctgaacgacatgggtaaggtgcgaaaggacatcccccagtgggaaccgtccaaggggtggaacgactggcagcaggtccccttctgcagccaccatttccatcagttgataatgaaggacggcagggagatagtggtaccctgtcggaaccaggatgagctggtgggacgcgcccgggtctcccagggtgccggctggagcttaagggagaccgcctgcctggggaagagttacgcgcagatgtggcagctgatgtacttccaccggcgtgacttacggctcgccgcgaatgccatctgcagcgccgtgcccgtggactgggtcccgacctccaggacgacgtggtcgatccacgcccaccaccagtggatgaccacagaggacatgttatcagtgtggaatcgggtgtggatcgaagagaatccctggatggaagacaagacacacatcagttcctgggaggacgtcccctacctggggaagcgggaggaccagtggtgcgggtccctcatcggcctgaccgcccgagcgacctgggccaccaacatccaggtggccatcaaccaggtgcgccgtcttatcggaaatgagaactacctagactacatgacgtcaatgaagcggttcaagaacgaaagcgaccccgagggagccctgtggtag

SEQ ID NO: 23848 - RNA, 9879 nt, synthetic construct
  misc_feature 1..9879: note = derived and/or modified CDS sequence (opt11) from DENV-1__HM181946__SS-prME
  source 1..9879: mol_type = other RNA
agcgtgactatgttgcttatgctgatgcccaccgccctggcattccacctcaccacccgcggcggggagcctcatatgatcgtgagcaagcaggagcgcggcaagagcctgctgtttaagacctccgccggggtgaacatgtgcaccctcattgccatggacctgggcgaactgtgtgaggataccatgacctacaaatgcccccgcataaccgaggccgagcccgacgacgtggactgctggtgcaacgccaccgacacgtgggtcacttatgggacctgcagccagacaggcgagcaccggcgcgacaagcgatccgtggcgctcgctccccacgtggggttagggttagagacgcgcaccgagacctggatgagctccgagggcgcgtggaagcagatacagcgggtggagacctgggccctcaggcaccccgggttcacggtgatcgccctgttcttggcgcatgccatcggcaccagcatcacacagaaggggataatcttcatcctcctgatgttggtgaccccctccatggccatgcggtgcgtcggcatcggcagccgtgacttcgtggaagggctctccggcgccacgtgggtggacgtcgtgcttgagcacgggagctgtgtgaccaccatggccaaggacaagcccaccctcgacatcgagctcctgaagacggaggtcaccaaccccgcgatcctgcgaaagctctgcattgaggccaagatctccaacaccacaaccgacagtcgctgccccacccagggcgaggccaccctggtggaggaacaggacgccaatttcgtgtgccggcgcacctttgtcgaccggggctgggggaacggctgcgggctgttcggcaaggggagtctcatcacgtgcgccaagttcaagtgcgtgaccaagctggagggcaagatcgttcagtacgaaaacctgaagtacagcgtcatcgtgaccgtgcacaccggcgaccaacaccaggtcgggaacgaatccacggagcacggaaccaccgcgaccatcacgccccaagcccccacgaccgagatccagctcaccgactacggggccctgaccctggactgcagcccccgcacggggttggacttcaatgagatggtgcttctgaccatgaaggagaaatcctggttagtccataagcagtggttcttagacctgccgttgccctggaccagcggggccagcacatcacaggagacgtggaacaggcaggacttgctggtcaccttcaagaccgcccacgctaaaaagcaggaggtggttgtcctcggcagccaagagggcgccatgcacaccgcgctgacgggggccaccgagatccagacttccggcaccacgacgatcttcgccgggcatctgaaatgccgcctcaaaatggacaagctgaccctgaaggggatgagctacgtcatgtgcaccggctctttcaagctcgagaaggaagtcgcggagacgcagcacggcaccgtgctggttcagattcgttacgagggcaccgacgccccctgcaagatccctttcagcacccaggacgagcgcggggtcactcagaacggccggctgatcacagccaacccgatcgtcaccgataaggagaagcccgtgaacatcgaggccgagccgcccttcggggagtcctacatagtcattggcgcgggcgagaaggctttgaagctctcatggttcaagaaagggtccagcatcggcaagatgttcgaggctacggcccgaggggcccgccggatggcgatcctgggcgacacggcctgggacttcgggtccatcggcggcgtgttcaccagcgtagggaagctggttcaccaaatattcggcaccgcttacggggtcctcttctcaggcgtgagctggaccatgaagatagggataggcgtcctgctgacgtggttaggcctcaactcccgctcaacgtccttcagtatgacctgcatcgccgtgggccttgtaaccctctacctcggcgttatggtgcaggccgacagtgggtgcgtgataaactggaagggccgagagctgaaatgcgggagtggcatcttcgtcacgaacgaagtccatacctggaccgagcagtataagttccaggcggacagcccgaagcgcctctctgccgccatcggcaaggcctgggaggagggggtgtgcggcatccggagcgctacacgcctggagaatatcatgtggaagcagatctctaacgagctgaaccacatcctcctggagaatgacatgaagttcaccgtcgtggtgggggacgtcgctggcatcctggcccaggggaagaagatgatcaggccccagcccatggagtacaagtactcgtggcgctcctggggcaaggccaagatcatcggggcagacgtgcagaatacgacatttatcatcgacgggcccaataccccggagtgcccggacgaccagcgggcgtggaacatctgggaggtggaggactatggcttcgggatctttacaacgaacatctggctcaagctgcgcgacagctacacccaggtctgcgaccaccggttgatgagcgccgccataaaggacagcaaggccgtgcacgccgacatgggctactggatcgaatccgagaagaacgagacctggaagctcgcgcgcgccagcttcatcgaggtgaaaacctgtatctggcccaagtctcacacgctgtggagcaacggtgtactggagtccgagatgataatccccaagatctacgggggcccgatctcccagcacaactaccggccggggtatttcacccagaccgccggcccctggcacctcgggaaattagagctggacttcgacctctgcgagggaaccacggtcgtggtcgatgagcactgcggcaacagagggccgtccctgagaacaaccaccgtgacgggcaagatcatccacgagtggtgctgccgcagctgcaccctgccccctctccggttccgcggggaggacggctgctggtacgggatggaaatccggcccgtgaaggagaaggaggagaatctggtcaagtccatggtgagcgccggctcgggcgaggtggactccttctctctggggttgctgtgcatctcgataatgatagaagaggtcatgcgctcacgctggtcccggaagatgctgatgaccggcacactcgccgtgttcctgctgctcatcatggggcagctgacgtggaacgacctcatccgcctctgtatcatggtgggcgccaacgccagcgacaggatggggatgggcaccacgtaccttgccctgatggccaccttcaagatgcgacctatgttcgccgtcgggctcctgttccggcgtctgacgtcccgggaggtgctcctgctgactatcgggctcagtctggtggcgtccgtcgagttgcccaacagcttggaggagttaggtgacgggctggcgatgggcatcatgatcctgaagctgttaaccgacttccagtcccatcagctctgggccaccctgctgagccttacgttcatcaagaccaccttctccctgcactacgcctggaagaccatggcgatggtactgagcatagtctccctctttcccctgtgcctgagcacaacctcccagaagaccacctggctccccgtgctgctgggcagcctcgggtgcaagccgctgacgatgttcctgatcgccgagaacaagatctggggcagacggtcctggcccctaaatgagggtatcatggccgtgggcatcgtcagcatcttgctgagctccctcctgaagaacgatgtgcccctggccgggcccctcattgcgggcggcatgctgatcgcgtgctatgtgatctcagggtccagcgccgacctgtcccttgagaaggccgccgaggtcagctgggaggaggaggccgaacacagtggcgcgagccacaacatactagtcgaagtgcaggacgacgggaccatgaagatcaaggatgaggagagggacgacacactgaccatcctcctaaaggccaccctgctagccgtatccggcgtgtacccgctgagcatccccgccaccctgttcgtgtggtatttctggcagaagaaaaagcagcggtccggggtcctctgggacactccgagcccgccggaggtggaaagagccgtgctggacgatggcatctaccggattatgcagcgcggcctgctgggtcggtcccaggtcggcgtgggggtgttccaggagaacgttttccatacgatgtggcacgtcactcgaggcgctgtgctcatgtaccagggcaagcggctggagcccagttgggccagtgtcaagaaggacttaatcagctacggtggcgggtggcgactccagggctcctggaacacgggagaggaggtccaggtgatcgccgtcgagcccggcaagaaccccaagaacgtgcagaccgcccccgggaccttcaagacccctgaaggcgaggtgggcgccatcgcgctggacttcaagcccgggacgagcggatcccccatcgtcaacagggaagggaagatagtaggcctgtacggcaacggggtggtcaccacctcaggcacgtacgtgagtgccatcgcccaggccaaggcgtcacaggaggggccactcccagagatcgaggacgaggtcttccgtaagcggaacctgacgataatggacctgcatccaggcagcgggaagacccgccgctacctccccgcaatcgtccgggaggccatcaagcgcaagctgcggaccctcatcctcgcccccacccgcgtggtggccagcgagatggcggaagccctgaagggcatgcccatccggtaccaaacgaccgccgtcaaaagcgagcacaccgggaaggaaatcgtggacctgatgtgccatgccaccttcacgatgcgcctcttgtcccccgtgcgggtaccgaactacaacatgatcatcatggacgaggcccacttcaccgacccgagctccatcgcggccaggggttacattagcacccgggtgggcatgggggaggcagcggccattttcatgaccgcaacgcctcctggctccgtagaggcgttcccgcagagcaatgccgtcatccaggacgaggagcgcgatatccccgagcggtcctggaacagcgggtacgagtggatcaccgatttcccaggtaagacagtttggttcgtgccctctatcaagagcggcaacgacatcgccaactgcctgcgcaagaacggcaagcgtgtcatccagctctcccgcaagaccttcgacacggagtaccagaagaccaagaacaacgactgggattatgtggttaccaccgacatcagcgagatgggcgcgaacttccgggccgaccgcgtgatcgacccgcggcgctgcctgaagcccgtgatcctgaaggacgggcctgagcgggtgatcctcgccggcccaatgccggtaacggtggcatccgccgcgcagcgccgcgggcggatcggccgcaaccacaacaaagagggcgaccaatacatctacatgggccagcctctaaacaacgacgaagatcacgcccactggaccgaggccaagatgctgctcgataacattaacacccccgaggggatcatccccgccctgttcgagccagagcgggagaagagcgccgcgatagacggggagtaccgcctgcggggcgaggcccgcaagacctttgtggagctcatgagacgcggggacctgcccgtgtggctgtcctacaaagtcgccagcgaaggcttccagtactcagacagaagatggtgcttcgacggcgagcggaacaaccaggtgctcgaggagaacatggacgtggagatctggacgaaggagggagagcgcaagaagctgcggccgagatggctggacgcccggacctactccgacccccttgccctgcgcgagttcaaggaattcgcggctggccggcgcagcgtgtccggggacttgatcctcgagattggaaagctgccgcagcacttaactcaacgggcccagaacgccctcgacaacctggtcatgttacacaacagcgagcagggcgggcgcgcgtaccggcacgccatggaggaactccccgacaccatcgagacgctgatgctgctcgccctgatcgccgtgctgaccggcggcgtgaccctcttcttcctgtccggtcgggggctgggcaaaacgagtatcggactcctgtgcgtcatggcctccagcgtgctgctctggatggcgtccgtggagccccactggatagccgcctctattatcctcgaatttttcctgatggtcctcttgatccccgagcctgaccgccagaggacgccccaggacaaccagctggcctacgtcgtgatcggcctcctgttcatgatactgacggtcgccgcgaatgagatgggcctcctggagaccacaaagaaggacctggggatcggccacgtggccgtggggaaccaccaccacgccgccatgctcgacgttgacctgcaccccgccagcgcgtggaccctgtacgccgtggccacgaccatcatcaccccgatgatgcgccacaccatcgagaacaccaccgcgaacatctcgctcaccgcgatcgcgaatcaggccgccatcctgatgggcctggacaaggggtggcccatctccaagatggacatcggggtgcccctcctggccctcggctgctacagccaggtcaaccccctcacactgacggcggccgtgctgatgctcgtggctcactacgccatcattgggccggggctgcaggccaaagcgacccgggaagcccagaagcggaccgccgccgggatcatgaagaaccccactgtggacggcatcgtggcgatcgacctggaccccgtggtctacgacgctaagttcgagaagcagctcggccagatcatgctgctaatcctctgcacgtcccagatcctgctgatgcggaccacctgggctctttgcgagagcatcaccttagccacggggcccctgaccaccctctgggaggggtccccggggaaattctggaacaccacgattgccgtgagcatggccaacatcttccgcggctcctacctggcgggcgccgggctagccttcagcctcatgaagtccctgggcgggggccggcgcggaacaggcgcccagggcgagaccctgggcgagaagtggaagcggcagctcaaccagctgtccaagagcgagttcaacacctacaagcgctccgggatcatggaggtggatcggagcgaggcgaaggagggcctgaaacgcggcgaaacgaccaagcacgccgtctcccggggaaccgccaagctccgctggttcgtggagcggaacctggtcaagcccgagggcaaggtgatcgacctgggctgcgggcgcggcggctggagctactactgcgccggactgaagaaggtgaccgaggtgaaggggtacacaaagggcggccccgggcacgaggagcccatccccatggccacctacggctggaacctcgtcaaactgcactccgggaaggacgtgttcttcgtgccgcccgagaaatgcgatacactgctctgcgacatcggagagagctcccccaacccgaccatcgaggaggggcgaacgctgcgtgtgctgaagatggtggagccctggctccggggcaaccagttctgtatcaagatactaaacccctacatgcccagcgtcgtggagacactggagcagatgcagcgcaagcacggcgggatgctcgtgcgcaacccgctgtcgcggaacagcacccacgagatgtactgggtgtcctgcggcaccgggaacatcgtctcagcggtgaacatgacctcccgcatgctgctcaaccggtttacgatggcccacagaaagcccacttacgagcgggacgtcgacctcggcgccggcacccgccacgtcgccgtggagcccgaggtggccaacctggacatcatcgggcagcggatcgagaacatcaagcatgagcacaagagcacctggcactacgatgaggacaacccctacaagacgtgggcgtaccacggctcctacgaggtgaagccgagcggaagcgcctcttcgatggtcaacggcgtcgtgaagctgctgaccaagccctgggacgtgatcccaatggtgacccagattgccatgaccgacacgacccccttcgggcaacagcgcgtcttcaaggagaaagttgacacccgaaccccgaaggccaagcgcggcacggcccagatcatggaggtcaccgcgaagtggctgtggggctttctctcccggaacaagaagccccgcatatgcacccgggaggagttcacccgcaaggttcggagcaacgccgcgatcggggccgtgttcgtcgacgagaaccagtggaactccgcgaaggaagccgtcgaggacgagcgcttctgggatctggtccaccgggagcgcgagctgcacaagcagggcaagtgcgccacttgcgtctacaacatgatgggtaaacgggagaagaagctcggcgagttcgggaaggccaagggttctcgcgccatctggtatatgtggctaggcgcgcggtttttagagttcgaggctctcgggttcatgaacgaggaccattggttctcccgcgagaacagcctatccggcgtggagggtgagggcctgcacaagctcgggtacatcctgcgtgacatcagcaagatccccggcggcaatatgtacgccgacgacaccgccggttgggacacccgaatcaccgaggacgacctgcagaatgaggctcgcatcacggatatcatggagccggagcatgcgttactggccaagtccatctttaaactgacctaccagaacaaggtggtccgcgtgcagagacccgcaaagaacggcaccgtgatggacgtcatcagccggcgcgaccaaagaggttccggacaggtgggcacctacggactcaacacattcaccaacatggaggcccagctgatccgccaaatggaaagcgaaggcatcttctccccctccgagctggagacccctaacctcgctgaacgggtgctggactggctggagaagtacggagtggagcgcttgaagcggatggcgatctccggcgacgactgcgtggttaagccgatcgacgaccgtttcgccaccgcactgacagccctgaacgacatggggaaggtccggaaggacatcccccaatgggagcccagcaagggatggaacgactggcagcaggtccccttctgctcccaccacttccaccagctcatcatgaaagacggccgcgagatcgtggtcccctgccggaaccaggacgagctggtggggagagcccgggtgagccaaggcgcggggtggagcctgcgggagaccgcctgcctcggcaagtcctacgcccagatgtggcagctgatgtacttccacaggcgggacctgcgcctcgccgcgaacgccatctgcagcgccgtccccgtggactggatccccacctcacggactacttggtccatccacgcccaccatcaatggatgactaccgaggacatgctgtccgtgtggaaccgagtctggatagaggagaacccctggatggaagacaagacccacatcagctcctggggcgacgttccgtacctcggcaagcgggaggatcagtggtgcggcagcctcatcgggctgacggcccgcgcaacatgggccacaaacatccaggtggccatcaaccaggtccggcgcctgatcgggaacgagaactacctcgactacatgaccagtatgaagagattcaagaacgagagcgaccccgagggggccctgtggtga

SEQ ID NO: 23849 - RNA, 9879 nt, synthetic construct
  misc_feature 1..9879: note = derived and/or modified CDS sequence (opt11) from DENV-1__HM181948__SS-prME
  source 1..9879: mol_type = other RNA
agcgtgaccatgttgctgatgctgatgccgactgcactggcgtttcacctcaccacccgcggcggggaacctcatatgatcgtgagcaagcaggagcgggggaagagcttattatttaaaaccagcgccggggtgaacatgtgcacccttatcgccatggacttaggcgagctatgcgaggacacgatgacctacaagtgcccccggatcaccgaggtggagccggatgatgtggactgctggtgtaacgccaccgacacgtgggtgacttacgggacctgctcgcagaccggcgagcaccgccgcgacaagcggtcagtggccctcgcgccccatgtgggtctggggctcgagacgcgcaccgagacctggatgagctcggagggcgcgtggaagcaaatccagcgggtcgagacgtgggcccttcgccatccagggttcactgtgatcgcgttattcctggcccacgcgatcggcacctccatcacccaaaaggggataatctttatcctcctgatgctcgtcacccccagtatggcaatgcgctgcgtgggtatcggctctcgcgatttcgtagaagggctctccggcgcgacatgggtcgacgtggtactggaacatggttcttgcgtcaccaccatggccaaggataagcccaccctggacatcgaactcctcaagacggaggtgactaatcccgccatcctgaggaaactctgcatcgaggcgaagatctccaacaccacgacggacagccgctgcccgacccaaggcgaagccaccctcgttgaggagcaggatgctaacttcgtctgccgccgaactttcgtggaccggggctgggggaatggatgcggcctgttcggaaaggggtccctcatcacgtgcgctaagttcaagtgcgtaactaagctggagggcaagatagtccagtacgagaacctgaagtattcagtgatcgtaacagtacacaccggcgaccagcatcaggtggggaacgagtccactgagcacggcaccaccgccaccatcaccccgcaggcgccgacgaccgagattcagctcacagactacggcgccttgaccctggactgcagtccgcgaacgggcctcgacttcaacgaaatggtcttattaaccatgaaggaaaagagctggttagttcacaagcagtggttcctagacctgcccttgccctggacgtcaggggcctcaacctcacaagagacatggaacagacaggacctcctggtgacctttaagaccgcccacgcaaagaagcaagaggttgtggtgcttggcagccaggagggagcgatgcacaccgctttgacgggggccacggagatccagacgtccggcaccacgacgatctttgccgggcatctgaagtgccgccttaagatggacaagttgaccctgaaaggtatgagctacgtcatgtgcacaggcagcttcaagctcgagaaggaggtggctgagacgcaacacggcaccgtgctggttcagatcaagtacgagggcacagatgctccttgcaagattcccttcagcacgcaggacgagaagggggtgacgcagaacggccgactgatcaccgccaacccaatcgtcaccgacaaggagaagcccgtgaacatagaagccgaaccgcccttcggtgagtcttacatcgtgatcggcgccggcgagaaggcgctgaagctcagctggttcaagaaagggtcgagcatcgggaagatgttcgaggccactgcccgcggggcacggcgcatggcaatcctcggggacactgcatgggattttgggtccataggcggcgtgttcacgagtgtggggaagcttgttcatcagatcttcgggaccgcctatggcgtcctattctccggcgtctcttggacgatgaaaatcggaatcggcgtgctcctgacttggctaggcctgaattccagaagtacctccctctctatgacctgtatagccgtcgggctcgtcacgctgtacttaggcgtgatggtccaagcagactctgggtgcgtcatcaactggaagggccgtgagctgaagtgtggtagcgggatcttcgtgacgaacgaggtacatacctggactgagcagtacaagttccaggctgacagcccgaagcgcctgagtgcggccatcggcaaggcctgggaggagggtgtttgcgggatccggagcgccaccaggctggagaacataatgtggaagcaaatatccaacgagctcaatcacatcctgctggaaaacgatatgaagttcactgtcgtggtcggggatgtggccggcatcctcgcgcaggggaaaaagatgatccggccccagccaatggagtacaagtacagctggaaatcctggggtaaggccaagatcatcggggccgacgtgcaaaacacgactttcataatagacggccccaataccccggaatgccccgacgaccaacgcgcttggaacatctgggaggtagaggactatggctttggaatcttcaccacgaacatctggctgaagctgcgggactcttatacccaagtctgcgaccaccgcctcatgtccgccgccatcaaggacagcaaggccgtgcacgccgatatgggttactggatcgagtccgagaagaacgagacgtggaagctcgcccgggcgagcttcatagaggtcaagacctgcatatggccgaaatcccacacgctgtggagcaacggcgtgctcgagtccgagatgatcatccccaagatctatggcggaccgatatcccagcacaattaccgcccgggctacttcacccaaaccgccggcccatggcacctgggcaaactggagctcgactttgacctgtgcgagggtaccacggtggtcgtggatgagcactgcggcaatcgagggccatccctgcgtactactaccgtgactggcaagatcatccacgagtggtgctgtcggagctgcaccttaccacccctcagatttagaggtgaggacggctgctggtacggtatggagatccgtcccgtaaaagagaaggaggagaacctggtgaagtccatggtgtcggccggcagcggcgaggtagactccttcagcctcgggctgctgtgcatttctattatgatcgaggaggtgatgcggagccgttggtcccggaagatgcttatgaccggcaccctggccgtcttcctactcttgatcatggggcagctgacttggaatgatctaatccgattgtgcataatggtcggggccaacgccagcgaccgcatgggaatgggtaccacctacctggccctgatggcaacctttaagatgcggccgatgttcgcggtggggctgctgtttcgacgcctaacgtcccgcgaagtgctgctgctcactatcgggctgtccctggttgcctccgtggagctccctaacagcctggaggagctgggggacgggctcgcgatgggcatcatgatcctgaagctcctcaccgactttcagtcccaccagctctgggccacactgctcagcctgacttttatcaagaccaccttctcactgcactacgcctggaagaccatggccatggtcctcagcatcgtgtccctgtttccgctgtgtctcagcaccacctctcagaagacaacctggttacccgtactgctcgggagtctggggtgcaagccgctgaccatgtttctgatagccgagaacaagatctggggtcggcggtcctggcccctgaacgaggggatcatggccgtcggcatcgtaagcatcctgctgagctctctgctgaagaatgacgttccactcgccggtcccctgatcgccgggggcatgctgatagcctgctacgttataagcgggtccagcgcggacctttccttagagaaagcggccgaggtgagctgggaggaagaggccgaacactccggcgcctcgcacaacatcttagtggaggtccaagacgacggcaccatgaagatcaaggatgaggaacgagacgacaccctcaccattctgctgaaggcaaccctgctggccgtgtcaggcgtgtacccgctgtcgatccccgcaaccttgttcgtgtggtacttttggcagaagaagaagcagcgatccggcgtgctgtgggatacccccagcccgccggaggtggaacgggccgtgttggacgacggaatctaccggatcatgcaacggggtctactcggccgctcccaggtgggcgttggtgtattccaagagaatgtgttccatactatgtggcacgtgaccaggggggcggtcctgatgtaccagggcaaaaggctggagcccagctgggcatccgtgaagaaggacctcatttcttatggaggcggttggcggctgcaaggctcctggaacacaggtgaagaggtacaggtaatagccgtagagccgggcaagaatccgaagaacgtgcagaccgcaccaggtaccttcaagactcccgagggcgaggtaggcgccatcgccctggacttcaagcccggaacatccgggtctccaatcgtgaatcgtgaagggaagatcgtgggcctgtacggcaatggggtagtgacgaccagcggtacttatgtcagcgcgatagcccaggctaaggcatcgcaggaaggaccgctgcccgaaattgaggacgaggtattccggaagcgcaacctaacgatcatggacctccacccaggcagtggtaagacccggcggtatcttccggcgatagtaagggaggcaatcaagcggaagctgcgcacactcatccttgcccccacacgcgtggtagcctccgagatggccgaggctctgaagggaatgcccatccgctaccagactaccgccgtcaaatcggagcacaccggcaaggagatcgttgacctcatgtgccatgccacattcacgatgcggctgttatccccggtccgcgtgccgaactacaacatgattatcatggacgaggcccactttaccgacccctcgtccatcgccgcacgggggtacatcagcaccagagtgggtatgggagaagcagccgccattttcatgaccgccacgccgccgggctccgttgaggcttttccgcagagcaatgccgtgatccaggacgaggagcgagacatcccggagcgctcatggaactcagggtacgagtggatcaccgacttccccggcaagaccgtttggttcgtccccagtatcaaatcaggcaacgacatagcaaactgcctacggaaaaatggcaagcgcgtgatccaattatcgcggaagaccttcgacacggagtaccagaaaaccaagaacaatgactgggattatgtggttaccaccgacatcagcgagatgggcgccaatttccgcgcggaccgggtaatcgacccgcgtcgttgcctgaaacccgtcatcctgaaggacggccctgagcgcgtcatcctagccggccccatgccggttacggtcgcctccgccgcccagaggcgcgggcggataggcaggaaccataacaaggagggcgaccagtacatttacatggggcaaccgctgaacaacgacgaggaccatgcgcactggacagaggccaagatgctcctggacaatatcaacacgcccgagggcattatacccgccctgtttgagccggagcgtgaaaagtccgccgcgatcgacggggaataccggttgagaggcgaggcgcggaagactttcgtggagcttatgcgcaggggcgaccttcccgtttggctcagctacaaagtggccagcgagggttttcagtactcggaccgccggtggtgcttcgatggcgagcgcaacaatcaggtcctggaagagaacatggacgtcgaaatttggacgaaggagggggagcgaaaaaagctgagacctagatggctcgacgcccgcacctactctgaccccctggcccttcgggagttcaaggagttcgccgcgggccgccggagcgtctccggagatctcattctggagataggcaaactcccgcagcacctaacccagcgcgcccagaacgccctggataacttggttatgttgcataactctgaacagggcgggcgggcctacaggcacgccatggaagagttgcctgacacgatcgaaacgttaatgctgctagccctcatagcggtgctcaccggcggtgtcaccctgtttttcctatcgggccggggcctcggcaagaccagtatcggcctgctgtgcgtgatggcctcctccgtgcttttatggatggcctccgtcgagccccattggatagcggcctctataattctggagtttttcctcatggtgctgctgatccccgagccggaccgccagcggacaccccaggataaccagctagcctacgtggtgatcgggctgctgttcatgatattaacggttgccgccaacgagatgggcttgcttgagacaacaaagaaagacctcgggatcggccacgttgcggtcgggaaccaccaccacgcggccatgctggacgttgacctgcacccagcaagtgcctggaccctgtacgccgtggccacaaccatcataacccccatgatgcgccacaccatcgagaacacgacggccaatattagcctgacggccatcgcgaaccaggcggccatcctaatgggcctcgacaaaggctggcccattagtaagatggatattggggtccccctgcttgctttgggctgctactcacaggtaaaccccctgaccctgacggccgcggtgcttatgttggtcgcccactacgccatcatcgggccgggtctgcaggccaaagcgacgcgcgaagcgcagaagcggacggccgccgggataatgaagaaccccactgtggacggaatcgtagccatcgacctcgaccccgtcgtctacgacgccaagtttgagaagcagctgggtcagatcatgctgctcatactctgcacgtcgcagatccttctcatgcggacaacctgggcgctctgcgagagcatcaccctggccacggggcccctcaccaccctgtgggaggggtccccggggaagttctggaacaccacgatcgccgtgtccatggccaacatcttccggggctcctacctggccggcgctgggctcgccttctcactcatgaaatccctcggcgggggccggcggggaacgggcgcccagggcgagacacttggggaaaagtggaagcgccagctgaaccaacttagcaaaagcgagtttaacacgtataagcggagtggcatcatggaggtcgacagaagcgaggccaaggaagggctcaagcggggggagaccaccaagcacgcggtctctcgcggaacagcaaagctacgttggttcgtggaacggaacttggtcaagcccgagggcaaggttatcgacctgggctgcgggcggggcggatggtcctactactgcgccgggttgaagaaagtgaccgaggtcaaagggtacacgaaagggggcccaggtcatgaggaacctatcccaatggccacctacggatggaacctggtgaaactgcactctgggaaggacgtgttcttcatcccgcccgagaagtgcgacacactcctgtgcgacatcggcgagtcatcccccaaccccactatcgaggaggggcgcacgctacgggtgctcaaaatggtggagccctggctgaggggcaaccaattctgcatcaagatattaaacccttacatgcccagcgtggtcgagaccctcgagcaaatgcaacgaaagcacggcggtatgctggtgcgcaacccgttgtctcggaacagcacccacgagatgtactgggtctcctgcggcaccggtaacatcgtctcggccgtaaatatgacgtctcgaatgctgctgaaccgcttcacgatggcacaccgcaagccaacatacgagcgcgatgttgacttgggcgccggcacccgacacgtcgcagtggagcccgaggtggccaacctcgacataataggccagcgcatagagaacatcaaacatgagcataagagcacttggcactacgacgaggacaacccatacaagacctgggcctaccacggaagctacgaggtcaaaccgagcgggtccgcgagcagcatggtgaacggcgtcgtgaagctgctgaccaagccctgggatgtgatacccatggtcacccagatcgccatgacagacacgaccccctttggccagcaacgcgtattcaaggaaaaggtggacacccgcaccccgaaggccaaacggggcacggcccagatcatggaagtcaccgcaaagtggctctggggcttcttaagtcggaacaagaagccccggatctgcacccgcgaggagttcaccagaaaggtgcgcagcaacgcggccatcggggctgtgttcgtcgacgagaaccagtggaactccgccaaggaggcggtggaggacgagcgattttgggatctggtccaccgtgagcgggagctacacaagcagggcaaatgcgccacgtgcgtctacaacatgatggggaagcgcgagaagaaactcggagagttcgggaaggccaaaggctcacgggcaatctggtacatgtggctgggcgctagattccttgaattcgaggcgctggggtttatgaacgaggaccactggttttccagggaaaacagcctgtcgggtgtggagggtgaaggactccacaagttagggtacatcttgagagacatcagcaagatccctggcggcaacatgtacgccgacgacaccgcgggttgggacacccggatcacagaggacgacctccagaacgaagcacgaatcacagatatcatggaacctgagcacgccctgctggcgaagtctatcttcaagcttacctaccaaaacaaggtggtccgcgtgcagcggcccgccaagaacggcaccgttatggacgtcatatcacgcagagaccagcgagggagcggtcaggtgggcacatacggactgaatacgttcaccaacatggaggcccagctgatccggcagatggagagcgagggcatcttttcccccagcgaactagagacgcccaacctggccgaacgcgtgctggactggctcgaaaagtacggcgttgaacgactgaaacgtatggccatatccggcgacgattgtgtggtgaagccaatcgatgacaggttcgcaaccgccctgacggccctcaatgatatggggaaggtcaggaaggacatcccccaatgggagccttccaagggctggaacgactggcagcaggtaccattctgttcccaccacttccaccagctgatcatgaaagacggtcgagagatcgttgtcccttgccgaaaccaagacgagctggtgggtcgcgcccgggtgagccagggcgccgggtggagcctacgggagaccgcctgcctcggcaagagttacgcacagatgtggcagctgatgtacttccatcgccgcgacctgcgcctggccgccaatgcgatctgtagcgccgtccccgtggactggatccccacctcacggactacatggagcatccacgcccaccaccagtggatgaccacggaggatatgctaagcgtgtggaaccgcgtctggatcgaagagaatccctggatggaagacaagacacacatctcttcctggggcgatgtcccgtacttgggcaaacgcgaggaccagtggtgcggcagcttgatcgggctgactgcgcgggcgacatgggcgaccaacatccaggtggccatcaaccaagtgcgccggctcatagggaacgaaaattatctggactacatgacctccatgaagcgctttaagaacgagagcgaccctgagggcgccctgtggtag

SEQ ID NO: 23850 - RNA, 9879 nt, synthetic construct
  misc_feature 1..9879: note = derived and/or modified CDS sequence (opt11) from DENV-1__HM181949__SS-prME
  source 1..9879: mol_type = other RNA
tccgtgaccatgctactcatgctgatgcccaccgccctggccttccacttgacaacccggggtggggagccacatatgatagtgagcaagcaggagcgggggaagagcctgctgttcaagaccagcgcgggggtaaacatgtgcaccctcatcgcgatggacttaggcgagctgtgcgaggacacgatgacatacaagtgcccgcgcattaccgaggccgagcccgacgatgtggactgctggtgcaacgccacggacacgtgggtgacctacgggacctgcagccaaaccggcgagcaccggagagataagcggtccgtggccctcgcaccacacgttggcctgggcctggagacgaggaccgagacctggatgagcagcgaaggagcctggaaacagatccagcgggtcgaaacctgggccttacggcaccccggcttcacagtgatcgcactgttcctggcgcacgccatcggcaccagcatcacccagaaagggatcatcttcatcctcctgatgctggtgaccccaagcatggccatgcggtgcgtcgggatcggcagccgcgacttcgtggaggggctcagtggcgccacctgggtggacgtcgtgctggagcatgggagctgcgttacaaccatggccaaagataagcccaccctggacatcgagttactcaagacggaggtcaccaaccccgcgatcttgcgcaagctctgcatcgaggccaagatctctaacaccaccacggacagccgctgcccgacccagggcgaggccaccctggtggaagagcaagacgccaacttcgtgtgccggcgcaccttcgtcgaccggggctgggggaacgggtgcggtctgttcggcaagggctccctcatcacttgcgctaagttcaaatgcgtgaccaagctggagggcaagatagtgcagtacgagaacctgaagtattccgtcatcgtgaccgtacacactggcgaccagcaccaggtcgggaacgagtccacgggccacgggacgacggcgacaattacgccgcaggcccccactacggagatccagctcactgactacggcgccctgacgctggactgctccccccgaacgggtctcgactttaacgagatggtgctgctgacaatgaaggagaagtcctggctcgtccacaaacaatggttcctggaccttcccctaccctggacctcgggtgccagcacctcccaagagacgtggaaccggcaggatctgctggtaaccttcaaaactgcccacgcgaagaaacaagaggtggtcgtgctcggctcgcaggagggggccatgcacaccgccctgaccggagccaccgagatccagacctctgggacgacgaccatattcgccggccacctgaagtgccgcctcaagatggacaaattgaccctgaagggcatgagctacgtgatgtgcaccggatccttcaagctcgagaaggaggtcgctgagacgcagcacggcaccgtgctggtgcagatcaagtacgaagggaccgacgccccctgtaagatcccttttagcacccaagacgagaagggcgtcacgcagaacgggcggctgattaccgcgaacccgatcgtgaccgataaggagaagcccgtcaatatcgaggcggagccgcccttcggtgagtcctacatagtcatcggcgcgggcgagaaggcgctgaagctcagctggttcaagaagggctcctcaataggcaagatgtttgaagccacagcccgcggcgcccggcgcatggctatcctgggagacactgcctgggacttcggctccatcggtggggtcttcacctcggtgggcaagctggtccaccagatcttcgggacagcctatggcgtactcttctctggggtgtcgtggaccatgaaaattggcataggggtcttactgacgtggctcggtctgaacagtcgcagcacctccctgagcatgacttgcatcgccgtgggccttgtgaccctgtacctgggggtcatggtccaggccgactccggttgcgtgatcaactggaaggggcgggagctcaagtgcggcagcgggatcttcgtaacgaacgaggtgcacacctggaccgagcagtacaagttccaggcggacagcccgaagcgcttatccgccgccatcgggaaggcctgggaggagggtgtgtgcgggatccggagtgccacacgcctggagaacatcatgtggaagcagatctccaacgagctgaaccacatcctgctggaaaacgacatgaagttcacagtcgtggtaggcgacgtggcggggatccttgcccagggcaagaagatgattcggccccagcccatggagtacaagtactcttggaagtcctggggcaaggccaagatcataggggctgacgtacagaacacgaccttcatcatcgacggaccgaacaccccggagtgcccagatgaccagcgcgcttggaacatctgggaggtggaggactacgggttcggcatctttaccacgaacatctggctgaagctgcgggacagctacacgcaggtctgcgatcaccgtctcatgtcggccgccatcaaagacagcaaggccgtgcacgccgacatgggctactggatcgagtccgagaagaacgagacttggaagctggcgcgggctagcttcatagaagtgaagacctgcatatggcctaagtcccatacgttatggagcaacggggtcttagagtccgagatgatcatccctaagatctacggagggccgattagtcagcacaactatcgccccggctacttcacccagacggccgggccctggcacctgggcaaactggagctcgacttcgacctatgcgagggaaccaccgtggtagtcgacgagcactgcgggaatcggggaccatccctgcgcaccaccaccgtgacggggaaaatcatccacgagtggtgctgccggagttgcaccttaccgcccctgaggttccggggcgaggatgggtgctggtatggcatggagatccgccccgtgaaggagaaggaggaaaacctggtcaagtccatggtgagcgccggctcaggggaagtcgactccttcagtctcggcctactgtgcatctctatcatgatagaggaggtgatgagaagccgctggtccaggaaaatgctcatgaccgggaccctggcggtcttcctgctcttaatcatggggcagctgacgtggaacgacttaatcaggctgtgcatcatggtgggggcaaacgccagcgaccgcatgggaatgggcaccacctacctggcactcatggcaaccttcaagatgcggccgatgttcgcagtcgggctgctgtttcgtcggctcacgtcccgcgaggtgttactgctcacaattgggctgagcctggttgcatccgtcgagctccctaacagtcttgaagaactgggggacgggctcgccatgggcataatgatcctgaagctgctcaccgatttccagtcccaccagctttgggcgaccctcctcagcctgacgttcatcaagaccacgttctctctgcactacgcatggaagaccatggcgatggttctcagcatcgtgtctctgttccccctgtgcctctccacgacttcccagaaaacaacgtggctgcctgtgctgctcgggagcttagggtgcaagcctctgacgatgttcttgatcgccgagaacaagatctgggggcggaggagctggccgctgaacgagggcataatggctgtagggatcgtcagcattttgctctcctccctgctgaagaacgacgtgccccttgctggccccctgatcgccggcggtatgttgatcgcgtgctacgtgatctctgggtccagcgccgacctctccctggagaaggccgccgaggtctcttgggaggaagaagcggagcactccggggcgagccacaacatcctcgtggaggtgcaggacgacggcaccatgaaaatcaaggacgaggaacgagatgacacgctcaccatcttgttgaaagccaccctcttagccgtctccggggtgtacccgttaagcatccccgccacactcttcgtgtggtacttctggcagaagaaaaaacagagatccggtgtcctgtgggacacccccagcccccccgaggttgagcgggcggtgctggacgacgggatctaccgcataatgcagcgggggttactcggccgttcccaggttggggtgggcgtgtttcaggagaacgtctttcacaccatgtggcacgtgacccgcggggcggtgctgatgtaccagggcaagcgtctcgagccaagctgggcctccgtgaaaaaggatcttatcagctacggagggggttggcggctgcaggggtcctggaacacaggcgaagaagtccaggttatagccgtcgagccggggaagaaccccaagaacgtgcagaccgcacccgggaccttcaagacgcccgagggcgaagtaggggccatagctctggacttcaagccgggcaccagcgggtcccccatcgtaaaccgtgagggcaagatcgtgggcctctacgggaacggcgtcgtcaccaccagcggcacctacgtgagcgccatcgcccaggccaaggcgtcccaggagggccccctgcccgagatcgaagacgaggtgttccggaagcgcaacctgaccatcatggacctccaccccgggagcggcaagacccggcgctacctgccggccatcgtccgggaggccataaagcgcaagctgcgcaccctcatcctggcccccacccgggtggtggccagtgagatggcggaagccctcaagggcatgccaatacgctaccagacgaccgccgtcaagagcgagcatacggggaaggagatcgtggaccttatgtgccacgctaccttcacaatgcgcctgctgtcccccgtgagggtcccgaactacaacatgatcataatggacgaggcccacttcaccgacccctcgtccatcgctgcgcggggctacatcagcacccgtgtgggcatgggcgaggccgccgccatctttatgaccgcgacgcctccagggtccgtggaggccttcccgcaaagcaacgccgtcatccaagacgaggagcgggacatccccgagcgcagttggaatagcggttacgagtggatcaccgacttccccggcaagaccgtatggttcgtgccctcgatcaagagcgggaatgacatcgccaactgcctccgtaagaacggtaagcgcgtcatccagttatcccggaagaccttcgacacggagtaccaaaagaccaagaacaacgactgggactacgtggtgacgaccgacatctcggagatgggggcgaatttccgcgccgacagagtcatcgatcctcgccggtgcctgaagcccgtcatcttgaaggacggccccgagcgggtgatcttagcggggcccatgccagttaccgtagcctccgccgcgcagaggcgcggccgaatcggccgcaatcataacaaggagggggaccagtacatctacatgggccaacccctgaacaatgacgaagaccacgcccactggaccgaagcaaagatgctcctcgacaacatcaacacccccgagggtatcatcccagccctgttcgagccggagcgcgagaagtccgccgcgatcgacggcgagtaccggctccgcggggaggcccggaagaccttcgtcgagctgatgcgtcggggcgacctgccggtgtggctctcctacaaggtggcttctgagggcttccagtacagcgacagacggtggtgcttcgacggcgagcgcaacaaccaggtcctggaagagaacatggatgtcgagatctggacgaaggagggagagcggaagaagctgcgcccccggtggctcgacgcccggacctactcagaccccctggccctgcgggaattcaaagagttcgcggccgggcgacggagcgtatcgggcgacctcatcctggagatcggtaagctgccgcaacacctcacccagcgcgcccagaacgcactggacaacctggtcatgcttcacaatagcgaacagggcggacgggcctaccgccacgccatggaagagcttccagacacgatcgagacgttgatgctcctggccctgatagccgtgctcacggggggcgtcaccctgttcttcttgagcgggcgcggcctcggcaagaccagcatcgggctgctgtgcgtcatggccagctccgtgctcctgtggatggcatccgtggagccccattggatcgccgccagcatcatcctggagttcttcctgatggtcctactgatccccgagccggaccgccagcggacgccccaggataaccaactcgcgtacgttgtgatcggcctgctgtttatgatcctcacggtcgccgcgaacgagatggggctgctcgagaccactaagaaggaccttggcatcgggcacgtggcagtgggcaatcaccaccatgcagcgatgctggacgtcgacctgcacccggcgtccgcttggaccttatatgccgtagccactaccatcatcaccccgatgatgagacacacaatcgaaaacacgaccgccaacatcagcttgaccgccatcgccaaccaagccgccattctgatgggcttggacaaggggtggcccatctccaagatggatatcggcgtgcccctgctggccttggggtgctacagtcaggtgaaccccctgaccctgacggcggccgtgctgatgctggtggcgcactacgccatcatcggacctgggctgcaggccaaggcaacccgggaggcacagaagcggaccgccgccggcatcatgaaaaaccctacggtcgacggaatcgtggccatcgaccttgatcctgtggtctatgacgcgaagttcgagaagcagctggggcaaatcatgctgctcatcttatgcacgtcccagatcctgctcatgcgcaccacatgggcgctgtgcgagagcatcaccctggccacgggccccctcactaccctgtgggaggggtccccgggcaagttttggaacaccaccatagccgtcagcatggccaacatcttccggggctcatacctggcgggagcggggctcgctttctccctgatgaagtccctggggaggggccggcgcgggaccggcgctcagggcgagacactcggggagaagtggaaaaggcaacttaaccagctgtccaagtccgagttcaatacctacaagcgctccgggatcatggaggtggaccggagcgaggcgaaggaggggcttaaacgcggcgagacgactaagcacgcagtctcgcgggggaccgccaagctgcgctggtttgtagagcggaatctggtaaagcccgagggcaaggtcatcgatctgggctgtggccgcggcgggtggagctactattgcgccggcctcaaaaaagtcacggaggttaaggggtacacgaagggcggtccggggcatgaggagcccatcccgatggccacatacggctggaatttggtcaagctgcactccgggaaggatgtgttcttcattcctccagaaaagtgcgacaccctcctgtgcgacatcggcgagtcctctccaaacccgaccatcgaagaggggcggacgctgcgcgttctcaagatggtcgaaccctggctgcggggcaaccagttctgcatcaagatactgaacccatacatgccgagcgtggtggagaccctcgagcagatgcagcgcaagcacggcgggatgttagtacgcaacccactgtcccgcaactcaactcatgagatgtactgggtgtcctgcggcaccggtaacatcgtaagcgcggtgaacatgaccagccgcatgctcctgaaccgcttcactatggcgcaccgcaagcccacctacgaacgggacgtggatctgggcgccggcacccggcacgtcgctgtcgagcccgaagtggccaacctcgacatcataggacagcggatagagaacatcaagcacgaacacaagagcacctggcattacgacgaggacaacccctacaagacgtgggcataccatggctcctacgaggtgaagccgagcgggtccgcgagcagtatggtcaacggcgtggtcaagttgctgaccaagccctgggacgtgatccccatggtgacccagatagccatgaccgacacaacccccttcgggcagcaacgcgtcttcaaagaaaaggtggacacccggaccccgaaggctaagaggggcacggcccagattatggaagtgaccgcgaagtggctctggggcttcctgtctcggaacaagaagccccgcatctgcacccgggaggagttcacccgtaaggtcaggtccaacgccgctatcggcgccgtgttcgttgatgagaaccagtggaactccgcgaaggaggcggttgaggacgagcgcttctgggacctggtgcaccgcgaacgggaactccataagcaaggcaagtgcgcaacgtgcgtgtacaacatgatgggcaagcgggagaagaagctgggcgagttcgggaaggccaagggcagcagagccatttggtacatgtggctgggcgcgcggttcctcgagttcgaggcgctgggtttcatgaacgaggaccactggttcagcagagaaaacagcctgtctggcgtcgagggggaggggctccataagctgggctacatcctgcgggacatcagcaagatccccggcggcaatatgtacgctgacgacaccgctggatgggacaccaggatcaccgaggacgatctccagaacgaggcgcgcatcacggacatcatggaaccggagcacgcgctgttagccaagagcatatttaagctcacctaccagaacaaggtggtgcgggtccagcgccctgcaaagaatggcacagtgatggacgtgataagcagacgcgaccagcgggggtccggccaagtcggtacctatgggctcaatacgttcaccaacatggaggcccagctgatccgccagatggagagcgaggggatcttctcccctagcgaactcgagacccctaatctggcagagcgggtgctggactggctcgagaagtatggggtggaacgcctgaagcggatggccatctccggcgacgactgcgtcgtgaagccgattgacgaccgcttcgccaccgccctgacggccctcaacgacatgggcaaagtgcgaaaagacatccctcagtgggagcctagcaagggctggaacgattggcagcaggttcccttctgcagccaccacttccatcagctaatcatgaaggacgggcgcgaaatcgtggtgccgtgccggaaccaggacgagctggtcggccgcgccagggtgagccagggcgccgggtggagcctccgcgagaccgcttgcctaggcaagtcctacgcccaaatgtggcagctgatgtacttccatcggcgcgacctccggctggcggcgaacgccatctgcagcgctgtgcccgtcgactggattcccacctcccgcaccacctggtccatccacgcccaccatcagtggatgaccacagaggacatgctgtccgtgtggaaccgcgtttggatcgaggagaacccctggatggaggacaagacccacataagctcctggggcgatgtcccgtacttgggcaaaagagaggaccagtggtgtggcagcctgatcgggctgacggcccgcgctacctgggcgactaacatccaggtggccatcaaccaggtgcggaggctcattgggaacgagaattacctagactatatgacgtccatgaagcgcttcaagaacgagagcgaccccgagggagcactatggtga

SEQ ID NO: 23851 - RNA, 9879 nt, synthetic construct
  misc_feature 1..9879: note = derived and/or modified CDS sequence (opt11) from DENV-1__HM181950__SS-prME
  source 1..9879: mol_type = other RNA
agcgtgaccatgctgctcatgcttatgcctaccgccctggccttccacctcaccacccggggcggggagccccacatgatcgtgagcaagcaggagcggggcaagtcgctgctgttcaagacgagcgccggggtaaacatgtgcaccctcatagccatggacctgggcgagctgtgtgaggacaccatgacgtacaagtgcccccggatcaccgaagcggagcccgacgacgtagattgctggtgcaacgccacagatacctgggtgacctacgggacctgcagccagacgggcgagcaccggcgcgacaagcgttccgtggccctcgcgccccacgtgggcctggggctggagacgagaaccgagacctggatgagctccgaaggcgcctggaagcagatccaacgggtggagacctgggccttgcgccaccccgggttcaccgtgatcgccctgttcctggcgcacgccatcggcaccagcatcacccagaaggggatcatcttcattctccttatgctggtgaccccctccatggccatgcggtgcgtcggcatcggcagccgagacttcgtagaagggctctccggcgccacgtgggtggatgtcgtactggagcacggcagctgcgtgaccaccatggccaaggacaagcccaccctggacatcgagctcctgaagacggaagtcaccaatcccgcgatcctgcggaagctctgcatcgaggccaagatttccaacaccaccacggactctaggtgcccgacccagggcgaggccaccctggtggaggagcaggacgccaacttcgtgtgccggcgcaccttcgtcgaccggggctgggggaacggctgcgggctgttcggcaagggaagcctcatcacgtgtgccaagttcaagtgcgtgaccaagctggagggcaagatcgtgcagtacgagaatctgaagtactcggtcatagtgaccgtgcacaccggcgaccagcaccaggtcgggaacgagtccacggagcacggcaccaccgctactatcacgccccaagcccctacgaccgagatacaactaaccgactacggggccctgaccttggattgcagtccccgcacaggcctcgacttcaacgagatggtgctgctgaccatgaaggagaagtcctggctagtccacaagcagtggttcctggacctgcccctcccctggacatcgggtgctagcacctcccaggagacatggaaccggcaggatctgctggtgaccttcaagaccgcccatgcgaagaagcaagaggtggtcgtgctcggctcccaggaaggggccatgcacaccgccctgacgggggccaccgaaatccagacctccggcaccacgaccatattcgccgggcacctgaagtgtcgcctcaagatggacaagctgaccctgaagggcatgagctacgtgatgtgcaccgggtcctttaagctcgagaaggaagtcgcggagacgcagcacggcacagtgctggtgcagatcaagtacgagggcaccgatgctccctgcaagatacccttctccacacaggacgaaaagggggtgacacagaacgggcggctgatcaccgccaacccgatcgtgaccgacaaggagaagcccgtgaacatcgaggcggagccgcccttcggggaatcctatatcgtcatcggcgctggcgagaaggccctgaagctctcctggttcaagaaggggtcaagcataggcaagatgttcgaagccactgcccgcggggcccggcgcatggcgatcctgggcgatacggcctgggacttcgggtcgatcggcggcgtgttcaccagcgtggggaagctggtccaccagatcttcggcgccgcctatggggtcttattctcgggcgtgagctggaccatgaagatcgggatcggcgtcctactgacttggcttggcctgaactcccgcagcacgtccctgtctatgacctgcatcgcagtggggctcgtgaccctgtacctaggcgtcatggttcaagcggactccgggtgcgtgatcaactggaagggccgggagctcaagtgcgggagcggcatcttcgtgaccaacgaggtgcacacgtggaccgagcagtacaaattccaagccgacagcccgaagcgactgtccgctgccattggcaaagcctgggaggagggggtgtgcggcattagaagcgcaacccgcctggagaacatcatgtggaaacagatctctaacgagctcaaccacatcctgctggagaacgatatgaagttcacggtcgtggtgggggacgtcgccggcatactcgcccaggggaagaagatgatccgacctcagcccatggagtacaagtacagctggaagtcatggggcaaggccaagatcatcggcgccgacgtacagaacaccacattcatcatcgacggccctaacaccccggagtgccccgacgaccagcgagcctggaacatttgggaagtggaggactacggctttggcatattcaccaccaacatctggctgaagctgcgggatagctacacgcaggtctgcgaccacagactaatgtcagccgccatcaaggacagcaaggccgtgcacgcggacatgggctactggatcgagtccgagaagaacgagacctggaaactggcccgggccagcttcatcgaggtgaagacctgcatctggcccaagtcacacaccctgtggtcgaacggcgtcctcgagtccgagatgatcatccccaagatctacgggggcccaatcagccagcacaactaccgacccgggtacttcacgcagaccgccggcccatggcacctggggaagctggagctcgacttcgacctttgtgagggcaccaccgtggtggtcgacgagcactgcggcaaccgggggccctccctgcgcacgaccaccgtcaccggcaagatcatccatgagtggtgctgccggagctgcaccctgccgcccctccgcttccgtggggaggacggctgctggtacggaatggagatccgccccgtgaaggagaaggaggagaacctggtcaagtccatggttagcgccggcagcggtgaggtggattccttctcactcgggctgctgtgcatttccatcatgatagaggaggtcatgcgcagcagatggtcccggaaaatgctcatgaccggcaccctggcggtattcctgctcttaatcatggggcagctgacatggaacgacctcatccgcctgtgcatcatggtgggcgccaacgccagcgaccgcatggggatgggcacgacctacctggcgctcatggccacctttaagatgcggccgatgttcgctgtagggttattgttccggcggctcacttcccgcgaggtgctcttgctcaccatcggactgagccttgtggcctccgtcgagctccccaacagcctggaggagctgggggatgggctcgctatgggcatcatgatcctgaaacttctcaccgacttccagtcccaccagctgtgggctacgctgctcagcctaaccttcatcaagacgacctttagcctgcactacgcttggaagaccatggccatggtgctcagcatcgtctcccttttccccctatgcctcagcaccacgtcccaaaagaccacctggctgcccgtgctgctaggcagcctggggtgcaagcctctgaccatgttcctcatcgccgagaacaagatctggggccggcgttcatggcccctgaatgaggggatcatggccgttggaatcgtcagcatccttctcagctccctgctcaagaacgacgtgcccctcgccgggcccctgatagcaggcggcatgctgatcgcctgctacgtcatcagcgggtcgagcgccgacctctccctggagaaggccgccgaggtcagttgggaggaggaggcggagcactccggcgcctcccacaatatcctggtagaggtgcaggacgacgggacgatgaagatcaaagacgaggagcgggacgacaccctgaccatcctgttgaaggccaccctccttgccgtttccggcgtgtacccgcttagcatccccgccaccttattcgtgtggtacttttggcagaagaagaagcagcgttccggggtcctatgggatacgcccagcccgcccgaggtggagcgggcggtgctggacgacggcatctaccgcatcatgcagcggggcctgcttgggcggtctcaagtcggagtgggggtgttccaggagaacgtcttccacaccatgtggcacgtgacacggggcgccgtgctgatgtaccaagggaagcgcctggagccctcgtgggccagcgtcaagaaggacctcatcagctacggcggcgggtggcgactgcagggctcttggaacacgggcgaggaagtccaggtgatcgccgtcgagcccggcaagaaccccaagaacgtgcagacggcccccgggaccttcaagacccctgagggcgaggtgggcgcgatcgccctggacttcaagcccgggactagtggctccccgattgtcaatagagagggcaagattgtgggcctctacggcaacggggtggtcacgaccagcggcacatacgtgagcgccatagcccaagcgaaggcctcccaggaggggccgttacccgagatcgaggatgaggtgtttcgtaagcgcaacctgaccatcatggacctccatccgggcagcgggaagacgcggcgatacctgccggccatcgtccgggaggccatcaagcgcaagctgcgcaccttaatcctggcccccacccgggtggtggcgtccgagatggccgaggccctgaagggaatgcccatccgctaccagaccacggccgtcaagagcgaacataccggcaaagagattgtggacctcatgtgccacgcaaccttcacaatgcggctgctctctcccgtgcgcgtcccaaactacaatatgatcatcatggacgaggcgcacttcacagaccccagcagtatcgcggcccggggctacatcagtaccagggttggcatgggggaggccgccgccatcttcatgacagccacgccgcccggctccgtggaagccttcccacagagcaacgccgttatccaggacgaggagcgggacatcccagagcgctcctggaacagcgggtacgagtggatcacggactttccaggtaaaacagtgtggttcgtgccctccatcaaatcgggcaacgacatcgcgaactgcctccggaagaacgggaagcgcgtcatccagctgtcccggaagaccttcgacaccgagtaccagaaaacgaagaacaacgactgggactacgtggtgaccaccgacatcagcgagatgggggctaacttccgcgccgatcgggttatcgacccgaggcggtgcctgaagcccgtgatcctcaaggatgggccggagcgcgtaatcctggctggccccatgcctgtcaccgtcgcctccgccgcccagagacgcgggaggatcggcagaaaccacaacaaggagggagaccagtacatctatatggggcagccccttaacaacgacgaggaccacgcccattggacggaggccaagatgctcctggacaacatcaacacccccgagggcatcatccccgccctgttcgagccggagcgcgaaaagtccgccgctatcgacggggagtatcggctccgcggcgaagcccggaagaccttcgttgagctgatgcgccgcggggacctgcccgtatggctctcctacaaggtggccagcgagggctttcagtacagcgatcgccggtggtgcttcgacggcgagcgcaacaatcaggtcctggaggagaatatggacgtggagatctggaccaaggagggggagcggaagaagctgcgcccccggtggctagacgccagaacgtactccgacccccttgcgctgcgggagttcaaggagttcgccgccggccgccggagcgtgtccggggacctcatcctggagattggcaagcttccgcagcacctcacccagcgggcccagaacgcgctggacaatctggtcatgctccacaacagcgagcagggcggtagggcctatcgccacgccatggaagagcttccggacacgatcgagaccttaatgctcctggccctcattgccgtgcttacgggcggggtgaccctattcttcctgtcgggccgggggctcgggaagaccagcatcggcctgctgtgcgtcatggcgtctagcgtgctcctgtggatggcgagtgtggagccccactggatcgccgccagcatcatactggaattcttcctcatggttctcctgatccccgagccggaccgtcagcggacgccccaggacaaccagctcgcctacgtggtgatcgggctgctgtttatgatcctcacagtcgcagccaatgagatgggcctgctggagacgacgaagaaggacctcgggatcggccacgtagccgtggggaaccaccaccatgccgccatgctggacgtcgacctgcaccccgcgagcgcctggaccctctatgccgtggcgaccacgatcatcaccccgatgatgcgccacaccatcgagaacacgacggcaaacatcagcctgaccgcgatcgccaaccaggccgccatcctgatgggcctcgacaagggatggcccatctcaaagatggacattggggtgcccctgctggcgctcggttgctacagccaggtcaaccccctgacactgaccgccgcggtgctcatgctggtggcccactacgccatcatcgggcccggactgcaggcgaaggccacgcgcgaggcccagaagaggaccgccgcagggatcatgaagaatcccaccgtcgacgggattgtggcgatcgacctcgaccccgtcgtctacgacgccaagttcgagaagcagctgggccagataatgctgctcatcctgtgcacttctcagatcctgctcatgcggactacctgggccctgtgcgagagcattaccctggccactgggcccctaaccaccctctgggagggctccccggggaagttctggaacaccaccatcgcagtgagcatggcaaacatcttccgaggcagttatctggctggcgccgggctcgcattctcactgatgaagtccctgggggggggccgccgggggacaggcgcgcagggcgagaccctcggggagaagtggaagcgccagcttaatcaactgtccaagtccgagtttaacacgtacaagcggtccggaatcatggaggtggaccgcagcgaggccaaggagggactcaagcggggcgagacgacgaagcacgccgtttcccgaggcaccgcaaagcttcggtggttcgtagagcgcaacctggtgaagcccgagggcaaggtcatcgacctgggctgcgggcggggagggtggagctattactgcgccggcctgaagaaggtcaccgaggttaagggttacaccaagggcggccccggacacgaggagcccatcccaatggcgacttacggctggaacctggtcaagctgcattccggcaaagacgtgttcttcatcccgcccgagaagtgcgacacgctactgtgcgacatcggcgagtccagtcccaacccgaccatagaggaggggcgcaccctgagggtgcttaagatggtcgagccctggctgcgcggcaaccaattctgcattaaaatcctgaacccctacatgcccagcgtggtcgagacgctcgagcagatgcagcggaaacacggcgggatgctggtccgcaacccactgtcccggaatagcacccacgagatgtattgggtctcctgcggcaccgggaacatagtgagcgccgtcaatatgacctcccgcatgctcctgaaccgtttcaccatggcccaccggaagcccacgtacgagcgcgacgttgacctgggagccggcaccaggcacgtggccgtcgagcccgaggtggcaaacctcgacattatcgggcaacgcatcgagaacataaagcacgagcacaagagcacctggcactacgacgaggacaacccctacaagacttgggcctaccacggctcatacgaggtgaagcctagcgggtccgccagcagcatggtcaatggcgtggtcaagctgctgacaaagccctgggacgtaatccccatggtgacgcagatcgccatgaccgacaccacgcccttcgggcagcagcgggtcttcaaggagaaggtggacacccgcaccccgaaggccaagcgcggcaccgcgcagatcatggaagtgacggccaagtggctctggggtttcctctcccgcaacaagaagccccggatctgcacccgcgaggagttcacccggaaggtccgcagcaacgccgccatcggggcggtattcgtggacgagaaccagtggaattccgcgaaggaggccgtcgaggacgagcggttctgggacctggtgcaccgcgagcgggagttgcacaagcagggcaagtgcgcgacctgcgtgtacaacatgatggggaagcgcgagaagaagctgggcgagttcgggaaggctaagggcagccgggcgatctggtacatgtggcttggggcccgcttcctcgagttcgaggctctggggttcatgaacgaagaccactggttctcccgggagaacagcctgtccggcgtggagggggaaggcctccacaaactggggtacatcctgagggatatcagcaaaatacccggcggcaacatgtatgccgatgacacggccgggtgggacacccggatcactgaggacgacttgcagaatgaggcgcgcatcaccgacataatggagccggagcacgcattgctggccaagtcaatcttcaagctcacgtaccagaacaaagtggtgcgcgtccaacggcccgccaagaacggcaccgtgatggacgtgatctcgaggcgggaccaacgcgggagtggccaggtcggcacctacagcctgaataccttcacgaacatggaggcccagctgatcaggcagatggagtccgaggggatctttagcccctccgagctcgaaacccccaacctggcggagcgcgtgctggactggctggagaagtacggtgtggagaggctgaagcgcatggctatcagcggagacgactgcgtcgtgaagccgatcgacgacagattcgcaactgcgctgaccgccctcaacgacatgggcaaggtgcgcaaagacatcccccagtgggagccctccaaggggtggaacgactggcagcaggtccccttttgctcccatcatttccaccagctgatcatgaaggacggccgggagatcgtggtgccgtgccgcaatcaggatgagctcgtaggccgggcacgcgtatcgcaaggggccggctggtccctacgggagacggcatgcctgggcaagagctacgctcagatgtggcaactgatgtatttccaccgccgggatctgcgcctggcggccaacgccatctgctctgccgtgcccgtcgactggatcccgaccagccggaccacctggtccatccatgcgcatcaccagtggatgacgaccgaggacatgctgagcgtctggaaccgcgtctggatcgaggagaacccctggatggaggacaagacccacatctccagctggggtgacgtcccttacctcggtaaacgagaggaccagtggtgcggctcactgatcggcttgaccgcgcgggcaacgtgggccaccaacatacaggtggccatcaaccaggtgcgccggctcatcgggaacgagaactacctggattacatgaccagcatgaaacgcttcaagaacgagtccgaccccgagggcgccctgtggtga

SEQ ID NO: 23852 - RNA, 9879 nt, synthetic construct
  misc_feature 1..9879: note = derived and/or modified CDS sequence (opt11) from DENV-1__HM181952__SS-prME
  source 1..9879: mol_type = other RNA
agcgttaccatgttactgatgctgatgcctactgccctggcattccacctcacaacccggggtggggagccccacatgatcgtgagcaagcaggagcggggcaaaagtctactcttcaagaccagcgccggcgtgaacatgtgtaccttaattgccatggacctgggtgagctttgcgaggacaccatgacctacaagtgccctaggatcaccgaggccgaacccgacgacgtagactgctggtgcaacgccacggacacgtgggtcacctacggtacgtgcagccagaccggcgagcacaggcgagagaaacggtccgtggccctcgcgccccacgtaggcctgggcctcgagacgcgcaccgagacctggatgagctccgagggcgcctggaagcagatccagcgagtcgagacctgggccctccgccatcccgggttcacggtaatcgcactcttcctagcgcacgccatcggcaccagcataacccagaaggggatcatattcattctcttgatgttagtgaccccctccatggccatgcggtgcgtcggcatcggcagccgcgacttcgtggaggggctctccggtgctacgtgggtggacgtcgttctggagcatgggagctgcgtgaccaccatggctaaggacaagcccaccctggacatcgagctccttaagacggaggtcaccaaccccgcggtgctgcggaagctctgcatcgaggcaaagatcagtaatacaacaacggacagccgatgcccgacccagggcgaggccaccctagtggaggagcaggacgccaacttcgtctgtcggcgcactttcgttgacagaggatggggtaacggctgcgggctgtttggaaaagggtccctcctgacgtgtgccaaattcaagtgcgtcaccaagctcgaaggcaagatcgtccagtacgagaacctaaagtattcagtgattgtgaccgtccacacaggcgaccaacaccaggtgggaaatgagtccaccgagcacggaaccaccgcgaccatcacgccccaggcccccacgaccgagatccagttgacagattacggggccctgacactcgattgtagcccccgcacgggcctggacttcaacgagatggttctgctcaccatgaaggagaagtcctggctggtccacaagcaatggttcctggacctccccctgccttggaccagcggagcctccacctcccaggagacctggaaccgccaggacctgctcgtaacctttaaaaccgcccacgcgaagaagcaggaagtcgtggtactgggctcacaggagggagcgatgcacacagccctgacgggggccaccgagatccagacctccggcaccactaccatcttcgccgggcatctcaaatgccgattgaagatggacaagctgactctcaagggcatgagctacgtaatgtgcaccgggtccttcaagctggaaaaggaggtagcggagacacaacacggcaccgtgctggttcagatcaagtatgagggcacagacgccccctgcaagatccccttcagcacccaagacgagaaaggtgtgacgcagaacggccggttaatcaccgcgaacccgatagtcaccgacaaggagaagcccgtcaatatagaggccgaaccgccatttggggagtcctacatcgtgatcggcgcgggcgagaaagcactcaaactaagctggtttaagaaggggagtagcatcggtaagatgttcgaggccaccgcccgcggggccaggcgcatggctatcctcggtgacacggcctgggacttcgggtccatcggcggcgttttcacgagcgtcgggaagctcgtgcaccagatcttcggcaccgcctacggggtcctgttctccggcgtgagctggaccatgaagatcgggatcggcgtgctgctcacgtggcttggcctgaacagtcgcagcacctccctcagcatgacctgtatcgccgtggggctggtcaccctctatctcggcgtcatggtgcaggcggactccgggtgtgttataaactggaagggccgggaactaaagtgcgggagcggtatcttcgtgaccaatgaagtccacacctggaccgagcagtacaagttccaggcggacagcccgaagcgcctttcggccgccatcggaaaggcttgggaagagggggtctgcggcatccggagcgcgacccgcctcgagaacatcatgtggaagcagatttccaacgagctgaaccatatactgctcgagaacgatatgaagttcaccgtggtggtcggggacgtggcgggcatcctggtgcaggggaagaagatgatccggccccagccaatggagtacaagtacagctggaagtcctggggcaaagccaaaatcatcggcgccgatgtgcagaattctacgttcattatcgacgggcccaacaccccggagtgccccgacgaccagcgcgcctggaatatctgggaggtggaggactacggcttcggaatcttcaccaccaacatctggttaaagctccgggattcctacacacaggtgtgcgaccatcgtctcatgagcgccgccatcaaggactccaaggccgtccatgccgacatgggctactggatcgagtcagagaagaacgagacctggaagctggccaaggcgtccttcatagaggtgaagacctgcatctggcctaagtcacataccctctggtccaacggagtgctagagagcgagatgatcattcccaagatccacggcggcccgatctcccagcacaactaccggcccgggtacttcactcagaccgccggcccctggcacctcgggaagctcgagctggattttgacctatgcgagggcacgacggtcgtggtggacgaacactgcggcaacagggggccaagcctccggacgaccaccgtcaccggaaagatcatccacgagtggtgttgccgctcctgcacgctgccgcccctgcggttccgcggggaggatggctgctggtatgggatggagatccggcccgtgaaggagaaggaggagaacctcgtgaagtccatggtaagcgcagggagtggagaggtggacagcttctccctggggcttctctgtatcagcatcatgatagaggaggtaatgcgctcccggtggagcagaaaaatgttgatgactggcaccttagctgtcttcttcctcctgatcatgggccaactgacctggaacgacctcatccggttgtgcatcatggtgggcgccaacgcgtcggaccgcatgggtatgggcacgacctacttggccctcatggccaccttcaagatgcgaccgatgttcgccgtcggactgctgttccggcgcctcaccagccgggaggtcctgctgcttacgatcggactgtccctggtggcaagcgtggagctcccgaactccctggaagagctgggcgacgggctcgcgatgggcattatgatcctgaagctgctaaccgacttccagagctaccagctatgggccacacttctaagcttaactttcatcaagacgacgttcagtctgcattacgcctggaagaccatggcaatggtcctttccatcgtgagcctgttccccctgtgtctctccaccacgagccagaaaaccacctggctgcccgttctactcggctcgctgggttgcaagccgctgactatgtttctcatagcagagaataagatctgggggcgcaagtcctggcccctgaacgaggggatcatggccgtgggcatcgtgagcatactgctctctagcctgctgaaaaatgatgtccctctcgccgggcccctgatcgccggcggcatgctgatagcctgctacgtaatatccgggagctccgcggacctcagcttagaaaaggccgctgaggtgtcctgggaggaggaagccgagcacagcggcgcctcccacaatattctggtggaggtccaagatgacgggacgatgaagatcaaggacgaggagagagacgacaccctcaccatcctgctaaaagcgaccctcctggccgtaagcggcgtctacccgctatccatccccgccacccttttcgtgtggcacttctggcagaagaagaagcagcgcagcggggtgctgtgggacacgcctagcccccctgaggtcgaacgagccgtgctggacgacggaatctacaggataatgcagcggggcctgctcggacgcagccaggtgggcgtcggggtgttccaggagaacgtgttccacaccatgtggcacgtgacccggggcgcagtgctgatgtaccaggggaagcgccttgagccctcatgggcgagcgtgaagaaggacctcatctcctatggcggcgggtggcggttacagggcagctggaataccggggaggaagtccaggttatcgccgtggagcccggtaagaaccctaagaacgtccagacggcccccgggacctttaagacccctgagggtgaggtgggcgcgatcgccctggacttcaaacccgggacctccgggtcacccatcgtcaaccgtgaggggaagatcgttggcctctacggcaacggggtggtgacgaccagcggcacctacgtctccgccatcgctcaggccaaggcaagccaggaggggccgctgcctgagatcgaagacgaggtgtttcggaagcggaacctgactatcatggacctccatcccggatccgggaagacgcggcgttacttgccggcgatcgtaagggaggccatcaagcgcaagctgcggaccctcatcctggcccccacccgcgtggtggccagcgagatggccgaggcgctgaagggcatgccgatccgctaccagaccacggcagtgaagagcgaacacaccggaaaagagatcgtcgacctgatgtgccacgcaaccttcactatgcggctgctgagccccgtgcgcgtgccgaactacaacatgatcatcatggacgaggcccacttcactgacccctccagcatcgccgcgcgagggtacatcagcacccgcgtaggcatgggggaggccgccgcgatcttcatgaccgctacgccgccgggtagcatggaggcattcccgcagtccaatgccgtgatccaggacgaggagcgggacattcccgagagaagctggaactccgggtacgagtggatcacggacttccccggcaagaccgtctggttcgtccccagcatcaaggccggaaacgacatcgctaactgcctcagaaagaatgggaagcgcgtgatacagctgtcccgtaagacctttgacaccgagtaccagaagacgaagaacaatgactgggactacgtggtcacgacagacatcagcgagatgggggcgaactttcgcgccgaccgggtgatcgatcctcgccggtgcctgaaacccgtgattttaaaggacgggcccgagcgcgtcattctggccggcccaatgccggtgaccgttgcctccgccgcgcagcggagggggagaattggccgcaaccacaacaaggagggcgaccagtacatatacatgggacaacccctgaacaacgacgaggaccatgcccactggacggaggcgaagatgctcctggacaacatcaatacgcccgagggcatcatccccgccctgttcgagccggagcgggaaaaatccgccgcgattgacggggagtaccgactccgcggcgaggcccggaagaccttcgtggagctcatgcgtcgcggggacctccccgtgtggctctcctacaaggtcgcgagcgagggcttccagtactcagaccgccggtggtgcttcgacggcgaacgcaacaatcaggtgcttgaggaaaacatggacgtggagatctggaccaaggagggggagcggaagaagctgcgcccccggtggctcgatgcccgcacgtactccgacccgctggccctgagagagttcaaggagttcgcggcgggcaggcggagcgtctccggtgacctcatcctggagatcggcaagctgccgcagcacctcacacagcgtgcccagaacgctctggataacctggtgatgctccacaacagcgagcaaggcgggcgggcgtaccgccacgccatggaggagctgcctgacaccatcgagacccttatgctcctggccctgatcgccgtgctcacgggcggggtcacccttttcttcctgtcaggcaagggactaggcaagaccagcatcggtctgctgtgcgtgatggcctcctcggtgctgttgtggatggcgtccgtcgagccccactggatagccgccagcatcatcttggagttcttcctcatggtgcttctgatccccgagccggaccggcagcgcacgccccaggacaaccagttggcctacgtggtcatagggctgctgttcatgatcctcacggtggccgcgaacgaaatgggcttgctggagacgaccaagaaggatctcgggatcggacacgtggccgtagagaaccaccatcacgcggccatgcttgacgtggatctgcaccccgccagcgcgtggaccctctacgccgtggccaccacaatcatcacccccatgatgcggcacaccatcgagaacacgaccgccaacatctcactgacggccatagcgaatcaggccgccatcctgatggggttagataagggctggcccatttccaagatggacatcggcgtacccctgctggccctcgggtgctactcacaagttaaccccctgaccctgaccgcagctgtcctcatgctggtggcccactacgctattgtgggcccggggctgcaagccaaggcgacgagggaggctcagaagcggactgccgccggcatcatgaagaaccccaccatcgacgggattgtggccatcgacctcgaccccgtcgtgtacgacgcgaagttcgaaaaacagctgggccagattatgctgctcatcctgtgcacatcccagatcctgctcatgcgcacgacctgggccctgtgcgagtccatcaccctggccaccggccccttgacgacattgtgggaggggtcacctggcaagttctggaacactacgatcgccgtgagcatggccaacatcttccgaggatcctaccttgcgggggccggcctcgcgttcagcctgatgaaaagcctcgggggaggacgcagggggactggggcccagggcgagaccctaggcgaaaaatggaaacggcagctgaaccagctgtccaagagcgagttcaacacctacaagcgcagcgggatcatggaggtcgatcggagcgaggccaaagaaggactgaaacgcggggagaccacgaagcacgccgtttccagaggcaccgccaagctccgctggttcgtggagcggaacctggtcaaacccgaaggcaaggtgatcgaccttggatgcggtcgcgggggctggagctactactgtgcgggtctcaaaaaagttaccgaggtcaaaggctacaccaagggcgggcctggccacgaggagcccatccccatggcaacgtacgggtggaacctggtcaagctgcactccggcaaggacgtgtttttcataccgcccgagaagtgcgacaccctcctgtgcgacatcggggagagcagtcccaaccccaccatcgaagagggccggacactgcgcgtcctcaaaatggtagagccctggctgcgggggaatcagttctgcatcaagatcttaaacccctacatgcccagcgtagtcgagacgctcgagcagatgcagcgcaagcacggcggcatgcttgttcggaacccgctatccagaaactccacgcacgagatgtactgggtctcttgcgggaccggcaacatagttagcgcggtgaacatgacctcacggatgctactgaatcgcttcaccatggctcacagaaagcctacatacgagcgtgacgtggacctgggggcaggtacacgccacgtcgccgtagaacccgaggtggcgaacttagacatcatcggccagagaatcgagaacattaagcacgagcacaagagcacctggcattacgacgaagacaacccctacaagacctgggcgtaccacgggtcctacgaggtcaagccgtcgggctccgccagctccatggtgaacggggtcgtgaagctgctgacgaagccctgggatgtgatcccaatggtcacccagatcgccatgaccgacaccacgcccttcggtcaacagcgcgtgttcaaggagaaggtggacacccggaccccgaaggccaagcgcgggaccgcccagatcatggaggtcacggctcggtggctctggggcttcctgagtcgcaataagaagccccggatctgcacccgcgaggagttcacacgcaaggtgcgcagcaacgccgcaattggcgcagtgttcgtcgacgagaaccagtggaacagcgcaaaggaggccgttgaggacgaccgtttctgggacctagtacatcgcgagcgggagctccacaagcaagggaagtgtgcgacctgcgtctataacatgatgggcaagagagagaagaagctgggggagttcggcaaggccaaaggttcgcgcgccatatggtacatgtggctgggcgcgcgattcctcgagtttgaggccctgggcttcatgaacgaggatcactggttctcgcgggagaacagcctgtccggggtcgagggcgaagggcttcacaagctgggatacatcttgcgcgacatatcaaagatccccggtggcaacatgtacgctgacgacacagccggctgggacacccggatcaccgaggacgacctccagaacgaggccaagatcaccgacatcatggagccggagcacgcgctactggccaagtcaatattcaagctcacttaccagaacaaggtggtccgcgttcagcggcccgccaagaacggaaccgtgatggatgtaatcagccgccgcgaccagcggggctcgggccaggtaggcacctacggccttaacaccttcacgaacatggaggcccagcttatccgccagatggagagcgagggaatctttctccctaacgagctggagacccccaacctggccgagcgggtgcttgactggctggagaagtacggcgtcgagcgccttaaacggatggcgatatccggggacgactgcgtggttaagccgattgacgaccgcttcgccaccgcgttgacagctctgaacgacatggggaaggtccggaaggacatcccccagtgggagcccagcaaagggtggaacgactggcagcaggtccccttctgttcccatcacttccaccagctgatcatgaaagacgggcgcgagatcgtggtcccgtgccggaaccaagacgaattggtgggccgcgcccgggtgagccagggggcgggctggtccctgcgcgagacggcctgtctgggaaagtcgtacgcccagatgtggcagctcatgtacttccaccggcgagatttacggctggccgcgaacgccatctgcagcgccgtcccagtggactgggtgcccacctcccgcaccacgtggagcatccacgcccaccaccagtggatgacgacagaagacatgttatccgtctggaaccgggtgtggattgaggaaaatccctggatggaagacaagacccgcatcagctcctgggaggacgtgccgtacctgggaaagcgggaggaccagtggtgtggaagcctgattggtctcacggcccgcgcgacgtgggccaccaatatccaagtggccatcaatcaggtccgcaggctgatcggcaacgagaactactccgactacatgaccagcatgaagaggttcaagaacgagtccgagcccgagggggccctgtggtaa

SEQ ID NO: 23853 - RNA, 9879 nt, synthetic construct
  misc_feature 1..9879: note = derived and/or modified CDS sequence (opt11) from DENV-1__HM181953__SS-prME
  source 1..9879: mol_type = other RNA
agcgtgacaatgctgctcatgttgatgcccacggcgctagcttttcacttgactacccggggcggggaacctcacatgatagtgagcaaacaggaacgaggcaagtccctcctgtttaaaaccagcgcgggagtaaacatgtgcacgctcattgccatggatctgggcgagctgtgtgaggacacgatgacttacaagtgccccaggatcaccgaggccgagcccgacgacgtggactgctggtgcaacgccacagacacgtgggtgacctacgggacctgctcgcagaccggcgagcaccgtcgcgacaaacggtccgttgcgttagcgccacacgtggggctgggtctggagacgaggaccgagacctggatgagcagtgaaggcgcatggaagcagatacagcgggtggagacctgggccctccgccaccccggattcacggtgattgctctattcctggcccacgccataggcaccagcataacccagaaagggataatcttcatcctattgatgctggttaccccctccatggccatgcgatgcgtcggcatcggcagccgtgactttgtggaagggctctccggcgcgacttgggtggacgtcgtacttgagcacgggagttgtgtgaccaccatggccaaggacaagccgacgctagatatcgagctcttaaagaccgaggtcaccaaccccgctatcctgcggaaactctgcatagaggccaagatctccaacaccaccacggacagccgttgcccgactcagggcgaggcgactctagtggaagaacaggacgctaactttgtatgccgccgcacgttcgtcgatcggggctgggggaatggctgcgggctgttcggcaaggggtcccttataacctgcgccaagttcaaatgcgttactaaacttgagggcaagatcgtgcaatacgaaaacctgaaatacagcgtcatcgtgaccgtgcacaccggtgatcagcaccaggtggggaatgagtccacggagcacggcaccacggctaccatcacgccacaggcccccacgacagagatacagctcaccgactacggggccctgaccctagactgcagcccccgcacgggcctcgacttcaacgagatggttcttctgacgatgaaggagaaatcatggctcgtccataagcaatggttcctcgacctgcccctaccctggacaagcggtgcctcgacttctcaggagacatggaacaggcaggacctgcttgtaaccttcaagaccgcacacgcgaaaaagcaggaggtggtcgtgctcggatcacaggagggggccatgcacaccgccctgaccggcgccaccgaaatccagaccagtggtactacgaccatcttcgccgggcacctgaagtgtcggttgaagatggataagctaaccctgaagggcatgagctacgtgatgtgcaccgggtccttcaagctcgaaaaggaggtcgcggagacccagcacggaacggtgctggtacaaatcaagtacgagggcactgacgcaccctgtaagatccccttcagcacacaggacgagaaaggggtaacgcaaaacggccggctgataactgcgaacccgatcgtgacagacaaggagaagcccgtgaatattgaagccgagccgccttttggagagtcctacatcgtaatcggcgccggcgagaaagcactgaagctcagctggttcaagaaggggtcatctatcggtaagatgtttgaagccaccgcgcgaggggcccggcgcatggcgatcttgggcgacacggcctgggacttcgggtccatcggtggcgtcttcaccagtgtggggaagctggtccaccagatcttcggcaccgcctacggggtcctcttctccggggtgtcatggaccatgaagatagggatcggtgtcctgctgacatggcttggcctgaactctcgttctacttccctgagcatgacctgcatcgccgttgggctcgtgaccttgtacctgggagtaatggtccaggcggactccggctgcgtgatcaattggaagggccgcgagctcaagtgcgggagcggaatcttcgttaccaacgaagtgcacacctggaccgagcagtacaaattccaggccgacagccctaaacgcctgtccgccgccatcggtaaagcatgggaggaaggcgtgtgcggcatccggagcgccacccgcctggaaaacatcatgtggaagcaaatttccaacgagttgaaccacatcctgttagaaaatgacatgaagttcaccgtcgtggtgggcgacgtcgcgggcatcctcgtacaggggaagaagatgatccgtccccagccaatggagtacaaatacagctggaagtcgtggggcaaagccaagatcataggggcggacgtccaaaacacgaccttcatcatcgacgggcccaacaccccggaatgccccgatgaccagcgcgcctggaatatatgggaagtcgaagactacggcttcggaatcttcaccaccaatatctggcttaaacttagggacagctacacccaggtttgtgatcacaggctcatgagtgcggcgatcaaggatagcaaggctgtacacgccgatatgggttattggatcgaatccgagaagaacgagacgtggaagctggcccgggcgagtttcatcgaggtgaagacctgcatatggccgaagtctcacacgttatggtcgaacggagtgctagaatcggagatgattatccccaagatctacggtggcccgatatcacagcacaactaccggcccgggtattttacccaaacagccggcccctggcacctaggcaagctggagctagacttcgacctgtgtgagggcacaacggtcgtcgtagatgagcactgcggaaaccggggcccgtccctccgaaccaccaccgtaaccggcaagatcatccacgagtggtgctgccgtagctgtacgctgccacccttgcgcttccgcggtgaagacggctgctggtacggaatggagatccgtccggtcaaggagaaggaggagaacctcgttaagtccatggtgagcgccggcagcggcgaggtcgacagcttcagtctcgggctgctgtgtatttccatcatgatcgaggaggtgatgcggagcagatggtcccggaaaatgttgatgaccgggaccctggctgtgttcctgctcttgatcatggggcagctgacgtggaatgacttgatccggctgtgcatcatggtcggcgcaaacgcgagcgatcgcatggggatgggcactacctatctggccctcatggccacgttcaagatgcggccgatgttcgcagtgggcctgctgttccgccggctcacgtcgcgagaggttctactgctcaccatcgggctgagcctggtggcctcagttgagctccccaatagcctggaggaactaggtgacgggctggcgatgggcatcatgatcctgaagttactcaccgatttccagagtcaccagctgtgggcaaccctgttaagtctgacgtttatcaagaccacctttagcctgcactatgcctggaagaccatggcgatggtcctcagcatcgtgagcctgtttcctctgtgcctcagcacgacctctcagaagaccacctggctgcccgtgctgctcggcagcctgggttgcaagccacttacaatgttcctcatagcggagaacaaaatctggggccggcgcagttggcccctgaatgaagggatcatggccgtcgggatcgtcagcatactcctcagctccctgcttaagaacgatgtgcccctcgccggaccgctgatagccggcggcatgctgatcgcatgctatgtcataagcgggtccagcgccgacctctccctggaaaaggccgccgaagtttcttgggaagaggaggcggagcactccggtgccagccacaacatactcgtggaggtccaggacgacggaaccatgaagatcaaagacgaggaacgagatgataccctcaccatcctgctgaaggcgacactcctagccgtgtctggcgtgtacccactgagcatccctgccaccctcttcgtatggtatttctggcagaagaaaaagcagcgctccggcgtgctatgggatacccccagcccgccggaggtggagagggccgtcctggacgacggcatataccgaatcatgcagcggggcctgttagggcgcagccaggtgggtgtgggggtcttccaggagaacgtgttccacaccatgtggcacgtgacccggggcgccgtcctgatgtaccaagggaagcgcctggagccctcatgggcgtccgtgaagaaggacctcatctcttacggaggagggtggcggttacaaggtagctggaatacgggggaggaggtgcaggtcatagcagtggagcccgggaagaaccccaagaacgtgcaaaccgcccctggcacattcaagacgccggagggagaagtcggcgccatcgctctggacttcaagcccgggaccagcggctcgcctatcgtgaacagagaggggaagatcgttggcctctacggcaatggtgtggtgaccacttcaggcacttatgtgagcgcaatcgcccaggccaaagccagtcaggaggggccgctgcccgaaatcgaggacgaagtctttcggaagcggaacctgacaatcatggacctacaccccggcagcggaaagacccggagatatctgccggccatcgtgcgggaggccatcaaacgcaagctgcgaaccttaatcctcgcaccgaccagggtggtcgcctccgagatggccgaggcgttaaagggcatgcctatccgctatcagacgaccgccgtcaagagcgagcataccggcaaggagattgtggacctcatgtgtcacgccacgtttaccatgcggctgctgagtcctgtacgcgtgccgaactataacatgatcataatggacgaggcccacttcacagaccccagctcgatcgctgcccgggggtatatcagcaccagagtgggtatgggggaggccgcagcaatctttatgacggctacgccgcccggctccgtagaggcattcccgcagagcaacgcggtgatccaagatgaggagcgggacatacctgagcgctcatggaatagcggctatgagtggatcaccgacttccccggcaagacggtctggttcgtcccctccataaagagcggcaacgatatcgcgaactgccttcggaagaacggaaagcgcgtgattcaactgtccaggaagaccttcgacacggagtatcaaaagaccaagaacaacgactgggattacgtggttaccaccgacatctcggagatgggagcgaatttccgagcagacagggtgatagaccctaggaggtgcctcaaaccggtgatccttaaggacgggcctgagcgcgtcatattggccggccccatgccggtaacggtcgcttcggccgcccaacgtagagggcggattggccgaaatcataacaaggagggcgaccagtacatctacatggggcagccactgaacaacgacgaggatcatgcgcactggactgaggctaagatgctcctggacaatatcaacacccccgaggggattatccccgccttattcgagccagagcgcgaaaagtccgcggccatcgacggggagtacaggctccgcggggaggcccggaaaaccttcgtagaactgatgcgtagaggagacctgcccgtttggctttcctacaaggtcgcgagtgagggctttcagtacagcgatagaaggtggtgttttgacggcgagcgcaataaccaagtacttgaggagaacatggacgtcgaaatttggaccaaagagggggaacggaagaagctgagaccccgatggctcgatgctcgcacctactccgatcccctggccctgcgagagttcaaggagttcgccgcgggccgacgcagcgtctctggtgacctcatcctggagatcggcaagctgcctcaacacttgacccagcgcgctcaaaatgccttggacaaccttgtcatgctccacaactctgagcagggcggacgggcctacaggcacgccatggaggaattgccggacaccatcgagacgctgatgctcctggccctgatcgccgtgctcaccggcggggtcaccctgttctttctcagtggccgggggttgggcaagacaagcatcggcctgctatgcgtgatggcctccagcgtgctcctatggatggcctccgttgagccgcattggatcgcggccagcattatactggagttcttcctcatggtgctgttaatccccgagccggaccgccagcggacgccgcaggataatcaactcgcctacgtcgtcattgggcttctgttcatgatcctgacggtggccgcgaacgagatgggcctattagagactacgaagaaggatctcgggatcggccacgtggccgttgggaaccaccaccatgccgccatgctggacgtggatctccaccctgcctccgcctggaccctctacgccgtagccacgacaatcattactccgatgatgcgccataccattgagaacacgaccgccaacatcagcttaacagccatcgcgaaccaggcggcaatcctgatgggcctcgataagggctggcccatttccaagatggacatcggggtccccctgcttgcactcggctgctacagtcaggtgaacccccttaccctgacggccgcggtgctaatgttggtcgcccactacgccattatcggacctgggcttcaggccaaggccacacgcgaggcgcagaagcggacggccgccggcatcatgaaaaatccgaccgtcgacggaatcgttgccatcgacctcgaccctgtcgtgtacgatgccaagtttgagaagcaactgggtcagatcatgctgctgatcctctgcacgtcccagatcctgctcatgaggaccacctgggctctgtgcgagtctatcacccttgccactggtcccctgactaccctatgggagggctcccccgggaaattttggaatactacgatcgccgtgtcgatggccaatatcttccgggggtcctacctagctggcgcgggtctggccttttcactgatgaagtccctaggcggaggccgccgggggaccggcgcccaaggcgagaccctcggggagaagtggaagagacagttgaaccagctatccaaactagagttcaatacgtacaagcgaagcggcataatggaagtagacaggtccgaagccaaagaggggctgaagagaggggaaacgaccaagcatgcggtgagccgcgggacggccaagctgcggtggtttgttgagaggaaccttgtcaagcctgagggcaaggtgattgacctcggctgcggtcgtggtggatggtcatactactgcgcgggcctgaagaaggtgaccgaggtcaaggggtacaccaaaggcggacccgggcacgaagaacccatcccgatggcgacctacggttggaacctggtgaagctccactcaggaaaagacgtgttctttatcccacccgagaagtgcgacaccctgctttgcgacatcggggaatctagccccaatccgacaatcgaggaagggcgaacgctccgggtcttgaaaatggtggagccctggctgcgcggcaaccagttttgtatcaaaatcctcaacccctacatgccctccgtagtcgagacactggaacagatgcagaggaagcatggcggcatgttagtacgcaacccgttaagccggaactccacccacgaaatgtactgggttagctgcggaaccggtaacatagtctccgccgtaaacatgacgtctcgcatgctgctgaaccgcttcaccatggcgcaccggaagccgacctatgagagggacgtggacctcggtgctggcacccggcacgtcgccgtagagccggaggtggccaatctggacatcatcgggcagagaattgagaacatcaagcacgagcacaagtccacctggcactacgatgaggacaatccctacaagacctgggcctaccacggctcctacgaggtcaaaccgtccggtagcgcgtcctcgatggtgaacggagtggtgaagctcctgacaaagccatgggacgtgatcccaatggtcacccagatcgccatgacagacacgacccccttcgggcagcagcgggtgttcaaggagaaggtcgacacccgcaccccgaaagccaagcgtggcacggcccaaatcatggaggtcaccgctaagtggttatggggcttcctatctcgcaacaagaagccccggatatgcacccgcgaggagtttaccaggaaggttcggtccaacgcggccataggggccgtgtttgtagacgaaaaccagtggaactcagcgaaggaagcggtggaggatgagaggttctgggacctcgtccaccgcgagcgggagctgcacaagcaaggtaagtgcgccacatgtgtctacaacatgatggggaaacgtgagaagaaactgggcgagttcgggaaggccaaaggctcccgggcaatttggtacatgtggctcggcgctcgcttcctggagtttgaagcgcttgggttcatgaatgaggaccattggttcagccgcgagaactccctgagtggcgtggaaggggaaggactgcacaaactgggttatatcctccgagacatatccaagatccccggcggcaacatgtatgctgacgacaccgcgggctgggacacgcggatcacggaggacgatctacagaacgaggcccgcatcacggacattatggagccggagcacgccctgctagccaagtctatcttcaagctgacttaccagaacaaggtggtccgcgtccagagacccgccaagaatggcaccgtaatggacgtcatctcccgcagagaccaacgcgggtcgggtcaggtgggcacgtacgggctgaacacgtttacaaatatggaggcgcagctcattcggcagatggagtccgagggaatcttcagtccctccgaactagagacccccaacctggccgagcgagtgctcgactggctggagaagtatggagtcgagcggctgaaacgcatggccatctcgggcgatgattgtgtggttaagccgatcgacgatcggtttgcgaccgcccttactgcgctgaacgatatggggaaagtccgcaaggatataccgcaatgggagccctcgaaaggctggaacgattggcagcaggtccccttctgcagccatcacttccaccagctcatcatgaaggacggacgtgagatcgtggtgccgtgccgcaaccaggacgagctagtggggcgggcccgcgtgtcgcagggcgcggggtggagcctgcgggaaaccgcctgtctaggcaagtcatacgcccagatgtggcagcttatgtacttccatcgccgtgaccttcgtctagccgcgaacgcgatctgctccgccgtacccgtggattggatccccacctcacgaaccacgtggtccatccacgcccaccaccagtggatgaccactgaggacatgctcagcgtgtggaacagagtctggatcgaggaaaacccctggatggaggacaagacacacatatcaagctggggcgatgtgccgtacctgggcaagcgagaggaccaatggtgcggctcactgatcgggctcacggctcgggctacgtgggcaacgaatatccaggtagctataaatcaagtacgccggttgatcggcaacgagaactacctggactatatgacctctatgaagcgcttcaagaacgagtccgacccggagggggccttatggtga

SEQ ID NO: 23854 - RNA, 9879 nt, synthetic construct
  misc_feature 1..9879: note = derived and/or modified CDS sequence (opt11) from DENV-1__KF921933__SS-prME
  source 1..9879: mol_type = other RNA
agcgtgaccatgcttctcatgctgatgcctaccgctctggccttccacttgacgacccgcggcggagagccgcacatgatcgtctccaagcaggagcggggcaagagcctgctgttcaagacctccgcgggtgtgaatatgtgcaccctcatcgccatggacctgggggagttatgcgaggacactatgacgtacaagtgcccccgcatcaccgaggctgagcccgatgacgtggactgctggtgcaacgccactgacacgtgggtcacttacgggacctgcagccagaccggcgagcacaggcgcgataagcggtccgtggccctcgcgccccacgtgggcctggggctggaaacgcgcaccgagacctggatgagctccgagggcgcctggaagcagattcagcgcgtcgagacctgggcgctccgccatccggggttcaccgtgattgccctgtttctggcgcatgccatcggcaccagcattacccagaaagggatcatcttcattctcctgatgctggtgaccccctccatggccatgaggtgcgttggcattggctcgcgggacttcgtggaggggctctccggggccacgtgggtggacgtggtgctggagcacgggagctgcgtgacgaccatggcaaaagacaagcccaccctcgacatcgagcttctgaagacggaagtcaccaatcccgcgatcctgcgtaagctctgcatagaggccaagatctccaacacaaccacggatagcaagtgcccgacccagggcgaggcgaccctggtggaagaacaggacgctaacttcgtgtgccgccggaccttcgtcgaccgcggctgggggaacggctgcgggctgttcggcaaggggtcactcatcacgtgcgccaagttcaagtgtgtgaccaagctggagggcaagatcgtacaatacgagaacctgaagtacagcgtcatcgtgaccgtgcacaccggcgaccagcaccaagtcgggaacgaatccacggagcacggaactaccgcgaccataacaccccaggcccccacgaccgagatccaactcaccgactatggggccctgaccctggattgcagcccccgtactggccttgacttcaatgagatggtcctgctgaccatgaaggagaagtcctggcttgttcacaagcagtggtttctggacctcccgctcccctggaccagcggggcaagcacctcccaagagacctggaaccggcaggacctgctggtgaccttcaagaccgcacacgcgaagaagcaggaggtggtcgtgctcggcagccaggagggcgctatgcatacagcgctgacgggggccaccgagatccagacctccggcaccacgaccatcttcgccgggcacctgaagtgccggctcaaaatggacaagctgaccctgaaaggcatgagctacgttatgtgcaccgggtcctttaagttggagaaggaggttgctgagacgcagcacggcaccgtgctggtgcagatcaagtacgaaggcaccgacgccccctgcaagatccccttcagcacccaggacgagaagggagtcacgcagaacggccgcctgatcaccgctaacccgatagtgaccgacaaggaaaaacccgtgaacatcgaggcagagccacccttcggggaatcctacatcgtaatcggcgcgggcgagaaggccctgaagctctcctggtttaagaaggggtcctccatcggcaagatgttcgaggctaccgcccgcggggcccgccgtatggcaatcctgggcgacacggcctgggacttcgggtcgatcggcggagtgttcacctcggtggggaagctggtccaccagatcttcggaacggcctatggggtactcttctcgggcgtgagctggaccatgaagatcgggatcggcgtcctgctgacgtggctcggcctgaactcccgcagcaccagcctgagcatgacctgcattgctgtcgggctagtaacgctgtacctgggtgtcatggtgcaggccgactccgggtgcgtgataaactggaagggccgcgagctcaagtgcgggagcggcatctttgtcacgaacgaggtgcacacctggaccgagcagtacaaatttcaggcggacagcccgaagcggctgtccgccgccatcggcaaagcctgggaagagggggtgtgcggcattcgctcggccactagactggagaacatcatgtggaagcagatctccaacgagctcaaccatatcctgctggagaacgacatgaagttcaccgtcgtcgtgggggacgtcgcgggcatcctcgcccaggggaagaagatgatccgcccccaacccatggagtataagtacagctggaaatcctggggcaaggccaagatcatcggcgcagacgtgcaaaacacgacctttatcatcgacgggcccaacacccccgaatgccccgacgaccagcgggcgtggaacatctgggaggtggaggactacggcttcgggattttcaccacgaacatctggctgaaacttcgcgactcatacacccaggtctgcgaccaccggctcatgtcagccgctataaaggacagcaaagctgtgcacgcagacatgggctactggatcgaatccgagaagaacgagacctggaagctggcacgcgcgagcttcatcgaggtgaagacctgtatttggcccaagtcccacacgctgtggagcaacggagtcctcgagtccgagatgataatccccaagatctacgggggcccaatctctcagcacaactaccggctggggtacttcacccagaccgccggcccctggcacctcgggaagttagagttggacttcgacctgtgtgagggcaccacggttgtggtcgatgagcactgcggcaaccgcgggccctccctccggaccactaccgtgacgggcaagatcatccacgagtggtgctgccgcagctgcaccctgccgcccctgcgcttccgcggggaggacggctgctggtacgggatggagatccggcccgtgaaggagaaagaggagaacctcgtcaagtccatggtgagcgccggcagcggcgaggtggactcttttagcctggggctgttgtgcatctccatcatgattgaggaggtcatgcgctcgcggtggtcccgcaagatgctgatgaccggcaccctggctgtgttcctcctactgatcatggggcagctcacttggaacgaccttatccggttgtgcatcatggttggcgcaaacgccagcgaccgcatggggatggggacgacctacctggccctcatggccacttttaaaatgcgccccatgttcgccgtcggcctactcttccggcgcctcacgtcccgggaggtgctgctcctgaccatcggactgagcctcgtggcgtccgtagagcttccaaacagcctggaggagctcggtgacgggctggccatgggcataatgatactgaagctcctcaccgacttccagtctcaccaactgtgggccactctcctgagcctgactttcattaagactaccttctccctccactatgcctggaaaaccatggcaatggttctgtccatagtctccctgttccccctctgcctgtcgacgacctcccagaaaaccacctggctgcccgtgctcctgggaagcctcgggtgcaagcctctcaccatgttcctgattgccgagaataagatctggggccgcaggtcatggccgctgaacgaggggatcatggccgtgggtatcgtcagcatactcctgtcgtccctgctcaagaacgacgtgcccctggccgggcccttgatcgccggcggcatgctcatcgcgtgctacgtcatcagtgggtccagcgccgacctgtccctggagaaggctgccgaggtcagttgggaggaggaggccgagcacagcggcgcgtctcacaacatcctggtggaggtgcaggacgacggaaccatgaagattaaggacgaggagcgcgacgacactctgaccatcctgttaaaggccaccctgttagctgtctccggcgtgtaccccctcagcatcccggccactttgttcgtatggtacttctggcagaagaagaagcagcggtccggggtcctgtgggacacccccagtccacccgaggtagagcgcgccgtgctggatgacgggatctatcggatcatgcagcgcggtctcctggggaggtcccaggtcggcgttggggtgttccaggagaacgtcttccacaccatgtggcacgtgacccgcggagcggtgctgatgtaccaggggaagcgtctcgaaccaagctgggccagtgtcaagaaggacctgatcagctacggcggcgggtggcgcctgcagggctcctggaacacgggagaggaggtacaggtgatcgccgtcgagcccggcaagaatcccaagaatgtgcagactgcacccgggacattcaaaacaccggagggcgaagtgggcgccattgccctcgacttcaagcccgggacgagcggctccccaatcgtcaaccgggaggggaagatcgtgggcctgtacggtaacggggtggtcaccacctctggcacgtacgtgagcgccatcgcccaggccaaggcgagtcaggaggggccactgccggagatcgaggacgaagtgttcagaaaacggaatctcacgatcatggacctgcatcccggcagcgggaagacccgccgttacctgcccgccatcgtccgcgaggccataaagcggaagctccgcaccctgatactagccccaacccgcgtggtggcctctgagatggccgaggccctcaagggcatgcccatccggtaccagacgaccgctgtcaagagcgaacacaccggcaaggaaatcgtggacttaatgtgccacgccaccttcacgatgcgcctgctctcccccgtgcgggtccccaactacaacatgatcatcatggacgaagcccatttcaccgacccgagctcgatcgcggcccgcgggtacataagcacccgagtgggaatgggtgaggccgccgctatctttatgaccgcgacgccacccggatccgtggaggccttcccccaaagcaatgccgtcatccaggacgaggagcgcgacatcccggagcggtcctggaacagcgggtacgaatggattaccgacttccccggaaagaccgtgtggttcgtgccctccatcaagagcggcaatgatatcgccaactgtttacgcaagaacggcaagcgggtgatccagctgagtcgcaagaccttcgacacagagtatcagaagaccaagaacaatgactgggactacgtggtgaccacggacatcagcgagatgggcgcgaacttccgggccgaccgcgtcatcgacccccggcgctgcctcaagccggtgatcctaaaggatgggcccgagagggtgatcctggctgggcccatgccggtcaccgtggcctctgcggcgcagcgccgggggcgcatcggtcggaaccacaacaaggagggagaccagtacatctacatggggcagccgctcaacaacgacgaggaccacgcccactggaccgaagcaaagatgctgctggacaatatcaacacccccgagggtatcatccccgccctcttcgagcccgagcgggagaaaagcgccgcgatcgacggagagtaccgcctgcggggagaggcccggaagaccttcgtcgagctgatgcggcgcggggatctcccggtgtggttgtcctacaaagtggcctcggagggcttccagtactccgaccgccgctggtgcttcgacggcgagcggaacaaccaggtcctggaggagaacatggacgtagagatctggacgaaggagggtgagcgcaagaagctccggccccgctggctggatgcccggacttactccgacccactggccctccgcgagttcaaagagttcgcggccggccggcgcagcgtatccggggacctgatcctcgagatcggcaaacttccacagcatctgacccagcgggcccagaacgcactagacaacctcgtcatgctgcacaatagcgagcagggcgggcgcgcgtaccgacacgctatggaggagctgccggacaccatcgagacgctcatgctgctggccctcatcgccgtgctcaccggcggggtgaccctgttcttcctctccggccgaggcctgggaaagacctctatcggcctgctctgcgtcatggctagtagcgtactgctgtggatggcgtccgtggagccccactggatcgccgcctctatcatcctcgagttcttcctgatggtcctgctcatcccagagcccgaccggcagaggaccccgcaggacaaccagctggcctacgtggtgatcgggctactcttcatgatcctgacggtcgcagcgaacgagatgggcctgctcgagaccacgaagaaggacctggggatcggccacgtggccgttgggaaccaccaccacgccgccatgcttgatgtcgacctgcaccccgcctccgcctggaccctgtacgccgttgccacgaccataatcacccccatgatgcgtcacactatcgagaacacgacggccaacatcagcctgaccgccatcgcgaaccaggccgccatcctcatgggcctggacaagggctggccgatctcaaagatggacatcggggtgccgctgctcgccttaggatgctacagccaggtgaaccccctgaccctaacggcggccgtgctgatgctggtggcccactacgccatcatagggcccggccttcaggccaaagctacccgcgaggcacagaagcgcacggccgccgggatcatgaagaacccgaccgtcgacgggatcgtggcgatcgacctggaccccgtggtctacgacgcgaagttcgagaagcagctgggccagatcatgctcctgatcctttgtacgtcccagatcctcctgatgcggacaacgtgggccctgtgcgagagcatcaccctcgccaccgggcccctgacgaccctgtgggagggaagcccggggaagttctggaataccacgatcgccgtgagcatggcgaacatctttcggggctcctacctcgcgggcgctgggctggccttcagcctgatgaaaagcctcggcgggggccggcgcgggaccggcgcacaaggcgaaacgctgggggagaagtggaagcggcagctgaaccagctctctaaaagcgagtttaacacctacaagcgctcaggcatcatggaggtggatcggagcgaggcgaaggaggggctgaaacgcggcgagacgaccaagcacgcggtctcccgggggactgccaagctgcgctggttcgtggagcggaacctagtgaagcctgagggcaaggtgatcgacctcggttgtgggcgcggcgggtggagctactactgcgccggcctgaagaaggtgacagaggtgaaggggtacacgaagggcggccccgggcatgaggagcccatccccatggctacctacggctggaacctggttaagctccattccgggaaggacgtgttcttcatcccgcccgagaagtgcgacaccctgttatgcgacatcggcgagagctcccccaaccccaccatcgaggaaggccggacgctccgcgtcctgaagatggtcgagccgtggctgcggggcaaccaattctgcatcaagatcctcaacccctacatgcccagcgtggtggaaaccctggagcagatgcagcgcaagcacggcgggatgctggtccggaatccgctgtcccgcaacagcacccacgaaatgtactgggtgtcctgcggcaccgggaacatcgtgagcgcggtcaatatgacctcccggatgctgctgaaccgcttcacgatggctcaccgaaagccgacgtacgagagagacgtggacctcggcgccggcacccgccacgtggccgtcgagcctgaggtggccaatttagacattatcgggcagaggatcgaaaacatcaagcacgagcacaagagcacctggcactacgacgaggacaatccctacaagacgtgggcgtatcatggctcctacgaggtgaagcctagcggatccgctagctcaatggtgaacggcgtggtcaagctcctcaccaaaccgtgggacgtaatccccatggttacccagatagcaatgacagacacaacccctttcgggcagcaaagggtcttcaaggagaaggtggacacccggacccccaaggccaaacgcggcacggcccagatcatggaggtgaccgcgaaatggttgtggggcttcctgtcccggaacaagaaaccgcgcatctgcacccgggaggagttcacccgcaaggtccggagcaacgccgccatcggggccgtgttcgtggacgagaaccagtggaactccgcgaaagaggccgtcgaagacggcagattttgggacctcgtgcaccgggagcgcgaactgcacaagcaggggaagtgcgccacatgcgtctacaacatgatgggcaagcgggagaagaagctgggggagttcggcaaggccaagggctcgcgggccatttggtatatgtggctcggggcgcggttcctggagttcgaagccctgggcttcatgaacgaggaccactggttctcccgcgagaacagcctctctggggtcgagggcgaagggctgcacaaattaggctacatcctacgggacatcagcaagatccccggcgggaacatgtacgccgacgacacagccggctgggacacccgaatcaccgaggacgacctacagaacgaggcccggataacggacataatggaaccagagcacgcgctgctcgccaagtcaatcttcaagctgacctaccagaataaggttgtgcgggtccagcgcccagccaagaacgggaccgttatggacgttatcagccggcgcgaccagcggggttcaggccaggtcgggacctacggcctcaatacgttcaccaacatggaggcccagctcatacgtcagatggagagcgagggaatcttctcccccagcgagctggagacccccaacctggccgagcgggtgttggattggctggagaagtacggcgtggagcgcctgaagcgcatggcgatatccggagacgactgcgtcgtgaagcccatcgacgatcgcttcgccaccgccctcacggccctgaacgacatgggtaaggtgcggaaggacatcccgcagtgggagcccagcaagggctggaatgactggcagcaggtccccttctgctcccaccacttccaccaactgatcatgaaggacgggcgcgagatcgtggtgccctgccggaaccaggacgagctcgtcggacgcgcccgagtgagccagggggcgggctggagcttgcgagagaccgcttgcctagggaagtcctacgcccagatgtggcagctcatgtacttccaccgacgtgacctgcggctggccgcgaatgccatctgcagcgctgtaccggttgactggatccccacctcccgcaccacatggtctattcacgcccaccatcagtggatgaccaccgaggacatgctctcagtatggaaccgtgtgtggattgaggagaacccctggatggaggacaagacccacatcagctcctggggcgatgtcccgtacctgggcaagcgcgaggaccagtggtgcgggagcttgatcggcctcaccgcccgcgcgacctgggccaccaacatccaggtggccatcaaccaggtgcggcgcctgatcgggaacgagaattacctggactacatgacctccatgaagcgtttcaagaacgagagcgacccagagggcgccctctggtga

SEQ ID NO: 23855 - RNA, 9879 nt, synthetic construct
  misc_feature 1..9879: note = derived and/or modified CDS sequence (opt11) from DENV-1__HM181954__SS-prME
  source 1..9879: mol_type = other RNA
agcgttaccatgctgctcatgctgatgcccaccgccctggcctttcaccttacgaccagaggaggggaaccgcacatgatcgtgagcaagcaggagcggggcaagagcctgctgttcaagacgagcgccggagtgaacatgtgtaccctcattgccatggacctgggggagctgtgcgaggacaccatgacctataagtgcccccgtatcaccgaggccgagccggacgacgtggactgctggtgcaacgctactgacacctgggtgacgtacgggacctgcagccagaccggtgagcatcggcgcgacaagcggtccgtggccctcgcgccacatgtggggctggggctggagacacgcaccgaaacatggatgagctccgagggtgcctggaagcagattcagcgtgttgagacctgggcgctccggcaccctgggttcacggtgatcgccctgttcctggcccacgccatcggtaccagcattacccagaaggggatcatcttcatcctcctaatgctggtgaccccctccatggccatgcgctgcgttggcatcggtagccgcgacttcgtggagggtctctccggcgcaacttgggtggacgtcgtgctggagcatgggagctgcgtgaccaccatggccaaggataagcccaccctggacatcgaactcttgaagacggaggtcacaaatcccgctatcctgcggaaactttgcatcgaggcaaagatctccaataccaccaccgacagccgatgccctacccagggcgaggcaaccttagtggaggagcaggacgccaacttcgtgtgtagacgcaccttcgttgaccggggctgggggaacggctgcggactgtttggcaagggatcactcatcacttgcgccaagtttaagtgcgtgaccaagctggaggggaagatcgtgcaatacgagaatttaaagtacagcgtcatcgttaccgtccacaccggggaccaacatcaggtcgggaacgagtccacggagcacggcaccactgcgaccatcacgcctcaggcccccacgaccgagatccaactcaccgactacggggccctgaccctggactgcagcccccgcacgggcctcgacttcaacgagatggtgcttctgacgatgaaagaaaagagctggctcgtacacaagcaatggttcctagacctgcccctcccctggactccaggggccagtacctctcaggagacgtggaatcgacaggacctcttagtgacgttcaagaccgctcacgcgaaaaagcaggaggtagtcgtgctcggatcccaggagggagccatgcacaccgccctgactggtgcaacagagatacaaaccagcggcactacgaccatcttcgccggacacctgaaatgcaggctgaaaatggataagctgaccctgaaggggatgtcctatgtcatgtgtaccgggagcttcaagctcgagaaggaagtagcggagacgcagcacggcaccgttctggttcaaatcaagtacgaaggaaccgatgccccctgcaagatcccgttctccacccaggatgagaagggggtcacgcagaacggccggctgatcaccgctaaccccatcgtgaccgacaaggagaagcccgtcaacatcgaggcggagcccccgttcggggaaagttacatcgtcatcggggcgggagagaaggcgttgaagctcagttggttcaaaaaggggtcatccatcggcaagatgtttgaggccaccgcccgcggggcacggcgcatggcgatcctcggcgatacggcctgggacttcgggagcatcggcggcgtattcacctccgtgggaaagctggtccaccaaatcttcggcgccgcctacggggtcctcttcagcggcgtgtcctggaccatgaagatcgggatcggcgtcttactaacctggctcggactgaactcgcgcagcaccagcctgtctatgacatgcatagccgtggggctcgtcaccctgtatttaggcgtcatggttcaggcggacagcggctgcgtgattaactggaagggccgggagttaaagtgcggatccggcatcttcgtcaccaacgaggtgcacacgtggaccgaacagtacaaattccaggccgactcacccaaacgtctgagcgccgccatcggcaaggcctgggaggagggggtttgcggtatccggtccgcgacgcgcctggagaacatcatgtggaagcagatcagcaacgaactcaatcacatcctgttggaaaacgacatgaagttcactgtagtggtgggggatgtcgcgggcatactcgcccaggggaagaagatgatccggccgcagcctatggagtacaagtactcctggaagtcctggggcaaggccaagatcatcggcgcggacgtgcagaacaccacattcatcatagacgggcctaacacgcccgaatgccccgacgaccagcgcgcctggaacatctgggaagtcgaggactacggctttgggatcttcaccacaaacatctggttaaagctgcgggactcctacacgcaggcttgcgaccaccgcttaatgtcggccgccataaaagactccaaggctgtccacgccgacatgggttactggatcgagtcagagaagaacgagacctggaagttagcgcgggcctccttcatcgaggtgaagacatgtatttggcccaagagccacactctgtggtccaacggcgtattggaaagcgagatgatcattccgaagatctacgggggtcccataagtcagcacaattatcgacccggctacttcacgcagaccgccgggccgtggcatttagggaaactggagctcgacttcgacctgtgcgagggcacgaccgtggtggtggacgagcactgcggcaatcgagggccctctctgcgcacgacgaccgtcaccgggaagatcatacacgaatggtgctgccggtcctgcacgcttccgcccctccgtttccgcggtgaggacggctgctggtacgggatggagattcgccccgtaaaggagaaggaggagaatctggtcaaaagtatggtctccgcgggcagcggcgaggtggactctttctccctggggctgctgtgcatctcgataatgatcgaggaggtgatgcgaagtcgctggagccggaagatgttaatgaccggcaccttggccgtcttcctgctcctcatcatgggtcaattgacttggaatgacctcattcggctgtgtatcatggtgggcgccaacgcctcggaccgcatgggaatgggcacgacatacctggccctcatggcgaccttcaaaatgcgccccatgttcgccgtgggtctgttgttccgccggctcaccagccgggaagtactgttactaactatcgggctgtccctcgtcgccagtgtggagcttcccaacagtctggaggaactgggcgacggtttggccatgggcatcatgatactgaagctgctcacggacttccagagccaccagctctgggcgaccttgctgagtctgacgttcatcaaaacgaccttcagtcttcactacgcctggaagaccatggctatggtcttaagtatcgtgtcactgtttccgctctgcttatctaccacgtcgcagaagaccacgtggttgccggtcctgctcggcagcctggggtgcaagccgctgaccatgttcctcatcgccgagaataagatctgggggcggcgttcctggcccttgaacgagggtatcatggccgtgggtatcgtctcgatcctactttcgagcttgctgaagaatgacgttccccttgcgggcccattgattgccggcggaatgctgattgcctgctacgtgatctccgggtccagcgccgacctcagcctggagaaagccgcagaagtgtcatgggaggaggaggccgagcacagcggggcttcacacaatatcctcgtcgaagtgcaggacgatgggacaatgaagatcaaggacgaggagcgggacgacaccctcaccatactgctgaaggcaactctcctagccgtgagcggcgtataccccctgtccatccctgcgaccctattcgtgtggtacttctggcagaagaagaagcagaggagcggggtgctgtgggacacgccatccccgccggaggtcgagcgggccgttctggacgatggcatttaccgcatcatgcagcggggcctgctcgggcgctcacaggtgggcgtcggggttttccaggaaaacgtgttccacacgatgtggcacgtcactcggggcgcagtgctgatgtaccaggggaagcgtctcgaaccgtcgtgggccagcgtcaagaaagacctcatatcctacggcggcgggtggaggctgcagggctcgtggaacaccggggaggaggtacaggtgatagccgtggaacccggcaaaaatccgaaaaacgtccagaccgcgcccgggaccttcaaaacccctgagggcgaggtgggagccattgccctggactttaagcccggaaccagcggcagcccaatcgtgaatcgtgaggggaaaatcgtcggcctctacggcaacggggtggtgacgacatccggcacttacgtcagcgctattgcacaggccaaggccagccaggaagggcccctgccggagatcgaagacgaagtgttccggaagcgcaacctgacgatcatggacctccaccccggctccgggaaaacgcgtcgctatctacctgcaatcgtgcgggaggctatcaagcgtaaactgcgtacgctcatactggcgcccacccgtgtcgtggccagcgagatggccgaagctctgaaaggcatgcccattcgctaccaaaccacggccgtgaagtcagagcacaccgggaaggagatcgtagacttgatgtgccacgcgactttcaccatgcggctacttagcccggtacgcgtgcccaactacaacatgatcattatggacgaggctcactttacggacccctcctctatcgccgcccgggggtacatctccaccagggtcggcatgggagaggccgcagccatctttatgaccgccacgccgcccggctcagtggaggcgttcccccaatctaacgccgtgatccaggacgaggaacgggacatccccgagaggtcttggaactccgggtacgagtggattacggactttcccggcaaaaccgtctggttcgtgcccagcatcaagtccgggaatgatatcgcaaattgcctccggaaaaacgggaagcgcgtaatccagttaagccgtaagaccttcgacaccgagtaccagaagacgaagaataacgactgggactacgtcgtgaccaccgacatttccgagatgggcgccaattttcgcgccgaccgggtgatcgacccgcgccggtgcctgaagcccgtcatactcaaggacggacccgaacgagtgatcctcgccggcccgatgcccgtgacggtcgcgagcgctgcgcagcggcgcgggcggatcgggcgcaaccacaacaaagagggtgaccagtacatctacatggggcagcccctaaacaacgatgaagatcacgcccactggacggaggccaagatgctcctggacaacatcaacacccctgagggcatcatcccggcgctgttcgagccagagcgcgagaagtccgccgcaatagacggggaataccggctccgcggtgaggcccggaagaccttcgtggagcttatgcgccgcggcgacctgcctgtctggctcagttacaaagtggcctccgagggattccagtactcagaccgccggtggtgcttcgatggagagcgcaacaaccaggtgctggaggagaacatggatgtagaaatttggaccaaggagggggaacgtaagaaactccgaccgcggtggctcgacgcccgcacgtacagcgacccgctggctttgcgggagttcaaggagttcgccgcaggccgcaggagcgtgtcgggcgacttgattctggagatcggcaagctgcctcagcacctcacccagcgcgctcagaacgcactggacaatctggtgatgttgcacaactccgagcagggcggcagagcctacagacatgcgatggaggaactgcccgacaccatcgagacacttatgctcctggccctgatcgcagtcctgacgggcggggtgaccctgttcttcctgagcggtcggggcttgggtaagaccagcatcggcttgctgtgcgttatggccagttccgttttactctggatggccagcgtggagccacactggatcgccgcgtcaatcatccttgagttcttccttatggtcctgctgatcccggagcccgaccgccagcggacgccgcaggacaatcagctcgcatacgtggtgatcgggctgctgttcatgatcctgaccgtggccgccaacgaaatgggtctgctggagacgacaaagaaggatttaggcataggccacgtcgccgtggggaaccaccaccacgccgcgatgctggatgtcgacctgcacccggcctccgcgtggaccctctacgcagtcgccaccacgatcataacccccatgatgagacataccatcgagaacactacggcgaacatctccctgaccgctattgctaaccaggccgcgatactgatgggcctcgacaagggctggcccatcagcaagatggacataggggttccattgctggccctcggctgctactcccaggtaaacccgttaaccctgaccgccgccgtcctcatgctggtcgcccactacgcaataatagggcccggcttgcaggccaaggccacgcgcgaggcccagaagcggaccgccgcggggatcatgaagaaccccaccgtggacggcatcgtcgctatagatttagatcctgtcgtgtacgacgcgaagttcgagaagcaactgggccagatcatgctgctcatcctgtgcaccagccagatcctgctcatgcgcaccacctgggccctctgcgagtccatcaccctggcaaccggaccgctcacgaccctgtgggaaggaagccccgggaaattctggaacaccaccatcgcggtcagcatggccaacatctttcggggcagctacttggccggtgcagggctcgcgttctcccttatgaagtcccttggcgggggccgccgggggacgggcgcccagggcgagaccctcggggagaagtggaagaggcagctgaaccagctgagcaagtcggagttcaacacgtacaagcggagcggcatcatggaagtggaccgctcagaggccaaagagggactcaagcggggagagaccactaaacatgccgtcagccgcgggacagccaagctgcggtggttcgttgagcgcaatctagtgaaacccgagggcaaagttatcgacctgggctgcgggcggggcgggtggtcctattactgcgcggggcttaagaaggtcacagaggtgaaagggtacaccaaagggggtcccgggcacgaggagccaatccccatggcgacgtacggctggaacctggtgaaactgcacagcgggaaggacgtcttctttatcccgcccgagaaatgcgataccctcctctgcgacatcggcgagtccagcccgaaccccaccatcgaggaggggcgcaccttacgggtgctcaaaatggtggagccgtggctgcgcggcaaccagttctgtatcaagatcctgaacccctacatgccttccgttgtggagacgctcgagcagatgcagcggaagcacgggggaatgctggtccgcaacccgctgagtagaaacagtactcatgaaatgtactgggtcagctgtggcaccgggaacatcgtgtccgccgtgaacatgaccagccgcatgctccttaaccgattcaccatggcccacagaaagcccacgtacgagcgcgatgtcgacctcggggctggcacccggcacgtagcggtggagcccgaggttgccaacctcgacatcatcggacagcgcatagagaacataaagcatgagcacaagtccacctggcactacgacgaggacaacccgtacaagacttgggcctaccatggctcttatgaagtaaagccctccgggagcgccagctcgatggttaatggcgtcgtgaagctgctgacgaagccatgggacgtaatcccaatggtgacccaaatcgccatgactgatacaaccccgttcggtcaacagcgagtcttcaaggagaaggtagacactcgcacccctaaggcaaagcggggcaccgcccaaatcatggaggtgacagccaagtggctatggggattcctcagccgaaacaagaagccccggatatgcacccgagaggagttcacccggaaggtgcgctccaacgcggcgatcggggccgtcttcgtggacgagaatcagtggaacagcgccaaagaggccgtggaggacgagcggttctgggatctggtccaccgcgaacgggagctccacaagcagggcaagtgtgctacctgcgtgtacaacatgatggggaagagagagaaaaagctgggagagtttggtaaggccaagggctctcgggccatctggtacatgtggcttggcgcacgcttcctcgagttcgaggcgctgggattcatgaacgaggaccactggttctctcgggaaaattccctgagcggagttgaaggggaggggctccacaagctggggtacatcctgcgcgacatctccaagatcccgggaggcaatatgtacgccgatgacacggctggctgggacaccagaatcaccgaggacgatctccagaacgaggctaggatcaccgacatcatggagcctgagcatgcgctgctggctaagagcatcttcaagttaacttaccagaacaaggtcgtccgcgtgcagcggcccgcaaagaacggcaccgtcatggacgtgatcagtcgccgggaccaacgcgggagcggccaggtgggaacttatgggttgaacacgttcacgaacatggaggcgcagttgattcggcaaatggagtcagagggcatatttagcccttccgagctcgaaacacccaaccttgccgagcgcgtcctagactggcttgagaagtacggggtagagcggctgaagcgcatggccatcagcggcgacgactgcgtggtcaagcccatcgacgacagatttgccacggccctgaccgcgctcaacgacatgggtaaggtgcgcaaggacatcccacagtgggagccatccaagggctggaatgactggcagcaggtcccgttctgtagccaccatttccatcaattaatcatgaaggacggccgggagatcgtcgtgccctgcaggaaccaggatgagctggtgggacgggcccgcgtctcacagggcgccgggtggagcctccgggagacggcctgtttaggcaagtcttacgcgcaaatgtggcagctcatgtacttccaccgccgggacctccgccttgctgcaaacgccatctgctccgccgtgcccgtggattggatccccacgagccggaccacttggtccatacatgcccaccaccagtggatgacgactgaggacatgctgagcgtttggaacagagtgtggattgaggagaacccgtggatggaagacaagacccacatctcctcgtggggcgacgtcccctatttaggcaagagagaagaccagtggtgcggctctctgatcggccttaccgcccgggccacctgggccaccaacatacaagtcgcaatcaatcaggtgcgccgcttgatcggcaatgaaaactatctggactacatgacaagtatgaaacggtttaagaacgagtccgaccccgagggggcactctggtga

SEQ ID NO: 23856 - RNA, 9879 nt, synthetic construct
  misc_feature 1..9879: note = derived and/or modified CDS sequence (opt11) from DENV-1__HM181955__SS-prME
  source 1..9879: mol_type = other RNA
tctgtgaccatgctgctcatgctgatgcccaccgccctggcattccacttgactacccggggcggggaaccccacatgatcgtgtccaagcaggagcggggcaagagcctgctgtttaagacctccgcaggggtgaacatgtgtaccctcatcgccatggacctgggcgagctgtgcgaggacacgatgacctacaagtgcccacgcatcaccgaggccgagcccgatgacgtcgactgctggtgtaacgccaccgacacgtgggtaacctacgggacgtgcagccagaccggcgagcaccggcgggacaaacgttcggtagccctcgcgccccacgttggcctggggctagagacgcgcaccgagacctggatgtcaagtgagagtgcctggaagcagatccagcgggtcgagacctgggccctccgccaccctggcttcacggtgatcgccttgttcctggctcacgccatagggacctccatcacccagaagggcatcatcttcatcctccttatgttagtgacccccagcatggccatgcggtgcgtcgggatcggctcccgagacttcgtggagggcctcagcggggccacttgggtggacgtcgtgttagagcacggctcctgcgttactaccatggcgaaggacaagcccacgctggacatagagctcctgaagacggaagtcaccaaccccgcgatactgcggaagctctgcatcgaggccaagataagcaacaccaccacggactcccgctgtccgacccaaggtgaggccaccctggtggaggagcaggacgccaacttcgtgtgccggaggacctttgtcgaccggggctggggcaacgggtgcggcctgttcggtaagggctcactcatcacatgcgccaagttcaagtgcgtgaccaagctagaggggaagatcgtgcagtacgagaacctgaaatactctgtcatagtgactgtgcacactggcgaccagcaccaggttggcaacgagagcaccgagcacgggacaacggcgactatcacgcctcaggcccccacgaccgagatccagttaacggactacggcgccttaacccttgactgctcgccccggacggggctcgacttcaacgagatggtcctgctgaccatgaaggagaagtcgtggctcgttcacaagcagtggttcctggacctgcccctcccctggaccagcggcgcctccaccagccaggagacatggaaccggcaggaccttctggtaactttcaagaccgcccacgcaaagaagcaggaggtggttgtgttggggagccaggagggcgccatgcacaccgccctgacaggcgccaccgagatccagacctcagggaccacaaccatcttcgccggccaccttaagtgtcgccttaagatggacaagcttaccctgaaggggatgtcctatgtgatgtgcaccggcagcttcaagctcgagaaggaggtcgcggagacgcagcacggcacagtgctggtgcagatcaagtacgagggcaccgacgccccctgcaagatccccttctccactcaggatgagaagggtgtcacgcagaacggtcggctgatcaccgccaatccgatcgtgacagacaaggaaaagcccgtgaacatcgaagccgagccaccgttcggtgaaagttacatcgtcatcggggcgggcgagaaggccctgaagctctcctggttcaagaagggcagctccatcgggaagatgttcgaggccaccgcccgcggcgcccgacgcatggccatcctgggggacacggcctgggacttcggctcaatcggaggcgtgttcacctccgtaggcaagctggtccaccagatcttcgggaccgcttacggcgtgctgttcagcggggtatcgtggactatgaagatcggcatcggtgtcctgctgacatggctcggcctgaacagccgctccaccagcctgtcaatgacctgtatcgccgtaggactcgtcacactgtacctgggggtcatggtccaggccgacagcggctgcgtgatcaactggaagggacgggagctcaagtgcggctcggggatcttcgtcacaaacgaggtgcacacctggaccgagcagtacaagttccaggcggacagtccaaagcgcctgagcgccgccatcggcaaagcctgggaggaaggagtgtgcgggatacgatccgccacccgcttggagaatatcatgtggaagcaaatcagcaacgagttaaaccatatcctgctggagaacgacatgaagttcaccgtcgtagttggcgatgtcgcgggaatactcgcccagggcaagaagatgatccggccccagcccatggagtacaagtattcctggaagtcctgggggaaggccaagatcatcggcgctgacgtgcagaacacgaccttcatcatcgacggacccaacactccggagtgcccagacgaccagcgcgcgtggaacatctgggaggtggaggactacgggttcggcatcttcactacgaacatctggcttaagctacgggactcctacacccaggtctgcgaccataggttaatgagcgcagccatcaaggactccaaggccgtgcacgccgacatggggtattggatcgagtccgagaagaatgagacatggaaactggcacgggcatcctttatcgaggtgaagacctgcatctggccaaagtctcacactctgtggtcgaacggcgtcctagagagcgagatgatcatccccaagatctacggcgggcccatctcccagcacaactaccgccccggctacttcacccaaaccgccggaccctggcacctggggaaactggaactcgacttcgacctctgcgaggggactacagtggtggtcgatgagcactgtgggaaccgggggccgagcctgcgcacaaccaccgtgacggggaagattatccacgagtggtgctgccggtcctgcaccttaccgccactccgcttccggggcgaagacgggtgctggtacggcatggagatccgccccgtgaaggagaaggaggagaacctggtgaagagcatggtcagcgccgggtccggcgaagtggacagtttcagtctcggactgctatgcatcagcatcatgatcgaggaggtcatgcggtcccgttggtcccggaagatgctcatgaccgggaccctggtggtgttcctgctccttatcatgggccagctgacgtggaacgacttaatccgcctctgcataatggtcggggccaacgcgagtgaccgcatgggcatgggaactacctacctggcgctcatggccaccttcaagatgcgaccgatgtttgcagtgggtttacttttcagacggctgacgtcccgcgaggtgctgctgctcactatcggcctgtccctggtcgccagcgtggagcttcccaactccctggaggagctgggtgacggactggctatggggatcatgatcctgaagctgctcacggacttccagagccatcagctgtgggccacccttttgtcccttacgttcatcaagaccacctttagcctgcactacgcctggaagaccatggccatggtgctttccatcgtgagcctgtttcccctgtgcttgtccacgaccagccagaagaccacctggctgcccgtgctgctcggctccctgggctgcaagccactgacgatgttcctcatcgcggagaacaagatttgggggcggagaagttggcccctgaacgaggggatcatggccgtcgggatcgtgtcaatcctgctctccagcctgctgaagaacgatgtccctttagccggccccctgatcgccgggggcatgctcatagcctgctacgtcatcagcggcagctccgcggacctcagcctggagaaggccgccgaggtgtcctgggaggaggaggccgagcacagcggggcttcccacaatattctagtggaggtccaggacgacggcaccatgaagatcaaagacgaggagcgggacgacaccctcaccatcctgctgaaggcgacgcttctggcggtgagcggcgtttacccgctgtcgatccccgccaccctcttcgtctggtatttctggcagaagaagaagcaacggagcggcgtgctgtgggacaccccgagcccgcccgaggtcgagcgggccgtcctggacgacgggatctaccgtatcatgcagcgaggcctgctcggccgcagccaggttggggtaggcgtcttccaggagaacgtgttccacaccatgtggcacgtgacccgcggagcggtcctcatgtaccaaggcaagcgcctggagccctcctgggcgtcggtgaagaaggacctcatcagttacgggggcggctggcggctgcaggggagttggaacacgggagaggaggtccaggtcatcgccgtggagcctgggaagaaccccaagaacgtgcagacggcccccggcacgttcaaaactcctgagggggaggtcggcgccattgccctggacttcaagcccggcacgtccggctctcccatcgtgaaccgcgagggcaagatcgtggggctctacggcaacggcgtcgtgacaaccagcgggacctacgtgtccgcgatagcccaggccaaggcctcgcaggagggcccgctgcccgagatcgaggacgaggtcttccgtaagcgcaacctgacgataatggacctccaccccgggtccggcaagacacgccgctatctgccggcgatcgtgcgggaggccatcaagcgcaagctgcgcaccctcatcctggcccccacccgggtagtcgcctccgaaatggccgaagcgctgaaagggatgcctatccgctaccaaacgaccgccgtgaagtccgagcacaccggcaaggagatcgtggacctcatgtgccacgcgaccttcacgatgcggctgctgagccctgtccgcgtgccaaactacaacatgatcataatggacgaggcccacttcaccgacccctctagcatcgccgcgcggggctacatctctacgcgcgtggggatgggcgaggccgcagccatctttatgaccgccacgccgcccggcagcgtcgaggctttcccgcagtccaacgccgtcattcaagacgaggagcgcgacatccccgagcgcagctggaactccggctatgaatggatcaccgacttccccgggaagaccgtgtggtttgtccccagcatcaagagcggcaatgacatcgccaactgcctccggaaaaacggcaaacgcgtgatccagctgagccggaaaaccttcgacacggaataccagaagaccaagaacaacgactgggactacgtggtcaccaccgacatctccgagatgggggccaacttccgcgccgaccgggtgatcgacccgcgcagatgcctaaagcccgtgatcctcaaagacggccccgagcgcgtcatcttagccgggcccatgcccgtgacggtagcgtccgcggctcagcgtcgcggcagaatcgggagaaaccacaacaaggagggcgaccagtatatctacatggggcaacccctgaacaacgacgaggaccacgcgcactggaccgaggccaagatgctcctggataatatcaacactcccgaagggatcatccccgctcttttcgagcctgaacgcgaaaagagcgccgccatagatggcgagtaccggctgcgcggggaagcgcgtaaaaccttcgtggagcttatgcgccggggcgacctgcccgtctggttgagctacaaggtagcctcggaagggttccagtactccgatcgcagatggtgtttcgatggcgagcgcaacaaccaagtactcgaggagaacatggatgtcgagatctggacgaaggaaggcgagcggaaaaagctgcgaccccggtggctcgacgcccgcacctacagcgaccctctggcactacgggagttcaaggagttcgccgccggtcgccggtctgtcagcggcgacctcatactggagatcgggaagttgcctcagcacctgacccagcgcgcacaaaacgcgctggacaacctggtgatgttacacaacagcgagcaaggcggccgcgcctaccgacatgcgatggaggagctgccagacaccatcgagacactgatgcttctggccctgatcgccgtgctcaccgggggagtaaccctcttcttcctgagcggccgtggccttgggaagacctccatcggtctgctttgcgtgatggcctcttccgtgctactttggatggccagcgtagaaccccattggatcgcagccagcatcatcctggagtttttcctcatggtgctgctgatccccgagccggaccgccagcggacgccccaagataaccagctagcctatgtggttatcggcctgctgttcatgatcctcactgtcgctgccaacgagatggggctgctggagaccaccaagaaagacctcggaattgggcacgtggcagttggcaaccaccaccacgccgccatgcttgacgtggacctccaccccgccagcgcctggactctatacgcggtagccactaccataatcaccccgatgatgaggcacaccattgagaatacgacagccaacatctccctgacagccattgccaaccaggcagccatcttgatggggctcgacaaaggctggcccatcagcaagatggacatcggcgtcccccttctggccctcgggtgctactcccaggtaaaccccctgactcttacggccgcggtgctcatgttggtcgcccactacgctatcatcggaccggggctgcaggccaaggccactcgtgaggcgcagaagcgaactgccgcgggcatcatgaagaaccccacggtggatgggatcgtggccatcgacctcgatcccgtcgtgtacgacgccaagttcgagaagcagctggggcagatcatgctgctcatcctgtgcacgagccagatcctgctcatgcgcaccacctgggcgctgtgcgagtccatcaccctggccacgggccctctgaccaccttatgggaggggtccccgggcaagttctggaacaccacgatcgccgtgagtatggcgaatatcttccgggggagctacctggccggcgccggcctcgccttcagcttgatgaaatccctcggcggcgggcgtagagggaccggcgcccagggcgagaccttgggcgagaagtggaagcgccagctgaaccaattgagcaaaagcgagttcaacacgtataagcggagcgggatcatggaggtcgaccgctctgaggccaaggaagggttaaagcgcggggagacgaccaagcatgcggtgagccgaggcacagctaaactgcggtggttcgtggagcgaaatttggtcaagcctgaggggaaggtgattgacctgggctgcggccgcggcgggtggtcctactactgcgcgggtcttaagaaagtgaccgaagtcaagggctacacgaaaggcgggcccggccacgaagagcccattccgatggccacctacggatggaacctggtgaagttgcactcaggcaaagacgtgtttttcataccgcccgagaagtgcgacacgctgctgtgcgacatcggagagtctagccccaaccctaccattgaggagggccgcacgctgcgggtgctcaagatggtggagccctggctgcgcgggaaccaattctgtatcaagatcctgaacccgtatatgccctccgtggtcgaaacccttgagcagatgcagcggaagcacggcggcatgctggtgcgcaaccctctgagccggaactccacccacgagatgtactgggtgagctgcggtaccggcaacatcgtttcggctgtgaacatgaccagccgcatgctcctgaacagattcacgatggcacaccggaagcccacgtacgagagggacgtggacctgggggccgggacacggcacgtcgccgtggagcccgaggtcgccaacctcgacatcatcggccagcggattgagaacatcaagcatgaacacaagtccacctggcactacgacgaggacaacccctacaagacgtgggcctatcatgggagctacgaagtgaagccatccggctcggcgtcctccatggtcaacggggtcgttaaactgctgacgaaaccctgggacgtcatacccatggtcacccagattgccatgaccgacactacccccttcggccagcaacgggtgttcaaggagaaggtggatacccgcaccccgaaagccaagcgagggacggcgcagatcatggaggtcaccgccaagtggctctggggcttcttaagccgaaataagaagccccggatctgcacccgcgaggagttcacccggaaggtgcggtctaacgcggccatcggcgccgtgttcgtcgacgaaaaccagtggaactcagccaaggaggcggtggaggatgagcgcttttgggatttagttcacagggagcgggagctgcacaagcaggggaagtgcgctacgtgcgtctacaacatgatgggaaagcgcgagaagaaactgggggagttcgggaaggccaaggggtcccgggccatctggtacatgtggctgggcgcccgcttcctcgagtttgaagcattgggcttcatgaacgaggaccactggttcagccgggagaactcactgtcgggggtggagggcgagggtctccacaagctgggctacattctgcgcgacatctccaagatccccggaggaaacatgtacgccgacgacaccgccggctgggacacccggataaccgaagacgacctccagaacgaggcccgcatcaccgacatcatggaaccggagcacgccctgttagccaagagcatcttcaagttaacctaccagaacaaggtggtccgcgtgcagcggcccgccaaaaatggtacggtgatggacgtcatctcccgccgggaccagcgcggcagcggccaggtgggaacgtatggcctgaacacctttaccaacatggaggcccagctgatcagacagatggagagcgaggggatcttcagcccctcagagctcgagacccccaacctggccgagagggtgctggactggctagagaagtacggcgtagagcggctgaagaggatggcgatcagcggggatgactgcgttgtgaagccgatcgacgaccggttcgcgaccgccctgacggcactcaacgacatggggaaggtcagaaaagatatcccccaatgggagccctccaaggggtggaacgactggcagcaggtccccttctgcagccaccatttccaccaactgatcatgaaggacggtcgagaaatcgtggtaccctgtcgcaatcaggacgaactggtggggcgggcacgtgtgagccagggggccggctggtccctccgggagaccgcgtgcctgggcaaaagctatgcccagatgtggcagctgatgtattttcaccgccgcgacctcaggctagcggccaacgcgatctgctccgccgtccccgtggactggatccccaccagccgaacaacatggtccatccacgcccatcaccagtggatgaccaccgaagacatgctgagcgtgtggaaccgcgtctggattgaggagaacccctggatggaagacaagacccacatctccagctggggcgacgtgccgtacctcgggaagagggaggaccagtggtgcggctccttaataggcctgacggcccgggccacctgggcgaccaacatccaggtggccatcaaccaagtccggcggctcattggcaacgagaactatctggactacatgaccagcatgaagcgtttcaaaaacgagtccgatcccgagggtgccctttggtga

SEQ ID NO: 23857 - RNA, 9879 nt, synthetic construct
  misc_feature 1..9879: note = derived and/or modified CDS sequence (opt11) from DENV-1__HM181959__SS-prME
  source 1..9879: mol_type = other RNA
agcgtgaccatgcttctaatgcttatgcccaccgccctggcattccatctaacgacccgaggaggggaaccccatatgatcgtctcgaagcaagaacggggtaaatccctactattcaagacgagcgctggggtaaacatgtgcaccctgatcgcaatggacttaggggagttatgtgaagacaccatgacatacaaatgcccacgcatcacagaagcagaacccgacgacgtcgactgctggtgcaacgcaacagacacgtgggtaacatacggaacgtgctcccaaacaggggaacaccggcgagacaaacgtagcgtagcacttgcgccgcacgtcggattgggtctagaaacccgcacagaaacgtggatgtcaagtgaatcggcgtggaaacagatccagcgagtagaaacttgggcacttcgacacccggggttcacagtcattgccctgttccttgcccacgcaataggcacaagcattactcaaaaaggcatcatatttatcctcctgatgctggtcaccccctctatggccatgcgatgtgtcggcatcggtagccgggacttcgttgaagggctatccggggctacatgggtcgacgtagtactagaacacgggagctgcgttacaaccatggcgaaagacaagccaacactagatattgaactgctcaaaactgaagtgaccaacccagcaatcctccgcaagctatgcatagaagcaaagatttcaaatacgacgacggactcacgatgccctacgcaaggggaagccaccctggtggaagaacaggacgcaaactttgtctgtcgccggactttcgtcgaccgtggatggggcaacggctgcggccttttcggtaagggatccttgatcacgtgcgcaaaattcaagtgcgtgacaaaactagaaggaaaaatcgtccaatacgaaaacttgaagtattctgtcatcgtgacagttcacacaggagatcagcaccaggtggggaacgagtcaaccgagcacggaaccactgctacgataacaccgcaagccccgacgaccgaaatccagctcacagactacggggctctaaccctagactgcagtccaagaaccggcctagatttcaatgaaatggtcctactgacaatgaaagaaaaatcatggctcgtacataagcagtggtttctagacctgccactgccctggacctcaggcgcctcgacaagccaggagacgtggaaccgccaagacctcctggtgacgtttaaaacagcacacgcgaaaaagcaagaagtcgtcgtacttggatctcaagagggtgccatgcacaccgccctcacgggggcaacagaaatccaaacatcggggactacaaccatctttgcgggccaccttaagtgcaggctaaagatggacaagctgactctaaagggcatgagctatgtcatgtgcacgggctccttcaaactcgagaaggaagtagcggaaacccaacatggaacagtcctggtccagatcaaatatgaaggcactgacgcgccatgtaaaatcccctttagcacgcaagacgaaaagggggtaacccaaaacggacggctgattacggcaaaccccatagttacggataaggagaagcccgtcaacatcgaggcagaaccacccttcggcgaatcctacattgtcataggggcaggagagaaagcactaaaactttcatggttcaaaaagggctcaagcatcggaaagatgtttgaggccacggcacgaggggccagacgtatggcgatcttaggagacaccgcttgggacttcgggtccataggaggcgtcttcacgagcgttggcaaactcgtccaccaaatcttcggaacagcctacggcgtactattcagcggggtctcttggaccatgaaaatcggcatcggggtactattgacctggctgggcctaaacagccgctctacaagcctcagcatgacatgcatcgcagtaggcctggttactctttacttgggagtcatggtgcaggccgatagcggatgcgttataaactggaaaggccgcgaattaaagtgcggcagcgggatcttcgtaacaaacgaagtccatacctggactgaacagtacaagttccaagccgactcgcccaaacggttgagcgcagcgataggaaaggcctgggaggaaggagtatgcggcatccgaagcgcaacgaggttggagaatatcatgtggaagcaaatcagcaatgaattaaaccacattttactggaaaacgacatgaagttcaccgtagtggtaggcgacgttgccggcatcctagcgcagggcaagaaaatgatccgaccacagcctatggagtacaaatacagttggaagtcttgggggaaggcaaaggtcatcggagccgacgtccaaaacacaacatttatcatagatggaccgaacacgcctgagtgccccgacgaccaacgagcctggaacatatgggaagtagaagactacggcttcggcatttttacgacgaacatttggttaaagctccgcgacagctacactcaggtatgtgaccatcggctgatgtcggctgcaattaaagactccaaagctgtacatgccgacatgggctactggatcgaatccgaaaagaacgaaacgtggaagttagcacgggccagcttcatagaggtaaaaacctgcatctggccaaagagtcacactctatggtccaacggagtcctagaatctgaaatgataattccgaaaatctacggaggaccgataagccagcataactacaggcccggatacttcacgcagactgcggggccatggcacttaggcaaacttgagctcgacttcgacttatgcgaaggcaccacggttgtcgtagacgaacactgtggcaatcgaggcccgagcttacggacgacgaccgtaaccgggaaaataatacatgaatggtgctgcaggtcgtgcacactacccccactcaggtttagaggggaagacggctgttggtacggcatggaaatacgcccagtgaaagagaaggaggagaacctagtcaaatcgatggtgtctgcaggaagtggagaagtggacagcttctccctaggcctcctatgcataagtataatgatagaggaagtaatgagatcgcgatggtcccgaaaaatgcttatgaccgggaccctcgtagtattcttgctactaataatgggacagcttacctggaacgatctaatacgactatgcatcatggtaggagcgaacgcatctgaccggatgggaatgggaacaacttatttagctctgatggcaacatttaaaatgagaccaatgttcgccgtgggcctcttattcaggcggctgacgtcccgggaggtactcctcctcacgatcggtttaagcctagtagcatcggtagagctccctaattccctggaagaactgggcgacggcctcgcaatgggtataatgatccttaaactactgacagactttcaatcccaccaactctgggcaacacttctgagcctcacgttcatcaaaacaacattcagccttcactacgcgtggaaaaccatggccatggttctaagcatcgtatctctcttccctctgtgcctaagcaccactagccagaaaaccacatggctcccagtcctgctcggatccctcggatgtaaaccactaacaatgttcttgatcgccgagaacaagatatggggcagaagatcctggccactgaacgagggaataatggccgtgggcatagtctcgattcttctatccagcctgctcaaaaatgacgtaccgctcgcgggccccctgatcgcgggtggaatgctcatcgcctgttatgtcatttccggcagctcagcagacctcagcttagaaaaagcagcggaagtttcatgggaagaagaagcggagcacagcggcgcatcgcacaacatattagttgaagtccaagacgacgggacgatgaaaataaaagatgaggaacgggacgatacactaaccatactcctcaaggccacactgctcgcggtatccggggtctatccgctgagcatcccagcaacactcttcgtatggtatttctggcaaaagaaaaagcagcggtcaggcgtgctttgggacacaccgtcgccaccggaagtggaacgcgcagtactggatgacgggatctaccgaatcatgcagcgtggcctactaggccgctcccaagtcggagtaggagtcttccaagaaaacgtattccacacaatgtggcacgtcacaaggggtgcggtcttgatgtaccaaggaaaacggctcgaaccatcctgggcatctgtcaagaaagacctgatcagttacgggggaggatggcgcctccaggggagttggaacacaggtgaagaggtccaagtaatcgcagttgaacccgggaaaaacccgaaaaacgttcaaacagccccaggaacgttcaaaacgccggagggggaggtgggcgctattgcactggacttcaaacctgggacctccggctccccaatcgtaaacagagaaggaaaaatagtaggactgtatgggaatggcgtggtcaccacgagcgggacatacgtttcggcgatcgcgcaagctaaggcgagccaggaaggaccgcttcccgagatcgaagacgaggtattcagaaaacgtaacctcacgattatggacctgcatccagggtccggaaaaacaaggagatacttacctgcgatagtgcgagaagccattaagcgtaaactccgcacgttgatactagctccgacaagagtggtagccagtgaaatggccgaggcgctcaagggcatgccaataagatatcagacgacagcagtcaagagcgaacacacaggaaaagaaattgtcgacttgatgtgtcatgcaacattcacgatgcgcctgctaagcccggtccgcgtcccaaactacaatatgataattatggatgaggcgcacttcacagacccgagctctattgctgcccgaggctatatcagcacacgagtaggcatgggagaagcggccgccatcttcatgaccgcaacaccacccggaagtgtggaggcttttccccaaagcaatgcggtcatacaagacgaagaacgcgacattcccgagcgatcatggaacagcggatatgagtggataaccgacttcccaggcaaaacagtatggttcgtcccgtccataaagtcgggaaatgacatcgccaactgtctgaggaaaaacggcaaaagggttatccagctcagccgaaagaccttcgacacggaataccaaaagacgaagaacaacgattgggactatgttgtgacaacggacatctcagagatgggcgcgaactttcgcgcagacagagtaatagacccccggcgctgtctaaagcccgtaatactaaaggacggaccagaacgcgtgatactagctggcccaatgccagtaacggtcgcctctgcggcgcagcgtagaggcagaataggtcggaaccacaataaggagggagaccaatacatatacatggggcagcccctgaacaacgacgaggaccacgcacactggacagaagcgaaaatgctactggacaacatcaacacacccgaagggattatcccagcactatttgaacccgaacgcgagaaaagcgcagccatcgacggcgagtacaggctccgaggggaggcgcggaagacctttgtcgagctaatgcggcgcggcgacctgccagtctggctttcttacaaagtagccagcgaggggttccaatactcagatcgacgttggtgctttgacggcgagagaaacaaccaggtactagaggaaaacatggatgttgaaatatggaccaaagagggcgaaagaaagaaactacgacccagatggctcgatgcacgaacgtactcagacccactggccttacgagaatttaaagagttcgcagcaggacgacgttcagtttcaggcgacctcatactggagatcggaaaactacctcagcaccttacccaaagggcccagaacgcattggataacttagtaatgctgcacaactcagagcaagggggccgcgcctacagacacgccatggaggaactgcccgacacgatagaaacactaatgctacttgcattgatagcagttctcacgggcggggtgacactgttcttcctcagcggtcgtggactcggaaaaaccagcataggactgctatgcgtaatggcgagcagtgttctgctatggatggcgtccgtcgaaccccactggatagctgcaagcatcatcctcgaatttttcctcatggtacttttgatccccgagccggaccgccaacgcacaccccaagacaaccaactggcgtacgtcgtgataggcctcttatttatgatactcacagtggctgccaacgaaatggggctcctagaaacaacgaagaaagacttaggaatcggccacgtggccgtaggcaaccatcaccatgccgccatgcttgacgtggacctccaccccgcgtcagcatggaccctctacgccgtggcgaccaccattatcaccccgatgatgagacacaccatagaaaacacaacagctaatatttccctgacagcaatagcaaatcaagcggcgatcctgatgggcctagacaagggttggccaatttccaagatggacatcggcgtaccccttctggcattagggtgctactcacaagtgaacccgctaacactcactgcggcagtactaatgctggtagcacactacgccataataggaccgggcctccaagcgaaagcaaccagagaggcacaaaagaggacggccgctggtatcatgaaaaacccaacagtggacggaattgtagcaatagatctcgacccagtcgtatacgacgcgaaattcgagaagcaattgggacaaataatgctcctcatcctctgtacttcccaaatactccttatgaggacgacttgggcactatgcgaatcgataacgctcgcgaccggcccgcttaccacactttgggaagggtcaccaggaaaattctggaacaccacaatcgcagtaagcatggcgaacatatttcgaggctcgtacctagccggagcaggattagctttctccctaatgaaaagcctcggtggagggcgcagagggacaggtgcacaaggagaaacattaggagaaaaatggaagaggcaactaaaccaactcagtaaaagcgagtttaacacatacaaacgtagcggaattatggaggtggaccggagcgaggcaaaagaggggctgaagcgtggagaaaccacaaagcacgcagtatcccggggcacagccaaactaaggtggttcgtcgaaagaaacctggtgaaacccgagggcaaagtcatcgacttaggatgcggccggggcggttggtcgtactactgcgcgggactcaagaaagtaacggaggtcaaggggtacacgaaaggtgggccgggccacgaagaacccatcccaatggcgacttacggatggaacctagtgaaactacacagtggtaaagatgtgtttttcattcctccggaaaaatgcgatacgcttttgtgtgatataggcgaaagctccccgaatccgacgatagaagaaggccgtacgttacgtgtactcaaaatggtcgagccgtggttgcgcggcaatcagttctgcataaagatactcaacccttacatgccaagcgttgtcgaaaccctcgagcagatgcaaagaaaacacggcggtatgctggtgaggaaccccctaagcagaaacagcactcacgagatgtactgggtaagctgcgggacgggaaacatagtatccgcagttaacatgacttcccgaatgctattgaaccgcttcactatggcgcaccgaaagccaacatacgagcgggatgttgatctaggagccggcaccaggcatgtggcggtggagccggaagtcgcgaacctagacatcataggccagaggatcgagaacatcaaacacgaacacaaaagtacctggcactacgacgaggacaacccctataaaacatgggcctatcacggaagctacgaggtaaaacccagcgggagtgcaagcagcatggtgaacggggtcgtgaaactcttaaccaaaccctgggatgttatacccatggtcacccaaatagccatgactgacaccaccccctttggacaacaaagagtgttcaaagaaaaagtggacactagaacgcccaaagccaagagaggtactgcccaaatcatggaggtaaccgctaaatggctatgggggttcctctcccgcaacaagaaaccgaggatctgcacgcgggaagagttcacacggaaggtacggagcaacgccgccattggggctgtattcgtagacgaaaaccagtggaacagcgccaaggaagcagtagaagacgaacgattctgggatcttgtccacagggaacgagagcttcacaaacagggaaagtgcgcgacgtgcgtatataatatgatgggaaagcgagagaagaaattgggagagtttggcaaagccaaagggagtcgggcaatatggtacatgtggttaggagcccgtttcttagagttcgaagcactagggttcatgaatgaggaccattggttttcacgagagaacagcctttcaggcgtcgagggggaagggctccacaaattaggctacatcctacgagatatctcaaaaatccccggcggtaatatgtacgcggatgacacagccggatgggatacaaggattaccgaggacgatctgcaaaatgaagcccggattactgacatcatggagccggaacacgcgcttctggcaaaaagtatattcaaactgacctaccaaaacaaagtcgttcgagtccaacggcccgccaaaaacgggacggtcatggacgtcatcagcagaagagatcagcgaggttctggccaggtagggacatacggcctcaatacgtttacaaacatggaagcccaactcatcagacaaatggagtcagaaggtatcttctcaccatccgagctagaaacccccaacctagcggagcgggtcttggactggctagaaaaatacggagtggaaaggttaaaaagaatggccatcagcggagacgactgtgtcgtaaaacctatcgacgaccgttttgctaccgcgctcacggcgctcaacgacatggggaaggtacgcaaggacatacctcaatgggaaccgagcaaaggatggaatgactggcaacaggtcccattctgtagtcaccactttcatcaattaatcatgaaggacggtcgagagattgtcgtgccgtgcagaaaccaagacgagctagttgggagggcacgcgtctcccaaggtgctggatggagcttacgggaaaccgcctgtttaggcaaatcgtacgctcaaatgtggcaactaatgtacttccatagacgagacctgcggctggctgcaaacgcaatctgcagcgcagtgcctgtagactggatccccaccagcaggacaacatggagcatccacgcccaccaccagtggatgaccaccgaagatatgcttagcgtttggaatagggtgtggatagaagaaaacccctggatggaagacaagacccacatctccagttggggagatgtcccttacctcggcaaacgcgaagaccaatggtgtggttctctaataggtctaaccgcccgtgccacctgggcaacaaacatacaagtagccataaaccaggtaagaagactaattgggaacgaaaattatttagactacatgacatccatgaaacgcttcaaaaacgaaagcgaccccgagggggccctctggtga

SEQ ID NO: 23858 - RNA, 9879 nt, synthetic construct
  misc_feature 1..9879: note = derived and/or modified CDS sequence (opt11) from DENV-1__JF937651__SS-prME
  source 1..9879: mol_type = other RNA
agcgtgaccatgctgctgatgttaatgcccacagccctagcgttccacctaaccacccggggcggggagccccacatgatcctgtccaaacaagaacgggggaagagcctcttgttcaaaacctccgcgggggtgaacatgtgcaccctgatcgcaatggacctgggtgaactctgtgaggacaccatgacctacaagtgcccaaggataaccgaagccgaaccggacgacgtggactgctggtgcaacgccacagatacgtgggtgacttacgggacctgcagccagaccggagagcaccgtagagacaagcggtcagtcgccctggcgccccacgtcggcctggggctcgaaactcgcaccgagacatggatgagctccgaaggcgcctggaagcagattcagcgggtggagacctgggccctgcgccacccgggcttcacagttattgccctgttcttagcgcacgccataggcaccagcatcacccagaaggggatcattttcatcctgctcatgttagtgactccctccatggcaatgcggtgcgttggtattggcagccgcgacttcgtcgaggggttgtccggcgctacttgggtggatgtggtcctggagcacgggagctgcgtgacaaccatggccaaggacaagccgactttggatatcgagctgttgaagacggaggtcaccaacccagcgatcctcaggaagctgtgcatcgaggccaagatctccaacaccaccacggacagtcgctgcccaacccagggcgaggccaccctggtcgaggagcaggacgcaaacttcgtatgccggcgcacattcgttgatcggggctgggggaacggttgcggcctgttcggcaaagggtccctcatcacgtgcgccaagttcaagtgcgttactaagctggaaggaaagattgtgcagtacgagaatctcaaatactcagtgatcgtgacagtgcacaccggcgaccagcaccaggtggggaacgaatctactgagcacggcaccacggcgaccatcacgccccaggcccccacgaccgagattcaactcaccgactacggggccctaaccctcgattgtagcccccgcacaggcctggacttcaacgagatggttctacttaccatgaaggaaaagtcctggctggtgcataaacaatggttcctggacctccccctgccctggaccagcggggcatccacctcccaagaaacgtggaaccggcaggacctgctcgtaaccttcaagaccgcgcacgcaaagaagcaagaggtggtagtcttagggagccaggaaggcgccatgcacaccgctttgacgggggccaccgagatccaaacctccggcaccacgaccatcttcgctggtcacttgaaatgtcgtctgaagatggataagttaaccctcaaaggcatgagctacgtgatgtgcaccgggtccttcaagctggagaaggaggtggccgagacgcagcacggcacagtcctcgtgcagatcaaatatgagggcaccgacgccccttgtaagattccgttcagcacccaggacgagaagggtgtgacgcagaacgggcgcctgatcaccgcaaacccgatcgtcaccgacaaagagaaaccagtgaacatcgaggccgagccgccctttggggagtcctacatcgtgatcggcgcaggcgagaaggccctaaagctatcatggttcaagaagggttcgagcatcggcaagatgttcgaggctaccgccagaggagccagacgtatggcaatcttaggcgacacggcctgggacttcgggtccatcggcggcgtattcacgtctgtgggaaagctcatccaccagatttttggtaccgcttacggggtcctgttcagtggcgtcagctggaccatgaaaataggtatcggcgtgctgctcacgtggctgggcttaaactctcgcagcactagcctcagtatgacctgtatagccgtggggctggtcaccctgtacctcggcgtgatggtccaggccgactccgggtgcgtcatcaactggaagggccgggagttgaaatgtggtagtgggatttttgtgacgaacgaggtccatacctggaccgagcagtacaagtttcaggcggacagcccgaaacgactgtccgccgccatcgggaaggcgtgggaagagggggtttgtggcattcgtagcgccacgcgcttagagaacatcatgtggaagcagatatccaacgaactgaaccacatcctgctcgagaacgacatgaagtttaccgtggtggtcggggacgtggcgggcattttggcccaggggaagaaaatgatccggccccagcccatggagtacaagtactcgtggaagtcatggggcaaagccaaaataatcggcgcggatgtacagaacacgaccttcatcatagacggccccaacaccccggaatgcccagacgaccagcgcgcgtggaacatttgggaggtcgaggactacggattcggtatcttcacaacgaacatttggctgaagctacgggacagctatacgcaagtttgcgaccacaggctcatgtccgccgctattaaggacagcaaggccgtgcacgccgacatgggctattggattgaatccgagaagaacgagacatggaagcttgcgcgtgccagctttatcgaggtcaaaacctgtatctggcccaaatcccacacgctctggagcaacggcgtgctagagtccgagatgatcattcccaaaatatacgggggaccgatcagccagcacaattaccgccccgggtacttcacccaaaccgctgggccatggcaccttggcaaacttgagctggacttcgacctctgcgagggaaccacggtggtcgtggacgagcactgtggcaatcggggaccgtccctccggaccactaccgtgacgggtaaaattatccacgagtggtgttgcagaagctgcactctgccgcccctgcgcttccgcggagaggacggctgctggtacgggatggagatccgccccgtcaaggaaaaagaggagaatctcgtgaagtccatggtgagcgccggcagcggcgaggtcgactccttcagcctgggcctgctctgcatatccatcatgatcgaggaggtgatgcgtagccgctggtcccgcaagatgctaatgaccgggaccctggccgtcttcttactgctgatcatggggcagctcacgtggaacgacctgatacgactgtgcatcatggttggagcgaatgcctgcgatcgcatgggcatgggcaccacctacctcgccctgatggcaacgttcaagatgagacctatgttcgctgtcgggcttttattccgccgcctgaccagccgcgaggttctgctcctgaccatcgggttgtcccttgttgccagcgtggagctgcccaactccctggaggagctcggtgatgggctggccatgggcatcatgatcctgaagctcctgacagacttccaaagctatcaactgtgggcgaccttactgagtctcacgttcatcaaaaccacgttctcgttacactatgcctggaagaccatggctatggtcctgtccatcgtctcgctgttcccactatgcctgtccacgaccagtcagaagaccacctggctgcccgtgctcctgggatccctggggtgtaaaccgctcacgatgttcctgatcgccgagaacaagatatggggcagacgctcctggcccctgaacgaggggatcatggccgtgggcatagtgtccatactcctgagcagcctgctcaaaaatgacgtgccgcttgccgggcccctgatcgccggaggcatgcttatagcgtgttatgtcatctccgggagctccgccgaccttagcctggaaaaggccgccgaagtctcctgggaggaggaggcagagcacagtggcgcgagtcacaatatcctcgtggaagtccaagacgacggaaccatgaagatcaaggatgaagagcgggacgacacccttaccatcctcctcaaggccaccctgctagctgtgtcgggcgtgtacccgctgtccatccctgctacactcttcgtgtggtacttctggcagaagaagaagcagcgcagcggggtgctgtgggacacgccaagcccgcccgaggtagagcgggccgttctggacgatggcatctaccgcatcatgcagaggggcctcctggggaggagccaggtgggcgtgggggtgtttcaggagaacgtgttccatactatgtggcacgtgacccggggcgctgtgctgatgtaccaagggaagcgcctcgagccgtcctgggccagcgtcaagaaggacctgatatcatacggcggcgggtggcggctgcaaggcagctggaacactggggaggaggtgcaggtcatcgccgtggaacccggcaagaaccccaagaacgtgcagaccgccccagggacattcaagacccccgagggcgaagtgggcgccatcgcgctcgacttcaagccagggacgagcggcagccccatcgtaaaccgcgaggggaaaatcgtgggactgtatggtaacggtgtcgtgaccacctccggcacctacgtcagtgccatagcccaggccaaggcatctcaggaagggcctctgcccgagatcgaggacgaggtattccggaagagaaatctgacgatcatggacctccaccccggctcagggaagacacggcgctacctgccggccatagtgcgggaggctatcaagcgcaagctcaggaccctcatcctagcacccaccagagtcgtcgccagcgagatggcggaggccctcaagggcatgcccatccgctaccagacgactgcagtgaagtctgagcacacagggaaggagatcgtggaccttatgtgccacgccaccttcacgatgcggctgctcagccccgtccgcgttccgaactacaacatgatcattatggacgaggcccatttcaccgacccgtccagcattgcggcccggggttacatctcaactcgagtaggcatgggggaggcagccgccatcttcatgaccgcgacgccgcccggctcggtcgaggccttcccccagtccaacgccgtgatccaggacgaggaaagggacatccccgagaggagctggaattccgggtacgaatggataaccgatttcccgggtaaaaccgtgtggtttgtccccagtattaagtccggcaacgacatcgccaactgcctccggaagaatgggaagcgcgtgatccagctgagccggaagaccttcgacaccgaataccagaaaaccaagaacaatgactgggactacgtggtaactaccgacatctccgagatgggcgctaacttccgcgcagaccgggtgatcgacccacgccggtgtttgaaacccgtgattttaaaagacggacccgagcgcgtcatcctggccggcccaatgccggtaacggtggccagcgccgcgcagcggcgcggtcggatcggccgaaaccacaacaaggagggcgaccagtacatctatatgggccaacccctcaacaacgacgaggaccacgcccattggaccgaggccaagatgctactggacaacatcaacactcccgagggcatcatcccagcccttttcgaaccggaacgcgagaagtccgcggcgatcgacggggagtacagactgcgcggggaagcccggaagacgttcgtcgagttgatgcgccgcggagatctccccgtatggctcagctacaaggtcgcgtcagagggcttccaatacagcgaccgccgctggtgtttcgacggcgagcgcaataaccaggtcttagaggagaacatggacgtggagatctggacgaaggagggtgagcgcaagaaactccgcccccggtggctcgatgcccgcacgtactcagacccccttgccctcagggagtttaaggagttcgcggccggccgcaggtccgtctcgggggacctgatcctagagatcggtaaactcccacagcatcttacccaacgcgcccaaaacgccctggacaatctcgtgatgctgcacaactccgagcagggcgggcgggcttaccgccacgctatggaggaactgcccgacacgatcgagacgttgatgctgctggccctcatcgctgtgctgacaggcggggtcacgcttttcttcttgtctgggcgggggctgggcaagacctccatcggcctgctgtgcgtgatggccagctcggtcctgctctggatggctagcgtcgagccccactggatcgcagcctccatcatcctcgaattcttcctgatggtacttctcatacccgaaccggaccgccagaggaccccccaggacaaccagctggcctacgttgtcatcgggctcctcttcatgatcctgacggtggccgcgaacgagatgggcctgctcgagaccacgaagaaggacctagggattggccacgtggccgtcgggaaccaccaccacgccgccatgctggacgtggaccttcaccccgccagcgcgtggacactgtacgcagtggccactaccatcatcaccccgatgatgaaacacaccatcgagaacacgaccgccaacatctcccttaccgcgatcgcgaaccaggccgccatcctcatgggactcgataagggctggcccatcagcaagatggacatcggggttcccctgctcgcactgggttgctactcccaggtgaaccccctgaccttaacggcggccgtgctgatgctagtcgcccactatgctatcatcggcccgggcttacaggccaaggcgaccagggaggcccagaagcgcaccgcagcagggataatgaagaaccccacggtggacggtatcgtggcaatcgatctggacccagttgtgtacgacgcgaaattcgaaaagcaactgggtcagatcatgctcctgatcttatgcacaagccagatcctcctgatgcggaccacctgggccctgtgcgagagcatcaccctggcgacgggtcccctgactacgttgtgggaggggagcccggggaaattctggaacaccacaatcgccgtgtccatggccaacatcttcagggggagctaccttgccggcgcggggctcgccttctccctgatgaagtccctcggtggggggcggagggggaccggcgcccagggcgagaccctgggggagaagtggaagcgacagcttaaccagctcagcaagtccgaattcaacacttacaagcgctcgggaataatggaggtcgacagatcagaggccaaggagggtctgaagcgcggcgagacaaccaaacacgcggttagccgagggaccgccaagctgcgctggttcgtagagcgaaacctagtcaagcccgagggcaaggtaatcgacctcggctgcgggcgcggcgggtggtcctactactgcgccggtctaaaaaaagtgacggaagtcaaggggtatacgaagggcggcccgggacacgaggagcccatcccgatggcaacctacggctggaacctggtgaagctccatagcggaaaggatgtattctttatcccgcccgagaagtgcgacaccctgctgtgcgatataggagagtctagccccaacccgactatcgaggaggggcggacgctccgcgtcctgaagatggtggaaccctggctgcggggcaaccaattctgcataaaaattctgaacccctacatgcccagcgtggtcgagaccttagaacagatgcagcgaaagcacggcgggatgctggtgcggaacccactcagccgcaattccacccacgagatgtactgggtatcctgtggcaccgggaacatcgtctccgcagtgaacatgaccagcaggatgctgctgaacagattcacgatggcccacaggaagcccacctacgagcgggacgttgacctcggagccggcacccgccacgtcgccgtggagcccgaggtggccaacctggacatcatcgggcagaggatcgagaacatcaagcacgagcacaaatccacgtggcattacgacgaagacaacccttataagacgtgggcgtaccacggcagctacgaggtcaagccgtccggaagcgcgtctagcatggtgaacggcgtggtcaagctgttgaccaagccgtgggacgtgatccccatggtcacccagatagcaatgaccgacactacccccttcgggcagcagcgcgtgttcaaggagaaggtcgacacccggactccgaaggccaagcgtggtactgcccagatcatggaggtcaccgcaaagtggctgtggggctttctgtcacggaacaaaaaaccacgcatctgcactcgggaggagttcaccgggaaggtgcgctccaatgctgccatcggagccgtgttcgtcgacgagaaccagtggaatagcgcgaaggaggcagtggaggacgagcggttctgggacctcgtccaccgcgagcgtgagctgcacaaacaggggaagtgcgccacgtgcgtgtacaacatgatgggcaagcgcgagaagaagctgggtgagttcggcaaggccaagggctcgcgggccatctggtacatgtggttaggcgcccgcttcctagagtttgaagcccttggcttcatgaatgaggaccactggtttagccgggagaactccctcagcggagtggagggcgaggggctgcacaagctggggtatatactccgcgacatatcgaagatccccggcgggaacatgtatgcggacgacacagcagggtgggacacccggatcaccgaagacgacctgcagaacgaggcccgcatcacggacataatggagcccgagcacgcgctgctcgccaaaagcattttcaagcttacctatcaaaacaaggtggtccgggtgcagagacccgctaagaacgggactgtgatggatgtcatctctcgccgggatcagcgcgggagtggccaggtgggaacctacggcctgaacacattcaccaatatggaggcccagctcatccgtcagatggagagcgagggaatcttcagcccctcggagctggagacccccaacctggccgagcgcgttctcgactggctggaaaagtatggcgtcgaaaggctgaagcgtatggcgatttccggggacgactgcgtggtaaagccgatagacgatcgattcgccaccgccctcacggccctgaacgacatgggcaaggtccgcaaggatatccctcagtgggagccctccaagggctggaatgactggcaacaggtccccttctgttcccaccatttccaccaactcataatgaaggacgggcgggaaatcgtggtcccgtgccgcaaccaagatgagcttgtgggccgagcccgcgtatcccaaggggccggctggtccctccgggagaccgcctgcctcggcaaaagttacgcccagatgtggcagctcatgtacttccataggcgggaccttcgcttagcagccaacgcgatatgctccgccgttcccgtggactggattcccacctcccggaccacgtggtccatccatgcccaccaccaatggatgactaccgaggacatgctatccgtgtggaacagagtctggattgaagagaacccatggatggaggataagacccacatatcctcgtggggggatgtgccgtacctgggcaagagagaggatcagtggtgcgggtcccttatcggtcttaccgccagagcgacatgggcaaccaacattcaggtggccatcaaccaggtgcgccggctgatcgggaacgagaactacctggactatatgacatctatgaagcgcttcaagaatgagtccgacccaaagggcgccctctggtga

SEQ ID NO: 23859 - RNA, 9879 nt, synthetic construct
  misc_feature 1..9879: note = derived and/or modified CDS sequence (opt11) from DENV-1__GU131956__SS-prME
  source 1..9879: mol_type = other RNA
tcggtgaccatgctcctcatgctgctgcccaccgcactcgccttccacctgacgactcggggcggggagcctcacatgatcgtgagtaagcaggagcgcggcaagtcccttctgttcaagacgagcgcgggggtgaacatgtgcacgctgatcgccatggacttaggcgagctctgcgaggacacgatgacctacaagtgccctcagatcaccgaggccgagcccgacgacgtggactgctggtgcaacgctaccgacacgtgggtgacctacgggacctgctcgcagactggcgagcaccgtcgggacaagcggtccgtggccctggcgccacacgtggggctgggcctcgagacgcggaccgagacctggatgagctccgagggcgcctggaaacaaatccagagagtcgagacctgggcattgcggcaccccgggttcactgtgatcgccctgtttctcgcgcacgccatcggaaccagcatcacccagaaggggaccatcttcatactcctcatgttggtgacgccgtccatggcgatgcgctgcgttggcatcggcaaccgggacttcgttgaggggttaagcggcgccacctgggtggatgtcgtcctggagcacgggagttgcgtgaccaccatggcaaagaataagcccacgctcgacattgagcttctgaagaccgaggtcaccaaccccgcgatcctccgcaagctgtgcatcgaggccaagatcagcaacaccacgaccgattctcgatgccccacgcagggcgaggcgaccctggtggaggagcaggatgccaacttcgtatgcagacggacgttcgtcgaccgcggctggggaaacgggtgcggtttattcggcaaggggagcctgctgacctgcgccaagttcaagtgtgtgaccaagctcgagggcaagatcgtccaatacgagaacttgaagtactccgtaatcgtgaccgtgcatacgggcgaccagcatcaggtcgggaacgagaccaccgagcacggcaccatcgcgaccataacgccccaggcgcccaccagcgagatccagctgaccgactacggggccctcaccctcgactgtagcccccggactggccttgacttcaacgagatggtgctcctcaccatgaaggagaagtcctggctggtccacaagcaatggttcctcgacctgccgctgccttggacatcgggagcgagcacctcacaggagacgtggaaccgtcaagacctcctggtgactttcaagacagcccacgccaagaaacaggaggtcgtcgttcttggctcccaggagggcgccatgcacactgccctcacgggggccaccgagatccaaactagcggcaccacgaccatcttcgccgggcatctgaagtgtcggctgaaaatggataagctaaccttaaagggtacctcctacgtgatgtgtacggggagcttcaagctggagaaggaggtcgcggagacgcagcacggcacggttctcgtgcaggtcaagtacgagggcacagacgccccgtgcaagatccctttctccacgcaagacgagaagggagtgacccagaacgggcgcctaatcacggccaatccgatcgttaccgataaggagaagcccgtcaacatcgagacggagccgcccttcggcgagtcgtatatcgtcgtgggcgccggcgagaaggcgctgaaactgtcctggttcaagaaggggagctcaatcggcaagatgttcgaggccaccgcccgcggggccaggcggatggccatcctaggggacactgcctgggatttcgggagcataggcggggtcttcacatccgtgggaaagctggtgcaccaggtcttcggcacggcctacggggtgctgttcagcggcgtgtcttggaccatgaagatcgggatcggcatcctcctgacctggctgggcctcaacagcagatccacaagcctgtccatgacgtgcatcgccgtcggtatggtgactttatacctcggcgtaatggtccaagccgacagcgggtgcgtaatcaattggaagggccgcgagctgaagtgcgggtcgggaatcttcgtgaccaacgaggtccacacctggacggagcagtacaagttccaggcagacagcccgaagagactgagcgcggccataggtaaagcctgggaggaaggggtgtgcggcatcagatcggccacgcgactcgagaacatcatgtggaagcaaatctcaaacgagctgaatcacatcctgctcgagaatgacatgaagttcaccgtcgtcgtgggagacgccaatggcatcctagcccaaggtaagaagatgatccgccctcagcccatggagcacaagtattcctggaagtcttggggcaaggccaaaataatcggcgccgacatacagaacaccaccttcatcatcgacgggccggacacgccggagtgccccgacaaccagagagcctggaacatttgggaggtcgaagactacggcttcgggatcttcacaaccaacatctggctgaagctccgcgactcctatacccagatgtgcgatcaccggcttatgagcgcggccatcaaagactccaaagccgtccacgccgacatgggctactggatcgagagcgaaaagaacgaaacttggaaactggcccgcgcgtccttcatcgaggtgaagacctgcacttggcctaagagccacacactctggtctaacggcgtgctggaaagcgagatgatcatccccaagatctacgggggcccgatatctcagcataattaccggcccgggtacttcacgcagaccgctggcccatggcacctggggaagctcgagttagacttcgacctgtgcgaaggcaccactgtcgtagttgatgagcactgcggaaacagggggccgagcctccgtacgaccaccgtcaccggcaagattatccacgagtggtgctgccgctcttgcacgctgccgccgctcagattcagaggggaagatggctgctggtacgggatggaaatcaggcccgtgaaagagaaagaggagaacctcgtgcgtagcatggtctccgccggcagcggcgaggtggacagtttctccctggggatcctgtgcgcatctatcatgatcgaggaggtgatgcgttcacgctggtcccggaagatgctaatgaccggcacccttgccgtcttcctgttactggtgatggggcaactgacctggaacgatctcatccgcctgtgcatcatggtgggcgcgaacgcctccgaccgcatggggatgggtaccacatacctggccctcatggccaccttcaagatgcgaccaatgttcgccgtcggcctgctgttccgccggctgaccagccgcgaggttctgctgctcacgatcgggctatccctggttgcgagcgtcgagctccccaactccctggaggagcttggcgacggactcgccatgggcatcatgatgctgaagctgttaacggagttccagccccaccagctttggaccaccttactatcactgacgtttattaagaccaccctgagtctcgactatgcctggaagacaacggccatggcgctgagcatcgtgtcccttttccccctctgtcttagtaccacctctcagaaaacgacctggctgccggtcctcctgggcagctttgggtgcaagcccctgacgatgttcttaattaccgagaacaaaatttggggacggaagtcctggcccctcaacgaggggatcatggccatcggtatcgtgagcatcttgctctccagcttactgaagaacgacgttcccctcgccgggccgctgatagccggcggcatgctgatcgcatgctacgtaatcagcggatccagcgcggacctctccttggagaaggccgccgaagtgagctgggaacaggaggccgaacactccggcaccagccacaacatcctggtggaggtccaggacgacgggaccatgaagatcaaggacgaggagcgcgatgacacgttaaccatccttttgaaggcaaccttactggcggtgtccggggtgtaccccatgagcatcccagccaccctattcgtctggtacttctggcagaagaagaaacagcggtccggggttctctgggacacgcccagccctcccgaggtggagcgcgccgtcctggacgatggtatataccggatcctgcagcgcggcctgctcggacggtcccaggtgggcgtgggcgtcttccaggacggcgtattccataccatgtggcacgtgacccgcggcgccgtcctgatgtaccaaggaaagaggctggagcccagctgggcctccgtgaagaaggatctcatctcttacggcgggggctggcgcttccaaggaagctggaacaccggcgaggaggtgcaggtcatcgcggtggagcctggtaagaacccgaagaacgttcagacaacccccggcacctttaaaacccccgagggggaggtaggggccatcgccctggacttcaagccgggcacgagcgggtcgccgatcgtgaaccgggagggcaagatcgtgggcctatacgggaacggcgttgttaccacgtcggggacctacgtgtcggcgatcgcccaggcgaaggccagtcaggagggcccgctccccgagatcgaggacgaggtcttcaagaagcgcaacttaacgatcatggatctgcatccggggagcggcaagacccggcgctatctccccgcgatggtgagggaagcaatcaagcgcaaacttcggaccctgatactcgctcccacccgcgtggttgcctccgaaatggctgaggcgctgaagggaatgcccatcagataccagacgaccgccgtgaaaagcgagcacaccgggagggagatcgtggacctgatgtgccacgcgacgttcacgatgcgtctcctgtcccctgtccgggttcccaactataacatgatcatcatggacgaggcccacttcaccgatcccgctagcatagcggcccgcgggtacatcagtacccgggtgggcatgggcgaggcggccgccatcttcatgaccgccactccgccgggtagcgtggaagccttcccccagagcaacgcggtgatccaggacgaggagcgcgatatccccgagcgcagctggaactccggctacgactggataacagactttcccggcaagaccgtgtggttcgtcccgagcatcaagtccgggaacgacattgctaactgcttacgaaagaacggcaagagagtgatccagctcagccgcaagacattcgacacggagtaccagaaaaccaagaacaacgactgggactacgtggtcaccaccgacataagtgagatgggggccaatttccgggccgaccgcgtgatcgacccccggaggtgcctgaagcccgtgatactgaaagacggcccggagcgggtcattctcgcggggccaatgccggtgacggtggcaagcgcggcccaacgccggggcagaatcggccgaaaccagaacaaggagggggatcaatatgtctacatggggcagcccctgaacaacgacgaagatcacgcccactggaccgaggcgaagatgttgctcgataatatcaacactcctgagggcatcatcccggccttgttcgagcccgaacgagagaaaagcgccgcgatagacggcgaataccgcctgcgcggagaggcccgcaagaccttcgtggagcttatgcggcgcggcgacttacccgtctggctaagctacaaggtggcgtccgagggcttccagtacagcgaccggcggtggtgcttcgacggggagcggaacaatcaggtgctcgaggagaacatggatgtcgagatctggacaaaggaaggcgagcgcaagaagctacggccacgctggttggacgcacgaacgtactccgacccgctcgccctgcgcgagttcaaggagttcgcagccgggcggcgctctgtgagcggcgacttaatactcgaaatcggcaagttacctcagcacctgaccttgcgggcgcagaatgccctggacaacctggtgatgttgcacaactccgagcagggcgggaaagcctacagacacgccatggaggagttacccgacactatcgagaccttgatgctgctggcgctgatcgccgtcctcaccggcggggtgaccctgttctttctgagtgggaaggggttgggcaagacctccatcgggctgttgtgcgtgactgcgagctccgccctcctgtggatggccagcgtagagccccactggattgcggccagtatcatcctggagttcttcctcatggtgctgctgatcccagagcccgacaggcagcgcacaccccaggataaccagctagcctacgtcgtcattggcctgctattcatgatcctcaccgtagctgccaatgaaatgggactgcttgagactaccaagaaggatctcggtatcgggcacgtggcggccgagaaccaccagcacgccacgatgctggacgtagatctgcgcccggcctcagcctggactctctacgcggtggccaccaccgtgatcactcccatgatgcgccacaccatcgagaacaccacggccaacatctccttaactgccattgccaaccaggcggcgatcctgatgggcctcgacaagggctggcccatcagcaaaatggacataggggtcccgcttctggccctcggttgttactctcaggtgaacccgctgacactgaccgcagcggtgctcatgctggtcgcccactacgctatcatcgggcccggcctgcaagctaaagccactcgggaggcgcaaaagagaacggcagccgggatcatgaagaatcccactgtggacggcatcgtagccattgacctcgaccccgtcgtgtacgacgccaagttcgagaagcagctgggacagatcatgctgctaatcctgtgcacaagccagatcctgctcatgcgcaccacgtgggcgctgtgcgaatccatcaccctggctaccggtccactcaccacgctgtgggagggcagccccgggaagttctggaataccactatcgccgtgtccatggccaacatattccggggctcttatctggccggcgctgggctcgccttctctctgatgaagtccctcggcgggggccggcggggcacaggcgcccagggcgagacgctcggggagaagtggaagcgccagctgaaccagctgtccaagagcgagttcaacacctataagcggagcggaatcatggaggtcgaccggtccgaggcgaaggaagggttaaagcggggcgagactaccaagcacgcggtgagccgcggtaccgccaagctgaggtggttcgtcgagagaaacctggtcaagcccgagggcaaggttatagacttaggctgtggacggggcgggtggtcctactactgtgccggcctcaagaaggtcacggaggtcaaggggtacacgaaaggcggccccgggcacgaggaaccgatccccatggcaacgtatggttggaacctggtaaaactgcacagcgggaaggacgtgttcttcatgcctcccgagaagtgcgacacccttctgtgcgacatcggcgagtccagcccgaaccccacgatcgaggaggggcgcacgctgcgggtcctcaagatggtggaaccctggctgcgcggcaatcagttctgcatcaagatcctgaacccctacatgccgtccgtggtcgagaccctcgagcagatgcagcggaagcacggcggtatgctggtgcgcaaccccctgagcagaaattcaacccatgaaatgtactgggtgtcatgcggcaccggaaatatcgtttccgccgtgaatatgaccagccgcatgctcctcaaccggttcactatggcgcatcgaaagcccacatacgagcgagacgtagacctgggcgccggaacgaggcacgtcgcagtggagcccgaggtggccaacctcgacatcatcgggcagcgaatcgaaaacatcaagaacgagcacaagagcacctggcactacgacgaggacaatccgtacaagacgtgggcctaccacggcagctacgaggtcaagccatccgggagcgcgtccagcatggtgaatggcgtggtccggctgctaaccaagccctgggacgtgatccccatggtcactcagatcgccatgaccgacaccaccccgttcggtcagcagcgcgtgttcaaggagaaggtggacacgagaactccccgggccaaaagaggcaccacccagatcatggaggtcacggccaaatggctctggggcttcctgtcgcgcaataagaaaccccggatctgcacccgcgaggagttcacccgcaaggtgcgcagcaacgcagcgatcggggccgttttcgtcgacgagaaccagtggaacagcgccaaggaggctgtggaagacgagcggttctgggatcttgtgcaccgcgaacgggagctacacaagcagggcaagtgcgcgacctgcgtttacaacatgatggggaaaagggaaaagaagctgggcgagtttgggaaggcgaagggctcccgggccatctggtacatgtggctgggcgcccgcttcctcgagttcgaggccctggggtttatgaacgaggaccactggttctcccgcgaaaattccctgagcggcgtggagggggagggcttgcacaagctggggtacatcctgcgcgacatctcaaagataccgggcggcaacatgtacgcggacgacaccgccgggtgggatactcggatcaccgaggacgacctccagaacgaggcgaagatcaccgagatcatggagcccgagcacgctttgctggctacgagcatcttcaagctcacgtaccagaataaagtggtccgcgtgcagcggccagcgaagaacggcaccgtgatggacgtgatctcccggcgcgaccaacggggaagcggtcaagtgggtacctacggactgaacacgttcaccaacatggaggtgcaactgatccgtcaaatggagtccgagggcatatttctccccagcgagctggaaaccccgaacctggcagagcgggtcctcgactggctggagaagcacggggccgagcgcctgaaacggatggccatctcaggcgacgactgtgtggtgaagcccatagacgatcgtttcgcaacagcgctcaccgcgctgaacgacatgggcaaggtccggaaagacattccccaatgggagcccagcaagggatggaacgattggcagcaagtaccgttctgctcccatcacttccatcagttaatcatgaaggacggccgcgagatcgtggtaccgtgtcggaaccaggacgagctcgtggggcgcgcccgtgtaagccagggcgccgggtggtctctgcgcgagacggcctgcctgggcaagagctacgcgcagatgtggcagctaatgtatttccataggcgcgacttgcggctggccgcgaacgcaatctgctccgcggtgcctgtggattgggtgccgaccagcaggacaacgtggagcatccacgcccaccaccaatggatgacgaccgaagacatgctctctgtctggaaccgggtgtggatcgaggagaacccgtggatggaggataaaacccacgtgagctcctgggaggaggtcccctacctggggaagcgcgaggaccagtggtgcggcagtttaatcggcctcacagcccgcgccacgtgggctaccaatatccaggtggcgatcaaccaggtgcggaggctgatcggtaacgaaaactacctggactacatgacctccatgaagcggttcaagaacgagagcgaccccgaaggcgccctctggtga

SEQ ID NO: 23860 - RNA, 9879 nt, synthetic construct
  misc_feature 1..9879: note = derived and/or modified CDS sequence (opt11) from DENV-1__GU131958__SS-prME
  source 1..9879: mol_type = other RNA
agcgtgaccatgctgctgatgctcctgcccaccgccttggcattccacctgaccactcggggaggggaaccccatatgatcgtgagcaaacaagagcggggcaaatcactcctgtttaaaacttcagcaggggtcaatatgtgcacccttatcgccatggacctgggtgaactgtgcgaggacaccatgacttacaagtgcccccagatcaccgaggcagaaccagacgacgtggactgctggtgtaacgccaccgacacctgggttacctacggaacctgtagccagaccggggagcatagacgggacaaacgatctgtcgcactcgcgccccacgtgggcctggggctcgagacccggaccgagacctggatgagcagcgaaggcgcctggaagcagatacagcgcgtcgagacctgggcccttcggcacccagggttcacggtgatcgctctgttcttggcgcacgcgatcggcaccagcatcactcagaaaggcatcattttcatcttattgatgctcgtaaccccctccatggctatgcggtgcgtgggcatcgggaaccgagacttcgtggaggggctgagcggtgccacgtgggtggacgtagtcttagaacacgggtcctgcgtcaccacaatggcaaagaacaagcccaccctagacatcgaactgcttaaaactgaggtcaccaaccccgcgatcttgcgcaagctgtgcatcgaggcaaagatctcgaataccacaaccgacagtcgatgtccgacgcagggcgaggccaccctggtggaggaacaggacgctaactttgtgtgccgtcgcacctttgtcgaccgcggatgggggaacggctgcggcttattcggaaaggggagcctgcttacgtgcgcaaagtttaagtgcgttacgaagttggagggcaaaatcgtacaatacgaaaacctgaagtactccgtgattgtgactgtgcacaccggcgaccagcaccaggtgggaaacgagacgaccgagcacgggacaatcgcgaccatcacgccacaggcccctacgagcgagatacagctaacagattacggggccctcaccctggactgcagcccgcggaccggcctcgacttcaatgagatggtgctcctaacgatgaaggagaaaagctggctggtccataaacagtggttcctcgacctgccgctgccctggacttccggagcgagcacaagccaggagacctggaaccgccaagacttgttagtgacgttcaagaccgcccacgccaaaaagcaggaggtggtcgtgttaggctctcaagagggcgccatgcacaccgccctcaccggcgccaccgagattcagaccagcgggaccacgacaatattcgccggtcacctgaagtgccgactgaagatggacaaattaacgctgaagggcacctcctatgtgatgtgcaccggcagcttcaagctggagaaggaagtagcggagacgcagcatggcaccgtgctagtccaagtcaagtacgagggcaccgacgccccctgtaagattcccttctccacccaggatgagaagggggtcacgcaaaatggccgcctcattactgcgaatcccatcgtgaccgataaggaaaaacccgtcaacatcgaaacagagccgcccttcggcgagagctacatcgtggtgggcgccggcgagaaggcgcttaagctgtcgtggttcaagaaaggcagctccatcggaaagatgttcgaggccacggcacgaggggcccgtcgcatggccatcttaggggacacggcgtgggactttggtagcatcggcggtgtcttcacaagtgtgggaaagctagttcatcaggtcttcggcaccgcatatggtgtgctgttcagcggtgtgtcttggacgatgaagattggaattgggatccttctgacttggcttggcctaaacagccggtctactagcctgtccatgacatgcatcgccgtcggtatggtgacgctttacttaggcgtgatggtccaggccgacagcgggtgcgtcatcaactggaagggccgtgagctgaaatgtgggtcaggtattttcgtgaccaacgaggtacacacttggacggagcagtacaaattccaggccgacagcccgaagcgcctgtccgctgccatcggcaaggcctgggaggagggggtttgcggcatcagatccgccactcgcctcgagaacataatgtggaaacaaatctcgaacgagctcaatcacatattactggaaaacgacatgaagttcacagtggtcgtaggagacgccaacggcatccttgcccagggtaagaagatgattcgcccccagcccatggagcataagtactcctggaaatcctggggcaaggccaagataatcggcgcggacatccagaacaccacattcatcatcgacgggcccgataccccggagtgccccgacaaccaacgggcatggaacatctgggaagtggaagactacgggttcgggatcttcacgaccaacatctggctgaagctcagagattcctatacccaaatgtgcgaccatagattgatgagcgcggccatcaaggactcaaaagccgtccacgcagacatgggttattggatcgagagcgagaagaacgagacgtggaagctggctcgcgcgtccttcatcgaggttaaaacctgcacctggccgaagtcccatacactctggtccaatggagtgttggaaagcgagatgattatccctaagatctacggagggccgatcagccagcacaactacagacccgggtatttcacccagacggcagggccctggcatctcgggaagctggagttggacttcgacctgtgcgagggtacgaccgtcgtggtagacgagcattgcggaaatcgcggaccttctctccgcaccactacggtcaccggaaagattatccacgagtggtgttgccgctcctgcaccttaccgcccttacggtttcgcggggaagatggctgctggtacgggatggagatccgtcccgttaaagaaaaggaggagaatctcgtgcgcagtatggtgtccgccggaagcggcgaggtggacagcttcagtctgggtattctctgtgcctccataatgatcgaggaggtgatgcggagccgctggagcagaaagatgcttatgacgggcacactagccgtctttctcctcttaattatggggcaactgacatggaacgatcttatcagactgtgcataatggtcggtgcgaacgcatccgatcgaatggggatgggcaccacttacctagcgctcatggccacatttaagatgcgacccatgttcgccgtgggattactttttcgccggctcacatctcgcgaagtcctgctgctaaccatcgggctatccctggtggccagcgtagagctccctaattccctggaggagttgggagatggtctggccatgggcatcatgatgctgaaactgctcacggagtttcagccccaccaactgtggaccacactgttgagcttaaccttcatcaagacgaccctgagtctcgactatgcctggaaaacgaccgcaatggcgctttctatcgtgtccttgtttcctctctgcctgtcgacgacatcccaaaagaccacctggttacccgtgctgctcgggtctttcggttgcaagcccctgacgatgtttctcatcacagaaaataagatatggggtcggaagtcttggcccttaaatgagggaatcatggccatcggaattgtcagcatcttgctctccagcctactgaagaacgacgtgcctctcgccggcccgcttatcgctggaggaatgctaatcgcctgctatgtgatctctgggtccagtgcggatctatccctggagaaggccgccgaggttagctgggagcaggaggccgagcatagcggcacctctcacaacatcctggtggaggtgcaggacgacggaaccatgaagattaaggacgaagagagagacgacacgctcacgatcctactgaaggcaaccctcctggcggtctccggcgtgtaccccatgagtattcccgccaccctttttgtgtggtacttctggcaaaagaagaagcagcggtctggggtcctctgggatacacccagcccgcccgaggtggagagggccgtgctagacgatggcatttatcggatcctgcagcgcggtcttctcggacggtcccaagtaggcgtgggcgtgttccaagacggcgtctttcacacgatgtggcacgtgactaggggagctgtgctaatgtaccaaggcaagcggctagagccgagctgggcgagtgtcaagaaagacctcatcagctacggcggaggctggcggttccaggggtcctggaacacgggcgaagaggtccaagtgatcgctgtggagcctgggaagaacccgaagaacgtccagaccacacccggtaccttcaagacccccgaaggcgaggtgggggccatagctctggacttcaaacccggcacctcaggttcccctatcgtcaaccgggagggaaaaatcgtaggtctgtacgggaacggcgtagtcactaccagcgggacctacgtgtccgcaattgctcaggcgaaggccagccaggaagggccccttcccgagatagaggatgaagtctttaagaaacgcaatttgaccataatggacctgcacccgggtagcggcaagacgagacgctacctacctgccattgtgcgagaggccataaagaggaagctccggaccctgatcctagcgccaacccgcgtggtagcctcagagatggcagaagccctgaagggtatgcccatccggtatcagaccaccgccgtcaagtctgaacacacggggagagaaatcgtggatctgatgtgccatgcgacattcaccatgcgtctccttagcccggttcgcgtcccaaactacaacatgatcatcatggacgaggcccacttcacggaccctgccagcatcgcggcacgaggctacataagtacgcgcgtggggatgggagaagcggctgccatctttatgaccgcgacgcctcctggcagcgtagaggccttcccccagtccaacgcggtcatccaggacgaggagagggacattcccgagcgaagctggaactcaggctacgactggatcacggactttccgggaaagaccgtttggttcgtgcccagcatcaagtcgggtaacgatatcgccaattgtctgcgcaaaaacggtaagcgggttatacagctttcacgcaaaaccttcgacaccgaataccagaagacgaagaacaatgattgggactacgttgtgacaaccgatatcagcgagatgggagccaatttccgggctgaccgcgtaattgacccacggcgctgcctgaagcccgtaatcctaaaggatgggcccgagcgcgtgattcttgcggggcctatgcccgtcactgtggcctcagctgcccaaagacgcggccgaatcggacgcaaccagaataaggagggagaccagtacgtgtacatgggccagcctctgaacaacgatgaagaccacgcccactggacggaggcaaagatgctgctagataacattaacacgcccgagggtatcattccggcattatttgagcccgagcgagagaagtcagctgcgatagacggtgagtatcgcctgcgaggggaggccagaaagaccttcgtcgagctcatgagacgcggcgacctgcccgtgtggctgtcatacaaggtcgcctccgagggcttccagtatagtgaccgtcgctggtgcttcgatggcgagcggaataaccaagtgctggaggaaaacatggacgtggagatctggaccaaggaaggcgagcgcaagaagttgcgtcctcgttggctggacgcccggacgtattccgaccccctcgccttgcgggagtttaaggaatttgcagcaggccggcgttcggtcagcggcgaccttattttggagatcggcaagctgccccagcacctgacgctgcgggctcagaacgccctggacaacctcgtgatgctccacaactccgagcagggcgggaaagcctaccgccatgccatggaggagctgcccgacaccatcgagacgttgatgcttctggcactgattgcggtgttaacagggggcgtcactctatttttcctgtctgggaaaggccttggcaagacctccattggtctgctgtgtgtgaccgcatcatccgccctcctctggatggccagcgtcgagccacactggatcgcggcatcaatcattcttgagttctttctcatggtcctgctcatccctgaaccggatcggcagcgcacgccgcaggacaaccaactcgcttacgtcgttataggcctgctgttcatgatcctcactgtagccgctaacgagatggggctgctggaaactacgaagaaggacttaggcatcgggcatgtggcagccgagaaccatcaacatgccaccatgctggacgttgacctgcgaccagcgagcgcctggacgctctacgctgtcgcaaccaccgtaatcacccccatgatgcgccacacgatcgagaatacaactgccaacatatccttaaccgccattgccaaccaggcggcgatcctaatgggcctcgacaagggctggcctataagcaaaatggacattggcgtacccctgcttgccctcgggtgctacagtcaggtcaatccgcttacgctgaccgcagcggtgctcatgctggtggcacattacgctattatagggccgggcctgcaggcgaaggccacaagggaggcgcaaaaacgcacggccgcaggtatcatgaagaaccccacggtcgacggcatcgtggccatcgacctcgaccccgtggtatacgacgccaaattcgagaagcaactgggccaaatcatgttactcatcttgtgcaccagccagatattattgatgcgcaccacctgggcgctgtgtgagtctatcacgctggcgactggtccgctcacgaccctctgggagggctcaccggggaagttctggaatacaaccatcgctgtctccatggccaacatcttccggggcagctacttagccggtgcgggcctcgctttttccctgatgaagagtctgggcggaggtcgccgggggacgggggcccaaggcgaaaccctcggagagaagtggaagagacaactgaaccagctaagtaagagcgaatttaacacgtacaagcggagtggcatcatggaagttgaccgtagcgaagccaaggaggggctgaaacggggcgaaaccaccaagcacgcggttagccgcgggacggccaagttgcggtggttcgtggagcgcaacctagtgaaacccgagggcaaggtcatcgacctgggctgcgggcggggcggatggtcctactactgcgccggcctaaagaaagtgacggaggtcaaggggtacacgaaagggggcccagggcacgaggagcctatccccatggcaacctacggctggaatctggtcaagctgcacagcgggaaggatgtgttcttcatgccgccagagaagtgcgacacgctactgtgtgacatcggcgagtccagcccgaaccccactatagaggagggacgcacgttacgggtgctcaagatggtcgagccctggctgcgcggcaaccagttttgcataaagatccttaacccgtatatgccgagcgtggtggaaacactcgagcagatgcagcggaagcacggtgggatgctggtccgcaaccccctaagccgtaacagcacccacgagatgtactgggtgtcctgcggcaccgggaacatcgtaagcgccgtcaacatgacgagtcgcatgcttctgaaccggttcaccatggcccaccgcaaacctacctttgagcgcgacgtggaccttggcgccggcacgcgacacgttgccgtcgagcccgaggttgcgaacctcgacatcatcgggcagcggatagagaacataaagaacgagcacaagtctacgtggcactatgacgaggacaacccgtacaaaacctgggcctaccatggcagctatgaagttaaaccctctgggagcgcaagtagcatggttaacggcgtcgtacgcctcctgaccaaaccctgggacgtcatacccatggttacccagatcgccatgacggacaccaccccgttcggccagcagcgcgtctttaaggagaaagtagatacccgaacgccccgtgccaaaagaggcaccacccagataatggaagtaaccgccaaatggctctggggctttttatcgcggaataagaaaccacggatctgcactcgcgaggagttcactcggaaagtccgttcaaacgccgcgattggggcggtgtttgtggacgagaaccagtggaatagcgccaaggaggccgtcgaggacgaacggttctgggacctggtgcatcgcgaaagagagctccacaagcaaggaaagtgcgcgacctgtgtgtacaacatgatgggtaagagagagaagaaactcggcgagtttgggaaagcaaagggatcccgagcgatttggtacatgtggctgggcgctcgcttcctcgagttcgaagccttaggtttcatgaacgaggaccactggttcagcagggaaaattcgctaagtggcgtcgagggcgagggtctccacaaacttggttatatcctgagggacatctccaagattcctggcggtaacatgtacgccgatgacacagctgggtgggatacgcggatcacagaggatgacttgcagaacgaagctaaaatcaccgacattatggagcccgagcacgccttattagccaccagcatattcaaactcacgtaccagaataaggtagtgcgcgtccagagacccgcgaagaacgggacggtcatggacgtgatctcccggcgtgaccaacgggggtccgggcaagttgggacctacgggctgaacacctttaccaacatggaggtgcagttgatccggcagatggagtctgaaggcatatttctcccctccgaacttgagacaccgaacctcgcagaacgagtgttggattggttagaaaagcacggggcagaacgcttgaagagaatggccatctccggcgatgactgcgtcgtgaagccaatcgacgaccgctttgccaccgccctaaccgccctgaacgacatgggcaaggtgcggaaggacatcccgcagtgggagccctcgaaggggtggaacgactggcagcaggtcccgttttgctcccaccatttccaccagctgatcatgaaagatggtcgcgagattgtggtgccctgccggaaccaggacgaactcgtcggacgcgcacgggtgagccagggcgccggctggtcattgcgtgagacggcatgtctgggcaagtcgtatgcgcagatgtggcaactcatgtacttccaccgtcgcgacctacggctggcggccaatgccatctgctccgcggtgcccgtcgactgggtacccacgtctcgcaccacatggagcatacatgcccaccaccaatggatgaccacagaggatatgctctccgtgtggaaccgggtctggatcgaagaaaacccgtggatggaggacaagacccacgttagctcctgggaggaggtgccctacctggggaagcgcgaagatcagtggtgcgggagcctgataggcctgactgcccgcgctacctgggccacgaatattcaggtcgcgatcaaccaggttcggcgcctgataggcaacgagaattacctggattacatgacctcaatgaagaggttcaagaacgagagcgacccagaaggcgccctctggtga

SEQ ID NO: 23861 - RNA, 9879 nt, synthetic construct
  misc_feature 1..9879: note = derived and/or modified CDS sequence (opt11) from DENV-1__GQ868499__SS-prME
  source 1..9879: mol_type = other RNA
agcgtaaccatgctgctcatgctcctgccgaccgcccttgcctttcacctgaccacccggggcggggagccccacatgatcgtgagcaagcaggagcgggggaagagcctgctctttaaaaccagcgccggggtgaacatgtgcaccctgatcgcaatggacctgggcgagttatgtgaagacactatgacttataaatgccctcagattaccgaggccgagcccgatgacgtggactgctggtgcaacgccaccgacacctgggtgacctacggaacatgctctcagacaggcggccaccgccgtgagaagcgctccgtggccctcgctcctcatgtgggcctgggcctcgagactcggaccgagacctggatgtcatccgagggggcctggaagcagatacagcgggtggagacctgggcgctgcgacaccccgggttcacggtaatagccctgttcctcgcgcatgctataggaaccagcatcacacaaaagggtatcattttcatcctgctgatgttagtgaccccctcaatggccatgcgctgcgtcggaatcggaaacagggacttcgtggagggcctgagtggagccacctgggttgatgtcgtgctagagcatgggtcctgcgtgactaccatggcaaaaaacaagcccaccctcgacatcgagctgctgaaaacagaagtcaccaatcccgcggtgctcaggaagctgtgtatagaggccaagatcagtaacaccactaccgactcgcggtgcccgacccaaggcgaggccacacttgtggaggagcaggacgccaacttcgtctgccgccgtacattcgtggacagagggtggggcaacgggtgcggtctcttcgggaaaggcagccttctcacatgtgccaagttcaagtgtgtcaccaagctcgagggcaagattgtccagtacgaaaatctcaaatattccgtgattgttacagtccacacgggggaccagcaccaggttggcaacgagacgaccgagcacgggaccatcgcgaccatcacgccgcaggccccgacgagcgagattcaactgaccgactacggcgcactcaccctggactgcagccccaggacagggctggacttcaatgagatggtgctgttaacgatgaaggagaagtcctggctagttcacaaacagtggttcctcgacttgccgctaccttggacctccggcgcttcaaccagccaggaaacctggaaccgccaggacctgctagtcacgttcaagaccgcccacgccaagaaacaggaggtcgtggtactgggctcccaggagggggccatgcacacggcgctcaccggagccacagagatccagaccagcgggaccaccacgatcttcgccggccacttgaagtgccggctaaagatggataaactcacccttaaagggacctcctacgtgatgtgcaccggcagcttcaagcttgagaaagaggtggcggaaacgcagcacgggaccgtgctagtccaggtcaagtacgaggggaccgatgcaccctgcaagatccccttttccacccaggatgagaagggcgtgacgcagaacgggcgccttatcaccgcgaaccccatagtaaccgacaaggagaagccagttaatatcgagaccgagccgcccttcggcgagtcatacatagtggtgggcgccggggagaaggcgttgaagctatcatggttcaagaagggctcttccatcgggaagatgttcgaggcgaccgcccggggcgcccgccggatggcaattctcggggacaccgcttgggacttcggcagcattggcggcgttttcacatccgtcggcaagctggtccatcaagtgttcgggacagcttacggcgtgcttttcagcggagtctcctggacgatgaagatcggaatcggaatacttctaacctggctgggattgaacagccgcagtacctctctgtccatgacctgtatcgccgtgggtatggtgacgctgtatctcggggtcatggtgcaggcggacagtggctgcgtgatcaattggaaggggcgcgaattgaaatgtgggtccggcatcttcgtcaccaatgaggtgcacacatggaccgagcagtataagttccaagccgacagcccgaagcggttgagcgcggctatcgggaaggcatgggaagaaggggtctgcgggatccgctccgccactcggttagaaaacataatgtggaagcagattagcaacgaactgaatcacatcttgctcgaaaacgacatgaaatttactgttgtggtgggcgacgccaacggtatcctagcccagggcaagaaaatgatccgcccccagccaatggagcacaagtattcctggaagtcctggggcaaggccaagatcatcggagccgacatccagaacaccaccttcatcatagacggccccgacactccggagtgcccggacaaccagagagcctggaacatctgggaggtggaggattatgggttcggcatcttcacgacaaacatttggctaaagttacgtgattcctacacccagatgtgcgaccaccggttgatgagcgcggctatcaaggactcaaaggccgtgcacgctgacatgggctactggattgagagcgagaagaacgaaacctggaagctggcccgagcatccttcattgaggtgaagacttgcacttggcccaaaagccacaccctctggtccaatggagtcctggagagcgagatgatcattcccaagatctacggcggtccaatctcccagcacaactaccggcccggatacttcacccaaaccgccgggccctggcacctaggcaagcttgagcttgactttgacctgtgcgagggcactactgtcgtggtcgacgagcactgtgggaaccgcggcccgagtctccgcacgacgaccgtcaccgggaagatcattcacgagtggtgctgccgctcctgcacactgccgcctctacgttttcgcggagaggacggatgctggtacggcatggaaatccgtcccgtgaaggagaaggaggagaaccttgtgcgcagcatggtttcggcgggcagcggggaggttgacagcttttccttgggcatcctgtgcgccagcataatgatcgaggaagtcatgagatcccgctggtcccgtaagatgctcatgaccggcaccctagccgtcttcttactcctgatcatgggccagctcacctggaaggatcttatccgactatgcatcatggtgggggcgaatgcctccgaccgcatgggcatgggtaccacctatttggcattaatggcaaccttcaaaatgagaccgatgtttgccgtcggcctcctgttccgccgtttaacaagcagggaggttttactgctcaccatcggcctctccctcgtggcgagcctcgagctgcccaactcactagaggagctcggcgacggactggcgatgggtatcatgatgctaaaactcttgacggagttccagccccaccagctgtggaccaccctactgtccctgacttttatcaagacaaccctctccctggactatgcctggaagacaaccgcaatggcgctgagtatcgtctcgctctttcccctgtgcctttccacaacctcccagaagacgacctggctcccggttctgcttggaagcttcggttgtaaacccttaacgatgttcttaatcacggagaataagatctggggccgtaagtcctggccccttaacgagggcatcatggccatcgggatcgtcagcatcttactgtccagcctgttgaaaaacgatgtgcccctggccggcccgctgatcgcaggcggcatgcttattgcctgctacgtgatcagcggttccagcgcggacctgtctcttgagaaggtcgccgaggtgagttgggagcaggaggccgagcactccggaaccagccacaacatcctagtggaggttcaggacgacgggacgatgaagataaaggacgaagagcgcgacgacacattgacgatcctgctgaaggccacactgttggcggtgtccggggtgtatcccatgagcattcccgcgaccctgtttgtctggtacttctggcagaaaaagaagcagcggtccggcgtactctgggacactccctcaccgcccgaggtggagcgcgccgtcctagacgacggcatctaccggatcctacaacgggggctgctcggccggtcccaggtgggggtaggcgtctttcaggacggggtgtttcacacgatgtggcacgtaaccagaggcgccgtcctgatgtaccaggggaagcggctcgagccgtcatgggcgtccgtgaagaaggatctgattagctacgggggcggctggcgctttcagggcagttggaacacgggcgaggaggtgcaggtcatagctgtagagcccggcaagaacccgaaaaatgtacagaccacacccggcaccttcaagacccccgagggggaggtcggcgcgatcgccctggattttaaaccaggaaccagcggttccccgatcgtcaatcgtgaaggcaagatagttggcttgtacggtaatggggtagtaactaccagcgggacctatgtctccgcaatcgcccaggccaaggcttcccaggaggggcccttgcccgaaatcgaggatgaggtgttcaagaagcgaaacctgacaattatggatctccacccaggcagcggcaagactcggcgctatctgcctgccatagttcgggaggccatcaagcgtaagctgcggaccctcatactggctccgacccgcgtagtggcatcagagatggccgaggccctgaaagggatgcccatccgctaccagaccacggcggtcaagagcgagcacacgggacgcgagatcgttgacctcatgtgccacgccaccttcaccatgagactgctgtcccccgtgcgggtgcccaattacaatatgataatcatggacgaggcacacttcacggaccccgccagcatcgccgcccgaggctacatatccactcgggttggcatgggtgaggccgcggcgatctttatgacagccacgccgcccgggagtgtcgaggctttcccgcaatccaacgccgttattcaggacgaggagcgcgacatcccagagagaagctggaactccgggtacgactggatcacggacttccccggtaagaccgtgtggttcgtacctagcatcaagtccggcaatgacatcgcgaattgcctcagaaagaacggaaagcgagtaatccagttaagccgcaagaccttcgacacagagtaccagaagactaagaacaacgattgggactacgtggtcaccaccgacatctccgaaatgggggccaacttccgggccgaccgcgtcatcgatcccagacggtgcctgaagcccgtgatcctcaaggacgggccggagcgggtcatcctggctggcccgatgcccgtgaccgtagcgagcgccgcccaaagacggggccgcattgggcggaaccagaacaaggaaggcgatcagtacgtctatatggggcagcccctgaacaacgatgaggaccacgcccactggacggaggccaagatgctcctggacaacatcaacaccccggagggcatcatcccggccctcttcgaacccgagagggagaagtccgccgccatcgatggggagtaccgcctccggggcgaggcgcgcaagactttcgtggagctgatgcggcgcggcgacctgccggtatggctcagctataaggtggcctccgaggggttccaatatagcgatagacgctggtgtttcgatggcgagcggaacaaccaagtgctcgaggaaaacatggacgtcgagatatggactaaggagggggagcgtaagaagctgcgcccccgctggctcgacgcacggacgtactccgacccactggctctgcgcgagttcaaagagttcgccgcgggccggcgcagcgtgagcggagacttgatcttagagatagggaagttgccacaacatctcactttgcgggcccagaacgcgttagacaacctcgttatgctgcacaacagtgaacaaggagggaaagcctatcgacacgcaatggaggagctgcccgacacgatcgagacgttaatgctgctggccctcatcgccgtcctgaccggcggggtgacgctattcttcctctcaggaaagggcctgggcaaaacttccatcggtctgctctgcgttaccgcgagctccgccctcctgtggatggccagcgtcgagccccactggatcgccgcttctatcatcctcgagtttttccttatggtgctattaataccggagcccgatcggcaacgcacccctcaggacaaccagctggcgtacgtggtaatcggccttctgttcatgattctgaccgtggccgccaacgagatgggcctgttagagactaccaagaaggacctggggattggccacgtggccgcggagaaccatcagcatgcgaccatgctggacgtcgacctgcggccagccagcgcctggaccctgtacgccgtggcgacgaccgtgatcaccccgatgatgcgccataccatcgaaaacacaacggccaacatctccctgacagccattgccaaccaggccgctattctcatgggactcgacaaggggtggcccattagcaagatggatatcggcgtgcccctgctagcgctggggtgctactcacaggtgaacccattaaccctcaccgccgcagtactgatgttggtcgctcactacgccatcattggccccggattacaggccaaagccaccagggaggcccagaagcgcactgcggcaggcatcatgaagaatcccacggtggacggtatcgttgccatcgatctggatcccgtcgtatacgatgcaaaattcgagaagcagctggggcagattatgcttctgatcctgtgtaccagtcagatactcctgatgcgtacaacctgggcactttgtgaatccatcacattagcaacaggcccgcttacgacactgtgggaggggagcccaggcaagttttggaataccaccatcgccgtgtcgatggcgaacatcttccgcggcagctacctcgcaggggccgggctggcgttttccctgatgaagtccctcgggggcgggcgcaggggcaccggggcccagggggagaccctcggcgagaagtggaagagacagctgaaccagctatcaaagagcgagtttaacacgtacaagcggtccggaatcatggaagtcgaccgcagtgaggctaaggagggcctgaagagaggggagaccaccaaacatgccgtgagccgcggcacagctaagctgcggtggttcgttgaacgtaatctggtcaagccagagggcaaggttattgatttggggtgcggccgcggcggttggtcctactattgcgcaggactgaagaaggtgaccgaggtcaaaggctacacaaaaggcgggcccgggcatgaggagccgatccccatggccacgtacggatggaacctcgtgaagctgcatagtggcaaggacgtgtttttcatgcctcccgagaagtgtgacaccttactgtgcgacataggcgagtcgagcccgaaccccaccatagaagagggccgcaccctccgggtcctgaagatggtggaaccatggctgaggggaaaccagttctgcatcaagattctcaacccatacatgccgtcggtggtcgagacgctggagcagatgcagcggaagcatggaggcatgctggtgcgcaaccccctctctcgaaactccacgcacgagatgtactgggtgagctgtgggacgggaaacatagtcagcgcagtgaacatgacgagccgcatgctgctcaaccggtttacaatggcccaccgcaagcccacgtacgaacgcgacgtggacctcggggcgggcacacggcatgtggccgtggaaccggaggtcgccaatctggacatcatcggtcagcgcatcgagaacatcaaaaacgagcacaagtcaacctggcactatgatgaagacaacccgtacaagacgtgggcctaccatgggagttacgaggtcaagccctccggcagcgcttcaagcatggtcaacggcgttgtccggctgctgaccaaaccgtgggacgtgatccccatggtgacccaaatcgcgatgacggacacaacgccgttcggccaacaacgtgtttttaaggagaaggtggatacccggactccccgcgctaaacgaggcacgacccaaatcatggaagttaccgcgaagtggctgtggggtttcctgtccaggaacaagaaacccagaatctgcactcgcgaggagttcacccgtaaggtccgcagcaacgcagcgatcggcgcggtgttcgtcgatgagaaccagtggaacagcgccaaggaagccgtggaggacgaaaggttttgggacctcgtgcaccgcgagagggaactgcacaagcagggtaagtgcgctacctgtgtctataacatgatgggcaagcgcgagaagaagctgggggagttcggcaaggcaaagggctcccgggccatctggtacatgtggttaggtgcccgcttcctagagttcgaggccctgggctttatgaacgaggaccactggttttcacgggagaattccctcagcggggtcgagggcgaggggctgcacaagctcggctacatcctgcgagacatctccaaaatcccgggcgggaacatgtacgccgatgacaccgctggctgggatacgcggatcaccgaagacgacctgcaaaacgaggcgaaaatcaccgacatcatggagcctgagcacgccctgctagccacaagtatatttaagctgacgtaccagaacaaggtggtccgggtgcagcgccccgccaagaacgggactgtcatggacgtaatttcccggcgcgaccagaggggctctggacaggtggggacctacggactgaacacattcacgaacatggaagtgcaactcatccgccagatggagtccgagggaatattcttgccgagcgaactggagaccccgaacctcgcggaacgcgtcttagactggttagagaagcacggtgcggagcgcctgaagcggatggccatctccggagacgattgcgtagtgaagcctatcgacgacagattcgcgacagctctgaccgcgctcaatgacatgggcaaagtccggaaggatatcccccaatgggaacctagcaagggctggaacgactggcagcaagtaccgttctgctcccaccacttccaccagctcataatgaaggatggacgggagatcgtggtcccgtgccgaaatcaggatgagttggtgggccgggcccgggtaagccaaggagcgggctggtcactgcgtgagaccgcctgtctcggcaaaagctacgcccagatgtggcagttaatgtacttccaccggcgcgacctgcggctcgccgccaatgcgatctgctccgccgtccccgttgactgggtccccacgagcagaactacctggagcatccacgcgcaccatcagtggatgacaacggaggatatgttgtcggtatggaatcgtgtttggatcgaggaaaatccctggatggaagacaagacccacgttagctcctgggaggaagttccctacctgggcaagcgcgaggaccagtggtgcggcagcttaatcgggctgacggccagggccacctgggccacgaacatccaggtagctatcaaccaggttcggcgcctgatcggcaacgagaattatctcgactacatgacgtccatgaagcggttcaagaatgagagcgatcccgaaggggcgttgtggtaa

SEQ ID NO: 23862 - RNA, 9879 nt, synthetic construct
  misc_feature 1..9879: note = derived and/or modified CDS sequence (opt11) from DENV-1__GQ868500__SS-prME
  source 1..9879: mol_type = other RNA
agcgttaccatgctgctcatgctgctgcccaccgccctcgcctttcacctgaccacccggggcggggagccccacatgatcgtgagcaagcaggagcggggcaagagcctcctgttcaagacctcagcgggggtgaacatgtgcaccctgatcgcaatggacctaggcgagctctgcgaggacaccatgacctacaagtgcccccagatcaccgaggccgagcccgacgatgttgactgctggtgcaacgccactgacacctgggtcacctacgggacgtgctctcagaccggagagcaccgccgggacaagcgctccgtggcgctggcgcctcacgtaggtctggggcttgagacccggaccgagacatggatgtcgtccgagggcgcctggaagcagatccagcgtgtcgagacctgggccttacggcaccccgggttcacggtaatcgcgctgttcctggctcatgctattggcaccagcatcacacaaaagggcatcatcttcatcctgctgatgctcgtgacccccagtatggcgatgcgctgtgtgggcattggcaaccgggacttcgttgagggcttaagcggcgctacgtgggtagacgttgtgctggagcacgggtcctgcgtgaccaccatggccaagaacaaacccaccttggacatcgagctgctgaagacggaggttaccaaccccgcgatcctccgcaagctgtgcattgaggccaagatcagcaacaccaccaccgactcccgctgcccgacccaaggcgaggccaccctggtggaggagcaggacgccaattttgtatgccgccggaccttcgtcgaccgcggctgggggaacggctgcggcctcttcggcaaggggagcctgctgacgtgcgcgaagttcaagtgcgtgaccaagctcgagggcaagatcgtgcagtacgagaacctgaagtactccgtcatcgtgaccgtgcacaccggcgaccagcaccaggtcgggaacgaaactacggaacacggcaccatcgcgactatcacgcctcaggcccccactagcgagatccagctcaccgactacggtgccctcaccctggattgcagcccccggaccggcctggactttaacgagatggtgctcctgacgatgaaggagaagtcctggctggtccacaagcagtggttcctggacctcccgttaccctggacttccggagccagcaccagccaggagacctggaaccgccaggacctcctagtgacgttcaagaccgcccatgcgaagaagcaggaagtggtcgtgctgggctcccaggagggcgctatgcacaccgcactcaccggcgcaacggagatccagaccagcggtactaccacgatcttcgccgggcacctgaagtgccggctgaagatggacaagctcactctgaagggcacctcttacgtgatgtgcaccgggtctttcaagctggagaaggaggtcgcggaaacgcagcacggcaccgtgctggtgcaggtcaagtacgagggcaccgatgccccctgcaagatccccttcagtacccaggacgagaagggtgtgacgcagaacggtcgtctaatcaccgccaaccccatcgtgaccgataaggagaagcccgtcaacatagagaccgagccgcccttcggggaaagctacatcgtggtaggcgccggagagaaggcgctgaagctgtcctggttcaagaaggggtcttccatcggcaagatgttcgaggccacggcacgcggcgcccgccggatggccatcctcggcgacaccgcgtgggacttcgggagcatcggcggcgtcttcaccagcgtggggaagctggtgcaccaggtcttcggcaccgcatacggggtgctgttcagcggcgtgtcttggacgatgaagatcgggattggcatcctactgacctggctgggcctaaacagccgctcaaccagtctgtccatgacctgcatcgctgtcgggatggtgacgctgtacttgggtgtgatggttcaggcggacagcgggtgcgtgataaactggaagggtcgcgagctgaagtgcggttccggcatcttcgtgaccaatgaagtgcacacctggaccgagcagtacaagttccaggccgactccccgaagcggctaagcgcggccatcggcaaggcttgggaggagggggtgtgcggaatccgctccgccacccggctcgagaacatcatgtggaaacagattagcaacgaactgaaccacatcctgctcgagaacgacatgaagttcacggtggtagtgggggatgccaacggcatcctcgcacaggggaagaagatgatcaggccccagcccatggaacacaagtactcctggaaatcctgggggaaggccaagatcatcggggcagacatccagaacaccaccttcataatcgacgggcccgacaccccggaatgccccgacaatcagcgggcctggaacatctgggaggtggaggactacggcttcgggatcttcacgactaacatctggctgaagctccgcgacagttacacccaaatgtgcgaccatcggctgatgagcgcggccatcaaggactccaaggccgtacacgccgacatgggctactggatcgaaagcgagaaaaacgagacgtggaagctggcccgtgcgagtttcatcgaggttaagacatgcacctggcccaagagccacaccctctggtccaacggcgtgctggaaagcgagatgatcattcccaagatctacggagggcccatctcccagcacaactaccggcccgggtacttcacgcagactgccggcccctggcacctggggaagttagagctggacttcgacctgtgtgaaggcaccacagtcgtagtggacgagcactgcggcaaccgcgggccaagcctccggaccacgacggtcaccggcaagatcatccacgagtggtgctgccgctcctgcaccctgccgcccctacggtttcgcggggaggacggctgctggtacgggatggagatccggcccgtgaaggagaaggaggagaacctagtacgcagcatggtatccgccggaagcggcgaggtggacagcttctccctggggatcctgtgtgcaagcatcatgatcgaggaggtgatgcggtcccgctggagccggaagatgttgatgacggggacactggcagtcttcttgctcctggtgatggggcagctaacctggaacgacctcatcaggctgtgcatcatggtgggcgcgaacgcctccgaccgcatggggatgggcaccacatacctggccctcatggccaccttcaagatgcgaccgatgttcgcggtcgggctgctgttccgacggctcacctcacgcgaggtgctgctgctcaccatcgggctttccctggtagcaagcgtcgagctccccaactctctggaggaactgggggacgggcttgccatgggcatcatgatgctgaagctgctcacggagttccagccccaccagctgtggaccaccctgctcagcctgacattcatcaagacgaccctgtcgctcgactacgcgtggaagaccaccgctatggcgctgagcatcgtgtccctgttccccctttgcctgagcacgacctcccagaagaccacctggctgccggtcctcctgggctcattcgggtgcaagcccctgaccatgttcctgatcacggagaacaagatctggggccggaaatcctggcccctgaacgagggaatcatggcaatcggcatcgtgagcatcctgctctccagcctgctgaaaaacgacgtgccccttgccgggccgctgatcgccggcggcatgctgatcgcctgctatgtgatctctgggtcgagtgcggacctctccctggagaaagcagccgaggtgagctgggagcaggaagccgagcactccggaacgagccacaacatactggtggaggtccaggacgacgggaccatgaagatcaaggacgaggaacgcgacgacacccttacgatcctgttgaaggccaccctcctggccgtatccggagtatatcccatgagcatccccgccaccctgttcgtctggtacttttggcagaaaaagaagcaacggtctggggtattgtgggatacccccagccctcccgaggtggagagggccgtcctggacgacggcatctaccggatcctgcagcgcggcctgttagggcggtcccaggtgggcgtcggggtcttccaagacggagtgttccacacaatgtggcacgtgacccgcggggccgtcctcatgtaccagggcaagcggctggagcccagctgggcctccgtgaagaaggacctcatcagttacggcgggggttggcgcttccaggggtcgtggaacaccggcgaggaggtgcaggtcatcgcagtggagcccgggaagaacccgaagaacgtgcagaccacgcccggcaccttcaagacccccgagggcgaggtcggggccatcgccctggacttcaaacccggcaccagcgggtccccgatcgtgaaccgggagggcaagatcgtgggcctgtacggaaacggcgtcgtgacgaccagcgggacctacgtgtctgccatcgcccaggcgaaggccagccaggagggcccgctccccgaaatcgaagacgaggtcttcaagaagcgcaacctgaccatcatggacttgcaccctgggtcgggcaagacgcggcgctacctccccgctatggtgcgggaggcgatcaagcgcaagctgcggaccttgatcctcgcgccaacgcgcgtcgtcgcctccgagatggccgaggccctgaagggcatgcccatccgctaccaaaccacggccgtcaagagcgagcacaccgggcgggagatcgtggacctgatgtgccacgcgacctttaccatgcgcctcctgtcccctgtcagagtgcccaactacaacatgatcatcatggacgaggcccacttcacggaccccgcctcgatcgccgcccgtggctacatctccacgcgggtggggatgggcgaggcggccgccatattcatgaccgccacgccgcccggttctgtagaagcgttcccccagagcaacgcggtgatccaggacgaggagcgcgacatcccagagaggagctggaactccggctacgactggatcacggacttccccggcaagaccgtgtggttcgtccccagcatcaaaagtggtaacgacatcgccaactgcctgcgcaagaacggcaagcgggtgatacagctcagccgcaagaccttcgacaccgaataccagaagacgaaaaacaacgactgggactacgtggttaccactgacatctccgagatgggggccaacttccgggctgaccgcgtgatcgacccccggcgctgcctcaagcctgtgatcctgaaggacgggcccgagcgggtgatcctcgctggaccgatgcccgtgaccgtggcctcagccgcccagcgccggggccgcataggaagaaaccagaacaaggagggggaccaatacgtctatatgggccagccattaaacaacgacgaggaccacgcccattggacggaggcgaagatgctgctcgacaacattaacacaccagaggggataatcccggctctgttcgagcccgagcgcgagaagtccgccgccatagacggcgagtaccgcctgcgcggggaggcccgcaagaccttcgtggagctcatgcggcgcggcgacctgcccgtctggctgagctacaaggtggcgtccgagggcttccagtacagcgaccggcgctggtgctttgacggagagcggaacaaccaggttctcgaggagaacatggacgtcgagatctggaccaaggagggcgagcgcaagaagttacggcctcgctggctggacgctcgaacctactccgacccgctcgccctgcgcgagttcaaggagttcgccgccgggcggcgcagcgtgagcggcgacctgatcctcgagatcggcaagctaccccaacacctaaccctccgggcgcaaaacgcgctggacaacctggtgatgctccacaactctgagcagggcgggaaggcctaccggcacgcaatggaggagctgcccgatacaatcgaaaccctgatgctcctggcgctgatcgccgtcctcaccgggggcgtgacgctgttcttcctgagcgggaagggtctcggcaagacctccattgggttgctgtgcgtgaccgcctcatccgccctgctgtggatggcctccgtcgaaccccactggatcgcggcctctatcatcctcgagtttttccttatggtgctgctgatcccggagcccgaccggcagcgcacgccccaggacaaccagctggcttacgtggtcataggcctgctgttcgtgatcctcacggttgccgccaatgagatggggctgctggagaccaccaagaaggacctgggcatagggcacgtcgcggctgagaaccaccaacacgcgaccatgctggacgtggacctgcggcccgccagcgcctggacgctatacgcggtggccaccaccgtcataacccccatgatgcgccacaccatcgagaacaccaccgcgaatatctctttgaccgccatcgccaaccaagcggccatcctgatgggcctcgacaaaggctggccgatcagcaagatggacatcggggtgcccctgctggccctcgggtgctactcccaggtgaatccgttaacgttaaccgcggcggtcctcatgctggtggcccactacgccatcatcgggcccggcctgcaggccaaggccacccgggaggcgcaaaagcgcaccgccgctgggatcatgaaaaaccctacggtggacgggattgtcgccatcgacctcgacccagtcgtgtacgatgccaagttcgagaaacagttgggccaaatcatgctgctaatcctgtgcactagccagatcctgctcatgcgcaccacctgggcgctgtgcgagtccatcacgctggccacagggccgctcacaaccctgtgggagggcagccccggaaaattctggaacacgaccatcgccgtctctatggccaacatattccggggcagctaccttgccggcgcggggctcgccttctccttaatgaagtcgctgggcggagggcgccgggggaccggcgcccagggggagaccctcggggagaagtggaaacgccagttgaaccagctgtcaaaaagcgagttcaacacttacaagcggtcgggcatcatggaagtggatcgctccgaggccaaggaggggctcaagcggggcgagactaccaagcatgcagtgagccgcgggaccgccaagctgcggtggttcgtggagaggaacctggtgaagcccgagggcaaggtgattgacctgggctgcgggaggggcgggtggtcctactattgcgccggactaaagaaggtcaccgaggtgaaggggtacacgaagggcggtcccgggcatgaggagccgatccccatggcaacctacggctggaatctagtgaagctccacagcgggaaggacgtcttcttcatgccgcccgagaagtgcgacaccctcctgtgtgacatcggcgagagtagcccgaaccccaccatcgaggaggggcgcacgttacgagtgctcaagatggtggagccctggctgcggggcaaccagttctgcataaagatcctcaacccctacatgccttccgttgtggagaccctcgaacagatgcagagaaagcacggcgggatgctagtgcgcaaccccctaagccggaactccacccacgagatgtactgggtcagctgcggcactgggaacatcgtgtccgccgtgaacatgaccagccgcatgctcctgaaccgctttaccatggcgcacagaaagcccacctacgagcgcgacgtcgacttaggcgccgggacccggcacgtggccgttgagcccgaggtcgccaacctcgacatcattgggcagcgcatcgagaacatcaagaacgagcacaagtccacgtggcactacgacgaggataacccatacaagacctgggcctaccacggcagctacgaggttaagccctccgggagcgcgtccagcatggtgaacggggtcgtacggctgcttaccaagccctgggatgtcattcccatggtcaagcaaatcgccatgaccgacacaaccccgttcggacaacagcgagtcttcaaggaaaaggtggatacccggacgccccgggccaagcgaggcacgacgcaaatcatggaggtgaccgccaagtggctctggggcttcctgagccgcaacaagaagccccggatctgcacccgtgaggagtttacgcggaaggtgcgcagcaacgccgctatcggggccgtcttcgtgggtgagaaccagtggaacagcgccaaggaggccgttgaggacgagcgtgtttgggacctggtacaccgcgagcgcgagctccacaagcaggggaagtgtgcaacatgcgtctacaacatgatgggcaagcgagagaagaagctgggggagttcggcaaggctaagggctcacgggccatctggtatatgtggctgggggcccgcttcctcgagttcgaagccctgggcttcatgaacgaggaccactggttcagccgggagaactccctgagcggggtggagggcgaggggctgcacaagctaggctacatcctgcgcgacatctccaaaatcccgggcgggaacatgtacgcggacgataccgccggctgggacacgcggatcaccgaggacgatctccagaacgaggccaagatcaccgaaatcatggaacccgagcatgcgctgctggccaccagcatcttcaagctcacctaccagaacaaggtggtgcgcgtccagcgccccgcgaagaacgggacggtgatggacgtgatatcccggcgcgaccagcggggcagcggccaggtcgggacctatggactgaacactttcaccaacatggaagtgcagctgatccgccagatggagtccgaggggatcttcctccccagcgagctggagacgccgaacctggctgaacgggtcctcgactggctggagaagcacggcgccgagcgcctgaagcggatggccatctccggggacgattgcgtcgtgaagcccatcgacgaccgcttcgccaccgcgctcacggcgctgaacgacatgggcaaggtgcggaaggacataccacagtgggagcccagcaagggctggaacgactggcagcaggtaccgttttgctcccaccacttccaccagttgataatgaaggacgggcgcgagatcgtggtgccctgccggaatcaggacgagctcgtaggccgcgcccgggtgagccagggtgccgggtggtccctgcgcgagaccgcctgcctgggcaagtcgtacgcgcagatgtggcagctgatgtatttccaccggcgtgacctgcggctggccgccaacgccatctgctccgctgtacccgtcgactgggtgcccaccagtcgcacgacctggtcaatccacgcccatcaccagtggatgactaccgaagacatgctctccgtgtggaaccgggtctggatcgaggagaacccgtggatggaggacaagacccacgtatcatcatgggaggaggtgccctaccttggcaagcgcgaggatcagtggtgcggcagcttaatcgggctcaccgcccgcgccacgtgggccaccaacatccaggttgcgatcaaccaggtgagaaggctgatcggcaacgagaactaccttgactacatgacgtctatgaagcggttcaagaacgagagcgaccccgagggggccctctggtaa

SEQ ID NO: 23863 - RNA, 9879 nt, synthetic construct
  misc_feature 1..9879: note = derived and/or modified CDS sequence (opt11) from DENV-1__GU131961__SS-prME
  source 1..9879: mol_type = other RNA
agcgtgaccatgctgctcatgctgctgcccactgctctcgcctttcacctgactactcggggcggggagccccacatgatcgtgtccaaacaggaacggggcaagagcctcctgttcaagacgagcgcgggggtgaacatgtgcacccttatcgctatggacctgggtgagctctgcgaggacaccatgacctacaagtgcccacagatcaccgaagcagagcccgatgacgtcgactgctggtgtaacgccacggatacctgggtcacatacgggacctgcagccagaccggagagcacagacgggataagcggagtgttgcattggcgccccacgtggggctcgggctcgaaacgcggaccgagacctggatgagctctgagggcgcctggaagcagatccagagagtcgagacttgggccctgcggcaccccggtttcacagtgatcgccctgttcctcgcacacgccataggcacatccatcacccagaagggcatcatatttatcctgctgatgctcgtgaccccttcaatggcaatgcgttgcgtgggaattggcaaccgggacttcgtggaggggctgagtggcgccacttgggtggatgttgtgttggagcacgggtcctgtgtgaccacaatggccaagaacaagccaaccctcgacatagagctgctgaagacggaagtcaccaaccccgctatcctccgcaagctgtgcatcgaggccaagatcagcaacactaccacggactcccggtgcccgacccagggcgaggcgaccctggtggaggagcaggacgcaaatttcgtgtgccgccggaccttcgtggaccgaggctgggggaacggctgcggtctcttcggtaaggggagcctgctcacgtgcgccaagttcaagtgcgtgaccaagctcgaaggcaagatcgtgcagtacgagaacctgaagtactccgttatcgtaacggtgcacaccggcgaccagcaccaggtcggtaacgagacgactgagcacggtaccatagcgaccatcacgccccaggcgccgacgtcggagatccagttaaccgattacggggctctaacgttggactgcagccccagaaccggcctggacttcaacgagatggtgctcctgaccatgaaggagaagtcctggcttgtgcacaagcagtggttcctggacctgccgttaccctggacatccggggccagcaccagccaggagacctggaaccgccaggacctcctggtgaccttcaagaccgcacacgccaagaaacaggaggtggtagtcctgggctctcaggaaggcgccatgcacaccgccttgaccggcgccacagagatacaaactagcggaaccacgactatcttcgccggtcatctgaaatgtcggctaaagatggacaaactcacgttgaaaggcacctcatacgtgatgtgcaccggatccttccgccttgagaaggaggtcgcggagacgcagcacggtacggtgttggtgcaagtcaaatacgagggtaccgacgccccctgcaagatccccttctcgacacaggacgagaagggcgtgactcagaacgggcggctcatcacggccaatccgatcgtgacggacaaggagaagcccgtcaacatcgagacagagccgccctttggggagtcttacatcgtggtgggagccggggagaaggctctgaagctgtcgtggttcaagaagggcagcagcatcggcaagatgttcgaggccacggcaagaggggcacggcgcatggccatcctcggcgacaccgcgtgggacttcgggagcatcgggggagtctttacatccgttggtaagctggtgcaccaggtcttcgggaccgcatacggggtactgtttagcggcgtgtcctggacaatgaagatagggatcggcatcctgctgacctggttaggcctgaacagccgctccaccagcctgtccatgacctgcatcgcggtggggatggttacgctgtatctgggggtgatggtccaagccgacagcgggtgcgtcatcaactggaagggacgggagctgaagtgcgggtccggcatattcgtcaccaacgaggtgcacacctggacagagcagtacaaattccaggcggactctccgaagagactaagcgcggccattggcaaggcctgggaggagggcgtgtgcggcatccggtccgccacgcgcctcgagaacatcatgtggaagcagataagcaacgagctgaatcacatcctgctggaaaacgacatgaagttcacggtggtagtcggggacgctaacggcatcctggcgcagggaaagaaaatgattcggccccagcccatggagcataagtattcgtggaagtcctgggggaaggccaagataatcggtgctgacattcagaacactaccttcatcatcgacgggccagacacaccggaatgccctgacaaccaacgcgcctggaacatctgggaagtggaggactacggcttcgggatctttacgaccaacatatggctgaagctccgggattcgtacacccaaatgtgcgaccaccgcctgatgagcgcggcaattaaggactccaaggccgttcacgctgacatgggctactggatcgagtcagagaaaaacgaaacctggaagctcgctcgggcgtccttcatcgaggtgaagacgtgcacctggcccaagagccacaccctttggtccaacggcgtactggagagtgagatgatcatccccaagatatacggaggcccgatctcccagcacaactaccgccctgggtacttcacccagacggcaggaccctggcatctggggaaacttgagctggacttcgatctgtgcgagggcaccaccgtggtggttgacgaacactgtggcaaccgggggccgagcctccgaaccacgactgtcaccggcaagatcatccacgagtggtgctgccggtcctgcaccctgccgcccctgaggttcagaggggaagatggctgctggtacggcatggagatccgccccgttaaggagaaagaggagaacctcgtgcgaagcatggtttccgcgggcagcggagaggtggacagcttttccctgggaatcctgtgcgccagcatcatgatagaggaagtgatgagatcccggtggagccgcaagatgctcatgacaggcacattagccgtcttcctgctcctgatcatgggtcagctcacctggaacgacctcatcagactgtgtatcatggtgggcgcgaacgcatccgacaggatggggatgggcactacgtatctcgccctcatggctaccttcaagatgcgccccatgttcgccgtgggtctgctgtttcggcgcctcactagccgggaggtcctgctgctcaccatcggcctgtccctggtggcgagcgtcgagttgcctaactcgctggaagaactgggtgatggcttggctatgggcatcatgatgttaaagctgctcacagaatttcagccgcaccagctgtggaccaccctgctcagcctgacattcatcaagacgactctctccttagactacgcctggaaaaccacggccatggcgctaagcatagtatccctgttccccctgtgccttagcacgacctcccagaagacaacctggctgccggtgttactgggcagcttcggttgcaagcccctgaccatgttcctgatcacggagaataagatctggggccgcaagtcctggcccctcaacgagggtatcatggccatcggcattgtcagcatcctgttatcctctctgctgaaaaacgacgtccccctcgccggccctctgattgccggtggcatgctgatcgcctgctacgtgatcagcgggtcttcggctgacctctcactggagaaggcagcggaagtctcctgggagcaggaggccgaacacagcggcacgtcgcacaacatcctagtggaagtgcaggacgacggcaccatgaagatcaaggacgaagaacgggacgacaccctcacaatcttacttaaggccacccttctggcagtctcgggcgtgtatccgatgagcatacccgccactctgttcgtatggtatttttggcagaagaaaaagcagcgatccggtgtactttgggacactccttccccgcccgaggtggagcgggccgtgctagatgacggcatataccgcattttacagcggggcctgctcgggcgatctcaggtcggggtgggggtgttccaggacggcgtgttccacactatgtggcatgtgacacgcggggctgtgcttatgtatcaaggcaaacgcctggagcccagctgggcctccgtaaagaaggacctcatcagctacggagggggatggcggttccaggggtcctggaacacgggcgaggaggtccaggtgattgcggtcgagcccggcaagaacccaaagaacgtgcagaccacgcctgggacgttcaagactcccgagggagaagtgggggccatcgccttagactttaagcccggcacaagtggttcaccgatcgtcaaccgcgagggaaagatcgtgggcctgtatgggaatggcgttgtcacgacaagcggaacctacgtgtctgcaattgcgcaggcaaaagccagccaggaaggacccctccccgagatcgaggacgaggtgttcaagaaacggaacctgaccatcatggacctgcatccaggctcaggcaaaacgcgccggtacctacccgctatcgtccgcgaggccatcaagcggaagctgcgaacgctgatcctcgcacccacccgtgtggtggcctccgagatggccgaggccctgaaaggaatgcccatccggtaccaaaccacggcggttaaaagtgagcacacaggccgagaaatcgtggatttgatgtgccacgcgactttcaccatgcggctcctgtccccggtgcgtgtcccgaattacaacatgattatcatggatgaggcacacttcacggaccccgccagcatcgccgcccggggctacatttccacccgcgtgggaatgggcgaggcggccgcaatcttcatgactgccactccacccgggtctgttgaggccttcccacaaagcaacgcggtcattcaggacgaggagcgcgacatccctgagcgcagctggaactccggctacgactggatcacggactttccaggcaagactgtgtggttcgtgcccagcatcaaatccggtaacgatatcgccaactgcctgcgaaagaacggcaagcgcgtcatccaactgtcccggaagaccttcgacaccgaataccagaagacaaagaacaatgactgggactacgtggtgaccaccgacatctccgagatgggggccaattttcgcgccgaccgggtcatcgatcccagacgttgcctgaagcctgtaatcctgaaggatgggcccgagagggtgattctcgcggggccgatgcccgtcaccgttgccagcgcagctcagcgccgcggcaggatcggccggaatcagaacaaggagggggaccagtacgtgtacatgggccaaccgctgaataacgacgaggaccacgcccactggacagaggcgaaaatgctactcgacaacatcaatacccctgaagggatcatcccggccttattcgagcctgagcgcgagaagtccgccgccatcgacggcgagtaccgactgcgtggggaagcccggaaaaccttcgttgaattgatgagaagaggtgacctgccagtttggctgtcgtataaggtcgcctcagagggattccagtacagcgaccgccggtggtgctttgacggggagcgtaacaaccaggttttggaggagaacatggacgtggagatctggaccaaggagggcgaacggaaaaagctgcgcccccggtggttggacgcccgcacatactccgaccctctcgccctcagagagttcaaagagttcgccgccgggcggcggagcgtctccggcgacttaatcctcgagataggcaaactgccgcagcacctgacactccgagcgcaaaacgccctggacaacctggtgatgttacacaactccgagcaagggggaaaggcctaccggcacgccatggaggagctgcctgacaccatcgagaccctgatgctcctggcgttaatcgccgtgttgaccggtggagtcacgctatttttcctgagcggaaagggactcggcaagaccagtattggtctgttatgcgtgacagccagcagtgcgctcttgtggatggccagcgtggagccacactggatcgcagcctccatcattctggagttcttcctaatggtgctcctgatcccggagcccgatcgacaacggacaccccaggacaaccagctcgcctatgtcgtgatcggcctactgttcatgatcctcacggtggccgccaacgagatgggactgttggagaccaccaagaaggacctcggtatcgggcacgtggcggctgaaaaccaccagcacgcaacaatgctcgatgtggacctgcgcccggcctctgcctggaccctctacgcggttgccaccacggtgatcacccccatgatgcggcatactatcgaaaataccaccgctaacatctccctgaccgccatagctaaccaggccgcgattctgatgggcttagataagggttggcccattagcaagatggacataggggttccgctcctcgccctcggctgctattcccaggttaacccgctgacgctcaccgctgcagtactcatgttggtggcccactacgccattatcgggccggggctgcaggcaaaggccacgcgcgaggcccagaaacgtacggcagcagggatcatgaagaaccccactgtcgacggaatcgtggccatcgacctagaccccgttgtatacgacgccaagtttgaaaaacagctgggccagatcatgctactcatcctatgcactagccagatcctgctaatgcggaccacttgggcgctgtgcgagagcatcacgctagctaccggcccgctcacgaccctttgggaggggagcccggggaagttctggaacacgaccatcgccgtgtccatggccaacatctttcgcgggtcttacctggccggcgcggggcttgcgttctccctaatgaagtccctgggcgggggtcggcgcgggaccggcgcccagggcgagaccctcggggaaaaatggaagcggcagctgaatcagctctccaagagtgagttcaatacgtacaagcgcagtggcatcatggaggttgaccggtccgaggccaaggaggggctcaagaggggcgaaaccaccaagcacgcggtctccagggggaccgccaaactgaggtggttcgtggagcggaacctggttaagccggagggtaaggtcatcgacctgggctgcgggcgcggcgggtggtcctattactgcgccggcctcaagaaggtgaccgaagtgaaggggtacacgaagggaggccccgggcatgaggagccaatccccatggccacctatggctggaatttagtcaagctgcacagcgggaaggatgtgttcttcatgccgcccgagaagtgcgacaccttactgtgcgacatcggggagagtagcccgaaccccactatcgaggaagggcggacgctgcgcgtcctcaagatggtcgaaccctggttgcggggcaaccagttctgcataaagattctgaacccctatatgccatcagtggtggagaccctcgagcagatgcaacgcaaacacggcgggatgctggtacgcaaccctctgagtcgcaattcaacacacgaaatgtattgggtgtcttgcgggaccggtaacatagtgtccgccgttaacatgacgtcgcggatgttgctcaaccgcttcaccatggcgcacagaaagcccaccttcgagcgggatgtggacctgggcgccggtacccgtcacgttgccgtcgagccagaggtggcaaacctcgacatcatagggcagcggatcgagaacatcaagaacgaacacaagtccacgtggcactatgatgaggataacccgtataagacctgggcctatcacggaagctacgaggtaaagccctccgggagcgcgtccagcatggtcaacggagtggtgcgcctgctgaccaagccctgggacgtcatacctatggtgacccaaatcgccatgacggacaccaccccgtttgggcagcagcgggtctttaaagagaaggttgacactcgcacgccccgggccaagcgtggcactactcagatcatggaggtgaccgccaaatggctctggggcttcctgtccagaaacaaaaagccccgaatttgtacgcgagaggagttcaccaggaaggtgcggagcaacgccgcgatcggggctgtgttcgtagatgagaaccaatggaacagcgccaaggaggccgtcgaagacgaacgcttctgggacttggtgcatcgcgagcgcgaactccacaaacagggcaaatgcgcgacgtgcgtgtacaacatgatggggaagcgggagaagaagctgggcgagttcgggaaggcgaagggctcccgcgccatctggtacatgtggctgggcgcccggttcctcgagttcgaggccctggggttcatgaacgaggatcactggttcagccgggaaaattctctgagcggtgtcgagggggagggcctccataaactggggtacatcctgcgggacatctccaagatcccgggcggcaatatgtacgcggacgacaccgccgggtgggacacgcgtatcaccgaggatgacctccagaatgaggccaagatcaccgacatcatggagcccgagcacgccctgctagccacctctattttcaagctcacgtaccagaataaggtggtccgtgtacagcggcccgcgaagaatggaaccgtgatggatgtgatctcccgccgggaccagcggggaagcggccaagttgggacatacgggctgaacaccttcactaacatggaggtccagctaatccggcagatggagtccgagggcatcttcctccccagcgagctggagaccccaaacttagccgagagggtgctcgattggctggaaaagcatggtgccgaacggctgaagcggatggcaatctccggcgacgactgcgttgtgaaacccattgacgacaggttcgccaccgcgctcaccgccctgaacgacatggggaaggtgcgcaaggacatcccccagtgggaaccgtcgaaaggctggaacgactggcagcaggtcccgttctgctcccaccacttccatcaactgatcatgaaagacggcagagagatcgttgtgccctgcaggaaccaggacgagttagtcggacgtgcccgcgtgagccagggcgcagggtggtccctgcgggagacggcctgcttaggcaagagctacgcccaaatgtggcagctcatgtattttcaccgccgggatctgcgccttgccgccaacgcaatctgctccgcggtgcctgtcgattgggtgcccacaagccgaaccacttggagcatccacgcccaccaccagtggatgacgacggaggatatgctctccgtgtggaaccgcgtttggatcgaggagaacccctggatggaggataagacccacgtaagctcctgggaggaggtgccctacctggggaagcgcgaagaccagtggtgcggcagcttaatcgggcttacagctcgagccacatgggccacgaacatccaggtagcgatcaaccaggtccgccggctgatcgggaacgagaactatctggactacatgacctccatgaagcgctttaagaacgagtccgaccctgagggggtgctatggtga

SEQ ID NO: 23864 - RNA, 9870 nt, synthetic construct
  misc_feature 1..9870: note = derived and/or modified CDS sequence (opt11) from DENV-1__GU131962__SS-prME
  source 1..9870: mol_type = other RNA
agcgtgaccatgttactcatgttgctccccaccgccctcgccttccacctgaccactcggggcggggagccccatatgatcgtgagcaagcaggagcggggtaaaagcctcctcttcaagaccagcgccggtgtgaacatgtgtaccctgatcgcaatggacttaggtgaactctgcgaggacaccatgacctacaagtgcccccaaatcaccgaggccgagccagacgatgtggactgttggtgtaacgcgaccgatacctgggtcacctacgggacctgcagccaaaccggcgaacaccggcgggataagcgctcagtggccctcgctccccacgtggggctggggctggagacgcggaccgaaacctggatgagcagcgagggcgcctggaagcagatccagcgcgttgagacctgggccctgcggcacccaggtttcacggtgatcgcgctgttcctcgcacacgctatagggacgagcatcacgcagaaggggataatatttatcctgcttatgctcgtcaccccctccatggccatgaggtgcgtgggcatcggaaaccgtgacttcgtggagggtctaagtggcgcgacgtgggtggacgtcgtgctggagcacggctcctgcgtgaccaccatggcgaagaacaagcccaccctcgacatcgagttgctaaagaccgaagtgaccaacccggcgatcctccgtaagttgtgcatagaggctaaaatctctaacaccaccaccgactcccgttgcccgacccaaggagaggccacactggtcgaggagcaggacgccaactttgtttgccgccggaccttcgtcgaccgcggctgggggaacggctgcggcctcttcggcaaggggagcctgttaacgtgcgctaagttcaaatgcgtgaccaaacttgagggcaagatcgtgcagtacgagaacttaaagtactccgtcatagtcaccgtgcacacgggcgaccaacatcaagtcgggaacgagacgaccgagcacggcaccatcgcgaccatcacccctcaagcgcccaccagcgaaattcagctgaccgactacggcgccctaactcttgactgcagcccccggaccggcctggacttcaacgagatggtcctcttaacgatgaaggaaaagagctggctggtccacaaacagtggtttttggatctcccgctgccctggacctcaggagctagcaccagccaggagacctggaaccgccaagatctattggtgacgtttaagaccgcccatgcgaaaaagcaagaggtggtcgtactgggctctcaagaaggggccatgcacaccgcactcactggggccacggagatccagaccagtggcacgactactatcttcgcagggcacctgaagtgccggctgaagatggacaaactcacattgaagggaacctcctatgtgatgtgcaccgggagcttcaagctagagaaggaggtcgcggaaacgcagcacggcaccgtgctggtgcaggtcaagtacgaaggcaccgacgcaccgtgcaagatacccttctccacccaagacgagaaaggggtgacgcagaacggccgcctcattaccgccaacccgatcgtgaccgacaaggagaaacctgtcaacatcgagaccgagccgccctttggggagtcttatattgtggtgggcgccggtgagaaagcgctgaaactgtcatggttcaagaaagggagctctatcggcaagatgtttgaggcaacggccagaggggctcgacggatggccattctgggagacaccgcgtgggatttcggaagcatcggaggcgtcttcacctccgtgggaaaactggtgcatcaagttttcggaaccgcctacggggtgctctttagcggcgtgagctggacgatgaagatcgggatcggcatcctcctgacctggctgggactcaacagccgatcgacctccctgtccatgacctgcatcgccgtcgggatggtgacgttatacctcggcgtgatggtccaggcggactcggggtgcgtgatcaactggaagggccgggagctgaaatgcgggtctggcatctttgtaactaacgaagtccacacctggaccgagcagtacaagttccaggccgatagccctaagagactgagcgcggccatcggtaaggcttgggaggagggggtgtgcggcatccgctccgccacgcggctcgagaacatcatgtggaagcaaatcagcaacgagctgaaccatatcctgctcgagaacgacatgaagtttaccgtcgtcgtaggagacgctaacggtatcctggcgcaagggaaaaagatgatacgtccccagcccatggaacataagtactcctggaaatcctggggcaaggccaaaataataggggccgacatccagaacactacctttatcatcgatgggcccgacaccccagagtgccccgataaccagcgggcctggaacatctgggaagtagaggactatggcttcgggatcttcactaccaacatctggctgaagctccgagactcctacacccagatgtgcgatcacaggctgatgagcgcggccatcaaagactccaaagccgtccacgccgacatgggctactggatcgagagcgagaaaaacgagacctggaagctggcaagagcgagcttcatcgaagtaaaaacctgcacctggccgaaatcacacacactctggtcgaatggcgtcctggagagcgagatgatcattcccaagatctacgggggaccaatttcccagcacaactaccggcccgggtatttcacccagacagcagggccctggcatctggggaagctcgagctggacttcgatctgtgcgagggcaccaccgtcgtggtggacgaacactgcggtaaccgcgggccgagcctacggaccacgaccgtcacaggcaagattatccacgaatggtgctgccgctcctgcaccctgccgcccttacgattccgcggggaggacggctgttggtacgggatggagattcggcctgttaaagaaaaggaagaaaacttggtgcggagcatggtctctgcaggcagcggagaggttgactcctttagcctggggatcttatgcgtgagcatcatgatcgaggaggtcatgcggagccgctggagtcggaaaatgctcatgacgggaaccctggcagtgttcctgctcctggtgatgggacagctgacctggaacgacctcatccgcctgtgcatcatggtcggcgcgaacgcgtccgaccgcatggggatggggactacgtacctagccctgatggccaccttcaaaatgcggccgatgtttgcggttgggttactgttcagaagactcacttcccgcgaggtactgctgttgactatcggactgagcctggtggccagcgttgagctcccaaactccttagaggaactcggcgacgggctcgcgatgggcataatgatgctcaagctgctcaccgagtttcaaccccaccagctgtggaccaccctgctcagcctgaccttcatcaagacgaccctcagtttagactatgcctggaagactaccgcaatggcccttagcatcgtctcccttttccccctttgtcttagcacgacctcccagaaaacgacgtggctgccggtactcttgggcagcttcgggtgcaagcccctgactatgttccttatcacggagaataagatctggggaagaaagagctggcctcttaacgaggggatcatggcgatcggcattgtgagcatcctgctctccagcctgctgaagaatgacgtccccctcgccgggccgctgatcgccggcggcatgctgatcgcctgttacgtgatcagcggatccagcgctgacctctcccttgaaaaggctgcggaggtgagctgggagcaggaggccgaacactccggcacgagccacaacatcctggtcgaagtccaggacgatgggaccatgaagataaaagacgaggagcgcgacgacaccttaacgatcctgctcaaggccaccctcctggccgtgtccggtgtctaccctatgagcatccctgcgaccttgtttgtgtggtacttctggcagaagaagaaacaacggtctggggtgctctgggacactccctcgccaccggaggtagagagagctgtgttggacgacggtatttaccgtatactgcagcgcgggctgctcggccgctcccaggtgggtgtcggggtgttccaagacggcgtgttccacacgatgtggcacgtcaccagaggggcagtgctgatgtaccagggcaagcggctggaacccagctgggcgtccgtcaagaaagacttgatttcgtacggcggaggctggcgcttccaggggtcgtggaacaccggagaggaggtgcaagtgatcgccgtagagcccggaaagaacccgaaaaacgtccaaacaacgccaggtacctttaagaccccggagggcgaggtgggggccatagccctggacttcaaacccggcaccagcgggtcacctatcgtgaaccgggagggcaagatagtaggcctgtacgggaacggcgttgtgacgacctcgggaacttacgtctccgccatcgcccaggccaaggcgtcccaggagggccccctcccagagattgaggatgaggtgtttaagaaacgcaacttaaccatcatggatttgcacccggggagcggtaaaacccgtcgctacctccccgccatcgttcgggaggccatcaagcgcaagctccgcacactgatcctcgccccgactcgcgtcgtggcttccgaaatggctgaagcgctgaagggcatgcccatacgctatcagaccacagccgtcaaaagcgagcacaccgggagagagatcgttgatctgatgtgccacgccacatttaccatgcgcctgctgtccccggtgcgggtgcccaattacaacatgatcatcatggacgaagcgcactttactgaccccgccagcatcgctgccagaggctacatctccacccgagtagggatgggcgaggccgcggcaattttcatgaccgctacgccgcctggctctgtggaggccttcccgcagtccaacgccgtgatccaggacgaggagcgcgacataccggagcgaagttggaacagtgggtacgactggatcacggacttcccgggcaaaaccgtctggttcgtgccttccatcaagtccgggaatgacatcgcgaactgcctgcgcaagaacggcaaaagggtgatccagttaagccggaagaccttcgataccgaataccagaaaacgaagaacaatgactgggactacgtagtgaccaccgatatatccgagatgggtgccaacttccgggccgaccgcgtgatcgacccgcggcgctgcctgaagccggtcatactgaaggacggcccggagcgggtgatcctcgcggggcccatgcccgtgaccgtagcgtccgccgcccagcgccgggggcgcatcggacggaaccagaacaaagagggggaccagtacgtgtacatgggtcagccgctgaacaacgacgaggaccacgcacactggacggaggccaagatgctgctcgataacatcaacacacccgaggggataatcccggccctgtttgagcccgagcgggagaagtccgccgcgatagatggtgagtacagactgcgcggagaggccagaaaaaccttcgtcgagctcatgcggcgcggggacctgcccgtgtggctaagctacaaggtggcttccgagggatttcagtactctgaccggcgatggtgcttcgacggggagcggaacaaccaggtcctcgaggagaacatggacgtggagatctggacgaaggaaggcgagcgcaagaagttacgtccccgctggctggacgcgcgcacttactccgacccgctcgccctacgcgagttcaaggaatttgccgccgggaggcgcagcgtcagcggcgacttgatccttgagataggcaagttgccccagcaccttacgctccgtgcacagaacgccctggacaaccttgtcatgctccacaactccgagcaaggcgggaaggcctataggcacgccatggaggagctgcctgacaccatcgagaccctcatgctcttagctctgatcgcggtactcactggaggggtgacgctattctttttgagcggaaaaggcctcggcaagacctctataggcctgctgtgtgtgaccgccagctcggccctcttatggatggccagcgtggaaccacactggatcgccgcgtccatcatactggaatttttcctcatggtcctcctgattccggagcctgaccggcaacgcacaccccaggacaaccaattagcgtacgttgtgatcggcctgctgtttatgattttgactgttgccgccaacgagatgggactgttggaaaccaccaagaaggatctcggcatcgggcacgtggccgctgagaaccaccaacacgcaaccatgctggacgtggacctccggcccgccagcgcctggaccctctacgcagtggcaaccaccgtcatcacaccgatgatgcggcacacgatcgagaataccacggccaacatctccctgaccgccatcgcaaaccaggccgcgatactgatgggcctcgataagggctggcctatcagcaagatggatatcggcgtgcctcttttagccctcggctgctactcacaggtgaacccgcttacactgacagccgctgtcctcatgctggtagcgcactacgcgatcattggcccaggcctacaggccaaggcaacacgggaggcccagaagcgaaccgcggccggaatcatgaagaatcccacggtggatggcatcgtcgctatcgacctcgaccccgtggtgtacgacgccaagttcgagaaacaactgggccagatcatgctgctcatattgtgcacttctcagatcctgttaatgcgtacaacctgggccctgtgtgaatcaataacgctggcgaccgggcccctgaccacactctgggagggcagccccggtaagttttggaatactaccatcgccgtatccatggccaacatcttccggggcagctatctcgccggagccgggctcgccttctccctgatgaagtccctgggcggtggccgccgggggacaggcgcccagggcgagaccctaggcgagaagtggaaacgccagttaaaccagctgtccaagagcgagttcaacacctacaaacgtagcggcataatggaggtggaccgctccgaggcgaaggaggggctgaagcggggcgaaaccaccaagcacgccgtatcccgcggaaccgcgaaactgcggtggttcgtcgagcgaaacctggttaagcccgagggcaaggtgatagacctgggctgcggacggggcggttggtcctactactgcgccggcctaaagaaggtcacggagtacgcctccgccgggctggccatcatcgtgcccctgccgctcgacacctacggtcgcaatcggctaaaaatccattccggcaaggacgtgttcttcatgccacccgagaagggggacaccctgctttgcgacatcggagagtcatcccccaacccgacgatcgaggaggggcgaaccctgcgcgtcctgaagatggtggagccctggcttcgcgggaaccagttctgcataaaaatcctgaatccctacatgccttccgtggtagaagcgctggagcagatgcaacgtaagcacgggggcatgttggttcgcaacccgctgtctcggaatagcacgcatgagatgtactgggtctcctgcggtactggaaacatcgtcagcgccgtgaacatgacttcgcgtatgttgctcaacagattcaccatggcccaccggaagcctacttatgagcgagacgtggacctaggcgccggtacccggcacgtcgccgttgagcctgaggtagcaaacctcgacatcataggccagcgcatcgagaatatcaagaacgagcacaagtccacctggcactacgacgaggacaacccctacaagacctgggcataccacgggtcctacgaggtcaagccgagcgggtccgccagctccatggttaacggcgtggttcgcctcctgacgaagccctgggatgtgatacccatggtaacacagatcgccatgaccgacactacgccattcgggcagcagcgcgtattcaaagagaaggtggacacccggaccccgcgcgcgaagcggggcacaacccagatcatggaggttaccgcgaagtggctgtgggggttcctaagccgcaacaaaaagccccggatctgtacccgtgaggagtttacccgcaaggttcgatctaacgccgccatcggagccgtgttcgtcgacgaaaaccaatggaactccgcgaaggaggccgtggaggacgagaggttctgggacttagtgcaccgtgagcgagagctgcacaagcagggcaaatgcgcgacttgcgtctacaacatgatggggaagcgcgaaaagaagctcggggagttcggtaaggccaagggcagccgggccatctggtacatgtggctgggggcacgcttcttagagtttgaagcactcggcttcatgaacgaggatcactggttctcacgtgagaatagcctgagtggcgtcgagggggaaggcctgcataagctggggtacatcctgagagacatatctaaaatccccggagggaacatgtacgccgacgacaccgccggttgggacacgcgcatcacggaggatgacttacagaatgaggccaaaattacggagatcatggagccggagcatgccctcctcgccacttccatcttcaagttgacctaccaaaacaaggtggtaagggtacaacgcccggccaagaacggcaccgtgatggatgtcatcagccggcgcgaccagagagggtccggccaagtcggcacgtacggcctcaacaccttcaccaatatggaggtccaactcatccgccagatggagagcgagggcatcttcttgccctccgagttagagacccccaacctggctgagcgggttctagactggctcgaaaagcacggcgctgagcgccttaagcggatggcgatcagcggcgatgactgtgtggtgaaaccgattgatgacaggttcgccacggctttgaccgccctaaacgacatggggaaagtacggaaggatatcccccagtgggagccctctaagggctggaacgattggcagcaggtacccttctgttcacatcacttccaccaactgatcatgaaggacgggcgtgagatcgtggtgccgtgccggaaccaggacgaactggtgggccgcgccagggtgtcccaaggcgcaggatggagcctcagggaaaccgcctgcctgggaaagtcctatgcccagatgtggcagctgatgtacttccaccggcgtgacctcaggctggccgcgaatgccatctgcagtgccgtccccgtggattgggtgccaacgtctaggaccacgtggtctattcacgcgcaccaccagtggatgaccactgaggacatgttgtccgtctggaaccgcgtttggatcgaggagaacccctggatggaggataagacccacgtatcctcgtgggaggaggtcccgtacctcgggaagagggaggaccagtggtgcgggtccctgatcgggttgacggcccgcgccacctgggccaccaacatccaggtggccattaatcaagttcgtcgcctcatcggtaatgagaattacttggattacatgaccagcatgaagagattcaagaacgagtccgaccccgagggagccctgtggtag

SEQ ID NO: 23865 - RNA, 9879 nt, synthetic construct
  misc_feature 1..9879: note = derived and/or modified CDS sequence (opt11) from DENV-1__GU131963__SS-prME
  source 1..9879: mol_type = other RNA
agcgttaccatgctactcatgctgctgcctaccgccctcgccttccaccttaccacccggggcggggagccccacatgattgtgagcaaacaagagcggggcaagagcctcctcttcaagaccagcgcgggggtgaacatgtgtaccctgatagccatggacctgggcgagctctgcgaggacaccatgacctacaagtgcccccagatcacggaggctgagcccgacgacgtggactgttggtgcaacgccaccgacacttgggtgacgtacggcacctgcagccagaccggcgagcaccgccgggacaagcggtccgtggccctggccccacatgtggggttaggcttagaaacgcggaccgaaacctggatgagcagcgagggtgcgtggaagcagattcaacgcgtggagacttgggccctacggcaccccgggtttacggtaatcgcatttttcctcgcccacgccatcggcaccagcatcacgcagaaggggatcatcttcatcttactgatgctggtgaccccctcgatggctatgagatgcgtcggcatcggcaaccgggacttcgtggaaggtctcagcggcgccacatgggtggacgtcgtgctggagcatgggtcctgcgtgaccaccatggccaagaacaagcccaccctggatatagagctcctgaagacggaggtgaccaaccccgctatcctgcgcaagctctgcattgaggccaagatcagcaacaccaccacggactcccggtgcccgactcaaggcgaggcgacgctggtggaggagcaggatgccaacttcgtttgtcgccggaccttcgtcgaccgcggatgggggaacggctgcggactgttcggcaaggggtccctcctgacgtgcgccaagtttaagtgcgttaccaagttagagggcaagatcgtacagtacgaaaacctgaagtactccgtaatcgtgaccgtgcacaccggcgatcagcaccaggtcggtaacgagaccacggagcatggaactatcgcgaccatcacgccccaagctcccacgtcggagatccagctgaccgactacggggctctgaccctcgactgcagccccagaaccggtctggacttcaacgaaatggtactcctcacgatgaaggagaagtcctggctggtgcataagcagtggttcctggacctcccgctgccttggacctcgggggccagcaccagccaagaaacatggaaccgccaagacctgctcgtgacgttcaagaccgcccacgcgaagaagcaggaggtggtcgttctaggctcccaggagggcgccatgcacaccgccctcaccggagccacggagatacagaccagcggcaccaccacgatcttcgccgggcacctcaagtgccggctgaagatggataagctgaccctaaagggaacctcctacgtgatgtgtaccgggagcttcaagcttgagaaggaagtcgccgagacgcagcacgggaccgtgctggtacaggtcaagtacgaaggcaccgacgccccctgcaagattcccttctccacccaggacgagaagggggtcacgcagaacggccgcctgataaccgcgaatccgatcgtgactgacaaggagaagccggtaaatattgagaccgagccgccgttcggggagagctatatcgtggtgggcgccggcgagaaggccctcaaactgtcttggttcaagaaggggtcatccatcggcaagatgttcgaggccacggctcgcggtgcgcgccgtatggccatcctgggcgatactgcgtgggacttcggcagcatcggcggtgtcttcacctccgttgggaagctcgtgcaccaggtctttggcaccgcttatggagtgctgtttagcggcgtgtcctggacgatgaagatcgggattggaatcctgctcacctggctgggcctgaacagccgctccacgagcctctccatgacctgcatcgccgtcgggatggtgacgctgtacctgggcgtgatggtccaagcggacagcgggtgcgtgatcaactggaagggcagagagctcaagtgcggatccggtatcttcgtgaccaacgaggtgcacacctggacggagcagtacaagttccaagccgacagtccgaagcgactctccgccgccatcggcaaggcctgggaggagggggtgtgcggcatccgctctgccactcgactggagaacatcatgtggaaacaaatcagcaacgagctcaaccatatcctcttagagaacgacatgaagttcacggtggtcgtgggggatgcgaacggcatcctggcgcaggggaagaaaatgatccgcccccagcccatggagcacaagtactcctggaagtcctggggcaaggccaagatcatcggcgcggacatccagaacacgaccttcataatcgacgggcccgataccccggagtgccccgacaaccagcgggcttggaacatatgggaagtggaggattacggcttcggcatctttacgaccaacatctggctgaagctgcgggactcctatacccagatgtgtgaccacagactcatgagcgcggccatcaaggattccaaggccgtacacgccgacatgggctactggattgagagcgaaaagaacgagacctggaagctggctcgcgcgtccttcatagaggtgaagacgtgcacctggcccaaaagccacaccctgtggtcaaacggcgtacttgaaagcgagatgatcatccccaagatctacgggggcccgatcagtcagcataactaccggcctggctacttcacccagacggcaggaccctggcatctggggaagctggagctcgacttcgacctgtgcgagggcacaaccgttgtggtggacgagcattgcggcaatcgcgggcctagcctgcggaccaccaccgtcaccggcaagatcatccacgaatggtgctgccgatcctgcactctcccgcccctgcggtttcgcggagaggacggctgctggtacgggatggaaatccggcctgtgaaggagaaggaggagaacctggtgagaagcatggtctcggccgggtcaggcgaggtggactcattctcactcgggatcttgtgcgtgagcatcatgatcgaggaagtcatgcggtcccgctggagccggaagatgctgatgacgggcaccttggccgtgttcttgctgctcgtgatggggcagctgacttggaacgatctgatacgcctctgcatcatggtcggcgccaacgcgtcggaccgcatgggcatgggcaccacgtacctggccttaatggcaacctttaagatgaggcctatgtttgccgtgggcctcctgttccgtcggctgacaagtcgcgaggtgctactgctgaccatagggctcagtctggtcgccagcgtggagctgcccaactccctcgaggagctaggcgacgggctggccatgggcatcatgatgctcaagcttctaacggagttccagccccaccaactctggactacactgctgagcctaacattcatcaagacgaccctgtcccttgactacgcctggaagaccaccgcgatggcccttagcatcgtctccctgttccccctttgcctcagcacgacctcccaaaagaccacctggttgcccgtgctgctgggcagcttcgggtgcaagcccctgaccatgttcttgatcacggagaacaagatctggggccggaagtcgtggcccctcaatgaggggatcatggctattggcatcgtgagcatactgctgagttcacttcttaagaacgacgtccccctggccgggccgctgatcgccggcggcatgctgatcgcatgctacgtgataagcgggtccagcgcagacctgtccttggagaaggcggccgaagtgagctgggagcaggaggccgagcactccggcaccagccacaatattctggtcgaggttcaggatgacgggactatgaaaattaaggacgaggaacgcgacgacaccctgacgatcctactgaaggccaccctactcgctgtgtccggcgtttatccgatgagcatccccgctaccctgtttgtctggtatttctggcaaaagaagaagcagcggtccggtgtcttatgggacacgcccagcccgcccgaggtcgagcgcgcggtgctggacgacggcatctaccggatactacagcgcggtctgctggggcggtcccaggttggcgtcggagtgttccaggatggcgtgttccacaccatgtggcacgtcacccgcggggccgtactcatgtatcaaggcaagcggctggaacccagctgggcctcggttaagaaggacctgatctcttatggcggcgggtggcggtttcaggggtcctggaataccggcgaagaggtccaggtgatagctgttgagcccgggaaaaacccaaagaacgtccaaaccactcctgggacgttcaagacccccgaaggcgaagtgggagcgatcgccctcgacttcaaacccgggaccagcgggtccccaatcgtgaaccgggagggcaagatcgtaggcctgtacgggaacggcgtggtgacgacgagcgggacctacgtctctgccatcgcccaggccaaggcgtctcaggagggtcccctgcccgagatcgaggacgaagtgtttaagaagcgcaatctcaccattatggacctacacccaggaagcggcaagacgcggcgctacctgcccgccatcgtgcgggaggccatcaagagaaagctccggacgctgatcctggcccccacgcgcgtcgttgcctctgagatggccgaggccctcaagggcatgcccatccgctaccagaccacggccgtcaagtccgaacacaccggtcgggaaattgtcgacctgatgtgccacgccaccttcaccatgcgactgctttccccggtgcgagtgcccaactacaatatgatcataatggatgaggcgcatttcacggacccggcctctatcgcagcccgcgggtatatctccaccagagtagggatgggcgaggccgcagccatcttcatgaccgccacgccgcccgggagcgtggaggcctttccgcagtccaacgccgttatccaggatgaggagcgcgacatccccgagcggagctggaactccggctacgactggatcacggacttccctggcaagaccgtctggttcgtgccctccatcaaatccgggaacgatatcgcgaattgccttcgaaagaacggcaagcgagtgatccagctgagccgcaagaccttcgataccgagtaccagaaaacgaagaacaacgactgggattacgtagtcaccaccgacatctccgagatgggggccaacttccgtgccgaccgcgtaatcgacccacggagatgccttaagccagtcatcctgaaagacggccccgagcgggtgatcctggcagggccgatgcccgtgaccgttgctagcgccgcccagcgccgggggcgcatcggccggaaccagaacaaggagggggatcagtacgtgtacatgggccagcccctgaataacgatgaggaccacgcgcactggacggaggccaagatgctgctggacaacatcaacacccctgaggggatcatcccagcactcttcgagccggagcgtgaaaagtccgccgccatcgacggggaataccgcctgcgtggggaggcccgcaagacattcgtcgagcttatgcggagaggcgatctccccgtgtggctcagctacaaggttgcgtctgagggcttccagtacagcgaccgacgctggtgcttcgacggggagcgcaacaaccaagttctggaagagaatatggacgtggaaatctggaccaaggagggcgagaggaaaaagttacggccccgctggctggacgcgagaacctattccgaccctttagccctccgcgagttcaaggagttcgccgcagggcggcgcagcgtgagcggcgatctgatactggagatcggcaagctcccgcagcacctgacgttacgtgcccagaacgcactcgacaacttagtcatgttacacaactccgaacaaggcgggaaggcctacagacacgcgatggaggagctccccgacaccattgagaccctgatgctgcttgcactgatcgcggtcctgaccgggggcgtaaccctattcttcttaagcggaaagggcttgggaaagacctccatcgggctgctttgcgtcaccgcgagttccgcgctgttatggatggccagcgtggagccccactggatcgccgcgtccatcatcctggagttcttcctgatggtgctccttatcccggagcccgacaggcagcgcacgccccaggacaaccagctggcctacgtcgtgatcggcctcctgttcatgattctgacggtggctgccaacgagatggggctcttggagaccacgaagaaggatctgggcatcgggcacgtcgccgcagaaaaccaccagcacgccaccatgttggacgtggacctgcggccggcgagcgcgtggaccctgtacgccgtggcgacaaccgtcatcacccccatgatgcgccacacgatagagaacaccaccgcgaacatctcactcaccgccatcgccaaccaggccgcgatattaatgggcctagacaagggctggcccatcagcaaaatggacatcggggtgcctctcctggccctgggctgctactcccaggtgaacccgctcacgctaaccgccgccgtactcatgctcgtggcgcactacgccatcatcggtcccgggctgcaagccaaagccacccgggaggcacagaagcgcaccgcggcggggataatgaagaaccccactgtggacggcatcgtcgccatcgatctggaccccgtggtatacgacgccaagttcgaaaagcaactcggccagatcatgcttctgatcctctgcaccagccagatcctgctgatgcgcacaacctgggccctctgcgagtccatcacgctagcgaccggcccgctgacaaccctgtgggagggcagccccgggaagttctggaacacgaccatcgccgtttccatggccaatatcttccgagggtcatacctggccggcgccgggctggcgttctccctcatgaagtccttaggcgggggccgcagagggaccggcgcgcagggcgagaccctaggggagaagtggaagcgccagctcaaccagctgtccaagagcgaattcaacacttacaagcggagcggtatcatggaggtggaccgttccgaggccaaggagggtctgaagcggggcgagaccaccaagcacgcagtgagtcgcgggaccgcgaagctccggtggttcgtcgagcgcaaccttgtgaagcccgaaggcaaggtgatcgacctgggctgcgggcggggcgggtggtcctactattgcgccggcctcaagaaggtcacagaggtgaagggttatacgaagggcggccccgggcacgaggagccgatccccatggccacctacggctggaacctcgtgaagctgcacagcgggaaggacgtgttcttcatgccgcccgaaaaatgcgacactctgctatgcgacatcggcgaatccagcccgaatccaaccatcgaagagggccgcacgctgcgggttctgaaaatggtggagccgtggctccgaggcaatcagttttgcatcaagatcctgaacccttacatgccgagtgtggtggaggcgctggagcagatgcagcggaagcacggcgggatgctcgtgcgcaatcccctgagccggaactccacccacgagatgtactgggttagctgcggaacggggaacatagtctcggccgtgaacatgaccagccgcatgctgctcaatcggttcacgatggcgcaccgcaagcccacctacgagcgcgatgtcgatctgggcgccggcacccggcacgtggcagtcgagcccgaagtcgcgaatctggacatcatcgggcaacgcatcgagaacatcaagaacgaacacaagtccacctggcactacgacgaggacaacccctacaagacctgggcttaccatggtagctacgaggtgaagccctccgggagcgcgtcctcaatggtgaacggcgtcgttcggctcctcacaaagccctgggacgtcatccccatggtgacccagattgccatgaccgacactaccccgttcggccagcagcgcgtgttcaaggagaaggtcgacacccggacgccccgggccaagcggggcacgacccagatcatggaggtgaccgccaagtggctgtggggcttcctctcccgcaacaagaagccccggatctgcacccgggaggagttcacgcggaaagtgcgcagcaacgccgcgattggggccgttttcgtggacgagaaccagtggaacagcgccaaggaggcagtggaggacgagcggttctgggacctggtacacagagagcgtgagctgcacaagcagggcaagtgcgcgacatgcgtgtacaacatgatggggaagcgcgagaaaaagctaggcgagttcgggaaggccaagggctcccgggccatatggtacatgtggctgggcgcccgcttcctggaattcgaggccctcggtttcatgaatgaggatcactggttctcacgggagaactccctgagcggcgtggagggagagggcctgcacaagctcgggtacatcctgcgcgacatttccaagatcccgggcggaaatatgtacgcggacgacaccgccggctgggacacccggatcacggaggacgaccttcagaacgaggccaagatcaccgagattatggagccggagcacgccctcctggccaccagcatctttaaactgacctaccagaacaaagtggtacgcgtgcagcgccccgcaaaaaacggcacagttatggacgtcatctcccggcgggaccagcggggctccggacaggtgggaacctacgggctcaacacatttaccaacatggaggtccagctgatcaggcagatggagtccgagggaattttcctgccatctgagcttgaaacgccgaacctggccgaacgtgtgctggattggctcgagaagcacggggccgagcgcctgaagcggatggccatatccggcgacgactgcgtggtcaagcccatcgatgaccggtttgcgaccgcgctgacggccctcaacgacatggggaaggtgcggaaggacattccccaatgggagcctagcaagggttggaacgactggcaacaagtccccttctgttcccaccacttccaccagctgatcatgaaagacggtcgcgagatagtcgtgccctgtcggaaccaggacgaactggttgggcgcgcgcgggtaagccaaggcgcaggatggtccctacgcgagacggcctgtcttggtaagtcttacgcacagatgtggcagctgatgtactttcaccggcgcgacctccggctggccgccaacgctatttgttccgcggtgccagtggactgggtccccacttcacgcacgacgtggtctatccacgcccatcaccagtggatgacaaccgaggatatgctgtcagtgtggaaccgggtgtggatcgaggagaacccttggatggaggacaaaactcaagtctcttcctgggaagaggtcccatacctgggaaagcgcgaggaccagtggtgcggcagccttatcggtctgaccgcgcgcgccacctgggccaccaacatccaggtggcgatcaaccaggtccggcgcctcatcggcaatgagaactacctggactacatgacatccatgaagcggttcaaaaacgagagcgaccccgagggagccctgtggtga

SEQ ID NO: 23866 - RNA, 9879 nt, synthetic construct
  misc_feature 1..9879: note = derived and/or modified CDS sequence (opt11) from DENV-1__KF955442__SS-prME
  source 1..9879: mol_type = other RNA
agcgttacgatgctgctcatgctgctgccaaccgccctcgccttccacctcaccacccggggcggggagccccacatgatcgtgagcaagcaggagcggggcaagagcctcctgttcaagactagcgcgggagtgaacatgtgcaccctgatcgccatggacctgggagaactgtgcgaggacaccatgacatacaaatgcccccagatcactgaggccgaacccgatgacgtggactgctggtgcaatgccaccgacacatgggtcacctacgggacctgctcccaaaccggcgaacaccggcgggacaagcgctccgtggctctagcgccacacgtgggtctggggctcgagacgaggaccgagacctggatgagctccgagggcgcctggaagcagattcagcgcgtagagacctgggcgctgcggcaccccggcttcactgtgatcgccctgtttctcgcgcacgccatcggcaccagcatcacccagaaggggatcatcttcatcctgctgatgctagtgaccccatccatggccatgcgctgtgtcggcatcggcaaccgggactttgtggaggggctgagcggcgccacgtgggtggacgttgttctggagcacgggtcctgcgtgaccaccatggccaagaacaagcccaccttagatatcgagcttctaaagacggaggtcaccaacccagcgattctccggaaactgtgcatagaggccaagatcagcaacaccaccacggactccaggtgcccgacccagggcgaggccacgctggtggaagagcaggacgccaacttcgtgtgccgccggaccttcgtagaccgcggctgggggaacggctgcggcctcttcggtaaggggagcctgctgacgtgcgccaagttcaagtgcgtgaccaagctcgagggaaagatcgtgcagtatgagaacctgaagtattcagtcatcgtgaccgtacacactggagaccagcaccaggtcggaaacgagaccaccgagcacggcaccatcgcgaccatcacgcctcaggcccccacgagcgagattcagcttaccgactacggggccctcactctggattgcagtccccggaccggcctggactttaacgagatggtgctcctgacgatgaaggagaagtcctggctggtccataagcagtggttcctcgacctccccttgccctggacctccggggctagcaccagccaggagacctggaaccgccaggatctccttgtgacgttcaagaccgcccacgcgaagaagcaggaggtggtcgtgctgggctcccaggagggcgccatgcacaccgcactcaccggggccacggagatccagacctcgggcaccaccaccatcttcgccgggcacctaaagtgccggttgaagatggacaagttgaccctcaaaggcacctcctacgttatgtgcaccgggagcttcaaactggagaaggaggtcgcggagacgcagcacggcaccgtgctggtccaagtcaagtatgagggcacggacgccccctgcaagatcccgttctccacccaggacgagaagggggtgactcagaacggccgcctcatcaccgccaaccccatcgtgaccgacaaggagaagcccgttaacatcgagaccgagccgccattcggggagtcctacatcgtggtgggcgcaggcgagaaggcgctgaagctgtcctggttcaagaaggggagctccatcggcaagatgttcgaggccacggcccgtggggcccgccgtatggccatcctcggcgacactgcatgggacttcgggagcatcggcggcgtcttcacctccgtgggtaagctggtgcaccaagttttcggaaccgcctatggggtgctgttcagcggcgtgtcatggactatgaagatcgggatcggcatcctcctgacctggctgggcctcaacagccgctcaacgtccctgtccatgacctgcatagccgtcgggatggtgacgctgtatctcggcgtgatggtccaggccgacagcgggtgcgtgatcaactggaagggccgcgagctgaagtgcgggtccggaatcttcgtaaccaacgaggtccacacctggaccgagcagtataagttccaggccgactcgccgaaacggttaagtgctgccataggcaaagcctgggaggagggagtgtgcggcatcaggtccgccacaaggctagagaatatcatgtggaagcagatcagcaacgagctgaatcacatcctgctcgagaacgacatgaagtttacggtggtcgtgggggacgccaacggcatcctggcgcaggggaagaagatgatccgcccccagcccatggagcacaagtactcctggaagtcctggggcaaggccaagattatcggtgccgacatacagaacaccaccttcatcatcgatgggcccgacaccccggagtgccccgacaaccaacgggcctggaatatctgggaggtggaggactacggcttcgggatcttcacgaccaacatctggttgaagctcagagactcgtacacccagatgtgtgaccaccggctgatgagcgcggccataaaggactccaaggccgtccacgccgatatgggctactggattgagagcgagaagaacgagacctggaagctggcccgcgcaagcttcattgaggtgaagacgtgcacctggcccaagagccacaccctttggtccaacggggtgctggagagcgagatgatcatccccaagatctacgggggcccgatctcccaacacaactaccggccgggatacttcacccagacggccggtccctggcacctggggaagctcgagctggacttcgacctgtgtgacggcaccaccgtcgtggtggacgagcactgcggcaacagagggccgagcctgcggaccacgaccgtcacgggcaagatcatccacgagtggtgctgccgctcctgtacgctgccgcccttacggttccgcggggaggatggctgctggtacgggatggagatccggcccgtgaaggaaaaggaggagaacctcgtgcgcagcatggtctccgccggcagcggcgaggtggacagcttctcgctcgggatcctgtgcgccagcatcatgatcgaggaggtgatgcggtcccgatggagccggaagatgctcatgacgggcaccttggccgtcttcctgctcctgatcatgggccagctgacctggaacgacctcatccgcctgtgcatcatggtgggcgcgaacgcctccgaccgcatggggatgggcaccacgtacctggcactcatggccacctttaaaatgcggccgatgttcgccgtggggctgctgttccgccggctcaccagccgcgaggtgctgctgctcaccatcggtctgtccctcgtggcgagcgtggaactccccaactccctggaagagttgggcgacgggctcgccatgggcatcatgatgctgaaactgctcacggagttccaaccccaccagctgtggaccaccctgctctccctgaccttcatcaagacgaccctgtccctcgattacgcttggaagaccaccgccatggcgctgagcatcgtctccctgttccccctctgcctgtcgacgacttcgcagaagaccacctggctgccggtgctcctgggcagcttcgggtgcaaaccccttaccatgttcctcatcacggagaacaagatctggggccggaagagctggccacttaacgaggggatcatggccatcggcatcgtcagtattctgttgtccagcctgctgaaaaacgacgttcccctcgccgggccgctgatcgctggtggcatgctgatcgcttgctacgtgatcagcgggtccagcgcggacctctcactcgagaaagccgccgaggtcagctgggagcaggaggccgagcactccggcacatcacacaacattttagtagaggtgcaggacgacggaactatgaagatcaaggacgaggagcgcgacgacaccctcaccatcctcctgaaggcgaccctcctggcggtctccggcgtttaccccatgagtatccccgccaccctgttcgtatggtacttctggcaaaagaagaagcagcggtccggggtcctctgggacacccccagccctcctgaggtggagcgcgccgtgctagacgatggtatataccggatcttacaacggggcctgctcgggcggagccaggtcggcgtgggggtgttccaagacggcgtcttccacacgatgtggcacgtgacccgcggggcagtgctgatgtaccagggcaagcggctggaaccctcttgggcctccgttaagaaggacctcatcagctacggcgggggctggcgcttccaggggtcctggaataccggcgaggaggtccaggtaattgcggtcgagcccgggaagaacccgaaaaacgttcagacaacgcccggcaccttcaagaccccggagggcgaagtgggggccatcgccctggacttcaagcccggcaccagcgggtccccgatcgtcaacagggagggcaagatcgttggcctgtacgggaacggcgtggtcacgaccagcggcacctacgtctccgccatcgcccaggcgaaggccagccaagagggcccactccccgagatcgaggacgaggtgttcaagaagcgcaacctaaccatcatggacctgcacccggggagcggcaagacgcggcgctatctgcccgccatcgtccgggaggccatcaagcgcaagctgcggaccctgatcctcgctcccacccgcgtggtggcctccgagatggccgaggcgctgaagggcatgcccatcaggtatcagacaacggccgtcaagtctgagcacaccgggcgggagatcgtggatctgatgtgccacgcgacttttaccatgcggctcctgtccccggtgcgggtcccaaactataacatgatcataatggacgaggcccacttcacagaccccgccagtatcgcggcccgcggctacatctccacccgggtagggatgggcgaggcagccgccatcttcatgacggccacgccccccggtagcgtggaggcgttcccccagtccaacgcggtaatccaggacgaagaacgcgacattcccgagcgaagctggaactccggctacgactggatcacggacttccccggcaagaccgtctggttcgtgcccagcattaaaagcgggaacgacatcgccaactgcctgcgcaaaaacggaaagcgggtcatccagctcagccgcaagaccttcgacacggagtaccagaagactaagaacaacgactgggactacgtggtgaccaccgacatttccgaaatgggcgccaacttccgggcagaccgcgtcatcgatccccggcgctgcctgaagcccgtgatcctgaaggacggccccgagcgggtgatcctcgcggggccgatgcccgtcaccgtagccagcgccgcccagcgcaggggccgcatcggtcggaaccagaacaaggagggggatcagtacgtctacatgggccagcccctgaacaacgacgaggaccacgcccattggactgaggccaagatgctcctcgacaacatcaatacccccgaggggattatcccggccctgttcgagcctgagcgcgagaagtctgccgccatcgacggcgagtaccgcctgcgcggggaggcccgcaagaccttcgtcgagctcatgcggcgcggggacttgcccgtgtggctgagctataaggtcgcgtccgaggggttccagtacagcgaccggcgctggtgtttcgatggggagcggaataaccaggtgctcgaggagaacatggatgtggaaatttggaccaaggagggcgagcgcaagaaactacggccccgctggctggacgcccggacctactccgacccgctcgccctgcgcgaattcaaggagttcgccgccgggcggcgcagcgtcagcggcgacctgatcctggagatcggcaagctgccgcagcatctgacgcttcgggcgcagaacgccctggacaacctagtgatgctccacaactcagagcagggcgggaaggcctaccgccacgccatggaggagctgcccgacaccatcgagaccctgatgctcctagcgctgatagccgtgctcaccgggggcgtgacgctgttcttcctgtcgggcaagggcctaggaaagacctcgatcgggctgctgtgcgtgaccgccagctccgcgctattgtggatggctagcgtggagccccactggatcgctgcctccatcatacttgagttcttcctcatggtactgctgatcccggagcccgaccggcagcgcacgccacaggacaaccagctcgcctacgtggtaatcggcctgctgtttatgattctcactgtcgcggcgaacgagatggggctgctggagaccactaagaaagacctcggcatcgggcacgtcgctgccgagaaccaccagcacgccaccatgcttgacgttgacttacggccggccagcgcctggactctctacgcggtcgccaccaccgtgataacccccatgatgcgccatacgatcgagaacaccaccgcgaacatctcactgactgccatcgccaaccaagcggccatcctgatgggactcgacaaaggctggcccatcagcaaaatggatatcggggtgcccctgttggctttaggctgctactctcaggttaacccgctgacgctgaccgccgcggtgcttatgctggtggcccactatgccatcatagggcccggcctgcaggccaaggccacccgggaggcgcaaaaacgcaccgccgccggtatcatgaagaaccccacggttgacgggatcgtggccatcgacctcgaccccgtggtatacgacgccaagttcgagaaacagctgggccagatcatgctgctaatcctgtgcacctctcagatcctgctcatgcgcaccacctgggccctgtgcgagtccatcacgctggccaccgggccgctcaccactctgtgggagggcagcccggggaaattctggaacacgaccatcgccgtgtccatggccaatatcttccggggcagctacctggccggcgcggggctcgccttctcactgatgaagtccttgggcggtggcaggagagggaccggggctcagggcgagacactaggggagaaatggaagcgccagctgaaccagctgtccaagagcgaattcaacacgtataagcggagcggcataatggaggtcgaccgcagtgaggccaaggagggcctcaaacggggagagaccaccaagcacgcggtcagccgcgggaccgccaagctgcggtggtttgtagagcgcaacctggtgaagcccgagggcaaggtcatcgacctgggctgcggacggggcgggtggtcctactattgcgccggcctcaagaaggtgaccgaggtgaaggggtataccaagggaggccccgggcacgaggagccgatccccatggccacctacggctggaacctcgtcaaactgcacagcgggaaggacgtgttcttcatgccgccagagaagtgcgacaccctcctgtgcgacatcggtgagtcctcaccgaaccccaccatcgaggaagggcgcacgctgcgggttctcaagatggtcgagccctggctacgcggaaaccagttctgcatcaagatcctgaacccctacatgccgtccgttgtggaaactttagagcagatgcagcggaagcacggagggatgctggtcagaaacccgctatcacggaactccacccacgagatgtactgggtaagctgtggcaccgggaacatcgtttccgccgtcaatatgacgagccgcatgctccttaaccgcttcaccatggcgcaccgcaaacccacgttcgagcgggacgtagatctgggcgccggaacccgtcacgtggccgtcgagcccgaggtggccaacctcgacatcatcgggcagcgcatcgagaacataaaaaacgagcacaagtcgacgtggcactacgacgaggacaacccgtacaagacctgggcgtatcacggctcctacgaagtgaagccttccgggagcgcttccagcatggtcaacggtgtggtgcggctgctgacgaagccctgggacgtcatccccatggtgactcagatcgccatgacggacaccactccgttcggtcagcaacgcgtattcaaggagaaggtggatacccgtacaccccgcgcaaagcggggcaccacccagatcatggaagtgaccgccaaatggctttggggattcctgtcacgcaacaaaaagccccgtatctgcacgcgcgaggagttcacccggaaggtacggagcaacgccgccatcggtgccgtgttcgtggacgagaaccagtggaacagcgccaaggaggccgtcgaggatgagcgtttctgggaccttgtgcaccgcgagcgggagctccacaagcagggcaagtgcgcgacctgcgtgtacaacatgatggggaagcgcgagaagaagctgggggagttcggcaaggccaagggcagtcgggccatctggtacatgtggctgggcgcccgctttctggaattcgaagcgctgggttttatgaacgaggaccactggtttagccgggaaaactccctgagcggtgtcgagggggagggcctccacaagctggggtacattctgcgcgacatttccaagattccgggcggcaacatgtacgcggacgacaccgccgggtgggatacgcggatcactgaggacgacctccagaacgaggccaagatcaccgacatcatggagcccgaacacgcgctgctggccaccagcatcttcaagttaacgtaccagaacaaggtggtgcgcgtccagcgccccgcgaagaacggcaccgtcatggacgtaatctcccggagggaccaacgtgggagcggccaggtcggcacctacgggctgaacacctttacgaacatggaggtacagctgatccgccaaatggagtccgagggcattttcctgcccagcgagctcgagaccccgaacctggccgagcgcgtgctcgactggttggagaagcacggtgcagagcggttgaagcggatggccatctccggcgacgactgcgtcgtgaagcccatcgacgaccgtttcgctaccgcgctaacagccctgaatgatatggggaaggtgcggaaggacataccccagtgggagcccagcaagggctggaacgactggcaacaggtcccgttttgctcccaccacttccaccagcttatcatgaaggacggccgcgagatcgtcgtgccctgccggaaccaggacgagctcgtggggcgcgcaagagttagccagggcgcagggtggtccctacgcgagaccgcctgtctgggcaagagctacgcgcagatgtggcagttaatgtacttccaccgccgcgacctgcggctggccgccaacgccatctgctccgcagtgccggtcgactgggtgccaacgagccgcaccacctggagcatccacgcccaccaccagtggatgaccacagaggacatgctctccgtgtggaaccgggtctggatcgaagagaacccgtggatggaagacaagacacacgtgagcagttgggaggaggtgccgtacctggggaagcgcgaggaccagtggtgcggcagcttaatcgggctcacggcccgggccacctgggcgacgaacatccaagtcgccatcaaccaagtgcggcgcctgatcgggaacgagaactacctggactacatgacctccatgaagcggttcaagaacgaaagcgaccccgagggcgcactctggtga

SEQ ID NO: 23867 - RNA, 9879 nt, synthetic construct
  misc_feature 1..9879: note = derived and/or modified CDS sequence (opt11) from DENV-1__GU131965__SS-prME
  source 1..9879: mol_type = other RNA
agcgtaaccatgcttctaatgcttctgccaaccgcactagcctttcacctgaccacccggggcggggagccccacatgattgtgagtaagcaggaacggggcaagagcctcctgttcaagacctcggcgggggtcaacatgtgcaccttaattgccatggatctgggcgagctttgcgaggacaccatgacctacaaatgcccccagattaccgaggccgagcccgatgacgtggattgctggtgtaacgccaccgacacctgggtcacctatggcacctgcagccagaccggcgaacaccggcgcgacaaacgctccgtggccctggcgccacacgtgggcctgggactcgaaacgcggaccgaaacttggatgagctccgagggcgcatggaaacagattcagcgggttgagacctgggttctccggcaccccgggttcacagtgatcgccctgttcctcgcccacgcaatcggaacgagcatcacccaaaaggggattatcttcatcctgctgatgctcgtcaccccctccatggcgatgcgctgcgtgggtatcggcaaccgggatttcgtggaggggttaagcggagctacgtgggtcgacgtcgtgctggagcatggaagctgcgtcaccaccatggcaaagaacaagccaaccctcgatatcgagctgctgaagacggaggtgaccaatcccgcgatcctccggaaactgtgtattgaggcgaagatctctaacaccaccacggattcccggtgtccgacccagggcgaggccaccctggtggaggagcaggacgctaactttgtgtgtaggcgaacctttgtggacagaggctgggggaacggctgcgggctcttcgggaagggatccttactgacgtgcgccaagttcaaatgtgtgaccaagctcgagggaaagatcgtccagtacgagaacctgaagtactccgtcatcgtgacagtccacaccggcgatcagcaccaggtggggaatgagacgaccgaacatggcactatcgccaccattacgccccaggcgcctacgtcggaaatccaactgaccgactacggggcgctcacccttgactgctcaccccggaccggcctggacttcaacgagatggtactcctgacgatgaaggagaagtcttggctggtacacaaacaatggttcctcgatctgccgctgccctggacctccggcgccagcaccagccaggagacctggaaccgccaggacctcctggttacgttcaagaccgcacacgctaagaagcaggaggttgttgtattagggtcccaggagggcgctatgcacactgccctcaccggggccacggagatccagacgagcggaaccacaacgatttttgcagggcacctcaagtgcaggcttaagatggacaagctgaccctgaagggcacttcctatgtcatgtgcacggggagcttcaagctcgaaaaagaggtggccgagacgcagcacggcaccgtacttgttcaggtgaagtacgagggcacggacgcgccctgcaagatccctttctccacccaggatgagaagggggtcacacagaacggtcgtctcatcaccgccaacccgatagtaaccgacaaggagaagcctgtgaacatcgagaccgagccgcccttcggggagagctacatcgtggtcggcgccggcgagaaggcgctgaagctttcctggttcaagaaggggagtagtataggcaagatgttcgaagcgacggctcgcggagcccgccggatggccatcctcggagacaccgcctgggacttcgggagcatcgggggcgtattcacttccgtggggaagctggtccaccaggtgttcggcacggcgtacggggtattattcagcggcgtctcctggactatgaagatagggatcggcatcctcctgacctggctgggccttaatagtcgcaacacctccctgagcatgacttgcatcgccgtggggatggtcacgctgtacttaggcgtcatggtacaggccgatagtggttgcgtgatcaactggaagggccgcgagctgaagtgcgggagcggcatcttcgtcaccaacgaggtacatacctggaccgagcagtacaagttccaggcagatagtcctaagcggctgtcagccgcgatcggcaaggcgtgggaggagggtgtatgtggaatccgcagcgccacccggctcgagaacattatgtggaagcagatctctaacgagctgaaccacattctgcttgagaacgacatgaagttcacggtcgtggtaggggacgccaacggcatcctagcacaggggaagaagatgatccgcccgcagcccatggagcacaagtacagctggaagagctggggaaaggcaaagatcatcggcgccgatatccagaacacgaccttcatcatcgacgggcccgacaccccggagtgccctgacaaccagcgggcctggaacatttgggaggtagaggactacggctttggcatattcacgactaacatctggctgaagctccgcgacagctacactcagatgtgtgaccaccggctgatgtccgcggcgatcaaggactcgaaggccgtgcacgctgatatgggctactggatcgagtccgagaagaacgagacctggaagctggcccgcgccagcttcatcgaggtgaagacgtgcacctggcccaagtcacacaccctctggagcaacggcgtcctagagtctgagatgattatccccaagatctacgggggtccgatctcccagcacaactaccggcccgggtatttcacccagaccgcgggcccatggcacctcgggaagctcgagctggacttcgacctgtgtgaagggaccaccgtggtggtcgacgagcactgcggcaaccgcggtccgtcgctgcggaccacgaccgccaccggcaagatcatccacgaatggtgctgcagatcctgcaccctgccgcccctgcggtttagaggagaagacgggtgctggtacgggatggagatccggccggtcaaggagaaggaggagaacctcgtgcggtccatggtcagcgcgggatccggcgaggttgacagcttctcactggggatactgtgcgcgagtataatgatagaggaggtgatgcggagccggtggtcccggaaaatgcttatgacgggcaccctggccgtcttcctcctcctggtgatggggcaactgacctggaacgacctcattcgcctgtgcatcatggtgggcgccaacgccagcgacagaatggggatgggcacaacgtacttagccctgatggccaccttcaagatgcgcccgatgttcgccgtcgggcttctgttccgcagattgacttctcgcgaggtactgctgctcacaatcggactcagcctcgtggcgagtgtcgagctcccgaactcactggaagagctgggcgatggactcgcgatgggcatcatgatgctgaagctgctcacagagttccagccccaccagctgtggaccacgctgttgtccctgaccttcatcaagacgacgctgtcgctcgactacgcctggaagaccactgccatggctctgtccatcgtctcgctgttccctctctgtctgtcaacgacatcgcagaagaccacttggctccccgtcctcctgggttcgttcgggtgcaagcccctcactatgttcctcatcacggaaaacaaaatatggggccgcaagtcatggcccctgaatgaggggatcatggcaatcggcatcgtgtccatccttttaagctctttgctgaaaaacgacgtgccactcgccggtccgctgatcgccggcggcatgttaatcgcttgttatgtcatcagtgggtcgtccgctgacctctccctggagaaggccgccgaggtctcctgggagcaggaagccgagcatagcggcacttctcataacatcctggtggaggtccaggacgacgggaccatgaagatcaaggacgaggaacgcgacgacaccctcacaattctgttaaaggccacgctactagcggtgtcaggcgtgtaccctatgtccatccccgccacgctatttgtatggtacttctggcagaagaagaagcaacggagcggggtactatgggatacccccagtccgccggaggtggagagggccgtccttgacgacggcatataccggatactgcagcgtggcctgctcggacggagccaggttggcgtcggggtcttccaagacggcgtgttccacacgatgtggcatgttacccgcggggccgtccttatgtaccagggcaagcggctggagccctcatgggcctccgtgaaaaaggacctcatatcctacggcggggggtggcgcttccaggggagctggaacaccggcgaggaggtgcaagtgatcgcggtagaacccggcaagaacccaaagaatgtccagaccacgcccggcaccttcaagactcccgaaggcgaggtcggtgccatcgccctggatttcaaacccggtacctcaggctctcccatagtcaaccgtgaaggcaagatcgtgggcctgtatggaaatggcgtcgtgacgacatccgggacctacgtgagcgccatcgcccaggcaaaggcctcccaggagggccccctgcccgaaatcgaagacgaggtcttcaagaaacgcaacctaaccataatggacttacacccggggtcaggcaaaacgcggcgctatctacccgccatagtgcgggaggccatcaaacgcaagctgcgtaccctaatactcgcgcctacccgagtggtcgccagcgagatggccgaggctctgaagggcatgcccatccgctaccagacgacggccgtgaagtccgagcacaccgggagggaaattgttgacctgatgtgccacgcgactttcacaatgcgcctgctgagcccagtccgtgtgcccaactataacatgatcataatggacgaggcccacttcacggacccagcctccatagcagcccgcggctatattagcacccgggtggggatgggcgaggcggccgccatctttatgacagctacgccgccggggtccgtcgaggcctttccccaaagcaacgcggtgatccaggacgaggagcgcgatatcccagagcggtcctggaacagcgggtatgactggatcacggacttcccaggcaagaccgtgtggttcgtcccctcgatcaagtccgggaacgacatcgccaactgcctgcgaaagaacggtaagcgggtgattcagctatcacggaagacgttcgacaccgagtatcagaagacaaagaacaacgactgggactacgtggtcaccacagacatcagcgagatgggggccaactttcgggccgaccgcgtaattgacccccggcgctgcctgaagcccgtcatcctgaaggacggccccgagcgggtcatcttggccggccctatgccagtgaccgtggccagcgcggcgcagcgacggggccgcatcggccggaatcagaacaaggagggggaccagtacgtgtacatgggccagcccctgaacaacgacgaggaccacgcccactggacggaggcgaagatgctgctagacaatatcaacacaccggagggaatcatcccggccctttttgaacccgaacgcgaaaagagcgcagccatcgacggcgagtaccgcctacgcggggaggccaggaagaccttcgtcgagctaatgcggcgcggtgaccttccagtatggctgtcatacaaggtggcgagcgagggcttccaatactccgaccggcgctggtgtttcgacggagagcggaacaaccaagtgctagaggagaacatggacgttgagatctggaccaaggaaggcgagcgtaagaagctacgacctagatggctcgatgcccggacttacagcgacccgctcgccctgcgcgaattcaaggagttcgccgcggggcgccgcagtgtgagcggcgacctgatccttgagatcggtaagctgccgcagcacctaacgctaagagcgcaaaacgccctggacaatctggtgatgctccacaacagcgagcagggcgggaaggcctaccgacatgcgatggaagaattgcccgatacaattgagaccctgatgctactggcgctgattgccgtcttaaccgggggggtaactctattcttcctgtccgggaagggcttaggcaagactagtatcggcctgctctgcgtgaccgcctccagcgccctcctgtggatggcctcagtcgagccccactggatcgcggccagcatcatcttagaattcttcctcatggtgctgttgatccccgagcccgatcggcagcgcacgccgcaagacaaccaactcgcctatgtggtcatcggcctgctgttcatgatcttgactgtagccgccaacgagatggggctgctggaaacaaccaaaaaggacctcgggatcgggcatgtggcagccgagaaccaccagcacgcgacgatgctggacgtcgaccttaggccggcctccgcttggacattgtacgcggtcgccaccaccgtcatcactcccatgatgcgacacacgatagagaacaccaccgccaatatcagcctgaccgccatcgcgaaccaggcggcgatcctgatgggcctcgacaagggctggcctatctccaagatggacatcggggtgccactgctggcgctcggctgctacagccaggtgaatccgctgacgctaacggccgcggtactcatgcttgtcgcgcactacgccatcatcgggcccggcctgcaggccaaggccacccgggaagcgcagaagaggaccgccgccgggatcatgaagaaccccacggtggacggcatagtagcaatcgaccttgaccccgtggtgtacgacgctaaattcgagaaacagctaggccagatcatgctgctgatcctatgcacgtcccagatactgctcatgcgcactacctgggccctgtgcgaaagtattacgctggctaccgggccgctcaccaccctgtgggaggggtccccaggaaagttctggaacacgacgatagccgtgagcatggcgaacatattccgaggatcctacctggccggcgccgggctcgcttttagcctgatgaagtctctgggcgggggccgccgggggaccggcgctcagggcgaaacgctcggggagaagtggaagcgccagctaaaccagttaagcaagtccgaattcaacacatataagcggtccgggatcatggaagtcgaccgcagcgaggcaaaggagggcctcaaacgaggagaaacaaccaagcacgctgtgtcacgcgggaccgccaagctgcggtggttcgtggagaggaacctagtcaagcccgagggcaaggtgattgacctgggctgcgggaggggcgggtggagttactactgcgccggcttaaagaaggtgaccgaggtcaaggggtacaccaaaggcggcccgggacacgaggaaccgattccgatggcgacatatggctggaacctggtgaagctgcactccgggaaagacgtgttcttcatgccgcccgagaaatgcgatacccttctgtgcgatatcggcgagagctccccgaaccccaccatagaagaggggcgcacgctgcgcgtcctcaagatggtagagccctggctgcgcggcaaccagttctgcatcaagatcttgaacccctacatgccgagcgtggtcgagacgttggagcagatgcaacggaagcacggcgggatgttggtgcgtaaccccctgtcgcggaacagcacccacgagatgtactgggtaagctgtggcaccgggaacatcgtgtcggctgtgaacatgacctcgcgcatgctcctaaaccggtttaccatggcccaccgcaagcccacttacgagcgagacgtggatctgggcgccggcacccggcacgtcgccgtagagcccgaggtggccaacctcgacattatcgggcagcgcattgagaatattaagaacgaacataagagtacttggcactacgatgaagacaacccgtacaagacctgggcctaccacggctcctacgaggtcaagccgagcgggtccgcgtcttcgatggtgaacggcgtggtccggctactgaccaagccctgggacgtgatccccatggtcacccagatagctatgacggacaccacccccttcggccagcagcgcgtgttcaaggagaaggtggacaccagaacgcctcgcgccaagcggggtaccacccagatcatggaggtcaccgcgaagtggctatggggtttcctcagccggaacaagaaacctcggatctgcacgcgtgaggagttcacccggaaagtacgatctaacgccgcgattggtgccgtattcgtggacgagaatcagtggaacagcgccaaggaggccgtggaggatgaacgattctgggacttagtgcaccgcgaacgggagctccataagcagggtaagtgtgcgacctgcgtctataacatgatgggaaagcgcgaaaagaagctaggagagttcgggaaggcgaaaggcagccgggccatctggtatatgtggctgggagcccgcttcctcgaattcgaggccctggggtttatgaacgaggaccattggttctcccgtgagaactcgctgtccggcgtggagggggagggcctccacaagttggggtacatcctgcgcgacatctccaagatccccggcggcaacatgtacgcggacgacacagcggggtgggacacgcggatcaccgaggacgacctccagaacgaggcaaaaatcaccgaaataatggagcccgagcacgccctgctagccacctccatatttaaactcacgtatcagaacaaggtcgtccgggtgcaacggcccgctaagaacggcaccgtcatggacgtaataagccggcgcgatcaaagaggatctggtcaagtgggcacctacgggctgaacacctttacgaacatggaggtccagctgatccgccagatggagtcggagggcatcttcctccccagtgagctggaaactccgaacctggccgagcgggtactcgactggctggagaagcacggggccgagcgccttaagcggatggccatcagcggcgacgactgtgttgtgaagcccatcgatgatcgattcgccaccgcgcttaccgccctgaacgacatggggaaagtccggaaggacatcccccagtgggaaccctctaagggctggaacgactggcagcaggtaccgttctgctcgcaccattttcaccagctgatcatgaaagacggccgcgagatcgtggtcccctgccggaaccaagacgagctcgtagggcgcgcccgggtgtcgcaaggagccggttggagccttcgcgagactgcctgcctgggcaaatcctacgcacagatgtggcagctcatgtacttccaccggcgcgacctgaggctggccgccaacgccatttgctctgccgtcccggtcgactgggtgcctacgagccgcaccacatggagcatccacgctcaccaccagtggatgaccacagaggatatgctctctgtctggaaccgagtatggatcgaggagaacccgtggatggaggacaagacccacgtgtccagctgggaggaggtcccctacctgggaaagcgcgaggaccagtggtgcggctccctcataggactcaccgcccgcgccacctgggccacgaacatccaggtcgcgatcaatcaggtgcggcgcctgatcgggaacgaaaactacttggattacatgacgagcatgaagcggtttaagaacgagtccgaccccgagggcgccctctggtga

SEQ ID NO: 23868 - RNA, 9879 nt, synthetic construct
  misc_feature 1..9879: note = derived and/or modified CDS sequence (opt11) from DENV-1__GU131966__SS-prME
  source 1..9879: mol_type = other RNA
agcgtgacgatgctcctcatgttacttcctaccgcactcgccttccacctgactacgcgaggaggggaaccccacatgatcgtaagcaagcaagagaggggcaaaagcctcctgtttaagaccagcgcaggagtgaacatgtgcaccctcatcgccatggatctgggcgaattgtgcgaggacaccatgacctataagtgcccccagatcaccgaagcggagcccgacgacgtggactgctggtgtaacgccaccgacacctgggtcacctacgggacgtgctcacagaccggcgagcaccggcgggacaaacggtccgtggcccttgcaccccacgtcggcctggggctcgagacgcggaccgagacttggatgtcatccgagggcgcgtggaaacagattcagcgggtcgagacctgggccctgaggcaccccggattcacggttatcgccttgttcctcgcgcatgccatcggcaccagcataacccagaagggaatcattttcatcctactgatgctcgtgaccccctccatggccatgcgctgcgtcggaatcggcaacagggatttcgtagaggggcttagcggtgcaacgtgggtagacgtcgtgctggagcacgggtcctgcgtcaccacgatggccaagaacaagcccacactggacatcgaactgctgaagacggaggtgaccaaccccgcgatcttgcgcaagctgtgcatcgaggccaagattagtaacaccactacggactcccggtgcccgacgcagggcgaagccaccctagtcgaggagcaggacgccaacttcgtgtgtcgccggacgttcgtcgaccgcggctggggtaatggctgcggccttttcggcaaaggcagcttattaacgtgcgctaagtttaaatgcgtaaccaagctcgaaggcaagatagtgcagtatgagaacctgaaatacagtgtcatcgttacagtacacaccggggaccagcaccaggtcggtaacgagacgaccgagcatggcaccatcgcgaccatcacaccccaggcccccacgtccgagattcagctgaccgactacggcgccctcaccctggactgtagccctcggaccggcttggacttcaacgagatggtgctactgacgatgaaggagaagagttggctggtccataagcagtggttcttggacctgcctctgccctggacctccggagcaagcaccagccaggagacctggaaccgccaggacctcctggtgacgtttaagaccgcacacgcgaagaagcaggaggtggtcgtgctggggtcccaagagggcgccatgcacaccgccctcaccggggcgacggagatccaaaccagcggcaccaccacgatcttcgccgggcacctgaaatgccggctgaagatggataagctcaccctcaaaggtacgagttacgtgatgtgcaccggtagcttcaagctggagaaggaggtggcggagactcagcacggcaccgtcctggtgcaagttaagtacgagggcaccgacgccccctgtaagatacccttctccacccaggacgagaaaggggttacgcagaacggacgcctcattaccgccaaccctatcgttaccgacaaggagaagcccgtcaacatcgagaccgagccacccttcggggaatcttatatcgtggtaggcgccggcgaaaaagcactgaagttgagttggttcaaaaaggggtcttccataggcaagatgttcgaagcaacagcccgcggcgctcgccggatggccatcctcggcgacaccgcgtgggactttggctcaatcgggggcgtctttacctccgtcgggaaactggtacaccaggtcttcggcacggcctacggggtgctgttcagcggcgtatcatggacaatgaagatcgggatcggcatcttgctgacctggctgggactcaacagccgctccacgagtctgtccatgacctgtattgcggtagggatggtgaccctgtacctcggcgtgatggtccaggccgacagcggatgcgtaatcaactggaagggcagagagctgaagtgcgggtctgggatcttcgtgaccaacgaggtccacacgtggaccgaacagtataagtttcaggcggacagcccgaagagactgtcagcggccatcggcaaagcatgggaggaaggtgtgtgcgggatccgctccgccactcggctcgagaacatcatgtggaagcaaatcagcaatgagctgaatcacattctgctggagaacgatatgaagttcacggtggtagtcggggacgcaaatggcatactggcgcaagggaagaagatgatccgcccccagcccatggagcacaaatactcctggaagtcctggggcaaggctaagatcattggcgccgacatccagaacaccaccttcatcatcgacgggcccgatacccccgagtgtcccgacaaccaacgggcctggaacatttgggaggtggaggactatggcttcgggatttttacgaccaacatctggctgaagctccgcgactcctatacccagatgtgcgaccataggctgatgagcgcggcgattaaggacagtaaggctgtccatgctgatatgggctattggatcgagtctgaaaagaatgaaacctggaagctcgcccgggcgtccttcatagaggtgaagacgtgcacgtggccgaaaagccatactttatggtccaatggagttctggaaagcgagatgatcatccctaagatctacggaggccccatttcccagcataattatcggcccggctacttcacacaaacggccgggccctggcatctggggaagttagagcttgactttgatctgtgcgaaggcaccaccgtggtggttgacgagcactgcggtaaccgcgggccaagcctccggaccacgaccgttactggaaagataatccacgagtggtgctgtcgctcctgcaccttaccgcccctacggttccgcggggaggacggctgctggtacgggatggagattcggccggtgaaggagaaggaggagaacttagtgcgcagcatggtcagcgctggaagtggtgaagtcgactcgttcagtctcgggatcctgtgcgcgagcatcatgattgaggaagtcatgaggtcccgctggagccggaaaatgctcatgacgggcacactggccgtatttttactgttgatcatggggcagctgacctggaacgatctcatccgcctttgcatcatggtgggcgctaatgcctccgatcgcatggggatgggaaccacctacctggcccttatggcaacgttcaagatgcggccgatgttcgccgttgggctgctgttcagaagactgaccagccgcgaggtgctgctgctcaccatcggtctgtccctggtggcgtctgtggagttacccaactccctcgaggagctgggcgacgggctcgccatgggaatcatgatgctgaagctgttaactgagttccaaccacaccaactgtggaccaccctgctcagcttaaccttcattaaaacgaccctgtcactcgattacgcctggaagaccaccgccatggcgctgagcatcgtctccctcttccccctatgcctgtccacgaccagccagaagaccacctggcttccggtgctcctgggctcattcggttgtaagcccctgaccatgttcctcatcacggagaacaaaatctggggtaggaagtcttggcctctaaacgagggcatcatggccataggcattgtctccatacttctcagcagccttctgaagaacgacgtgccacttgccgggccgttgattgcgggtggaatgctcatcgcatgctacgtcattagcgggtcctcggcggatctgtccctggagaaagccgcggaggtcagctgggagcaggaggccgaacacagtggaaccagccacaacatcctggtggaagtgcaggacgatggtaccatgaaaatcaaagacgaggaacgcgatgacacgctcacgatcctgctgaaggccaccctcctggcggtgtccggcgtgtaccctatgtcgattcctgccaccctgttcgtgtggtacttctggcagaagaagaagcaacgatccggggtcctctgggacacccccagcccgccagaagttgagcgcgccgtgctggatgacggaatctaccggatcctccagcgcggcttactggggcggtcccaggtaggcgtgggggtgtttcaggacggggtattccacacgatgtggcacgtgactcgaggcgccgttctgatgtatcagggcaagcggctggaacccagctgggcctccgtcaagaaggatctcatcagttatggcgggggctggcgcttccaggggtcctggaataccggcgaggaggtccaggtgatcgcggtcgagcccgggaaaaacccgaagaacgtacagacgacgcccggcaccttcaagaccccggaaggggaggtgggggccatcgccctggatttcaaacccggcaccagcgggtccccgatcgtaaaccgggagggcaagatcgtggggctgtacgggaacggtgtggtgacgactagcgggacctacgtgagcgccatagcccaggcaaaggccagccaggagggcccactacccgaaatcgaggacgaggtcttcaagaagagaaacctgaccatcatggacctgcacccggggtcgggcaagacgaggagatacctccccgccatcgtgcgggaggcaatcaaacgaaagctgcggacgctgattctcgcgcccacccgtgtcgtggcctccgagatggccgaggcgttaaagggcatgcccatcaggtatcagaccacggcggtcaaaagcgagcacaccggccgtgagatcgtggatcttatgtgccacgcgaccttcacgatgagactcctgtccccagtgcgggtccccaactacaacatgatcatcatggacgaggcccactttacggatcccgccagcatcgccgctcggggctacatctccacccgggtggggatgggtgaggcggccgccatattcatgaccgccacgccgccaggtagcgttgaggcattcccccaaagcaacgcggtcatccaagacgaagaaagggacatcccggagcggagttggaactccggctacgactggattacggacttcccagggaagactgtgtggttcgtgcccagcataaagtccggcaacgacatcgccaactgcctgaggaagaatggcaaacgggtcatccagcttagtcgcaagactttcgacaccgagtaccagaagacgaaaaacaatgattgggactatgtcgtgaccaccgacatctccgagatgggggccaacttccgagcggacagggtcatcgacccccggaggtgcctgaagcccgtaatcctgaaggacggccccgagagagtaatactcgcggggccgatgcccgtcaccgtggccagcgccgcccagcggcggggccgcatcggccggaaccagaacaaggagggggaccagtacgtgtacatgggccagcccttaaacaatgacgaggaccatgcccattggactgaggcgaaaatgctgctcgacaacataaataccccagaagggataatccctgccttgttcgaacctgagcgcgagaagtccgccgccatcgatggcgaataccgacttcgtggggaggcccgcaagaccttcgtggagctcatgcggcgcggcgacctgcctgtgtggctgtcttacaaggtcgcctccgagggcttccagtacagcgatcggcgctggtgctttgacggggagaggaacaatcaagtgctcgaggagaacatggacgtggagatctggaccaaagagggcgagcgaaagaagctacgccctcgatggctggacgcccggacctactccgatccgctcgccttaagagaatttaaagagttcgccgccgggcggcgtagcgtcagcggcgacctaatcctcgagatcggcaagctgccccaacacttgacgcttcgggcgcaaaacgccctggacaacctggtgatgctccacaactctgaacagggtggcaaggcctacagacatgccatggaagaactccccgacaccatcgagaccctcatgctcctggcgctgattgccgtgctaaccgggggagtaacactgttcttcctcagcgggaaaggcctcggtaagacctccatcgggctgctgtgcgtgacggccagttccgccctcctgtggatggcgagcgtggagccccactggattgcggcatccatcatcctggagttctttttaatggtcttattaattccggagcccgaccggcaacgcacaccccaggacaaccagttagcctacgtggtaataggcctgttatttatgatcctcacggtcgccgcaaacgagatggggctgctcgagaccaccaagaaggacctagggatcgggcacgtggcggccgagaaccatcagcacgcaacaatgctagacgtggacctgcggccggccagcgcctggacactatacgcggtcgccactaccgtgatcaccccgatgatgcgccacacgatcgagaacaccaccgccaacatttccctgactgccatcgccaatcaggcagccatcttgatgggactggacaagggctggcctatttcgaagatggacatcggggtgcccttactagccctcggctgctactcccaggtgaacccgctgactctgaccgccgccgtgctcatgctggtcgcccattacgcgataatcgggcctggcctgcaggccaaggccacccgcgaggcgcagaaacggaccgccgccgggatcatgaaaaatcctactgtcgatggcatcgtggcgatcgacctcgaccccgtggtctacgacgccaagttcgagaagcaattgggccagatcatgctcctcatcctgtgcaccagccagatacttctcatgcgtacaacttgggcgctgtgcgaatccatcacactggcgaccggaccgctcacaaccctgtgggagggcagccccggaaaattttggaacactactatcgccgtgtcgatggccaatatctttcggggttcctatctggccggcgcggggctcgctttctccttgatgaagtccctgggcgggggccgccggggaactggcgcccagggcgagacactgggcgagaagtggaagcggcaactgaaccagctgtccaaaagcgagttcaacacgtatcggcgttcaggcatcatggaggtagaccggtccgaggccaaggaggggctcaagagaggggaaacaaccaagcacgcggtgtcacgagggaccgccaagctgcggtggttcgtggagagaaacctggtgaagcccgagggaaaggtcatcgatcttggctgcggacgcgggggttggtcctattactgcgccggcctcaagaaggttaccgaagtgaaggggtacacgaagggcggacctgggcatgaagaaccgatccctatggccacctacggctggaacctggtcaagctgcatagcgggaaggacgtgttcttcatgccgcctgagaagtgcgacacgctcctgtgcgacatcggagagtccagtccaaacccaacaatcgaagagggtcggacgctgcgcgtactcaagatggtcgagccttggttgcgggggaaccagttctgcatcaagatcctgaacccatacatgccgtccgtggtggagaccctcgagcagatgcaacgcaagcacggcggcatgctggttcggaaccccctgagccgaaactccacccatgagatgtattgggtgagctgcggcaccgggaacatagttagcgccgtcaacatgacgagcagaatgctcttaaaccgctttaccatggctcacaggaagcccaccttcgaacgggacgtggacctgggcgccggtacgcgccacgtggccgtcgagcccgaagtggccaacctcgacatcatcgggcagcggatcgaaaacatcaagaatgagcacaagtccacgtggcactatgacgaggacaacccgtacaagacctgggcctatcacggcagctacgaggtgaagcccagtgggagcgcctcctctatggtcaacggcgtggttagattactgaccaagccatgggacgtcatccccatggtgacccagatagccatgacggacactaccccgttcgggcagcagcgggtcttcaaagagaaggttgacacccgcacgccacgggccaagcgcggtaccacccagatcatggaagttaccgccaagtggctctggggtttcctgtcccggaacaagaagccccgcatctgtacgcgggaggagttcacgcgaaaggtccggtcaaatgccgcgatcggcgccgtgttcgtcgacgagaaccagtggaacagcgccaaagaggccgtcgaggatgagaggttctgggacctggtgcaccgggagcgcgagctccacaaacagggcaagtgtgcgacgtgtgtgtacaatatgatggggaagagggagaaaaagctcggcgagttcggcaaggctaagggcagccgcgccatctggtacatgtggctgggcgcccggttccttgagtttgaggcgctggggtttatgaacgaggaccactggttctcacgggagaactccttgagcggagtcgagggggagggcttacacaaacttgggtacatcctgcgggatatatccaagatcccgggcggtaatatgtacgcagacgacaccgccgggtgggacacgcgaatcaccgaggacgatctccagaacgaggccaagataaccgacatcatggagcccgagcatgccctgctggccacgtccattttcaagctgacataccagaacaaggtggtgcgcgtccagcggcccgcgaagaacggcaccgtgatggacgtgatctcccgccgggaccagcgcgggagcggccaagtgggcacctacggcctaaacacatttaccaacatggaggtgcagctgatccggcagatggagagcgagggcatcttcctccccagcgagctggagacccccaacctggccgagcgtgtgctcgactggctggagaaacatggtgccgagcggctgaagcgcatggccatctccggcgatgattgcgtcgtgaagcccatagatgaccggttcgccaccgcgttaaccgccctgaacgacatggggaaggtgcgcaaggacataccccagtgggagccgagcaagggctggaacgattggcagcaggtaccgttctgcagccaccatttccaccagctgatcatgaaggacggccgggagatcgtggtgccctgccgcaaccaggatgagctcgttggtagggcacgcgtgagccagggcgccgggtggtccctgcgtgagaccgcctgcctcggcaaatcctacgctcagatgtggcagctcatgtatttccacagacgggaccttcgcctagccgccaacgctatctgctctgcggtacccgtcgattgggtacccaccagccggactacctggagcatccatgcacaccaccagtggatgaccactgaggatatgctcagtgtgtggaaccgcgtctggatcgaggagaacccgtggatggaggacaagacccacgtgagctcctgggaggaagtgccctacctggggaaacgcgaggatcagtggtgcggttcgctgatcggcttgaccgcgcgggccacctgggcgacgaatatacaggtcgcgatcaaccaggtccgcagattaatcgggaacgagaactacttagactacatgacctcgatgaaacgcttcaagaacgaaagcgaccccgagggcgccctctggtga

SEQ ID NO: 23869 - RNA, 9879 nt, synthetic construct
  misc_feature 1..9879: note = derived and/or modified CDS sequence (opt11) from DENV-1__GQ868501__SS-prME
  source 1..9879: mol_type = other RNA
tcggttacaatgctattgatgctgctcccgaccgcacttgcatttcatcttacaacccgaggcggggaaccccacatgatagtatcaaaacaggaacgcgggaaaagcctacttttcaaaaccagcgcaggagttaatatgtgcacccttatagcaatggacctgggtgaactatgtgaagacacaatgacctataaatgcccacagatcacagaagcagaaccagacgatgtcgattgttggtgtaatgctactgatacctgggtcacctacgggacctgctcacagacgggagagcacagacgggacaaacgatctgtcgcccttgcgccgcacgtggggttaggactcgagactcgaaccgaaacttggatgagctcggaaggggcgtggaaacaaatccaaagagtagaaacatgggccctccgccaccccggattcacagtcatcgctctattcttagcccacgccataggcacatcgataactcagaaagggattatattcattttgcttatgcttgtaacgccctccatggctatgcgatgtgtcggcataggcaatcgcgattttgtcgagggactcagtggcgcaacatgggtagacgtggtgctagaacacgggagttgtgtaaccaccatggccaaaaacaagccaacactggacattgaactccttaaaacggaagttacgaacccggccatcctccgcaaactttgtatagaagccaagattagtaacaccacgaccgattcaaggtgccccacccaaggcgaggcgacactcgtagaggagcaagatgccaacttcgtatgcaggcgaacattcgtggataggggatgggggaacggttgcggactcttcggcaaagggagtctcctaacatgcgcgaaattcaaatgcgtaacaaagctagagggaaaaatcgtgcaatatgagaatttaaaatactccgtaatcgtcacagtgcacactggtgaccaacaccaagtcgggaacgaaactactgagcacggtacgatagcgaccatcacgccccaagccccaacgtcggagatacaactcacggactatggtgcgctcacactcgactgtagcccgagaaccggactggacttcaacgagatggtcctactaacgatgaaggagaaaagctggcttgtacacaagcagtggttccttgacctgccactcccgtggacgtccggcgccagcactagccaagaaacatggaatcgacaggacttgctcgtaacattcaaaacggctcatgccaagaaacaagaagtagtagtcctcgggtcacaggaaggggcaatgcacaccgcgctaaccggagccaccgaaatccagacgagcggaacaacaaccatcttcgcaggacacctgaaatgtcgactcaagatggataaactaacgctgaagggaacatcatatgtaatgtgcactggatcgttcaaactcgaaaaagaagtagcagaaactcaacacggcacggtcttagtccaggttaaatatgaaggcacagacgcaccctgcaagatccctttctccacacaagacgaaaagggcgtcacccagaacggacggctaattacagcaaatccgattgtaacggataaggaaaagcccgtaaacatagaaacagaacccccgtttggtgaatcctatatcgtggtaggcgcaggggagaaagccctaaaattgtcctggttcaagaagggttcgtccataggaaaaatgttcgaagccacagcccggggagcgcgcaggatggccattctaggagacacagcatgggacttcggcagcatcggcggagtcttcacatccgtaggaaaactcgtccaccaagtcttcgggacagcatatggcgtacttttcagcggcgtcagttggaccatgaaaataggcattgggattctgctgacctggcttggcctgaatagccgttccacatcattaagtatgacatgcatcgcagtgggcatggtcaccttgtacctcggagtgatggtccaagcagactcagggtgtgtcataaattggaaaggcagagaactcaagtgcggcagtgggatattcgtcaccaatgaggtacacacatggacagaacaatacaaattccaggcggactcacctaagcgcctatcagccgccatcggaaaggcttgggaagagggagtctgcgggattcgttcagcaaccaggcttgaaaatatcatgtggaaacaaataagcaacgaactaaaccacatcctcctggaaaacgacatgaagttcaccgtagtcgtgggcgacgccaacgggatcctggctcaaggaaagaagatgataagaccacaaccaatggaacacaaatacagctggaaaagctggggaaaggcaaaaattatcggcgccgacatacaaaacaccaccttcataatagacggccctgacacacccgaatgcccggacaatcagcgagcatggaacatatgggaagtggaagattacggattcggcatattcacgaccaacatctggttaaaactaagagacagctacacgcagatgtgcgaccaccgactaatgtccgcagccatcaaggactcgaaggcggtacacgcagacatgggctactggattgaaagcgaaaagaatgaaacttggaagctggctcgggccagcttcattgaggtcaagacatgtacatggcccaagagccacacgctttggtccaatggtgtcctggagagcgagatgatcataccaaaaatttatggcgggcccataagccagcacaactaccgaccagggtacttcacccaaacggccggtccatggcatttaggcaaactagagctggactttgacctctgcgagggcacaaccgtggtggtagacgaacattgcggcaaccgtggaccgagtctcaggacgaccacagtcacaggaaagataatacacgagtggtgctgccgaagttgcacccttcccccactgcgctttagaggggaagacgggtgctggtacggaatggagataagacccgtcaaggaaaaagaggaaaacctagttcgtagcatggtatcagcgggatcgggcgaagtagatagcttcagcctgggcatcctgtgtgcgagcataatgatcgaagaagtcatgagatcgagatggagtagaaaaatgttgatgactgggaccctggcagttttcttgttgctaatcatgggacagctaacatggaacgatctcatccgactctgcataatggtcggggcgaacgcaagcgacaggatggggatgggaaccacttacctcgccctaatggcaaccttcaagatgaggcccatgttcgcggtcggcctcctgttcagaaggcttacctcgagagaggtactactactaacaataggtctatcgctcgtggcgagtgtggagctgcctaattcacttgaggagttaggagacgggttagcaatgggtattatgatgctcaagctcctcaccgaatttcagccacaccaactatggaccaccttattatcactgacgtttataaaaactacgctctccttagactacgcgtggaagacgacagccatggcactgagcatcgtatccctattcccactgtgcctcagtaccacgagtcaaaagactacgtggttgccagtactcctcggatcattcgggtgcaagccactaacgatgtttctgatcacagaaaaccaaatatggggacgtaaatcatggcccctcaatgaaggaatcatggcgatcggaatagtgtcgatcctcctgtcaagcctgttgaaaaacgatgtaccactagcaggacctctgatagcaggagggatgttgatcgcctgctacgtcatctcagggagcagcgcggatctgtcactagaaaagacggccgaagtaagttgggaacaagaagcggaacacagcggaacctcgcacaacatccttgtagaagtacaagatgacggaacaatgaaaattaaggatgaagaacgagacgatacccttacaatactgttgaaggcgacacttttagccgttagtggagtgtacccgatgagcatacccgcaactctattcgtatggtatttctggcagaagaagaaacaaagaagcggggtcctgtgggacacaccaagcccgccggaggtcgaacgcgcagtactggacgacggcatctaccggatactccaacgaggcttgttaggacgaagtcaagtaggagttggagtattccaagatggagtcttccacacaatgtggcacgtgacacgcggagccgttctcatgtatcaaggaaaacgcctcgagccatcctgggcaagtgtaaagaaagacctcatctcttacgggggcggatggcgtttccagggatcatggaacaccggggaggaggtacaggtcatcgctgtagaacccggcaaaaaccccaaaaacgtccagaccacacccggcacgttcaaaacgcccgagggcgaagtcggggccatcgctctggactttaaaccgggaacctctggctcaccaatcgtcaaccgggagggcaaaatcgttggcctttatgggaacggggtcgtaaccacgtcgggaacttacgtaagcgccatagcccaagcgaaggcatcacaggaagggccacttcctgaaatagaggacgaggttttcaagaaacgcaacctcacgataatggatctgcacccaggcagcggaaaaacaagacggtatctgccagcaatagtccgagaagctatcaagcgcaagttgcgcacactaatcctcgcaccgacccgggtcgtggcaagcgagatggccgaagccctaaagggaatgccgataagataccaaacaacagcagtcaaatcggaacacacaggaagagagatcgtggacctgatgtgccatgccacattcaccatgcggttattatcgccggtacgcgtacccaactacaatatgataataatggatgaagcacacttcaccgacccagcatcaatagcggctcggggctacatatctaccagagtagggatgggcgaagcagcagcaatatttatgacagccacaccacccgggtcagtggaagccttcccacagagcaacgccgtaatacaagacgaagaacgagatatccccgagaggtcttggaactcaggatacgattggataacagacttcccaggcaagaccgtgtggtttgtaccaagcataaaatcaggcaatgacatcgcaaactgcctaaggaaaaatgggaagcgagtaatacaattatcccgcaagactttcgataccgaataccagaaaacgaaaaacaacgactgggattacgtggtcacgacggatataagcgaaatgggcgctaactttcgtgccgatagggtcatcgacccaagacgatgccttaaaccagtaatattaaaagacggaccagaacgcgtcatattagcgggcccaatgccagtaactgtcgctagcgcagcacagcgcaggggtcgcataggccgaaaccaaaacaaggagggagatcagtatgtatacatgggccaacccctcaacaacgacgaagaccatgcacactggacagaagcaaaaatgctgttggacaacataaacaccccggaggggatcattcctgccctcttcgaacctgaaagggaaaagtccgcagctatagacggggagtacaggttacgaggggaggctaggaaaacattcgtagaactaatgcgccgcggcgacctccccgtatggctcagctacaaggtagcctcagagggcttccaatatagcgatcggcgctggtgctttgatggtgagagaaataatcaggtgctcgaggagaacatggatgtagagatatggacaaaagagggggagaggaagaaactacgacctagatggctcgacgcacgaacatattcggacccactagcccttagagaatttaaggaatttgcagcagggcgacgctccgtctcaggagatctcattctagagatcggaaagctccctcaacacctcacccttcgagcacaaaacgctctagacaacctagttatgctccataactcagaacaaggagggaaggcgtatagacacgcgatggaagaactcccagacacgatagaaaccctgatgttgctagcactcatcgcagtcctcacaggcggagttaccctatttttcctatcgggaaagggactagggaaaaccagcattggactactgtgcgtgacagccagcagcgctctgctatggatggcttccgtagaaccgcattggatcgccgcgagtataatcctagagttctttctaatggtactacttataccagaaccagatcggcaacgtaccccgcaagataaccagcttgcctacgttgtcatcgggttactgttcatgatactcacggttgccgcaaatgagatgggactgttggaaacaaccaagaaagacctagggattggacacgtagccgctgaaaaccatcaacacgccacaatgctcgacgtagacttacgacccgcgtccgcgtggacgctgtacgccgtggcgaccacagtaatcactcccatgatgcgacacacaatagaaaacacaacggccaacatatcgttaacagcaatcgccaatcaagcggctatactaatgggtctcgataaggggtggccaatatcgaagatggacatcggcgtgccgctgctagctctaggatgctacagccaggtcaaccccctcacgctgacggcagcagtcctcatgctagtcgcgcactacgcaatcattggaccgggactccaagccaaagcgactcgagaagcacaaaaacgcaccgctgcaggaattatgaaaaaccccactgtcgacggcatagtggccatagaccttgatccagtcgtttacgacgcaaaattcgaaaagcagctaggccaaattatgctcctaatcctgtgtaccagccagatcctattaatgaggacaacctgggcgttatgcgaatctataaccctcgcaacaggcccgctcacaaccctatgggagggctcaccgggcaaattctggaacaccaccatagccgtttcgatggcaaacatatttcgcgggagctatctagccggcgcaggcctcgcctttagtctgatgaaatccctcgggggcgggcggcgaggcaccggcgcgcaaggagaaactctaggagaaaaatggaagagacagctgaaccaactgtcaaagtcggagtttaacacttacaaaaggagcggaatcatggaagtagatagaagtgaagccaaagagggtctgaaacgaggagaaacgacaaagcacgctgtctcacgggggacagcgaaacttcgctggttcgtagaaagaaacctagtgaagccggaaggcaaagtaatagacttgggatgcggacgtggcgggtggtcgtattactgtgcaggcctcaagaaggtcaccgaggtgaagggctatactaagggcggtccggggcacgaagaaccgatcctaatggccacttacgggtggaacctagtagagctacacagtggtaaagacgtgttcttcatgcctccagaaaaatgtgacacccttctttgcgacatcggagaaagctcacctaacccaaccatagaggaaggcaggacactcagagtactcaagatggtagaaccctggctacgagggaatcagttctgcataaaaatactcaacccctacatgccctcggtcgtcgagactctagaacaaatgcagcgcaaacatggtggcatgctagtacgcaatccgctatcccggaatagcactcatgagatgtattgggtgagctgcggcacgggtaacatcgtgagcgccgtgaacatgacctcgagaatgctccttaaccgcttcacaatggcccaccggaaacccacattcgaacgagacgtggacctaggcgcagggacgaggcacgtcgcggtggaaccggaggtcgcaaacctcgacatcatcgggcaacgcatcgaaaatatcaaaaacgagcacaagtccacctggcattatgacgaagacaacccatataagacatgggcataccatggatcatatgaagtcaagccttccggatcggcgtcgagcatggtgaacggtgtcgtacggctccttacaaagccatgggacgtaattcccatggtaactcaaatagccatgaccgacacaaccccattcggccaacaacgggtcttcaaagaaaaggtagacaccagaacaccgagagccaaaagaggcaccacacagatcatggaagtcacagccaaatggctctggggatttttatcgagaaacaagaaaccacgaatatgcacacgcgaagagttcacccggaaagtacgaagcaatgcagctattggtgcggtcttcgtagacgagaaccagtggaacagtgcaaaagaggccgtcgaggacgaacggttttgggacttagtccatcgggaacgagaattacacaagcaggggaagtgtgctacttgtgtatacaacatgatgggcaagcgtgaaaagaagctcggagagttcggtaaggccaaaggctcacgcgccatatggtacatgtggttaggggcaagattcctcgagttcgaggctctaggctttatgaatgaagaccactggttcagtcgcgaaaactcgttgtcgggggttgagggcgaaggactccacaaactaggctatatattaagggacattagcaagatccctggtgggaacatgtacgctgacgacactgcgggctgggatacgaggatcaccgaagatgacctgcaaaatgaagcgaagataaccgacataatggagcccgaacacgcactactcgccacatcaatctttaaacttacgtaccagaacaaagtcgtaagggtccaacgcccggccaaaaacggaaccgtaatggatgtcatttcaagacgagatcaaagagggagcgggcaggttggaacatacggcctaaatacatttaccaacatggaggtacagctcattagacagatggaaagcgaggggattttcctaccgtccgagctcgagacccctaacctagcagaacgtgtgctagactggctcgagaagcacggcgccgaacggcttaagagaatggccatatcaggggacgactgcgtcgtaaaacccatcgacgatcgctttgctacggcgctaactgcgctaaatgacatgggcaaggtacgcaaagatatcccgcaatgggaaccctcaaaaggatggaatgactggcagcaggtcccgttttgcagtcaccacttccaccaactaatcatgaaagatggacgtgaaatcgttgtgccatgcagaaaccaagatgaacttgtaggccgcgctagagtgtcacaaggagccgggtggagtctccgggagaccgcctgtctcggaaaaagctacgcgcaaatgtggcagttaatgtactttcaccgacgagacctacgtttagcagcaaatgccatatgtagtgccgtgccggtagactgggtaccaacttcccgtacgacatggtccatccacgctcaccatcagtggatgacaacggaggacatgctttccgtgtggaacagggtatggatcgaagaaaacccgtggatggaagacaaaacgcacgtctcaagctgggaagaggtgccctacctcggcaagcgcgaagaccaatggtgtggcagtctcataggactcaccgcgagggcgacatgggcaacgaacatccaggtagccatcaatcaggtacggcgtctcatagggaatgagaactacttggactacatgacttcaatgaagcgcttcaagaacgagtcagatccggaaggagcattatggtaa

SEQ ID NO: 23870 - RNA, 9879 nt, synthetic construct
  misc_feature 1..9879: note = derived and/or modified CDS sequence (opt11) from DENV-1__HQ166035__SS-prME
  source 1..9879: mol_type = other RNA
agcgtgaccatgctgctcatgttactgcccaccgccctcgccttccacctgaccacccgggggggggagcctcacatgatcgtctcaaagcaggagcggggcaagagcctcctgttcaagacctccgcgggggtaaacatgtgcaccttaatcgccatggatctgggggagctctgcgaggatacaatgacctacaagtgcccccagattaccgaggccgagcccgatgacgtggactgctggtgcaacgccaccgacacctgggtcacatacggaacctgcagccagacgggcgagcaccgccgtgacaaacgttccgtggcccttgctccccacgtgggcctggggcttgagacgcggaccgaaacgtggatgtcatccgagggagcgtggaagcagatccagcgcgtcgaaacgtgggccctgcgccaccccgggttcacggtgatcgccttgttcctcgcgcacgccatcggcacctccatcacacagaaggggatcatcttcatacttctgatgctcgtgaccccctccatggccatgcgctgcgtcgggatcggcaatcgggacttcgttgaggggctgagcggcgcaacgtgggtcgacgtcgtcctggagcacgggtcctgcgtaacgaccatggccaagaataagccgaccctcgatatcgaactgctgaagacggaggtcaccaaccctgcgatcctacgcaagctttgcatagaagcaaagataagcaatacaaccactgactcccggtgccccactcagggcgaggccacgctggtggaagagcaggacgccaatttcgtgtgccgccggaccttcgtcgacaggggctgggggaacggctgcggactgttcggcaaggggagcctgcttacatgcgccaagttcaagtgtgtgaccaagctagagggcaaaatagtgcagtacgaaaacctgaagtactccgtaatcgtgaccgtgcacaccggagaccagcaccaagtcgggaacgaaacgacggaacacggcaccatcgcaaccatcacgccccaggcccccacgagcgagatccgtttgaccgactatggggcgctcactctggattgcagcccccggaccggcctggacttcaacgagatggtgttactgacgatgaaggagaaatcctggctggtccacaagcagtggttcctcgacctgcctttgccatggaccagcggggccagcaccagccaggagacctggaaccggcaggacctcctggtgacgttcaaaaccgcccacgcgaagaagcaagaggtggttgtcctcggaagccaggagggcgccatgcacaccgccctcactggtgccacggagatacagaccagtgggaccaccactatcttcgccgggcacctgaagtgccgcctgaaaatggacaagctcaccctgaagggcacctcgtacgtgatgtgcactgggagcttcaagctggagaaggaggtggcggagacccagcacgggaccgtcctggtacaggtcaaatacgagggcaccgacgccccctgcaagatccccttcagtacccaggacgaaaagggggtgactcagaacggccggctcatcacggccaacccaatcgtgaccgacaaggagaagcccgtcaatatcgagaccgagccacccttcggagaaagctacatcgtggtaggcgccggcgagaaggcgttaaagctctcctggttcaagaagggatcgagcataggcaagatgttcgaggcaacggcccgcggggcccggcgtatggccattctcggcgataccgcgtgggacttcggaagcatcggaggtgtcttcacctccgttgggaagctggtgcaccaggtcttcggcaccgcctacggggtgctgtttagtggggtgtcgtggacgatgaagatcggcatcgggatcctcctgacctggctgggccttaactcgcgctcgaccagcctgagcatgacctgcatagccgtcgggatggttacgttatacctcggcgttatggtccaggccgacagcggatgcgtgatcaactggaagggccgggagctgaagtgcgggtccggcatcttcgtgactaacgaggtccatacctggaccgagcaatacaagttccaggccgactccccgaagagactgagcgcggccatcggaaaggcctgggaggaaggggtctgcggcatccggtccgccacccgcctagagaatatcatgtggaagcagatctcaaacgagctgaaccacatcctgctcgaaaacgacatgaagttcactgtagtcgtgggggatgcaaacggcatcctggcgcaggggaagaagatgatccgcccacagcccatggaacacaagtatagctggaagtcgtggggcaaagctaagattatcggcgctgacatccagaacaccacatttataatcgatgggcccgacaccccggagtgccccgacaatcagcgcgcctggaacatttgggaggtggaagactacggcttcgggatcttcacgaccaacatctggctgaagctcagggacagctacacccagatgtgcgatcaccgcttaatgagtgcagccatcaaagactccaaggccgtccacgcggacatgggatactggattgaaagcgagaagaacgagacctggaagttggctcgtgcgtccttcatcgaggtgaaaacgtgcacctggcccaagagccacaccctctggtccaacggcgtgctggagagcgagatgatcatccccaagatctacggcggccccatctcccagcataattatagacctgggtacttcacccagacagcgggcccctggcacctgggcaagctagaactggacttcgacttatgcgaggggaccaccgtcgtggtggacgagcactgcggaaaccggggccctagcctcaggaccacgaccgtcaccggcaagatcatacacgaatggtgctgccggtcctgcaccctgccgccccttcgcttccgaggggaggatggctgttggtatgggatggaaatccgcccagttaaggaaaaagaggaaaacctcgttcggagcatggtctcagcgggaagcggagaagtggacagcttttcccttggaatcctctgcgtgagcataatgatcgaggaggtcatgcgctccagatggagcaggaagatgctgatgacgggtaccctggccgtgttccttctcctcgtgatggggcagctaacctggaacgacctcatccgcctgtgcatcatggtcggcgccaacgcctccgaccgcatgggaatgggcactacatacctggccctaatggccaccttcaagatgcgccccatgttcgccgtggggctgctgttcagacgcctcaccagcagagaggttctgctgctcaccatcgggctctccctggtcgcgagcgtggagctccccaactccttagaggagctgggtgacggcctcgccatgggcatcatgatgctcaagttgctcactgagttccagccccaccagctgtggacaacactgttaagcctcacatttataaaaacgacgctgagcctcgactatgcctggaaaaccactgcgatggccctgagtatcgtttccctgttcccgctctgcctgagcacgaccagtcaaaagaccacctggctgccggtgctcctgggcagtttcgggtgtaagcccttaacgatgtttctcatcacggaaaacaagatatggggcaggaagtcctggcccctgaatgagggcatcatggcgattggcattgttagcatccttctctccagccttttgaagaatgatgtccccctagcgggcccgcttatcgcgggaggtatgttaatcgcctgctatgtgatcagcgggtccagcgccgacctctccctggagaaggcggccgaggtgtcttgggaacaggaggccgagcactccggcacaagccataacatactggttgaggtgcaggatgacgggacgatgaagatcaaagacgaggagcgggacgacaccctcacgatcctgttaaaggccactatgctcgccgtgtcaggcgtctaccccatgtccatccctgcgactccgttcgtatggtacttctggcagaagaaaaagcagcgcattcgtgtgctgtgggatacgccgagcccgccagaagttgaacgcgcagtgctggacgacgggatctaccggatcctccagcgcggcctgctgggaaggagccaagtgggggtgggcgtattccaggacggtgtgttccacacgatgtggcacgtcacccgcggcgccgtgctgatgtaccaggggaagcggctcgagccctcctgggccagcgtaaagaaggacctgatttcctacggcggcgggtggcgatttcagggcagctggaacaccggggaggaggtccaggtgatcgccgtagagccgggcaagaacccaaagaatgtccagactacgcctggcacctttaagacccccgagggcgaggtgggcgcgatcgccctggatttcaagccggggacatcgggctcacccatcgtgaaccgggaggagaagatcgtagggctgtatggcaacggcgtggtgacgacctccgggacctatgtcagcgccatcgcccaggccaaggcgagtcaagagggccccctgccggagattgaagacgaggtgttcaaaaagcgcaacctgaccatcatggaccttcacccagggtctggcaaaacgcggcggtatctgccagccatcgtgagagaggccatcaagcgcaagctgcgcaccctcatcctggctcccacccgcgtcgtggcttctgagatggccgaagccctgaaggggatgccgatccgctaccagactacggcggtgaaatccgagcacaccggccgcgagattgtcgacctcatgtgccacgccaccttcaccatgcggctgctcagccccgtgcgggtgcccaactacaacatgatcattatggacgaggcccactttacggaccccgcgtccatcgccgcccgcggctacatctcaacccgggtcgggatgggcgaggccgcggcgatcttcatgaccgccacaccgcctgggagtgtcgaggctttccctcagagcaacgcggtcatccaggacgaggaacgggacattcccgagcgtagctggaacagcggctacgattggatcacggatttcccggggaagaccgtctggttcgtaccctccatcaagagcggcaacgacatcgcgaactgtctccggaagaacggcaaacgcgtaattcagctgtccaggaagacctttgacacggagtaccagaagacgaagaacaatgactgggactatgttgtgaccaccgatatctcagagatgggagcgaacttccgcgccgaccgtgtaatcgatcccaggcggtgtctgaagcccgttatcctaaaagacggcccggagcgcgtaatcctggccggacccatgccggtgaccgtcgcgtccgccgcacagcgtcggggtaggattgggcgcaatcagaacaaggagggcgaccaatacgtgtacatgggacagcctctgaacaatgacgaggatcacgcccactggacggaggccaagatgctcctggacaacatcaacacaccggaggggataatacccgcgctctttgagccggagcgggagaaaagtgccgcaatcgacggcgagtacagactgcgcggggaggcccgcaagacgtttgtcgagcttatgcgtcgcggcgaccttcccgtttggttatcctataaggtggccagcgaagggttccagtactccgaccggcgctggtgcttcgacggcgaacggaacaaccaggtcctggaggagaacatggatgtggaaatctggaccaaggaaggcgagagaaaaaagttgcggccgcgatggctcgacgcgcgaacatacagcgaccccctggctttacgcgaattcaaggaattcgccgccgggcggcgctccgtgagcggcgacctcatcttagaaatagggaagctgccccagcacctcacgcttcgggcgcagaacgcgttggacaacctcgtcatgctgcacaatagcgagcagggtggcaaagcctaccgccacgccatggaagaattgccagacacaattgagaccctcatgctgctggccctcatcgcggtgttaactggcggtgtgacgctgttctttctctccgggaagggtctgggtaaaaccagcatcggcctcctctgcgtgaccgcttccagcgccctcttatggatggcctccgtggagccgcactggattgcagctagcatcatcctcgaatttttcctaatggtgttgctcatccccgagcccgaccgacagcgcaccccgcaggacaaccagctagcgtacgtggtcattgggctcctcttcatgatcttaacggtggccgccaacgagatgggtctgctcgagactaccaagaaggacctggggatcgggcacgtcgccgcggaaaatcaccagcacgcaactatgctggacgttgacctacgtcccgcctccgcctggacgctgtacgcagtcgcgaccaccgtcatcacccccatgatgcgccacacaatcgagaacaccaccgcgaacatctccttgaccgccatcgccaatcaggcagccattctcatggggttggacaaggggtggcccatctccaagatggatatcggcgtgccgctgctcgctttagggtgctactcgcaggtgaaccccctcaccctcacagccgccgtcctgatgcttgtggcgcactatgctataatagggcccgggctccaggccaaggccacccgcgaggcacagaaacggaccgcagcggggatcatgaagaaccccacggtggacggtatcgtggccatcgatctagacccggtggtatacgacgcaaagttcgagaagcagctggggcagatcatgctccttatcctttgtaccagccagatactcctgatgcgcaccacctgggccctttgcgagagcatcacgctcgcgacgggccccctgaccaccctgtgggaaggctcgccagggaagttttggaacacaactattgcggttagcatggccaacatcttccgggggagttatctcgcaggggcgggcctggcgttcagcctgatgaagtcccttggcgggggccgccgggggaccggcgcgcaaggagagacactgggcgaaaagtggaagcgccagctgaaccaactaagcaagagtgagttcaatacttacaagcggagcggcatcatggaagtggacagaagcgaggccaaggaggggttgaagcggggcgagaccactaaacacgccgtgagtcgcgggaccgcgaagttgcgttggttcgtcgagcgaaacctcgtgaagcccgagggcaaggtgatcgaccttgggtgtggccggggagggtggagctactactgcgccggcttgaagaaggtcaccgaggtaaagggttacacgaaaggcggacccggccacgaggagcccatccccatggccacttacggttggaacctggtgaagctacactccggcaaggatgtcttcttcatgccccccgaaaagtgcgacaccctgctctgtgacataggcgagagctcccccaatcccaccatcgaggaggggaggacgctccgggttctgaagatggtggagccctggttgcgcggcaatcagttctgcatcaagatcctgaacccgtacatgcccagcgtcgttgaagccctggagcaaatgcaaaggaagcatggggggatgctggtgcgtaaccccctctcgcgcaactcaacccacgaaatgtattgggtctcctgcggcacggggaatatagtgagcgccgtgaacatgaccagccgcatgctgctgaaccgcttcacgatggcgcaccggaagcccacctacgaacgcgacgtcgatctcggcgccgggacccggcacgtggccgtggagccggaggtcgccaacctggacatcatcggccagcgcattgagaatattaagaacgaacacaaaagtacttggcactacgacgaggacaacccctacaagacgtgggcctaccacggctcctacgaagttaagcctagcgggagtgcgagctcgatggtgaatggagtcgtccggctgctcaccaagccttgggacgttatcccgatggtaacacagatagccatgaccgacactacgccctttgggcagcagcgagtgtttaaagagaaagtggacacgcggacgccccgggccaagcggggcacgacgcaaatcatggaagtcaccgccaagtggctgtgggggtttctgagccgcaacaagaagccgaggatctgcacccgcgaggagttcaccaggaaggtgcgttccaacgccgcgatcggcgctgtcttcgtagacgagaatcagtggaacagcgctaaggaggccgttgaggacgaaagattctgggatctcgtccaccgggagcgggagctgcacaagcagggcaaatgcgcgacctgcgtgtacaacatgatgggaaagcgagagaagaagctgggcgagttcgggaaagccaagggtagccgggccatctggtacatgtggttgggggcccgcttcctggagttcgaggccctgggcttcatgaacgaggaccactggttctcccgggagaacagcctcagcggcgtggagggtgagggcctgcacaagctggggtatatcctccgcgacatcagcaagatccccggggggaacatgtatgcggatgacacagcaggctgggacacacgcataactgaggacgacctgcagaacgaggccaagatcaccgagatcatggagcccgagcatgccttactcgccacctccatcttcaagttgacctaccagaacaaggtcgtgcgcgtgcagcgccccgccaagaacggcaccgtcatggacgtcatctcacggcgggaccagcgggggtccggacaggtggggacctacggcctgaacacctttactaacatggaagtccagctcatccgtcaaatggagagcgagggcatcttccttccgagtgagctggagacgcccaacttagcggagcgtgtgcttgactggctggagaagcacggggcagagcgcctcaagcgtatggcaatcagcggcgacgactgcgttgtcaagcccatcgacgaccgcttcgccaccgcgttaaccgctctgaacgacatggggaaggtacgcaaggacatcccccagtgggagccgagtaagggctggaacgattggcagcaagtcccgttttgctcgcaccattttcaccagctcataatgaaggacggtcgcgagatcgttgtgccttgtcgtaaccaggacgagctggtgggtcgcgcccgcgtctctcaaggtgccgggtggagcctgcgcgagacagcgtgtctgggcaagtcctacgcacaaatgtggcagctcatgtactttcatcggcgcgacctgcgtctcgcggcaaacgccatctgcagcgctgttcccgtagactgggttccgacctcccgtacgacctggagcatccacgcccatcaccagtggatgacgaccgaggacatgttaagcgtgtggaaccgggtgtggatcgaggagaacccttggatggaggacaagacgcacgtctccagctgggaggaagtgccttacctagggaagcgggaggaccagtggtgtggcagcctcatcgggttgactgcccgcgccacctgggccaccaatatacaggtggcgatcaaccaggtcagacgcctgatcggcaacgagaactacctcgactacatgacgtcgatgaagcgtttcaagaacgaatccgatcccgagggcgcattatggtga

SEQ ID NO: 23871 - RNA, 9879 nt, synthetic construct
  misc_feature 1..9879: note = derived and/or modified CDS sequence (opt11) from DENV-1__GQ868502__SS-prME
  source 1..9879: mol_type = other RNA
agcgtgaccatgctgctcatgctgctgcccaccgccctcgccttccacctgaccacacggggcggggaaccccacatgatcgtgagcaagcaggaacggggcaagagcctcctgttcaagacaagcgcgggtgtgaacatgtgcaccctaatcgccatggacctgggcgagctctgtgaggacactatgacgtacaagtgtccccagatcaccgaggccgagcccgacgacgtggactgctggtgcaacgccaccgacacctgggtgacctacgggacctgtagccaaacgggcgagcaccgccgggacaagcgctccgttgccttagcgccccacgtcggcctgggactcgagactcggacggagacctggatgagcagtgagggtgcctggaagcagatccagcgcgtcgagacatgggctctgagacaccccggattcacggtgatcgccctgttcctcgcgcacgccatcggcacaagcatcacccaaaaggggaccatcttcatcttactgatgctcgcgactccctccatggccatgaggtgcgtgggcattggcaaccgggactttgtcgaggggctgagcggggccacgtgggtggacgtggtcctggagcacgggtcctgcgtgacgacaatggcgaaaaacaagcccacccttgacatcgagctgctgaagaccgaggtgaccaaccccgccatcctcagaaagctgtgtatcgaggcgaagatcagtaacacgactacggattccagatgcccgacgcagggcgaggccaccctggtcgaagagcaggacgccaacttcgtgtgtcgccggacgttcgtggaccgcggatgggggaatggttgcgggctcttcggcaaggggagcctgctaacgtgcgcgaagttcaaatgcgtcaccaagctcgaaggcaagaccgtgcagtatgagaacctgaagtactccgtgatcgtcacggtccacactggcgaccagcatcaagtgggtaacgagaccaccgagcacggcaccatcgccacgatcacgccccaggcccccaccagcgagatccagctgaccgattacggggccctcacgctggactgcagccctaggacaggcctcgacttcaacgagatggtcctcctgaccatgaaggagaagtcctggctagtgcataagcagtggttcctcgacctgccgctgccttggacttccggggcctcaacgagtcaggaaacctggaatcgacaggacctcctggtcaccttcaagaccgcgcacgccaagaagcaggaggtggtggtcctgggctcccaggaaggcgccatgcacacggcgttaaccggggccactgagatccagacctcgggaacgaccaccatctttgcggggcacctgaagtgccggcttaagatggacaagctcactctgaagggcacgtcctatgtgatgtgtactgggagcttcaaactggagaaagaggtggcagagacccaacacgggaccgttctggtccaggtgaagtacgagggcacggacgcgccctgcaagatccccttctccacccaagacgagaagggggtcacacagaacggccgcctcatcacagccaacccgatcgtgacagacaaggagaagcccgtgaacatcgagaccgagccgcccttcggagaaagctacatcgtcgtgggcgcgggcgagaaggcgctgaagctgagctggttcaagaaggggagctccatcggaaaaatgtttgaagccacggcgcgcggggcccgccggatggcgatcctcggcgacaccgcgtgggacttcgggagcataggcggcgtgtttacttccgtcgggaagcttgtgcaccaggtcttcgggaccgcctatggggtcctgtttagcggcgtgtcctggactatgaaaatcggtatcggcatactcctgacctggctgggcctcaacagcaggtccacgagcctgagcatgacctgcatcgccgtggggatggtcaccttgtaccttggcgtgatggtgcaggccgacagcgggtgcgtcattaactggaagggccgcgagctcaaatgcgggtccggcatcttcgtgaccaacgaagtgcacacatggacagagcagtacaagttccaagctgacagcccgaaacggctttcagccgcgataggaaaggcctgggaggagggcgtttgcggcatccgctctgccacccggctcgagaacatcatgtggaagcagatcagcaatgagctgaatcacatactactcgagaacgacatgaagttcaccgttgtggtcggagacgcaaacggcatactggcccaggggaagaaaatgatccgccctcagccaatggagcacaagtactcctggaagtcctggggcaaggccaagataatcggcgccgacatccaaaataccacgttcatcatcgacgggcccgacaccccagagtgccccgacaatcagcgggcatggaacatctgggaggtggaagattacgggttcgggatcttcacgaccaacatctggctgaagttacgcgattcctacacgcagatgtgcgaccaccggctaatgagcgcggccatcaaggactccaaggccgtgcatgcggacatgggttattggatagagtcagagaagaacgagacctggaagctggcaagagcctccttcatcgaagtaaagacctgcacctggcccaagagccatacgctgtggtccaacggcgtgctggagagcgagatgatcatccccaagatctacgggggaccgatctcccagcataattaccggcccgggtacttcacccagaccgccggaccctggcacctgggtaagctcgagctcgacttcgatctgtgcgagggcaccacggttgtcgtcgacgagcactgcgggaaccgcggtccgagcctccggaccaccaccgtgacgggcaagatcatccacgagtggtgttgccgtagctgcacccttccgcccctgcggtttcgcggggaggacggctgctggtacgggatggagatccggcccgtcaaggaaaaggaagagaacttagtgcgcagcatggtgtccgccggcagcggtgaggtggatagcttttccctggggatcctgtgcgccagcatcatgatcgaggaggtgatgcggtccaggtggagccggaaaatgttaatgaccggcaccctggcggtcttcctgctcctggtcatggggcaactgacgtggaatgacttaataaggctgtgcatcatggtgggtgcgaacgcctccgaccgcatggggatgggcaccacctacctggccctcatggccaccttcaagatgcggccgatgtttgcggtagggctgttgtttcgccggctcacgagccgcgaggtcctgctgctcaccatcggactgtcccttgtggcaagcgtggagctccccaattccctggaagagctgggtgacgggctagccatgggcatcatgatgctaaagttgctcaccgaattccagccccaccagttatggaccacgctgctcagcctaacgttcatcaagaccaccctgtccctcgactacgcatggaagacgacagcgatggccctgagcatcgtctccctcttccctctctgcctgtccactacgtcccaaaagaccacctggctgccggtgctccttggcagcttcggctgcaaacccctgacaatgttcctgatcaccgaaaacaagatttggggccggaagtcctggcccctgaacgaggggatcatggccatcggcatcgtaagcattctgctctccagcctgctgaaaaatgacgtgcccctcgccgggccactgatagccgggggcatgctcatagcatgctacgtgatcagcgggtccagcgccgacctctccctggagaaggctgccgaggtcagctgggagcaagaggccgaacactccggtacctcccacaacatcctagtggaggtgcaggacgacggaacgatgaagatcaaggacgaggagcgcgacgacaccctcaccatcctgctgaaggcgaccctcctggccgtctccggcgtgtatcccatgagcatccccgccacgctgttcgtgtggtacttctggcagaagaagaagcagcggtccggagtactctgggacacccccagcccgcccgaggtggagcgcgccgtgctggacgatggcatataccggatcttacaacgcggcctgctcgggaggtcccaggtcggcgtgggggtttttcaagacggtgtttttcacaccatgtggcacgtgacccgcggggccgtgctgatgtaccagggcaagcggctggagccaagctgggcgagtgtcaagaaggacctaataagctacggcggtggctggcgctttcaagggtcctggaatacgggcgaggaggtccaggtgatcgccgtcgagcccggtaagaacccgaagaacgtgcaaaccaccccgggcaccttcaagacgcccgagggcgaggtaggggccatcgccctggacttcaagcccggcacaagcggatccccgatcgtcaaccgggagggcaagatcgtcggactttatggaaacggcgtagtcaccacaagcgggacatacgtgtccgccatcgcccaagccaaagccagccaagagggccccctacccgagatcgaggacgaggtgttcaagaaaagaaacctgaccattatggacctgcatcctgggagcggcaagacgcggcgctacctccccgctatggtccgggaggcgattaagcgcaagctgcggacactgatcctggcacccacgcgcgtggtggcctccgaaatggccgaggccttaaagggcatgcctatacgctaccagaccacagcggtcaaaagcgagcacaccgggcgggagatcgtggacctaatgtgccacgccacgttcaccatgcggcttctttccccggtgcgtgtccccaattacaacatgatcatcatggacgaggcccacttcaccgaccccgccagcatcgccgcccgcggctacatctccacccgtgtaggcatgggggaagccgccgccatcttcatgacagccacgcctcccgggtcagtggaggcgttccctcagtctaacgctgtcatacaagatgaggagcgcgacattcccgagcggagttggaactccgggtacgactggatcaccgacttccccggcaagaccgtgtggttcgtgcctagcatcaagtcagggaacgatatcgctaactgcttgcgcaagaatggcaagcgggttattcagctgtctcgcaagacgttcgacaccgagtaccagaagaccaagaacaacgactgggactacgtggtgacaacggacatctccgagatgggcgctaacttccgggcggaccgcgttatcgatccccggcgctgcttgaagcccgttatactgaaggacgggcccgagagggtaatccttgccgggccgatgcccgttaccgtggccagcgccgcccagcgccggggccgcatcggccggaaccagaacaaggagggagaccaatacgtgtacatgggacaacccctgaacaacgacgaggaccatgcgcattggaccgaggccaagatgcttttggacaatatcaacacaccagaggggatcatcccggccctgtttgagcccgagcgcgaaaagtccgcagccatcgacggagagtaccgtttacgcggggaagcgcgcaagacattcgtcgaactcatgaggcgcggcgacctgcccgtgtggctgtcatataaggtcgcctccgagggcttccagtacagcgaccggcgctggtgcttcgacggggagcgaaacaaccaggtgctcgaagagaacatggatgtggagatctggactaaagagggcgagcgcaagaagcttcggccgcgctggctggacgcgagaacctactccgaccccctcgccctccgggagttcaaggagtttgccgcggggcgtcgcagcgtcagcggcgacctgattctcgagatcggcaaactgccccagcacctgaccctacgagcccagaacgccctggataaccttgtgatgctccacaactccgagcagggcgggaaggcataccgccacgcgatggaggagctgcccgacaccatcgagacgctgatgctcctggccctgattgccgtcctcaccgggggcgtcacgttgttcttcctgagtgggaagggactcggtaagacctccatcgggctgttatgcgtgacggcctcctcggccctcctgtggatggcgagcgtggaaccccactggatcgcagcctccatcatcctggagttcttcctcatggtcctgctgatccccgagcccgatcggcagagaacgcctcaggacaaccagctcgcctacgtagtgatcgggctgctgttcatgattctcaccgtcgccgcgaacgagatggggctgctggagacgacgaaaaaggacctcggcatagggcacgtggctgccgagaaccaccagcacgccaccatgttggacgtggacctgcgtccggccagcgcgtggaccctctacgctgtcgccaccacagtgataacccccatgatgcgccacaccatcgagaacaccacggccaacatctcattgaccgccatagcgaaccaggccgccatcctgatgggtttagacaagggctggcccatcagcaaaatggatatcggagtgccactgctggccctcggctgctattcccaggtcaatccgcttaccttaaccgcggctgtgctgatgttggtggcccactacgccatcatcggacccggcctgcaagccaaggcgacacgggaggcccagaagcgaacggccgccgggatcatgaaaaaccccacagtcgacggtattgtggccatcgacctcgaccccgtggtctacgacgcgaaattcgagaagcagctgggccaaatcatgctcctcatcctttgcacatctcagatcctgctcatgaggacgacctgggcactatgcgagtccatcaccctggccacgggtccgctcacgaccctttgggagggcagccccgggaagttctggaacacgaccatcgcggtgtccatggccaacattttccggggcagctacctggccggcgccgggctcgcgttctctctgatgaagtccttgggtgggggccgccgggggacgggcgcacagggcgagaccctaggtgagaagtggaagcgccagctcaaccagctatccaagagcgagttcaatacctataagcggtccggcattatggaagtagatcgttccgaggccaaggagggcctcaagcgtggtgagaccaccaagcacgcggtatctcgcgggacggccaagctacggtggttcgtggaacgcaacctggtgaagcccgagggcaaggtcatcgacctgggctgcgggcggggcgggtggtcctattactgcgctggtttgaaaaaggtgaccgaggtgaaggggtacaccaagggcggccccgggcacgaggagccgattcccatggccacctacggctggaacctggtgaagctgcacagcggcaaggacgtgttctttatgccgccagagaagtgcgatacgttactgtgcgacatcggagagtcctcacctaatcccacgatcgaggaggggcgcaccctgcgggttctcaagatggtcgagccctggctgcgaggcaaccagttctgcatcaagatactgaatccttacatgccgtccgtggtggagactttagagcagatgcagcggaagcacggcggtatgctggtcagaaatcctctgagccggaattcaacgcacgagatgtactgggtaagctgcggcacaggtaacatcgtgtccgctgtaaacatgaccagccgcatgttgctgaaccggttcaccatggctcaccgcaagcccacgtacgagcgcgacgtggacctgggcgccggcactcggcacgtggccgtcgagcccgaggtggccaacctagatatcataggtcaacgcattgagaacatcaagaatgagcataaatccacctggcactacgacgaggacaacccatacaagacctgggcgtatcacggctcctacgaggttaaaccctccggaagcgcttcctccatggtcaacggcgtggtgaggctgctaacgaaaccatgggacgtcatccccatggtgacccagatcgccatgacggacaccacgcctttcgggcagcagcgcgtctttaaggagaaggtagacacccggaccccccgggccaagcggggcaccacgcagataatggaggtcaccgccaaatggctctggggcttcttatcgcgaaacaagaagccccgcatctgcacccgagaagagttcacccggaaagtacgctctaacgcggccataggggccgtgttcgtggatgagaaccagtggaacagcgccaaggaggcggtcgaagacgagcggttctgggacctggtgcatcgcgagcgggagcttcacaagcagggcaagtgtgccacgtgcgtgtacaacatgatggggaagcgtgagaagaagctgggcgagtttgggaaagccaagggctcccgggccatctggtacatgtggttgggcgctagattcctcgaattcgaggcgctggggtttatgaacgaggaccactggttcagccgcgagaactccctgtccggcgtagagggagagggactccacaagctgggttacatcctgcgcgacatatccaagataccgggcggcaacatgtacgcagacgacaccgccgggtgggacactcggatcacagaggacgacctgcagaacgaggcgaagatcacggagataatggagccagagcatgccctgctggcgaccagcatcttcaagttgacctaccagaacaaagttgtgcgcgtccaaaggcccgccaagaacggaactgtgatggacgtgatctccagacgcgaccagcgagggagcggccaggtcggcacgtacgggctgaacaccttcaccaacatggaggtgcagctgatccgccagatggagtcagagggcatcttcctaccctccgagcttgagaccccgaacctggccgagcgggtgttggattggctggagaaacacggggccgagcgcctaaagcggatggccatctccggcgacgattgcgtcgtgaagccgatcgacgaccgcttcgcgaccgcacttacggccctgaacgacatggggaaggtgcggaaggacattccccagtgggagcccagcaagggctggaacgattggcaacaggtgccgttctgctcccaccacttccaccagttaatcatgaaagacggccgcgagatcgtagtaccctgccgcaaccaggacgagctcgtcgggcgcgcccgggtgagccagggtgcagggtggtcccttcgcgagaccgcctgtctgggcaagagctacgcccagatgtggcagcttatgtacttccaccggcgagaccttcggctggcggcgaatgccatctgctcggccgtgcccgtcgactgggtccccaccagccgtaccacttggagcatccacgcccaccaccagtggatgaccaccgaggatatgctgtccgtctggaaccgggtctggatcgaggagaacccgtggatggaggacaagactcacgtgtcttcttgggaagaggtgccttacctggggaagcgcgaggaccaatggtgcggctcgctgatcggtctgacagcccgcgccacctgggcgaccaacatccaggtcgccatcaaccaagtgcggcgcctgatcggtaacgagaactacctggactacatgaccagtatgaagcggttcaagaacgagagcgaccctgagggtgccctctggtaa

SEQ ID NO: 23872 - RNA, 9879 nt, synthetic construct
  misc_feature 1..9879: note = derived and/or modified CDS sequence (opt11) from DENV-1__GQ868503__SS-prME
  source 1..9879: mol_type = other RNA
agcgtaaccatgctgctcatgctgctgcctaccgccttggccttccacctgaccacccggggcggggagccacatatgatcgtgagcaagcaagagcggggcaagagcctcctgttcaagacctccgccggggtgaacatgtgcacgctgatcgccatggacctgggcgagctctgcgaggacaccatgacctacaagtgtccccagatcaccgaggcagagcccgacgacgtggattgctggtgcaacgcaacagacacgtgggtcacctacgggacctgcagccagaccggcgaacaccgacgggacaagcgcagtgtggccctggcgccccacgtgggcctggggctcgaaacccggacagagacctggatgtcatccgagggcgcctggaagcagatccagcgcgtcgagacctgggccctacggcaccccgggttcacggtgatcgccctgttcctcgcgcatgctattgggacttccattacccagaaggggatcatcttcatcctgctaatgctcgtcaccccatctatggccatgcgctgcgtcggcatcggcaaccgggacttcgtggagggactgagcggcgctacgtgggtggacgtcgtgctggaacacgggtcctgcgtcacaacgatggcgaagaacaaacccaccctcgacatcgagctgctgaagacggaggtcaccaaccccgcgatcttgcgcaagttgtgcattgaggccaaaatctcgaacaccaccacggactcccggtgcccgacgcagggggaggccactctggtggaggagcaggatgccaacttcgtttgcaggcggaccttcgtcgaccgcggctggggtaatggttgcggcctcttcggcaaggggagtctgctgacgtgcgccaagtttaagtgcgtaaccaagttggaaggcaagatcgtgcagtatgagaacctgaaatactcggtcatcgtgaccgtgcacaccggcgaccaacaccaggtcggaaacgagacgaccgagcacggcaccatagcgaccatcacgccccaagcgccaacgagcgagatccagctgaccgactacggtgcacttacgctggactgcagcccacggacgggcctggacttcaacgagatggttctcctgacgatgaaggagaagagttggctggtccataagcagtggtttttagacttacccctgccctggacttccggggccagcacctcgcaggagacctggaaccgccaggatctcctggtaacgttcaagaccgcgcacgccaagaagcaggaggtcgtcgtgctgggctctcaggagggcgccatgcacaccgcactcacaggggcgacggagatccaaactagcggcaccaccaccatcttcgccgggcacctgaagtgtcggctgaagatggacaagctcacactgaagggaacctcctacgttatgtgcaccggatctttcaagttagagaaggaagttgccgagacccagcacggcactgtgctggtgcaggtcaagtacgagggcacagacgccccctgcaaaatccccttttctacccagaacgagaaaggggtcacgcagaacggtcgcctcatcaccgccaaccccatcgtgaccgacaaggagaagcccgtcaacatcgaaaccgagccgccattcggggagagctacatcgtggtgggcgccggcgagaaggcgctgaagctgtcctggttcaaaaaggggtcctccatcggcaagatgttcgaggccacggccagaggggcccgccggatggcaatcctcggcgacaccgcgtgggacttcgggagcattggcggcgtcttcacttccgtgggtaagttagtgcaccaagtcttcggcaccgcctacggagtgctgttcagcggcgtgtcctggacgatgaagatcgggatcggcatcctcctgacctggctgggcctcaacagccggtccaccagcctgtcgatgacctgtatcgcagtcgggatggtgacgctgtacctcggcgtgatggtccaggccgacagcgggtgtgtgatcaactggaagggccgcgaactgaagtgtggatccggcatcttcgtgaccaacgaggtacacacctggaccgaacagtacaaattccaggccgactcgccgaagcggctgagcgcggcgatcggcaaggcctgggaggagggggtgtgcggcatccgtagcgctacccggctcgagaatatcatgtggaagcagatcagcaacgagctgaaccacatactgctcgagaacgacatgaagttcacggtggtggtgggggacgccaatggcattctagcgcagggtaagaaaatgattagaccccagcccatggagcataagtactcctggaagtcgtgggggaaggcaaagatcatcggcgcagacatccagaacaccacgttcatcatcgatggccccgacactccggaatgccccgacaaccagcgggcctggaacatttgggaggtggaggactatggcttcggcatcttcacgaccaatatctggctcaagctccgcgactcctatacacagatgtgcgaccaccggctgatgtctgcggccatcaaggactccaaggccgtgcacgccgacatgggctactggatcgagagtgaaaagaacgagacctggaagctggagcgggcctccttcatcgaggtgaagacgtgcacctggcccaagagccacaccctctggtccaacggcgttcttgaatctgaaatgatcatacccaaaatctacgggggcccgatctcacagcacaactaccggcccggatacttcacccagacggcagggccgtggcacctgggaaagctcgaactggatttcgatctgtgcgagggcaccaccgtagtggtggacgagcactgcggcaaccgcgggcccagcttacggactacgaccgtcaccggcaagatcatccacgagtggtgctgccgctcctgcacactgccgcccctcagattccgtggggaagacggttgctggtatgggatggagatccgtcccgttaaggaaaaggaggagaacctcgtgcgcagtatggtctcagccggaagcggggaagtggatagcttctccctgggcattctgtgcgcaagcatcatgatcgaggaagtgatgcggtcccgctggtcacggaagatgctcatgacgggaactctggcggtcttcctgcttctgatcatggggcagctgacatggaacgacctcatccgcctttgcatcatggtaggcgctaacgcgtccgaccgcatgggaatgggtacaacgtacctggccctcatggccacgtttaagatgcggccgatgttcgcggtggggctgctgtttcgccggctcaccagccgcgaggtcctcctgctcaccatcgggttatccctggtggccagcgtagagctcccgaatagtctggaggagctgggcgacggtcttgcgatgggcatcatgatgctgaagctgctcacggagtttcagccccaccagctgtggaccaccctgctcagcctgaccttcattaagacgaccctgtccctagactacgcctggaagacaaccgcaatggccctgagcatcgtctccctgttccccttgtgcctgtcgacgacctcccagaagaccacctggctgccggtgttactggggagcttcgggtgcaagccgctgaccatgttcttgatcacggaaaacaaaatctggggtcgtaagtcctggccccttaacgaggggatcatggcgatcggcatcgtctcaatattactctccagcctgctcaagaacgacgtgcccctagccgggccgttaatcgccggcggcatgctgatcgcatgctatgtgatcagcgggagcagcgccgacttgtccctggaaaaggccgccgaggtaagctgggagcaggaggccgagcactccggcacctcccacaacatccttgtcgaggtgcaggacgacggtactatgaaaatcaaggacgaggaacgcgacgacacgctcacgattctgctgaaggccaccttacttgccgtctccggcgtgtaccctatgagcatcccagccaccctgttcgtgtggtacttctggcagaagcggaagcagcgcagtggggtcctctgggacacccctagtccgcccgaggtggagcgggccgttctggacgacggtatctaccgcatccttcagcggggcctactcgggcgctcccaggtcggcgtgggggtgttccaggatggcgtcttccatacgatgtggcacgtgacccgcggggcagtgctgatgtaccagggcaagcggctggagcccagctgggcctccgtgaagaaggacctcataagctacggcggcggctggcggttccaggggtcctggaacaccggcgaggaggtacaggtgatagccgtcgagcccggcaagaacccgaagaacgtgcaaacgacgccaggcatctttaagacccccgagggcgaggtgggtgcgatcgcactcgacttcaagccgggcaccagcgggagtccgatcgtcaatcgcgaggggaaaatcgttggcctatacgggaacggcgtggtcacaacgagcgggacctacgtgtccgccatcgcccaggcgaaggcgagccaggaaggccccctccccgagatcgaggacgaagtgttcaagaaacggaatcttaccatcatggacttgcacccgggcagcggcaagacccgccgatacctccccgctatcgtccgcgaggccatcaagcggaaactgcgcacgctgattctcgccccaacgcgggtggtggcgagcgagatggccgaggccctgaagggcatgcccatccggtaccagaccaccgccgtcaaaagcgagcacacggggcgcgagatcgtggacctgatgtgccacgccaccttcactatgcggctcctgtcacctgtcagagtccccaactacaacatgatcatcatggatgaggcgcacttcaccgaccccgccagcatcgccgcccggggctacatcagcacgcgcgtggggatgggcgaggccgctgccatcttcatgacggcaactccgcctgggagcgtcgaggcctttccccagtccaatgccgtaatccaggacgaggagcgggacattcccgagcgcagctggaactccggctatgactggatcaccgacttccccggcaagacggtatggttcgtgccgagcatcaagtccgggaacgacatcgcgaactgcctccggaagaacggtaaacgcgtcatccagttatctcggaagaccttcgacaccgagtaccagaagaccaagaacaacgactgggactatgtggtcacgaccgacatctccgagatgggggccaacttccgcgcggaccgggtcatcgaccctcgccggtgcctgaagccggtgatcctgaaggatggcccagagcgggtgatcctcgccgggccgatgccggtcacggtcgcgtcggcagcccagcgacgcgggaggatcggccgcaaccaaaacaaggagggggaccagtacgtgtacatgggccagcccctcaataacgacgaggaccacgcccactggaccgaggccaagatgttactcgacaacatcaacacgcccgagggcatcattccggctctgttcgagcccgagcgcgagaagtcggccgccatcgacggtgagtaccggctgcgcggggaggcccggaagacattcgtcgaactcatgcgcaggggcgacctgcccgtgtggctgagctataaggtcgcctccgaaggattccagtactcggaccgcagatggtgcttcgatggggagcgcaataatcaggtgctcgaggaaaacatggacgtggagatctggaccaaggagggagaacggaagaagctgaggccccggtggctggacgcgcgcacctactccgacccgctcgctctgcgtgagttcaaggagttcgccgccgggcgtcgtagcgtcagtggcgacctgatattagagatcggcaagctaccgcaacacctgaccctgcgcgcccagaacgcgctggataatctggtgatgctccacaactccgagcagggcgggaaggcctaccggcacgcaatggaggaactgcccgacacgatcgagacgctgatgctcctggccctgatcgcggtcctcaccggaggggtcaccctattcttcctgtccgggaaaggccttggcaagacgtccatcgggctgttgtgcgttaccgccagctccgccctcctgtggatggctagcgtggagccccactggatcgccgcctcgatcatcctcgagttcttcctaatggtcctgctgatccctgagcccgacagacagcggacgcctcaggacaaccagctcgcctacgtggtgatcggcttattgttcatgatcctcaccgtcgccgccaacgagatggggttgcttgagacgaccaagaaagacctcggcatcgggcacgtggccgcggagaaccatcagcacgcaaccatgctggacgtggacctgcgcccggcctccgcctggaccttatacgcagtagctacgaccgtgatcacccccatgatgcgccacaccatagagaacacgaccgccaacatatccctgaccgccatcgccaaccaagccgcgatcctaatgggcctcgacaagggctggcccatctccaagatggacatcggggtgcccctgctggcactcggctgctactcccaggtcaacccgctgaccttgacggccgccgtgctcatgctggtggcgcactatgccatcatcggtcccggcctacaggccaaggcgacccgtgaggcccagaagcgcacggcggcggggatcatgaagaaccccacagttgacggcatcgtggccatagacttggatcccgtggtctacgacgccaagttcgagaagcagctgggccagatcatgctgctcatcttgtgcacctcacaaatcctgctcatgcggaccacctgggccctgtgcgagtccatcacccttgcgactggtccactcacaaccctgtgggagggtagccccgggaagttctggaacaccacgatcgccgtgtccatggcgaacatctttcgcggatcatacttggccggagccggactcgcattctcactgatgaagtctttgggcggaggtcggagagggaccggtgcgcagggcgagaccctaggggaaaagtggaagcggcaattgaaccagctgtccaagagcgagttcaacacctacaaacgcagcggcatcatggaggtggacagaagtgaggccaaggaaggcctcaagcgcggcgagaccaccaagcacgccgtgagcagggggaccgcgaagctgcgctggtttgtggagcggaatctggtgaagcctgagggcaaggtcatcgatctgggctgcgggcggggcgggtggtcatattactgcgccggcctgaagaaggtgaccgaagtgaaggggtacaccaaagggggccccgggcacgaggagccgatccccatggccacttacggctggaacctggtcaaactgcacagtgggaaagacgtgttcttcatgcctcccgagaagtgcgacaccctcctgtgcgacatcggcgagtccagtccaaatcccaccatcgaggaggggcgtaccctgcgtgtgctcaagatggtcgaaccctggttgcggggcaatcaattctgcatcaagatcctgaacccctacatgccgagcgtggtggaaacgctagagcagatgcagcgcaaacatggagggatgctggtccggaaccccctgtcgcgcaactccacccatgaaatgtactgggtgagttgcggcacggggaacatcgtctccgccgtcaacatgaccagccggatgctcctgaaccggttcacgatggcgcaccgcaagcccaccttcgagcgggatgtcgacctgggcgccggcacccgacacgtggccgtagaaccagaagtcgctaacctcgacatcatcggccagcgtatcgagaacatcaagaacgagcacaagtccacctggcactacgacgaggacaacccttacaagacgtgggcctaccacggcagctacgaggtgaagccttcggggtcggcctccagcatggtcaacggcgtggtgcgcttactgaccaagccctgggacgtcatccccatggtgacgcaaatcgcgatgaccgacacgacgccgttcggtcagcaacgggtcttcaaggagaaggtagacacgcgcacgccccgggccaagcgagggactacccaaataatggaagtaacagccaagtggttatggggattcctgtcccggaacaagaagccgcgcatctgcactcgagaggagttcactcgcaaggtccggagcaacgcggctataggcgcggttttcgtggatgagaaccagtggaatagcgcaaaggaggcagtcgaggacgagcgtttttgggacctagtgcacagagagcgcgagctccacaagcagggcaaatgcgctacgtgcgtgtataacatgatggggaaacgggagaagaagctgggcgagttcgggaaggcgaagggctccagagccatctggtatatgtggctgggcgcacggttcctcgagttcgaggctctggggtttatgaacgaggatcactggttcagccgtgaaaattccctgagcggcgtcgagggcgagggcctacataaacttggctacatcctgagggacatatccaagatcccgggcggcaatatgtacgccgacgacaccgcgggatgggacacccgcatcactgaggacgacctccagaacgaagcgaagataaccgacatcatggagcccgagcacgccctgttagccaccagcatcttcaagctgacctaccagaacaaggtggtgagagtacaacggccggccaagaacggcacggtgatggacgtcatctcacgccgggaccagcgggggagcgggcaggtcggcacctacgggctgaacaccttcactaacatggaggtacagctgatacggcagatggagtccgaggggatcttcctccccagcgaactggagacgccgaatctggcggagcgcgttctcgactggcttgagaagcatggggccgagcggctgaagcgcatggccatctccggcgacgactgcgtcgtcaagcccatcgacgaccggttcgccaccgcactcacagcgctgaacgacatggggaaggtgcgcaaggacatcccccagtgggagcccagcaagggctggaatgattggcaacaggtcccgttctgctcacaccacttccaccaattaattatgaaggacggccgggagatcgtggtgccatgccgcaaccaggacgagttggtcgggcgggcgcgagtgagccagggcgcggggtggagcctgcgggaaacagcctgtctgggcaagagctatgcccaaatgtggcagctgatgtacttccaccgccgggacctgcgcctagcggccaacgcgatctgctccgccgtgcccgtcgactgggtgcccaccagccggacgacctggtcaatccacgcgcaccaccagtggatgaccaccgaggacatgctctcagtgtggaaccgggtttggattgaggagaacccttggatggaggacaagacgcacgtgagctcatgggaggaggtgccctatctggggaagcgcgaggaccagtggtgcggcagcctaatcggcctcaccgcccgggccacctgggccaccaacatccaggtcgcgattaaccaggtgagacggcttatagggaacgagaactacctggactacatgacgagcatgaagcgcttcaagaacgagagcgatcccgagggcgccctctggtga

SEQ ID NO: 23873 - RNA, 9879 nt, synthetic construct
  misc_feature 1..9879: note = derived and/or modified CDS sequence (opt11) from DENV-1__GQ868504__SS-prME
  source 1..9879: mol_type = other RNA
agtgtgacaatgctgctcatgctgctgccgaccgctctcgccttccatctcacgactcggggcggggaaccgcacatgatcgtgagtaagcaggagaggggaaagtccttgctgttcaagaccagcgccggtgtgaacatgtgtacactgatcgccatggatctgggtgagctctgcgaggacacgatgacctacaagtgtccccagattaccgaggccgagcccgacgatgtagactgctggtgcaacgccaccgacacttgggtaacatacgggacctgtagccaaacgggcgagcacagacgcgacaagcggtccgtggccctggcgccccacgtgggcctggggctcgagactcggaccgagacctggatgtcttcggagggcgcttggaagcaaatccagcgggtcgaaacctgggctttaaggcaccccgggttcacggtcatcgccctatttctcgctcacgcgatagggacaagcatcacccagaagggaatcatctttatccttctgatgctcgtgaccccctctatggcaatgcgctgcgtcggcatcggtaatcgggacttcgtggaagggttgagcggcgccacgtgggtcgatgtcgtgctggagcatggatcctgcgtgaccaccatggccaagaataagcccacccttgatatagaactgctaaagacggaggtcaccaacccggcaatcctgcgcaaactgtgcatcgaggccaagatctccaatacgaccacggactcgcgttgcccgacccagggtgaagccaccctggtggaggagcaggacgcaaatttcgtgtgccgccgcaccttcgtagaccgcggttggggaaacggatgtggcctgtttggcaaggggtcactgttaacctgcgccaagttcaagtgcgttaccaagctcgagggaaagatcgtgcaatacgagaatctgaagtactccgtcatcgtcaccgtgcacaccggcgaccagcaccaggtcgggaacgagacgaccgagcatggcaccatagcgaccatcactcctcaagcccccactagcgagattcagctgaccgactatggtgcacttaccctagactgcagcccacggaccggcctcgatttcaacgagatggtgctgttgacgatgaaggagaagtcatggctggtccacaagcagtggttcctcgacctgccgcttccctggacgtccggtgcaagcaccagccaggaaacatggaaccggcaggatcttctggtcacgttcaagaccgcccacgcgaagaagcaagaggtggtcgttctgggctcccaggagggggccatgcacaccgcactcaccggggccactgaaatacagaccagcgggaccaccacgatattcgccggtcatttaaagtgccggctgaagatggacaagctcaccctgaaaggtacctcctacgtaatgtgcaccggctcgttcaaactggagaaggaagtcgcagagacgcagcacggcaccgtactcgtgcaggttaaatacgagggcaccgacgccccctgcaagatccccttctccacccaggacgagaagggggttacgcaaaacggcaggctcattaccgccaacccgatcgtgaccgataaggagaaacccgtaaatattgagactgagccgcccttcggtgagtcttacatcgtggtgggtgccggcgagaaggcgctgaagctgtcctggttcaagaagggtagctccatcggcaaaatgtttgaggccacggcccggggggcccgccgaatggcaatcctcggggacacagcgtgggacttcgggagcatcggcggcgtcttcacctctgtagggaagctggtacaccaggtgttcggcaccgcctatggggtgctcttcagcggcgtcagttggaccatgaagattgggatcggcatattgctgacctggctgggcctaaacagccgcagcacttcgctgtccatgacctgcatcgccgtcgggatggtgacgctgtacctcggggtcatggtccaagccgacagcgggtgtgttatcaactggaagggccgcgagctgaagtgcggttccggaatcttcgttaccaatgaggtccatacgtggaccgagcagtacaagtttcaggcggactcaccgaagcggctgtcggctgctatcggcaaagcctgggaggaaggggtgtgtggcattcgaagcgctaccagactggagaacatcatgtggaagcagattagtaacgaactgaaccacatccttctcgagaatgacatgaagttcactgtcgttgtcggggacgctaacggcatcctcgcgcaggggaagaaaatgattcgcccccagccgatggagcataaatacagctggaagagctgggggaaagcaaagatcatcggtgccgacatccagaacaccaccttcatcatcgacgggcccgatactccggagtgccccgacaaccagcgcgcctggaatatatgggaggttgaggactacggcttcgggatcttcacgaccaacatctggctgaagctccgcgatagctacacccaaatgtgcgaccaccgactgatgtcggctgccatcaaggattccaaggccgttcacgccgacatgggctattggattgagtctgagaagaacgagacatggaagctggctcgcgcgagcttcatcgaagtcaagacgtgcacctggcccaagagccacacgctctggtctaacggcgtgctggagagcgagatgataatccccaaaatctacggaggcccgatctcgcagcacaactaccgcccggggtacttcacccagacggcaggaccatggcacctgggtaagctcgagcttgatttcgacctgtgcgagggcaccacggtcgtggtggacgagcactgcgggaaccgcgggccgtccctgcggaccacgaccgtcacaggcaagatcattcacgaatggtgctgccgatcctgcactttgccgccactaaggttccgcggagaagacggttgttggtacgggatggagatccggccggtgaaggagaaggaagaaaacttggtgcgcagcatggtgtctgcaggcagcggcgaagtggactctttctccctggggatcctgtgcgtctcaataatgatcgaggaggtcatgcggtcccgctggagcaggaagatgctcatgacgggcaccttagctgtgttcctactactggtgatgggacagctgacgtggaacgacctcatccgcctgtgcatcatggttggtgccaatgcgtccgacagaatggggatgggcaccacgtacttagccctcatggccaccttcaagatgcgccccatgttcgccgtgggcctgctgttccgccggctcaccagccgtgaggttctgctgctcacaatcgggttatccctggttgccagcgtggaactgcccaactccctggaggaactaggcgacgggctagcgatgggtataatgatgctgaaactgctcacggagtttcagccccaccagttgtggaccaccctgctctcgttgaccttcatcaagactaccctgtctttggactacgcgtggaagaccaccgccatggccctgagcatcgtatccctgtttccgttgtgcctgagcacgacctcccagaaaaccacttggttaccggtgctcctggggagcttcgggtgcaagcctttgactatgttcctcatcacggagaacaagatttggggccggaagtcctggcccctaaacgaggggatcatggcgatcgggattgtcagcatacttctctccagcctgcttaaaaacgacgtcccgttagctgggcctctgatcgccggcggcatgctgatcgcgtgctatgtgatctcggggtcaagtgccgacctttccctggaaaaggcggccgaggttagctgggagcaggaggcggagcactccggcacttcacacaacatcttagtcgaggtgcaggatgacggaaccatgaagatcaaggacgaggagcgcgacgacaccctcacgatcctgctcaaggccacgttactggccgtgtccggcgtctatcccatgagcatcccggctacactgttcgtctggtatttttggcagaagaagaaacagcggtccggtgtgctctgggacactccctcaccaccggaggtcgagcgcgccgtactggacgacggcatctaccgcattctgcaaaggggtttactcggtcgttcccaagtgggcgtaggggttttccaagacggcgtattccacacgatgtggcacgtgacccgcggcgccgtgctaatgtaccaaggcaagaggctggaacccagctgggccagtgtgaagaaggacctcatcagctacggcgggggatggcggttccagggctcctggaacaccggcgaggaggtccaggtgatagcagttgaacctgggaagaatcctaagaacgtccagaccacgcccggcaccttcaagacgccagaaggcgaggtgggggcgattgccctggattttaagccgggcaccagcgggtccccgatagttaatagagaggggaagatcgtgggcctctacggtaacggcgttgtgacgaccagcgggacctacgtgtccgccatcgcacaggccaaagcctcgcaagaaggcccgttgccagaaattgaggacgaagtgtttaagaagaggaacctcaccattatggaccttcacccgggaagcggcaagacgcggcgctacctccccgccatcgtgcgagaggcaatcaagcgcaagctgcggacactgatcctcgccccgacccgcgtcgttgcgtccgaaatggcggaagccctgaagggcatgcccatccgctatcagaccacggcagtcaaaggcgagcacacaggtagggagatcgtcgacttaatgtgccacgccacttttacgatgcgcctcctgagcccagtccgggtgcccaattacaacatgatcatcatggacgaggcgcactttacggatccagcctccatcgccgcccgcgggtacatttcgactcgcgtcggcatgggggaagctgcggccatcttcatgaccgccacgccgccgggttctgtggaggccttcccccaaagcaacgctgtcattcaggatgaggagcgcgacatcccggagcgatcttggaatagcggttacgattggatcacggatttcccaggaaagaccgtctggtttgtccccagcatcaagagcggcaacgacattgctaactgcctgcgcaagaacgggaagcgggtgatccaactcagtcgaaagaccttcgataccgagtaccagaagacgaagaacaacgactgggactacgtcgtaacgaccgacataagcgagatgggggccaacttcagggcagatagggtgatcgacccccggcgctgcctgaagccagtcatactgaaggacgggccagagcgggtaatcctcgccggcccgatgcccgtgacggtcgcgtccgccgcccaacgccggggcagaatcgggagaaaccagaacaaagagggcgaccaatacgtgtacatggggcagcctctgaataacgacgaggaccacgcccactggacggaagccaagatgttactcgacaatatcaacacgcccgagggcatcataccggcacttttcgagcccgaacgcgagaagtccgctgccatcgacggggagtaccgcctgaggggcgaggcccgcaagaccttcgtagaacttatgcggcgcggagatctgcccgtgtggctctcctacaaggtggcaagcgagggtttccaataccctgaccggaggtggtgctttgacggcgagcggaacaaccaagtgctcgaggagaatatggacgtggagatatggacaaaggagggggagcgcaagaagctgcgtccgcgctggctggacgcccgcacctactctgaccccctcgccctgcgcgaattcaaagagttcgcagctggccggcgcagcgtgtccggcgacctcattctcgagatcggcaagctgccccagcatctgaccctccgggcccaaaacgcgttagacaacttagtcatgctccacaacagcgagcagggcgggaaagcctataggcacgccatggaagaactaccggacaccatcgaaacgctgatgctcctggccttaatcgcggtgctcaccggtggggttacgctgttctttctgagcggaaagggccttgggaagaccagcatcggcctgctgtgcgtaacggcaagctccgcactcttatggatggccagcgtagagccgcactggatcgccgcgtccatcatcctggagtttttcctcatggtgctcctgatccccgagcccgaccggcagcgcaccccccaggacaaccagctcgcctatgtcgtgatcgggctgctgttcatgatcctcacagttgccgccaacgagatgggcctcttagagaccaccaagaaggacctcgggatcggccatgtcgcggcggagaaccatcagcatgcaaccatgctagatgtggacctaagaccggccagcgcctggactctttacgccgtcgcgaccaccgtcataacccccatgatgcgccacacgatcgagaataccaccgctaacatatccctcaccgccatcgccaaccaggccgcgatcttgatgggattagacaaagggtggcccataagcaaaatggacatcggcgtcccgctactggccttgggctgctactcccaagttaacccgctgacgctaaccgcagcagtcctcatgctagtggcacattacgccatcatcggccccgggttgcaagccaaagctacccgggaggcccagaaacgaaccgcggcaggcatcatgaagaatccaacagtagacggcatagtcgccatagacctagacccagtggtttacgacgccaagttcgagaagcagctgggtcagataatgctgctcatcctgtgcacgtcgcaaatcctgctgatgcggactacctgggccctctgcgagtccatcacactggcgaccggccccctcacaacactgtgggaggggtcgccaggcaagttctggaacacgacaatcgccgtttccatggcgaacatcttcaggggatcctacctagccggggccggactcgcgttctccctgatgaagagcctcgggggcggacgccgggggaccggcgcccagggtgaaaccctcggggaaaagtggaagcgtcagctgaaccagctctccaagagcgagttcaacacgtataagaggtccggtatcatggaggtggaccgcagcgaggcaaaggaaggcctcaagcgtggtgaaaccacgaaacacgccgtgagccgcggcaccgcgaagctgcggtggttcgtcgagcgcaacctggtaaagccggagggcaaagttatcgacctggggtgcggccgcggcggatggtcctattactgcgccggcctgaagaaggtgactgaagtgaaaggctatacgaaggggggcccgggccatgaagagccgatccccatggccacctacgggtggaacctggtaaagctccacagcggtaaggacgtctttttcatgcccccggaaaagtgcgacaccctcctgtgcgacatcggggaatccagccccaatcccacaatcgaagagggtaggacgctgagggttctcaagatggtggagccctggctgcgcggcaaccagttttgcataaagatcctgaacccgtacatgcccagtgtcgtggaggccctagaacagatgcagcggaagcacgggggtatgctagtgcgcaaccccctgagtcggaactccacccacgagatgtactgggtctcatgcgggaccggcaacatcgtatccgccgtgaacatgacctcccgcatgctcctcaaccggttcacgatggcgcaccggaaaccgacatacgagcgggacgtcgacctgggcgccggcaccagacatgtggccgtagagccggaggtcgccaacttagacataatcggccaaagaatcgaaaatatcaaaaacgagcacaagtccacatggcactacgacgaggacaacccctacaagacatgggcataccacgggagctacgaggtaaagccctccgggtcagcgtccagcatggtgaacggggtcgtgcggcttctgaccaaaccctgggatgtgatcccgatggtgacccagatcgccatgaccgacacgacccccttcgggcagcagcgagtgtttaaggaaaaggtcgacaccaggacgccacgtgccaagagaggcacgacccagatcatggaggttacggccaagtggctctggggatttctgagccgcaacaagaagccaagaatctgcacgcgggaggaattcacccggaaagtgcgcagcaacgccgcgatcggtgccgtctttgtggacgagaaccagtggaattctgccaaggaggccgtcgaggatgaacggttttgggatctggtgcaccgtgagcgtgagcttcataagcagggaaagtgtgcgacctgcgtgtacaacatgatgggcaagagggaaaagaagttaggggaattcggaaaggctaagggcagccgtgccatctggtacatgtggttgggggcccgcttcctcgaatttgaagccctgggcttcatgaacgaggaccattggttctcaagagagaactccctgagcggcgtggagggtgaggggctgcataaactggggtacatcctccgcgacattagcaagatcccgggggggaacatgtatgcggacgacaccgccggatgggacactcggatcacagaggacgacctccagaatgaggccaaaataaccgaaataatggagccggagcatgccctgcttgccacgagcatcttcaagctcacttaccagaacaaggtcgtgcgcgtgcagcgccccgcgaagaacgggaccgtcatggacgtgatctcacggcgcgatcagcggggtagcggccaagtggggacgtacggcctgaacactttcaccaacatggaggtccagctgatccggcagatggagtcggagggcatcttcttgccgagcgagttggagacgcccaacctggccgagcgagttctcgactggctggagaaacacggggcggagcgcttaaaacggatggccatctccggggacgactgcgtggtcaaacccatcgacgatcgcttcgccaccgcgttaacagcactgaatgatatgggcaaggtgcgaaaggacatcccccagtgggagccgagcaagggctggaacgactggcagcaagtcccattctgcagtcaccactttcaccagctgatcatgaaggacgggcgcgagatcgtcgtgccctgtagaaaccaggacgagctcgtgggccgcgcccgggtcagccaaggtgccggatggtccctccgcgaaaccgcctgcttaggcaaaagctacgcgcagatgtggcagctcatgtacttccaccgtagggatctgaggttagccgctaacgctatctgttccgctgtgcccgtggattgggttccgacctcccgcacgacctggtcaatccacgcccaccaccagtggatgaccaccgaggacatgctaagcgtgtggaaccgagtctggatcgaggagaatccctggatggaggacaagacgcatgtcagttcctgggaagaggtgccctacctgggcaagagggaggatcagtggtgcggcagcctgatcggactcaccgcccgggccacctgggccaccaacatacaggtggcgattaaccaggtccggcgtctgataggcaatgaaaactacctggactacatgacaagcatgaaacgtttcaagaatgagagcgaccccgagggggcgctctggtga

SEQ ID NO: 23874 - RNA, 9879 nt, synthetic construct
  misc_feature 1..9879: note = derived and/or modified CDS sequence (opt11) from DENV-1__GU131967__SS-prME
  source 1..9879: mol_type = other RNA
agcgtgaccatgttactcatgctgttacccaccgctctcgcctttcatctcacgacccggggcggcgagccccacatgatagttagtaagcaggagaggggaaagagcctcctgttcaagactagcgcaggggtgaacatgtgcaccctgatcgccatggacctcggtgagttgtgcgaggacacgatgacatacaaatgccctcagatcaccgaggccgagcccgatgatgtagattgctggtgtaacgccacggacacgtgggtgacctacggcacctgcagccagaccggagagcaccgccgggacaagcgctccgtggcccttgcgccacacgtgggcctggggctcgagacgcgtaccgagacttggatgagcagcgagggcgcatggaagcagatccaacgcgtcgagacctgggcgctgagacaccccgggttcacggtcatcgccctgttcctcgcccacgcgatcggcaccagcatcacccagaaggggatcatcttcatcctgctaatgctcgttaccccctctatggccatgaggtgcgtcggcataggcaatcgggacttcgtagaggggctgtccggcgccacgtgggtggacgtcgtgctggagcacggatcctgcgtgactaccatggccaagaacaagcccacactcgatatcgagctcttaaaaacggaggttaccaatcccgcgatcctccgcaagctgtgcattgaggccaaaatctctaacaccaccacggactcccgatgtccgacccagggcgaggccaccctggtcgaggagcaggatgctaacttcgtctgcagacgaacatttgtcgatcggggctgggggaatgggtgcggccttttcggcaaggggagcctgttgacgtgcgcaaaattcaaatgcgtaactaagctcgagggcaagattgtgcaatacgagaacctgaaatactccgtcatagtgaccgtacataccggcgaccagcaccaggtcggcaacgagacgaccgagcacggcaccattgcaacaatcacgccccaggccccgacatccgaaatccaactgaccgactatggcgcgttaaccctggactgtagcccgcggactggactggacttcaacgaaatggtgctcctgacgatgaaggagaagtcctggctcgtccacaagcagtggttcttggacctgccgctgccctggacgtccggagccagcacctctcaagagacctggaaccgccaggacctcctagttacgttcaaaaccgctcacgcgaagaaacaggaggtggtcgtgctaggctcgcaagaaggcgccatgcatacggccctcaccggggccacggaaatccagaccagcggcaccactactatcttcgccggacacctgaaatgccggttaaagatggataagctcaccttgaagggaacctcctacgtgatgtgcaccggaagcttcaagctcgagaaggaggtcgcggagacccagcacggcaccgtgctggtccaggtcaagtacgaggggaccgacgccccctgcaagatccccttttccacccaagacgagaaaggggtgacgcagaacggcaggttaatcactgccaacccgatcgtgaccgataaggaaaagcccgtcaacatcgaaaccgagccgcccttcggggagagctacatcgtggtgggagctggcgagaaggcactgaaactgtcctggttcaagaagggtagctcaataggcaagatgtttgaagctacagctcgcggcgctcgtcggatggccatcctgggggacacggcgtgggactttgggagcatcggtggcgtcttcaccagtgtgggcaagctggtgcaccaggtgttcggcaccgcatacggggtgctgttcagcggcgtgtcctggacgatgaagattggcataggaatcctcttaacctggctaggcctcaactcacgctctaccagcctgtccatgacctgcatcgccgtcgggatggtgacgctgtatctcggcgttatggtccaggccgacagcgggtgtgtgattaactggaagggtcgcgaactgaagtgcggctccggcatcttcgtgaccaacgaggtccacacctggacggagcagtataagttccaggccgacagcccgaagcggctcagcgcggccatcggaaaggcctgggaagagggagtgtgcggtatacgatctgccacccgtctcgagaacatcatgtggaagcagatcagcaatgagcttaaccacatcctgctcgagaacgacatgaagttcacggtcgttgtgggggatgccaatggcatcctcgcacagggtaagaagatgatccgaccccagccaatggaacataagtactcctggaagagctggggcaaggccaagataatcggcgccgatatccaaaatactaccttcataatcgatggacccgacacccctgaatgcccagacaaccagcgggcgtggaacatctgggaggtggaggactacggatttggcatctttacgaccaatatctggctaaagctgagagactcatacacacaaacctgcgaccaccggctgatgagcgcagctataaaggattccaaggctgtccatgccgatatgggctactggattgagagcgagaagaacgagacgtggaagctggccagggcgtccttcatcgaggtaaagacctgcacctggcccaaaagccacaccctctggtccaacggtgtgcttgaaagtgagatgatcatccccaagatctacgggggcccgatctcgcagcacaactaccggccggggtacttcacacagaccgcgggcccatggcacctggggaagctcgagctggacttcgacctgtgcgaaggcaccaccgtcgtggtagacgaacactgcggcaaccgcgggccgagtctccggaccacgaccgttaccgggaagatcatccacgaatggtgttgccgctcctgcacgctgccaccacttcgatttcgcggggaggacggctgctggtacgggatggagatccgacccgtgaaggagaaggaggagaacctcgtccgcagcatggtctccgccggtagcggcgaggtggacagcttctccctgggaattttgtgtgtaagcatcatgatcgaggaagtgatgagaagccgctggagccggaagatgctcatgaccggcaccctggcagtgttcttgctcctggtgatggggcaactgacctggaacgacctgatccgcctgtgcatcatggtgggggccaacgcgtccgacagaatggggatgggaacgacttatcttgcgctcatggcaactttcaagatgcggccgatgttcgccgtggggttgctgtttcgccggctcaccagccgggaagtgctgctgctcacgatcggtctgtccctggtcgccagcgtggagttgcccaactccctggaggaactgggcgacgggctcgcgatggggataatgatgctcaaactgctcaccgaattccagccgcaccagctgtggaccaccctgttaagcctgactttcatcaagacaaccctgtctctcgactacgcctggaagacaaccgcaatggcactgagcatagtctccctgttccccctctgcctgagcaccacctcccagaagaccacctggctgccggtgctcctgggttcctttgggtgtaagcccctgaccatgtttttgatcaccgagaacaagatctggggcagaaagtcctggcccctgaacgaggggatcatggcgatcggcatagtgtcaattctgctctccagcctactgaagaatgacgtccccctcgccgggccgctgatcgccggcggcatgctgatagcttgctacgttataagcggatccagcgccgacctaagcctggagaaggcggccgaggtgtcctgggagcaagaggccgaacactccggcaccagccacaacattctggtcgaggtgcaagacgatggtaccatgaagatcaaggatgaagaacgcgacgacacgttaaccatcctgctgaaggcaaccctcctagccgtgtccggcgtataccccatgagtattcccgcgacactgtttgtgtggtacttctggcagaaaaaaaagcagcggtccggggtgttatgggacacgcccagtcctcccgaggtcgagcgcgccgtgcttgacgatggcatataccggatactccaacgcggcctgctcgggcggagtcaggtgggcgtcggggtgttccaggatggagtattccacactatgtggcacgtgacacgaggggcagtactgatgtaccagggcaagcggctggaaccaagctgggcatccgtgaagaaagatctgatctcatacggagggggatggcgcttccaggggtcctggaacacgggtgaagaggtccaagtgattgccgtcgagcccgggaagaacccgaagaatgtccagacaacaccgggcactttcaagacccccgagggcgaagtgggcgcgatagccctggatttcaagcccgggacgagcgggtcaccgatagtaaaccgggagggcaagatcgtcggcttatacggtaacggcgtggtgaccacttccgggacatacgtcagtgcgatcgcacaggccaaggcgagccaagagggccccctccccgagatcgaggacgaggtgttcaaaaagcgtaacctgacgattatggacctgcacccgggctctggcaagacccggcgctatctgcccgcaatcgttcgagaggctattaagcgcaagctccggaccctgatcctcgccccaacccgagtcgtggcgtctgagatggccgaggccttgaaggggatgcccatacgctaccagacgaccgccgtcaagagcgagcacaccggacgggagatagtcgacttgatgtgccacgccactttcacgatgcgcctcctgagtccagtgcgggtacccaattacaacatgataatcatggacgaggcgcattttaccgaccccgcctcaatcgccgcacgcggctatatcagcacccgtgtcgggatgggagaggccgcggccatctttatgaccgcgacgcccccggggagcgttgaggcctttccccagagcaacgcggttatccaagatgaggagcgcgacatccccgagcggtcctggaactccggctacgactggatcaccgacttccccgggaagaccgtttggttcgtcccgtcgatcaagtccggcaacgacatcgcgaactgcctgcgcaagaacggcaagcgggtcattcaactcagccgtaagaccttcgacacggagtaccagaagaccaagaacaacgattgggactatgtagtgaccaccgacatctccgaaatgggcgctaacttcagggcagaccgcgtgatcgatccccggcgctgtctgaagcccgtaatactgaaggacggtcccgaacgggtgattctcgcaggcccaatgccagtgacggtagctagcgccgcccaacgccgcggccgcatcggtcggaaccagaacaaggagggggaccagtacgtgtacatgggccagcccctgaacaacgatgaggaccacgcccattggacagaggcaaagatgctgctcgataatatcaacacccctgaggggatcatcccggccctattcgaacccgagcgcgagaagtccgccgcgatagatggcgagtaccgcctgcgcggggaagccaggaagacgttcgtagagctcatgcggaggggcgacctgcccgtttggctgtcctacaaggtcgcatccgagggcttccagtacagcgaccggcgatggtgcttcgacggggaacgtaataaccaggtcctcgaggagaacatggacgtggagatctggacgaaggagggcgagcgaaagaaactacggcccaggtggctggacgcgcggacatacagcgacccgctcgctctgcgggaattcaaggaattcgctgccgggcggcgctcagtcagcggcgacttgatccttgagatcggaaagctgccccaacacctgaccctccgggcgcagaacgcgctagacaatctggttatgttacacaactcggagcaaggggggaaggcctaccgccacgccatggaggagctgcccgacactatagaaactcttatgctcctagccctgatcgcagtgctcaccggcggggtaaccctgtttttcttaagcgggaagggtctcggcaagacttccatcggtctactatgcgtaacggccagctctgccctcctttggatggccagcgtggagccccattggatcgccgctagcatcatactggagttcttcctaatggtcctcttgatcccggagcccgaccgacagcgcacgccccaggacaaccagctggcatatgtcgtgatcggcctgctgttcatgattctcacagtggccgccaatgagatggggctgctggagactaccaagaaggacctcgggatcgggcacgtcgcggccgaaaaccaccaacacgcaacgatgctggacgtggacctgcggccggcgagcgcgtggaccctctacgccgtggcgaccacagttatcacgcccatgatgcgccacaccattgagaacacaaccgcaaatattagcctgacggccatcgcgaaccaggccgcgatcctgatgggtctcgacaagggttggcccattagcaagatggacatcggggtcccgctgctggcgctcggctgctattcccaggttaacccgctgaccctgaccgctgccgtcctcatgctcgtggcgcactacgccatcatcgggcctggcttgcaggccaaggccacccgtgaagcccagaagcgaaccgctgctggtatcatgaagaacccgaccgtggacgggatagtcgccatagacctcgaccccgtggtgtatgacgctaaattcgagaagcagctggggcaaattatgctcctcatcctgtgcaccagccaaatcctgctcatgcgcaccacgtgggccctgtgcgagtccatcaccctggctacaggcccgctcacaacgctgtgggagggttctcccgggaaattctggaacaccacgatcgccgtttcgatggccaacatctttcggggcagctacctcgccggagccgggttggcgttctccctgatgaagtcgctgggcggaggcagacgggggaccggcgcgcaaggagagacgctcggggaaaagtggaagcgccagctaaaccaactgtcgaagagcgagttcaacacctacaagcggagcggcataatggaggtggaccgctcggaggccaaggagggactcaagaggggagaaacaactaagcacgcagtgagccgggggaccgcgaaactgcgatggttcgtcgaacgcaacctcgttaagcccgaaggcaaggtgatcgacctgggatgcgggcgcggtgggtggagctactactgtgccggcttaaagaaggtcacggaggtgaaggggtataccaaaggcggccccgggcacggggagccgatccccctggccacctacgggtggaatctggtgaagttgcacagcggcaaagacgtattcttcatgccgcccgagaaatgcgacaccctgctgtgcgacatcggggagtcctcaccgaatccgaccatcgaggaaggccgcaccttgagggtgctgaagatggtagaaccctggctgcgaggcaaccaattctgcataaagatactcaatccctatatgccctcagtcgtggaagctctggagcagatgcagcgtaagcacgggggcatgctcgtgagaaaccccctgagccgaaactccacccacgagatgtactgggttagctgtgggaccggcaacatcgtgtctgccgtgaacatgacgagccgcatgctgcttaaccggttcaccatggcacacaggaagcccacctacgagcgtgatgtcgacctcggcgcggggacccgtcacgtggccgtggagcctgaggtcgccaacctggacatcatcggacaacgcatcgagaacatcaagaacgagcacaagagcacgtggcattacgacgaagacaacccgtacaagacctgggcctaccatgggagctacgaggtgaagccctccggaagcgcgtcctctatggtgaacggggtcgttcggctgctcaccaagccgtgggacgtcatccccatggtgactcagatcgccatgacggacaccacgccgttcggacagcagagagtgttcaaggagaaagtagatacccgaaccccccgcgccaagcggggcacgacccagatcatggaggtgactgccaagtggctgtggggcttcctgtctcgcaataagaagccccggatctgcacgcgggaggaattcacccggaaggtccgcagcaacgccgcgatcggcgccgtcttcgtggacgaaaaccagtggaacagcgccaaagaggcagtagaagatgaacgtttctgggacttagtacatcgtgagcgggaactccacaagcaggggaaatgcgcgacctgcgtgtacaacatgatgggcaaacgagagaagaagttgggtgaattcggtaaggccaaaggttcccgggccatttggtacatgtggctcggggcccgcttcctggagttcgaggccctgggcttcatgaatgaggatcactggttcagccgggaaaattctctaagcggggtggagggcgaaggactgcacaaacttggctatatcttgagggacatctccaaaatcccgggcgggaacatgtacgcggacgacaccgccggttgggacacacggatcaccgaggacgacctgcagaacgaggccaagatcaccgagatcatggagcccgagcacgccctccttgccaccagcatctttaagctgacgtaccagaataaggtcgtgcgcgtgcaaagacccgcgaagaatggtaccgtcatggacgtgatctccaggcgggatcaacggggaagcggtcaggtggggacctacggcctgaacaccttcacgaacatggaagtgcagctcatccgccagatggagagcgaagggatcttcctgcccagcgagctcgaaacaccgaacttagccgagcgggtgctggattggttagagaaacatggcgctgaacgcctcaagagaatggccatctcgggggacgattgcgtggtcaagcccatcgacgaccgatttgccaccgcactaaccgccctgaatgacatgggcaaggtgcggaaggacataccccagtgggagccctccaagggctggaatgactggcaacaggtcccgttctgctcccatcatttccaccaactcatcatgaaggacgggcgcgagatagtagtgccctgccggaaccaggatgagctcgttggccgcgcccgggtgagccagggagccggctggagcctgcgcgaaaccgcatgcctcggcaagagctatgcgcagatgtggcaactaatgtactttcacaggcgcgacctgcggctcgccgccaacgccatctgctccgctgtgccagtggactgggtccccacgtcgcgtaccacctggagcatccacgcccaccatcagtggatgaccacggaagacatgctctccgtgtggaatcgcgtgtggatagaagaaaacccgtggatggaggacaagacgcacgtctcgtcctgggaggaggtgccctacctgggcaaacgagaggaccagtggtgtggctcacttatcgggcttaccgcccgcgccacctgggccacgaacatacaagtcgccatcaaccaggtccggcgcctgatcggcaacgagaactacctcgactatatgacctccatgaagcggttcaaaaacgagagcgacccggagggggcgctgtggtga

SEQ ID NO: 23875 - RNA, 9879 nt, synthetic construct
  misc_feature 1..9879: note = derived and/or modified CDS sequence (opt11) from DENV-1__GU131968__SS-prME
  source 1..9879: mol_type = other RNA
agcgtaaccatgctgctcatgctactgcccaccgccctcgcctttcaccttacaacccgtggcggggagccccacatgatcgtgagcaaacaggaaagaggtaagagccttctgttcaagaccagcgccggagtaaacatgtgcacgctgatcgccatggacttgggcgagctctgcgaggacacaatgacctacaagtgcccccaaatcactgaggctgaaccggacgacgtggattgctggtgcaacgccaccgacacttgggtcacctatgggacctgcagccagactggcgagcatcgtcgggataagcgatcagtggcactagcgccccacgtcggcctgggcctcgagacacggaccgagacctggatgtcatccgagggtgcctggaagcaaattcagcgggtcgagacctgggccctgcgtcaccccgggttcactgtgatcgctctgttcctcgcgcatgccataggaacctcaattacgcaaaaggggatcatcttcatactgctgatgctcgtcaccccctccatggccatgcgctgcgtcggcatcgggaaccgggacttcgtagagggcctgagcggcgccacgtgggtggacgtcgtgctggaacacgggtcctgcgtgaccaccatggccaagaacaaacccaccctggatatagagttgctgaaaacggaggtgaccaaccctgcgatcctccgtaagctgtgtatcgaagccaaaatcagcaacaccaccacggactccagatgcccaacccagggcgaagccacactggtggaggagcaggacgcgaacttcgtctgccgccggaccttcgtcgaccgcggctggggaaacggctgcggcttatttggtaagggatctctgctgacgtgtgccaagtttaagtgcgtgactaagctcgagggcaagatcgtccagtacgagaacctgaagtactccgtcatcgtcaccgtacacaccggcgatcagcatcaagtggggaacgagacaacagaacacggcaccattgcgactataactccccaggcacccactagcgagatacagttgaccgactatggggccctcaccctggactgcagtccgaggacaggtcttgacttcaacgagatggttctcctgacgatgaaggaaaagtcctggcttgtccacaaacagtggttcctagacctgcccctgccctggacctccggggccagcacctctcaggagacctggaatcgccaggacctgttggttaccttcaagactgcgcatgcgaagaagcaggaggtggtcgtgctgggctcccaggaaggagccatgcataccgccctcaccggggccactgagattcagacctccggcaccaccacgatctttgcagggcacctcaagtgccggctgaagatggacaagctaaccctgaagggcacatcgtacgtgatgtgtacggggagcttcaagctagagaaggaggtagcggaaacgcagcatggcactgtcctggtgcaggtcaagtatgagggcaccgacgccccctgcaagatacccttcagtacccagaatgagaagggggtgacgcagaacggtcgcctcatcacagccaacccgatcgtcaccgacaaggagaagcccgtaaacattgagaccgagccgccgttcggggagagctacatagttgtgggggccggcgagaaggcgctgaaactgtcctggttcaagaaggggagctccatcggcaagatgttcgaggcaacggcacgcggggccagacggatggccatcctcggggataccgcgtgggactttggaagcatcggcggagtgtttacctccgtggggaaactggtgcaccaggtcttcggcactgcctacggggtgctgttcagcggcgtgtcctggactatgaagatcgggattgggatcctgctgacctggctgggcctcaacagccggtccactagcctgtccatgacctgcatcgccgtcgggatggtcacgttataccttggcgttatggtgcaagcagacagcgggtgcgtgatcaactggaagggcagggagctgaagtgcgggtccggcatcttcgtgaccaacgaggttcacacctggaccgaacagtacaagtttcaggccgactccccgaagcggcttagcgcagccatcggcaaggcctgggaggagggggtgtgcggaatcagatctgccacccggcttgaaaacatcatgtggaagcagatctcgaacgagctgaaccatatcttactcgagaacgacatgaagtttacggtggtggtgggcgacgccaacggcatcctggcgcagggtaagaagatgatcaggccgcagcccatggagcacaagtactcttggaagagctgggggaaggccaagatcataggcgccgacatccagaacactaccttcatcatcgatgggcccgacacccctgagtgccccgacaaccagcgggcctggaatatatgggaagtggaggactacgggttcgggatattcacgaccaacatctggctaaagctccgggattcctacacccagatgtgcgatcaccgtttgatgagcgcggccatcaaggactcgaaagccgttcacgccgatatgggctactggatcgagagtgagaagaatgaaacctggaagctggagcgcgcctccttcatagaggtgaagacgtgtacctggcctaagagccacaccctctggtccaacggcgtgctggagagcgagatgataatacctaagatctacggtggccccatctcccagcataattaccggcccgggtacttcacccagaccgcggggccctggcaccttgggaaactcgaactggacttcgatctttgcgagggcaccaccgtcgtggtggatgaacactgtggtaaccgcgggcctagcctacgaactaccactgtcaccggcaagatcatccacgagtggtgttgtcgctcctgcaccctgccgcccttgaggttccgcggggaggacggctgctggtacggaatggagattcggcccgtgaaggagaaggaagagaaccttgtccgttcgatggtctccgctggtagtggtgaggtagactcgttctctctggggatcctatgcgcctctattatgatcgaagaggtgatgagaagccgctggagccggaaaatgttgatgacgggcaccctggccgtatttctgttactgatcatggggcagctgacctggaatgacctcatacgcctgtgcatcatggtgggtgccaacgcctcagataggatggggatgggcaccacgtacctggccctaatggccaccttcaagatgcggccgatgttcgccgtcggtctgctgttcaggcggctgacctctcgtgaggtcttattactgaccatcgggctgtccctggtggccagcgtcgagctccctaactccttagaggaattgggcgatgggctggcgatgggcattatgatgctgaaactgctcacggagtttcagccccaccagctgtggactaccctgctcagcctgaccttcatcaagacaaccctttccctcgactacgcatggaagaccacggccatggccctgagcatcgtctccctgtttccactctgtctctcaacgaccagtcagaagaccacctggctgccggtgctcctgggcagcttcgggtgtaagcccctgaccatgttcctcatcaccgagaacaaaatctggggcaggaagtcctggcccctgaacgaaggcatcatggcaattggcatagtcagcatcctgctcagtagcctgctgaagaacgacgtgccgttagccgggccgctaatcgccggcggtatgctgatcgcctgctacgtcatcagcgggtccagcgcggatctctccctggagaaagcggctgaggtcagctgggaacaggaggctgaacactcaggcacctcccacaacatcttggtggaggtgcaagacgatggcactatgaaaatcaaggacgaggaacgcgacgacaccctcacgatactgctaaaggccaccctcctagcagtctccggcgtgtaccccatgagtatccccgctacactgttcgtttggtacttctggcaaaaacggaagcagcgctccggggttctctgggacaccccctcgcctccagaagtggagcgtgccgtcctggacgacgggatctaccgtatcctacagagaggcctcttggggcgatcacaggtaggcgtgggggtgttccaggacggggttttccacacgatgtggcacgtcacgcgcggggccgtcctgatgtaccagggcaagcgcctggagcccagttgggccagtgtcaagaaggacctcatcagctacggcgggggctggcgatttcagggcagctggaataccggagaggaggtccaggtgatcgcggtcgagcccgggaagaatccgaagaatgttcaaaccacgcccggcaccttcaagacgcccgagggcgaggtgggagcgatcgccctggactttaagcccggcaccagcggttctcctatagttaacagggagggcaagattgtgggcctgtacgggaacggcgtggtcacgacctctggaacctacgtgagtgccatcgctcaggccaaggcttcgcaggagggccccctgcccgagatcgaggacgaggtgtttaagaagcggaaccttaccatcatggacctgcacccggggagtggcaagactcgcaggtacctccccgctatcgttcgcgaggccatcaagagaaagctgcgcacgctgatcctagctcccacccgggtagtggcgtccgagatggccgaggcactgaaaggcatgccgatacggtatcaaaccacggccgtcaagagcgagcacaccgggcgcgaaatagtggacctcatgtgccacgccaccttcaccatgcggctcctgagcccggtgagagtaccaaactacaacatgatcatcatggacgaggcgcacttcacggaccccgccagcattgccgccagaggctatatctccacacgtgtgggaatgggtgaggccgcggccatcttcatgaccgcgacgccgcccggcagcgtggaggccttcccccagtccaacgcggtcatacaggacgaggagcgggacataccagagcggagctggaacagcggctacgactggattacggactttcctggcaaaaccgtgtggtttgtgcccagtatcaaaagcgggaacgacatcgccaactgcttgcgcaagaatggcaaacgcgtaattcagctcagccgcaagacgttcgacacggagtatcaaaaaacgaagaacaacgattgggactacgtcgtgacgaccgacatatcagagatgggggcaaacttccgcgccgatcgtgttattgacccacgccggtgcctgaagcccgtgatattgaaggacggccccgagagggtgatccttgccgggccaatgcccgtcaccgtggcaagcgcggcccagcggcgcggccggatcggccgcaaccaaaacaaggagggtgaccaatacgtgtacatgggccagcctttgaacaacgatgaagatcacgcccactggacggaggccaagatgctgctggacaacataaacacccctgaggggatcatcccggccttattcgagcccgagcgtgagaagtccgcggccatagacggagagtatcggctgcgcggggaggcgcggaagacctttgttgagctaatgcgcaggggcgacctgcccgtatggctgagctacaaggtcgcctccgaaggcttccagtactctgaccgcaggtggtgctttgacggggagcgcaacaaccaagtgctcgaggagaatatggacgtagagatctggaccaaggagggcgagcggaaaaagctgcgcccccggtggctggatgcgcgcacctattccgaccccctcgcgctgcgggagttcaaagaattcgccgccgggcgccggtccgtcagcggcgacctgatcctcgaaatcggcaagctgcctcagcaccttacgttacgcgcgcagaacgcactggacaacctggtgatgctccacaactccgagcagggcgggaaggcctaccggcacgcgatggaggagctccccgacactatcgagaccctgatgctcctggccctgatcgcggttctcaccgggggcgtcacgctgttcttcctgtccgggaagggcctcggcaaaacctctatagggctgctgtgcgtaaccgccagttcagccctcctgtggatggcaagcgtggagccccattggatcgcggcaagtatcatcctggaattctttctcatggtcctgctcatcccggagccggatcgccaacggacgccccaggataaccagctcgcctacgtggtgatcggcctcctgttcatgatcctcacggtcgcggctaacgaaatgggcctcctggagaccaccaagaaggatctcggcatcgggcacgtcgctgcggagaatcaccagcacgcgaccatgctggacgtggacctgcgcccagccagcgcctggacactctacgcagtagcgaccacagtgatcacgcccatgatgcggcacacgatcgagaatacgaccgccaacatctccctcacggctatcgcgaatcaggctgcgatcctgatgggcctcgacaagggctggcccatcagcaaaatggacataggtgttcccctgctggcgcttgggtgctactcccaggtcaacccgctgacgctgaccgccgccgtgctcatgctggtggcgcactacgcaatcattgggcctggcctgcaggccaaggctaccagagaggcccagaagcgcaccgcggccggaatcatgaagaaccccacggtcgacggcatagtggccatcgacctagaccccgtggtatacgacgccaagttcgagaagcaacttggccagatcatgctcctcatcctgtgcaccagccagatccttctgatgcggaccacttgggcgctgtgtgagtccataacgctggcgaccggaccgctcacaacgctctgggagggaagccccggaaagttctggaatactaccatcgccgtaagtatggccaacatcttccgcggcagctacctggccggtgccggactcgcgttctccctgatgaagtctctgggcgggggccggcgcgggaccggcgcccagggtgagaccctcggcgaaaagtggaaacgtcagcttaaccagctttccaagagcgagttcaacacgtacaagcgctccgggatcatggaggtcgaccggtccgaagcgaaggaggggctgaagcgcggggagaccaccaagcacgccgtcagccgtgggaccgcgaagctacgctggttcgtagagcggaacctggtcaagcccgagggcaaggtcatcgacctgggctgcgggcggggcgggtggtcctactattgcgccggcctaaagaaggtgactgaggtgaaggggtacacgaaaggcggccccgggcacgaagagcccatcccgatggccacctatggctggaatctggtcaagctccacagcgggaaagacgtgttctttatgccgcccgagaagtgcgataccctgttgtgcgatatcggcgagtcctcccctaaccccaccatcgaggaggggcggacgctgcgcgtgctaaagatggtcgagccctggctacgtggtaaccagttttgcatcaagatcctgaacccctacatgccgtccgtggtggagacgctcgagcagatgcagcgcaagcacggcggcatgctagtgcgtaaccccttgagccgaaactccacgcacgagatgtactgggtgagctgtggtaccgggaacatcgtgtcggctgtcaacatgacatcccggatgttactgaaccgcttcacaatggcccaccgcaagcccactttcgagagagacgtggacttaggcgcgggaacccgccacgtggccgtggaacccgaggtggccaacctcgacatcatcgggcagcggattgagaacattaagaacgagcataagtccacgtggcattacgacgaagacaacccatacaagacctgggcctaccacggcagctatgaggtaaaacccagcggaagcgcctctagcatggtcaacggcgtggtgcgcctgctgacaaagccctgggacgtgattcccatggtgacccagatcgcgatgactgacacgaccccgttcggccagcaacgagtcttcaaggagaaggtggacacccgtacgccccgggccaagcgcggaaccacccaaatcatggaggtgaccgccaagtggctctggggattcctgtcccgtaacaagaagccccgaatctgcaccagggaggagttcacccgtaaggtccggagcaacgcagccatcggtgcggtcttcgtggacgagaaccagtggaacagcgcaaaggaggcagttgaggacgagcgcttctgggacctggtacatagagagcgcgaactacacaagcaaggcaagtgcgcgacctgtgtgtacaacatgatggggaagcgggagaagaagctgggcgagttcggtaaggcgaaaggctcccgcgccatctggtacatgtggctgggcgctcggttcctcgagttcgaggctcttgggttcatgaacgaggatcactggttttcgcgggagaactccttatcaggcgtggaaggggagggtctccacaagctggggtacatcttgcgggacatctccaagatcccgggtggcaacatgtacgccgacgacaccgcggggtgggacacgcgcatcaccgaagacgacctccagaacgaagccaagatcaccgacatcatggagccggagcacgccctattagccacctcgatcttcaaactcacgtaccagaacaaggtggtgcgtgtccagcggccagccaagaacggcacagtgatggacgtgatatcccgacgcgaccagcggggaagcggccaggtcggcacctacggtcttaacaccttcacgaacatggaggtgcagctcatcagacaaatggagagcgagggaatctttctccccagcgagctggaaacaccgaacctcgccgagagagtgctcgactggctggagaaacacggggccgagcggctgaagcgcatggccatttccggcgatgactgcgtcgtgaaacccatagacgaccggttcgcgaccgccttaaccgcgttaaacgacatgggcaaggtgcgcaaagacatcccacagtgggagccctcgaagggctggaacgactggcagcaagtacctttctgctcccaccatttccaccagttgatcatgaaggacggccgggaaatagtggtgccctgcagaaaccaagacgagctcgtcgggagggcccgcgtaagccagggcgccgggtggtcgctgcgggaaacagcctgtcttggcaagagctatgcccagatgtggcagttgatgtacttccacaggcgggacttgcgcctagcggccaacgccatctgctccgccgtgcccgtcgactgggtacccacgagccggaccacttggagcatccacgcgcaccatcagtggatgaccacggaggatatgctctccgtgtggaaccgcgtatggattgaagaaaatccgtggatggaggataaaacccatgtatcgagttgggaagaagtgccctatctggggaaacgcgaggaccaatggtgtgggagcctgatcggattgaccgcccgggccacgtgggccacgaacatacaggtcgccattaatcaagtgagacggctgatcgggaacgagaactatctcgactacatgacctccatgaagcgctttaaaaacgagagcgaccccgagggcgccctctggtga

SEQ ID NO: 23876 - RNA, 9879 nt, synthetic construct
  misc_feature 1..9879: note = derived and/or modified CDS sequence (opt11) from DENV-1__GQ868506__SS-prME
  source 1..9879: mol_type = other RNA
agtgtcacaatgttactcatgttactgccgaccgccctcgccttccacctgaccacccgggggggggaaccgcacatgatcgtgagcaaacaggagcggggcaagagcctcctgttcaagacgagcgctggggtgaacatgtgtacactgatcgccatggaccttggagaattatgcgaggacaccatgacctacaagtgtccccagattaccgaggccgagcccgatgacgtagactgttggtgtaatgcgacggacacctgggtcacctacgggacatgctcccagactggcgagcatcgccgggacaaacgctcggtggcccttgccccccatgtgggccttgggctcgagacgcggaccgaaacctggatgagctccgagggcgcctggaagcagatccagcgggtcgagacttgggctttgcggcacccagggttcacggtgatagcgttcttcctggcgcacgccataggcaccagtatcacgcagaagggcatcatcttcattcttctgatgctggtgaccccctccatggccatgcgttgcgtcggcatcgggaaccgggacttcgtggagggtttaagcggggcgacgtgggtagacgtcgtgttggagcacgggagctgcgtgaccaccatggccaagaacaagccaaccctggacatcgagctcctgaagactgaggtcaccaatcccgcgatccttcgcaagctctgcattgaggccaagatcagcaacaccacaacggatagtcggtgccccacccagggcgaggccaccctggtggaggagcaggacgccaatttcgtgtgccgtcggaccttcgtcgaccgcggctggggaaacggctgcgggctgttcgggaaggggtctctcctgacttgcgccaagttcaagtgcgtgaccaagcttgagggcaagatcgtgcagtatgagaacctcaagtacagtgtgatcgtaactgtccacaccggcgaccagcaccaggtggggaacgagacgactgagcatggcaccatcgcgacgattacgccccaggcacccacgtcagagatccagctgacggattacggggccctgaccctggactgtagtccccggacagggctcgacttcaacgagatggtactgttgacgatgaaggagaagtcctggctggtccacaagcagtggttccttgatctaccgctgccctggacctccggggccagcaccagccaggagacttggaaccgccaggacctgctcgtgacgttcaagactgcccacgctaaaaagcaggaggtcgtcgtactgggctcccaggagggcgccatgcacacggcgctgaccggagccactgaaatccagacgtctggcaccaccacgatcttcgccggacatctaaagtgccggctaaaaatggacaagctgacacttaaaggcacctcttacgtgatgtgcacggggagcttcaagctggagaaggaggtagcggagacgcagcacggcactgtgctggtgcaggtaaagtacgagggcaccgacgccccctgtaaaatccccttttcaacccaggacgagaaaggggttacgcaaaacgggcgcttgatcactgccaaccctatcgtgaccgacaaagaaaagcccgtgaacattgagacggagccgcccttcggggagtcctacatcgtcgtgggggccggcgagaaggcgctcaagctgtcctggttcaagaaggggagctccatcggcaaaatgttcgaggcaacggcccgcggggcgcgtcgaatggccatactgggcgataccgcctgggatttcgggagcatcggcggtgtgttcacctccgtgggcaagctcgtgcaccaggtcttcggcaccgcctacggggtgctgttcagtggcgtctcttggaccatgaaaatcgggatcggcatccttctcacgtggctcggcctgaacagccgctccaccagtctctccatgacctgtattgccgttgggatggtgacactgtacctgggcgtgatggtgcaggcagacagcgggtgcgtgatcaactggaaggggcgcgagctcaagtgtggctccgggatcttcgtgacgaacgaagtccacacctggaccgagcagtacaagtttcaggctgacagcccgaagcggctctcggctgccataggcaaagcttgggaggaaggggtgtgtggcatccgatccgcaacccgcctagagaacataatgtggaagcagatcagcaacgagctcaaccacatactgttggagaacgacatgaagtttacggtggtagtgggggatgccaacggcatcctcgcgcaggggaagaagatgattcgcccccaacctatggagcacaagtacagttggaagtcttggggcaaggccaagatcatcggcgccgacatccagaataccaccttcataatcgacggccccgacaccccggaatgcccagacaaccaacgggcctggaacatctgggaggtggaggactacggctttgggatcttcacgaccaacatctggctgaagctgcgcgactcctacacccagatgtgcgaccacagactcatgtccgcggccatcaaggattctaaggcagtgcacgccgatatggggtactggatcgagagcgagaagaatgagacctggaaactggctcgcgcgtccttcattgaggtaaagacatgcacctggcctaagagccataccctgtggtcgaacggcgtgctagagagtgagatgatcatccccaaaatctacgggggccctatatcccagcacaactatcggccagggtacttcacgcaaacggccggcccctggcacctggggaaactagagctcgactttgatttgtgcgagggtacgaccgtcgtggtagacgagcactgtggcaacagagggccgagtctgcggacaacgaccgtcaccggcaagatcatccacgagtggtgctgccgctcgtgcacccttccgcccctgcggttccgtggggaggacggctgctggtacgggatggagatccgacctgtgaaggagaaggaggagaaccttgtgcgtagcatggtttccgccggctcgggcgaggtcgacagcttctctctcgggatcctttgcgtgtccataatgatcgaagaggttatgcggtcccggtggagccggaagatgctgatgacgggcaccctcgccgtattcctgttacttgtgatggggcagctgacatggaacgacctaatccgtctctgcatcatggtcggcgcgaatgcgtccgatcgcatgggaatgggcacaacgtaccttgctttgatggcaacattcaagatgcgtccgatgttcgctgtgggcctgctgtttcgcagactgaccagccgcgaggtactcttgctgaccatcgggctcagtttggtagcctccgtggaactgcctaactcactagaggagctgggcgatgggctggctatgggcatcatgatgctcaaactgctaacggagttccagccgcaccagctctggacgactctcctgagcctcaccttcatcaagacgaccttatccctggactacgcctggaaaaccactgccatggccctgtcaatcgtctccctatttccactgtgcctcagcacgacctcccagaagaccacctggctgccagtgttgctgggcagcttcgggtgcaagcccctcaccatgttcctgatcacggagaacaagatctggggccggaagtcatggcccctcaacgagggcatcatggcaatcggcatcgtgtcaatcctcctgtctagccttctgaagaacgacgtaccgctggccgggccgctgatcgccggcgggatgctaatcgcctgctacgtgatcagcgggtccagcgccgatctgtctttagaaaaagcggcagaggttagctgggagcaagaggctgagcactcaggcactagccacaacatactggtagaagtgcaggacgacgggaccatgaagatcaaggacgaggagcgcgacgacaccctgaccatactcctgaaggccaccctgctagccgtaagtggtgtctaccccatgtcgatcccagcgaccctgtttgtatggtacttctggcagaagaagaagcagcggtcaggggtgttgtgggatacgcccagcccgcctgaggttgagagagccgtactcgatgacggcatctaccgtatactgcagcgaggcctactagggcggtctcaggtgggcgtcggggtcttccaggacggcgtgttccatacgatgtggcacgttacccgcggcgccgtgctcatgtaccagggcaagagattggagcccagctgggcctccgtgaagaaggacctgatcagctacgggggaggttggcgcttccaggggtcctggaacacgggggaggaggtccaagttatcgccgtggaacccgggaagaatccgaagaacgtgcagaccacgcccggcaccttcaagacccccgaaggtgaggtgggcgcgatcgccctcgacttcaagccgggaaccagcggatccccgatcgtcaaccgggagggcaagatcgtcggactctatgggaacggcgtggttacaacgagcgggacctacgtttccgccatcgctcaggccaaggcgagccaagagggccccctgccggagatcgaggacgaggtattcaaaaaacgcaacctcaccatcatggacctccacccagggagcggcaagacgcgacgctacctgcccgctatagtacgggaagccattaagcgaaaactaaggacccttatcttagcccccacccgagtcgtggcctcagaaatggcggaggccctcaagggaatgcccatacgataccagaccacagccgtcaaatcagagcacaccgggagagagattgtcgacctgatgtgccacgccacattcaccatgcgtctgctttctccgggccgggtacccaattacaacatgatcatcatggacgaggcgcatttcacagaccccgcctctatcgccgctcgcggatacatctccacacgcgtgggcatgggggaagccgcggccatcttcatgaccgccacccctcccggctctgtcgaggccttcccccagtccaacgccgtgatccaggatgaggagcgcgacatccccgagcggagctggaactccggttatgactggatcacggactttcccgggaaaaccgtgtggttcgtcccgagcatcaaatccggaaatgacatcgcgaactgcctgcgaaagaacgggaagcgagtgatacagctgagccgcaagacttttgacaccgagtaccagaaaacaaagaataatgactgggactacgtggtcaccacagacatttcggagatgggcgccaacttccgggccgaccgcgtgatcgacccccggcgctgcctcaagcccgtgatcctgaaggacggccccgagcgggtcatcctggccggcccgatgcccgtgacagtggcgagcgccgcccagcgccggggccgcatcgggcggaaccagaacaaggaaggcgaccagtacgtctacatgggtcagcccctgaacaatgatgaggaccacgcccactggaccgaggcgaagatgctgctagacaatatcaacacccccgaggggataatccctgcccttttcgagccagagcgcgaaaagtccgccgccatcgacggcgagtatcgtctgcggggggaagccagaaagacctttgtggagctgatgcggcgcggcgacctacccgtgtggttaagctacaaggtggcctccgaggggtttcagtacagcgatcggcggtggtgcttcgatggcgagcggaataaccaagtgctcgaagagaacatggacgttgagatctggaccaaggagggggaacgcaagaagctacggcctagatggctggacgcgcggacctactccgacccgctggccctgcgcgagttcaaagagttcgccgccggccgtcggagcgtgagcggcgacctcatacttgagatcgggaagctgccccagcaccttaccctgcgggcacagaacgcccttgacaacctagtgatgctgcacaactctgaacaaggcgggaaggcctaccgacacgcgatggaggaactccccgataccatagagacgctgatgctgttggcccttattgcggtcctgaccgggggggtgaccttattcttcctgagcggcaagggcctcgggaagaccagtatcggcctcctgtgcgtgaccgcctcctccgccctgttatggatggcctcagtcgagccccactggatcgccgcgtccatcattctggagttcttcctgatggtgctcctcatcccggagcccgaccggcaacgcacgcctcaggacaaccagttggcctacgtggtcatcgggttactgttcatgatactgacggtggccgccaacgagatgggcctccttgagaccaccaagaaggacctggggatcggccacgtggcagcggaaaaccaccagcacgccaccatgttagacgtcgacctgcggccggcttcggcctggaccctgtacgccgttgcgacgaccgtcatcacgcccatgatgcggcacactatcgagaatacgacggcgaacatttccctcaccgcaatagcgaaccaggccgcgattctgatgggcctcgacaaggggtggcccatcagcaagatggacataggcgttcccctcttggccctgggctgctactcccaggttaacccgctcacgcttacggccgccgttctgatgctcgtcgcgcactacgccatcattggcccagggcttcaggccaaggccacgcgggaggcacagaaacggaccgctgccggtatcatgaagaacccaacggtcgacggcatcgtggccatcgacctggacccagtcgtgtacgacgccaagttcgagaaacaactcgggcaaatcatgcttctgatcttgtgcactagccagatcctgctcatgcgtacgacgtgggccctgtgcgagtccatcacgctggcgaccggacctttgaccacgctctgggaggggagccctggcaagttttggaacacgacaatcgccgtatccatggccaacatcttccggggcagctacctggccggtgccggcctggcgttctccctcatgaagtccctcgggggcggacgccggggtaccggcgcccagggggagactctcggcgagaagtggaagcgccagctaaaccagctgtcgaaaagcgagttcaatacgtacaagcggagcggaatcatggaggtcgaccgctccgaagcgaaggaaggcctgaagcgcggggagaccacgaagcacgccgtgagtcgcggaaccgcgaagctccggtggttcgtggaaagaaacctggtcaagcccgagggcaaggtgatcgacttagggtgcggcagaggtggctggtcctattactgcgcggggctgaagaaagtgactgaggttaaagggtacacaaagggcggcccgggccacgaggaaccgatccccatggccacatatgggtggaacttggtcaagctgcactcaggtaaggacgttttcttcatgccgcccgagaaatgcgataccctcctctgcgacatcggggagtccagcccgaaccccaccatcgaagaggggcgcacgctgcgggttctgaagatggtggagccgtggctccgcggcaaccagttttgcattaagatcctgaatccctacatgccgagcgtggtcgaagccctggagcagatgcagcggaaacacggtggcatgctcgtacgcaaccccctgtcgcggaactccacacacgagatgtactgggtgagctgtgggaccggcaatattgtttctgccgtcaacatgaccagccgcatgctactcaaccgcttcacgatggcgcaccgcaaacccacctacgagcgcgacgttgatttaggcgccgggaccagacacgtcgccgtggaacccgaggtggccaaccttgacataatcggccagcggatcgaaaacatcaagaacgagcacaagtccacctggcactatgacgaggacaatccgtataagacgtgggcgtaccacggcagctacgaagtaaagccctccggctccgcgagcagcatggtgaacggggtggtccgcctcctgaccaaaccctgggatgtgatacctatggtcacacaaatagcaatgaccgacacgaccccattcggacagcagagggtattcaaggagaaggtggacactcgcacgcccagggccaagcggggcacgacgcagatcatggaggtaaccgccaagtggctgtggggattcctctccagaaataagaagccccggatttgcacgcgcgaggagttcacgcggaaggtgcgctctaacgctgcgatcggcgccgttttcgtcgacgaaaaccagtggaatagcgccaaggaggccgtggaggacgagcggttctgggacttggtgcaccgagagcgggagctgcataagcaagggaagtgcgcgacctgcgtctataacatgatgggcaagcgcgagaagaaactcggggagttcggcaaggccaagggctccagggccatatggtacatgtggctgggcgcgagattcctggagttcgaggcactcggttttatgaacgaggaccactggttctcgcgggagaactccctgagtggggtggaaggggaggggctgcacaagctgggctacattctgcgcgacatatccaagatcccggggggcaacatgtacgcggacgacaccgcaggatgggacacccgcatcacggaggacgaccttcaaaacgaggccaagattaccgagatcatggagcccgagcacgccctactcgccaccagcatcttcaaactcacataccaaaacaaggtcgtccgcgtccagcgccccgctaaaaatgggacggtgatggatgtgatatcccggcgagaccaacggggttccggacaggttgggacctatggtctcaacaccttcaccaacatggaagttcagctgatccgccagatggagtccgaagggatattcctgcccagcgagctcgagacgccgaacctggccgagcgcgttctggattggctagagaagcacggcgccgaacgcttaaagcggatggccatctcgggggacgactgcgtggtaaagccaatcgacgaccgcttcgccacagctctgaccgccctcaatgacatgggcaaggtacggaaggacatcccccagtgggaacccagcaagggctggaacgactggcagcaggtccccttctgttcccaccacttccatcagttgatcatgaaggacgggagagagatcgttgtcccttgccggaatcaggacgagctggttggccgcgctcgtgtgagccagggggccggctggtccctccgggagacagcctgcctgggcaaatcctatgcgcagatgtggcagctgatgtacttccacagaagagacctccggctggcagccaacgccatttgctccgcggtcccagtagactgggtgcccaccagccgcacgacctggagcatccatgcccaccaccagtggatgaccacggaggacatgctgtccgtctggaatcgcgtgtggatagaggagaacccctggatggaggacaagacgcacgtttcttcctgggaggaagttccctacctcggcaagcgcgaggaccagtggtgtggcagcctgattgggctgacggcgcgcgcgacctgggccactaacatccaagtcgcgatcaatcaggtgcggcgcctcatcggcaacgagaactatctggactacatgacgtccatgaagcggttcaagaacgagagcgaccccgagggggccctgtggtaa

SEQ ID NO: 23877 - RNA, 9879 nt, synthetic construct
  misc_feature 1..9879: note = derived and/or modified CDS sequence (opt11) from DENV-1__GQ868507__SS-prME
  source 1..9879: mol_type = other RNA
agcgtgaccatgctactgatgctactacccacagccctggcatttcacctaacaactcgaggcggggaaccccacatgatagttagtaaacaggaacgcgggaaaagtctgctattcaagaccagtgctggggtcaacatgtgcacattaatcgctatggacctcggcgaactctgcgaagacacgatgacctacaagtgtccccaaataaccgaagcagaacccgacgacgtggattgttggtgcaacgctacggacacgtgggttacttatggaacctgctcccaaacaggggaacataggcgggacaagcgatcggttgccctggcaccacacgtaggactcggactagaaacgcgcaccgaaacatggatgtccagcgaaggcgcttggaagcaaatccaaagggtagaaacctgggcactccgacaccccgggttcacagttatcgcgctattcttagcacacgctatcggtacgtcgataacccagaagggaatcatattcatacttctgatgctggtaactccaagtatggcaatgcggtgtgtcggtataggaaatcgagacttcgtggaaggcctctccggcgcgacctgggtcgacgtagtgctagaacacggctcctgtgtcaccacgatggcaaagaacaagccgacgctcgatatagaactattgaagaccgaagtgacgaatcccgcgatcctgaggaaactgtgcatcgaagcgaaaataagcaacacgacgacggacagccgctgccccacccagggggaggcaacacttgtcgaagaacaagatgccaactttgtatgtcgtcggacattcgtagatagaggatgggggaatggctgcggactattcggaaaaggcagcctcctaacgtgcgccaagttcaagtgcgtaaccaagctagaaggtaaaatcgtgcaatacgaaaatctgaagtacagcgtgatagtaacagtacacacgggagatcagcaccaagtgggaaatgaaacaactgaacacgggacgatcgcgacaataactccacaagcccccaccagcgagatacaactcacggactacggggccctgacccttgactgttcacccagaacaggactagactttaatgaaatggtgttgctaaccatgaaggagaaatcctggctggttcacaaacaatggttcctcgacttgcccctaccatggacatcaggggcctccacaagccaagagacatggaacagacaagacttactggtgacattcaaaaccgcacatgccaagaaacaagaggttgtagtcctcggaagccaggaaggcgcaatgcatacggctctcaccggcgccaccgagatacaaacttcaggcacgaccacaatcttcgctggccacttgaagtgccgattaaaaatggacaagctcacgttaaaaggcacctcctacgtcatgtgcactgggagctttaaactcgaaaaagaggttgcagaaacacagcacggaacagtgcttgtccaggtgaagtatgagggtaccgacgccccatgcaaaataccattcagtacccaggatgaaaaaggagtcacgcaaaacggcaggctaatcacggcaaacccaatagtgactgataaagagaaacccgttaacatcgaaacagaaccacccttcggtgaatcctacattgttgtgggcgcgggtgaaaaggctctaaaactgtcgtggttcaagaagggaagcagcattggcaaaatgtttgaggcaacagcccgaggggcgcgtcgaatggcaatcctgggggacacggcgtgggatttcggcagcatcggcggtgtattcacctccgtcggtaagctcgtccaccaagtattcggaacagcctatggggtcctgttctcgggtgttagctggacgatgaaaattggaattggcatcctgctcacgtggctggggctgaactcccgctcaacgagcctctccatgacatgcatcgcggtcggcatggtgacgttatatctaggcgtgatggtacaagcagactctggatgcgtaatcaactggaaaggccgggagctcaaatgcggcagcggaatttttgtcacaaacgaagtgcatacttggacagagcaatataaattccaagctgattcaccaaaacggctatccgctgccattggtaaggcgtgggaagagggcgtgtgcggaatacgcagtgccacgaggctcgaaaacataatgtggaagcaaataagtaacgagttaaaccacatactgctggagaacgacatgaaattcaccgtggtggttggagacgccaacggaatactagcacagggcaagaaaatgattcgaccacagccgatggaacacaaatactcctggaaatcctggggcaaagccaaaataataggtgcagacatacaaaacacaaccttcataatcgacgggccggacacaccggagtgccctgacaaccaacgcgcctggaacatctgggaagtggaggattacggtttcggcatctttacaacaaacatttggttgaaacttcgcgacagttacacccaaatgtgtgaccaccggttaatgtcggccgccataaaagactcgaaggcggtgcatgcagacatgggatactggatcgaatccgagaagaacgaaacatggaagttagcgcgggcatcctttatcgaagtcaagacatgcacatggcccaaatctcacacgctctggagcaacggtgtattagagtccgaaatgataatcccgaaaatctatggagggcccatcagccaacacaactatcgcccagggtacttcacccaaacggccggcccctggcacctcggcaaactcgaactagatttcgatctgtgcgagggcacgacagtcgtcgtagacgaacactgcgggaatagaggacccagcttacggacgacaacagtcacgggcaagattatccacgaatggtgctgtagatcatgcacattgcctccacttagattcagaggggaagacggctgctggtacggtatggaaatcagaccagtaaaggaaaaagaagaaaatctggtgcgctccatggtaagcgcaggctcgggcgaagtagacagtttctccctcggaatcctctgtgccagcataatgatagaagaagtaatgaggagccgatggagcaggaaaatgttgatgaccggaaccctcgccgtattcttgctcctagtaatggggcagctaacatggaatgatctcatacggctgtgcataatggtgggtgcaaacgcgtcggacagaatgggaatggggacgacgtacctagcactgatggcgacgttcaagatgcgaccaatgttcgcagtcggcctactcttccgacgcctaacaagccgggaagtgctcctcctcaccataggattaagcctcgtcgcctcggttgagctgccgaacagcctcgaggagctaggagatgggctagccatggggataatgatgctgaagctactcaccgagttccagccccaccaactctggattaccctacttagcctaacattcatcaaaacgacactgagcctcgactatgcgtggaagaccacagcgatggcgttaagcatagtgtcactgttcccgctgtgcctatcaaccacttcgcagaaaacaacctggcttccagtactgctcggcagctttggttgtaagcccttgacaatgtttcttatcacggagaacaaaatctgggggagaaagtcttggcctctcaacgaaggcatcatggccatagggatcgtaagcatactactctcatccctactaaagaatgatgttcccttagcgggccctctcatcgcgggaggtatgttgatagcctgttacgtgatatccgggtcaagcgccgatctctccctggagaaggcggcagaagtgtcctgggaacaagaagccgagcattccggtaccagtcataacattctcgtggaggtccaagatgacggaaccatgaagatcaaggacgaagaacgggatgatacactcacaatactactaaaggccactctcctcgccgtcagcggcgtgtaccccatgagcattccggcaaccctctttgtctggtacttttggcaaaagaagaaacaacgcagcggagtgttatgggacacgccgtccccgcccgaagtagagagagcagtgctcgacgacggcatctaccgcatcctccaacgaggactgctgggaagatctcaggtgggcgtcggggtgttccaagacggcgtgttccatacaatgtggcacgtcaccaggggagcagttctgatgtaccaaggcaaacgcctagagcctagctgggcgtcagtaaagaaagacctaatatcatatggaggtggatggagattccagggttcatggaacacgggagaagaagtacaggtaatcgctgtagaacccggaaagaatcccaagaacgttcagacaatgccagggacgttcaagactccggaaggtgaggtcggggcaatcgccctagacttcaagccgggaacaagtggttctcccatcgtaaaccgggaggggaaaatagttggcctatacggcaacggagtcgtgacgacaagtggaacatacgtaagcgcaatcgcgcaagcgaaagcgtcacaagaaggccccctgccagagatcgaagacgaagtatttaagaaacgcaacctcacaattatggacctccatccgggcagtggaaaaaccagaagatacctcccggcaatggtgcgcgaagccataaaaagaaagttgagaaccctaatactggcgcctacccgtgtagtagcctctgagatggcagaagcactgaaaggaatgccgatccggtaccagacgacggccgtcaagtcggaacacacgggacgggaaatagtcgatctgatgtgccacgctacgtttaccatgcggctgctttcccccgtgcgagtccccaactataacatgataataatggacgaagcacactttacggaccccgccagcattgcagcccgtgggtacataagcacaagggtaggcatgggcgaggcagctgcaatcttcatgacagccaccccgccaggcagtgtagaagcattcccccaaagcaatgccgtaatacaagacgaagaaagagacatcccggagaggagctggaactcaggatacgactggatcactgatttcccggggaaaacagtatggtttgtaccctccataaagtcaggcaacgatatcgccaattgcctgcgcaaaaacgggaagcgcgtaatccaactgtcaaggaaaactttcgacaccgaataccagaaaaccaaaaacaacgattgggactatgtcgtcacaaccgacatatcggaaatgggcgccaacttccgggcagatcgagtcattgatccgcgaaggtgcttaaaaccagtgatacttaaagacggccccgaacgggtaatcctggcgggtccgatgccagtaacggtcgccagcgcagcccaacgacggggccgaatagggcgaaaccaaaacaaggagggggatcaatacgtatacatgggacaaccgctaaataacgacgaagatcacgctcactggaccgaggccaaaatgctgttagacaacataaacacccccgaggggataatcccggcgctgttcgagccagaacgggagaaaagcgcagcgattgacggagagtaccggctacggggcgaagcacgtaaaaccttcgtcgaactaatgagacgaggggacctacccgtttggttgtcatataaagtagcctcggaaggcttccaatacagcgaccgtcgctggtgcttcgacggagagaggaataaccaagtcctggaagagaatatggacgtggaaatatggaccaaggagggagaaagaaagaaactccgcccccgctggctagatgcgcgcacatacagtgacccattggcgctgcgagaatttaaagaatttgccgcagggagacgaagtgttagcggcgatctaatactcgaaatcggaaaactaccccagcacctcacactcagagcacagaacgcactagataacttagtcatgctccacaacagtgagcagggcggaaaagcgtaccgacacgccatggaagaactgcccgatacgatagaaacactgatgttactggccctcatcgccgtcctaacgggaggagttaccctatttttcctaagtgggaaaggactaggcaagacaagtataggcctgctctgcgtgaccgcttcgtcagccttactgtggatggccagcgtcgaaccacactggatagcagccagcatcatcctcgagttctttctcatggtgctcttgatcccagaaccagaccgtcagcggacaccgcaagataaccaactagcctacgtagttatcgggctgctctttatgatccttactgtcgcagctaacgagatgggcctactcgaaaccaccaaaaaggatctagggatcggccacgttgccgcagaaaaccaccagcatgcaacgatgcttgatgtggacctaagaccggcgagcgcatggaccctatatgccgtggcgaccacggttataacaccgatgatgaggcacaccatcgaaaacacaacggcaaacatttcacttactgccatagccaaccaggcggctatactcatggggttagataaaggatggccgatcagtaaaatggatattggggtacctcttctcgcactcgggtgctacagccaagtaaatccactcacattaactgccgcagtactgatgttagtggcgcactacgccattatagggcccgggttgcaggcgaaggcaacacgtgaggcgcaaaaacgaacagcagcgggcatcatgaaaaacccaaccgtcgacggaattgtagcaatagacctagatccagtagtatatgatgcaaagttcgagaaacaacttggtcaaatcatgctcctaatcctttgcacatcacaaatcctccttatgaggacgacctgggcactatgcgagtcaataacactagccaccgggccgttaacgactctatgggaaggctccccgggaaaattctggaacactactatagcagtgagcatggcgaacatattccggggtagttatttagccggagcagggctcgcattctctttaatgaaaagcctaggcggtggtcgacgaggtacgggtgcacagggggaaacgcttggggaaaaatggaaaagacagctaaatcaactctcaaaatcagaatttaacacatataagcgctcaggcataatggaagtggaccggtccgaggcaaaagagggactaaaaagaggagaaacgaccaaacacgccgtctcccgaggaacagcgaagctccgctggttcgtcgagagaaacctggtgaaacccgagggtaaagttatagacctcggctgcgggagaggaggatggagttattactgcgcaggccttaagaaagtgacagaagtcaaaggatataccaaagggggaccgggacacgaggaaccgattccgatggctacctacggatggaacctcgtaaagctgccaagcgggaaggacgtattcttcatgccaccggaaaagtgtgacacattattatgcgatatcggcgaaagctcacccaatccaacaatcgaagaggggcgcaccttgagagtcctcaaaatggtcgagccgtggcttcgagggaaccaattctgcataaaaatcctaaatccatacatgccatccgttgtagagaccctagaacaaatgcaacgaaagcacggagggatgctcgtgcgcaaccccctgagccgaaattcaacacacgaaatgtactgggtatcatgtggcactggtaacatagttagtgcggtgaacatgacgtcaaggatgttgttaaaccgattcaccatggcacaccgaaagcccacatacgaacgcgacgtagatttgggcgccggcacgagacacgttgcggtggagccggaggtagccaatctcgacataattggccagcgaatcgaaaatatcaaaaacgagcacaagtcgacatggcattacgatgaggacaacccgtataaaacttgggcgtatcacgggtcctacgaagtaaaaccctctggaagcgcctcgagcatggtgaacggggtagtcagactgctgacaaaaccatgggatgtaataccaatggtgacacaaatagcaatgacagataccacccccttcggccagcagcgagtcttcaaagagaaagtagatacgcgaacaccgcgagcaaaacgggggacaacgcaaattatggaggtgacagccaagtggctctgggggtttcttagccggaacaagaaaccgcgaatatgcacccgggaagagttcacgcggaaggtgcggagcaacgcggcgattggtgccgtattcgtagatgagaaccagtggaacagcgcgaaggaagccgtggaggacgagcgcttctgggatctcgttcaccgcgaaagagaattacataaacaaggcaagtgcgccacgtgtgtctataacatgatggggaaacgtgagaagaaactcggagagttcggaaaagccaaaggtagtcgcgcgatatggtacatgtggttaggagcaaggtttctcgaatttgaagcgctgggcttcatgaatgaggaccactggttcagccgtgaaaatagcctctcaggggtagaaggggagggtctacacaaactcggctacatccttagagacatatcaaaaattccaggcggtaacatgtacgctgacgacacggcgggctgggatacaaggattaccgaggatgatctgcaaaatgaagcgaagataactgaaataatggagcccgaacacgcactcctagcgacgagcatatttaaattaacctaccaaaacaaagttgtacgcgtacagagaccagccaaaaacggaacagtcatggacgtaatcagccggcgtgatcaaagaggcagcggccaagtaggcacttacggactaaacacatttacaaatatggaggtacagctcatacggcaaatggaaagtgaaggaatattcctgccaagtgaactggaaacaccaaacctcgcagagagagtcctagactggctcgaaaaacatggagcagaacgacttaaaaggatggcgatctcgggagacgactgtgtcgtaaagccgatagacgacagattcgcaacagcattgactgcgctcaatgacatgggaaaggtccgcaaagatatcccacagtgggagccatctaaagggtggaatgactggcaacaggttccgttttgttcccatcattttcaccaacttatcatgaaagacggtagggaaatcgtcgtgccctgccgtaaccaggacgagcttgtgggccgagcccgggtaagtcagggggccggatggagcctaagagaaaccgcttgcttggggaagtcctacgcccaaatgtggcaactcatgtacttccaccgtcgcgacctaagacttgcagctaatgcgatttgctcagcagtccccgtagactgggtcccaacttcaagaaccacgtggagcatccatgcgcatcaccaatggatgacaactgaggacatgctcagcgtctggaaccgcgtctggatcgaagagaacccatggatggaagataaaacccacgtatccagctgggaagaggttccttacctcgggaaacgtgaagaccagtggtgcggcagccttataggactaacggcccgcgcaacatgggccacaaacatccaagtggctatcaaccaagttagacgcctaatcgggaacgaaaactacctggactacatgacatccatgaagcgatttaaaaacgaaagcgacccggaaggggccctatggtaa

SEQ ID NO: 23878 - RNA, 9879 nt, synthetic construct
  misc_feature 1..9879: note = derived and/or modified CDS sequence (opt11) from DENV-1__GQ868508__SS-prME
  source 1..9879: mol_type = other RNA
tccgtcaccatgcttctaatgcttctgcccaccgcgcttgccttccacttaaccacacggggcggcgagccccacatgatcgtgagcaagcaggagcgagggaagtcgttattatttaagacaagcgcaggggtgaacatgtgtacccttatcgccatggatttaggcgagctctgcgaagacaccatgacctacaagtgtccccagatcacggaggccgagcccgatgacgtggactgctggtgcaacgccaccgacacatgggtgacatatgggacctgcagtcagaccggcgaacaccggcgggacaagcgttccgtggccctggcgccccacgtcggcttaggcttagaaacccggaccgaaacttggatgagcagtgagggtgcatggaagcagatccagcgcgtcgagacctgggccttgcgccaccccgggttcacagtcattgccctattcctcgcccacgcaatcggcacgagtattacacagaaggggattatctttatcctgctaatgctcgttacccccagtatggccatgcgctgcgtagggattggcaatagagattttgtagaggggctgagcggggcaacttgggtggacgtcgtgctggaacacggctcctgcgtgaccaccatggccaagaacaagcccactttggacatcgagctgctgaaaacggaggtcacaaatccagctatcctgaggaagctgtgcatagaggctaagatcagtaacactaccacggactccagatgcccaacccagggcgaggcgactctagtcgaggagcaggacgctaactttgtgtgccgtcgtaccttcgtcgaccgtgggtgggggaacggctgcggtctgtttggcaaggggtccctgctcacgtgtgccaagtttaagtgcgtaaccaagctcgagggcaagattgttcagtacgagaacctaaagtatagcgtgatcgtgaccgtgcacaccggagatcagcaccaggtcgggaacgagacgacggagcacggcaccatcgcaaccatcacgccgcaggcccccacgagcgagatccagctgaccgactatggagcgctcaccctggattgcagcccccggaccggcctcgacttcaacgagatggttctcttgactatgaaggaaaagagttggctagtacacaagcagtggttcctcgatctcccgctaccctggacctcgggagcctctacctcccaggagacctggaatagacaggacttgttagtgacgttcaagaccgcccatgcgaaaaaacaggaagtggtcgttctgggctcccaagagggtgccatgcacaccgcactcaccggggccacggagatccagaccagtggcacgactacgattttcgctgggcatctcaagtgccggctaaaaatggacaagttaaccttgaagggcacctcgtatgtgatgtgcactgggtccttcaagcttgagaaagaggttgcggagacgcaacacgggactgtgctggtgcaggtcaaatacgaaggtaccgacgccccgtgcaagatccccttctctacccaggacgaaaaaggggtgacgcagaatgggcgactcataaccgccaaccctatcgtgaccgacaaggagaaacccgttaacatcgagaccgagccccccttcggagagtcctacatcgtggtgggtgcaggcgagaaagctctcaaactatcttggttcaaaaaggggagctccatcggcaagatgttcgaggccactgcccgcggggcccggcggatggcaatcttgggagacaccgcctgggactttggatcaattggcggcgtcttcacctccgtagggaagttggtccatcaggtgttcggcacggcctacggggtgctgttcagtggcgtgtcatggacgatgaaaatcgggatcggcatcctcctgacttggttgggcctcaactcacggtccacctctctgtccatgacctgcatagccgtcgggatggtgacactctatctcggcgtgatggtccaggcagacagcgggtgcgtgatcaattggaaaggccgtgagttaaagtgcgggtccgggatcttcgtgaccaatgaggtccatacttggaccgagcagtacaagttccaagccgactcaccgaagcgactgagcgcggccatcggtaaggcttgggaggagggagtgtgcggaatccgctccgccacgcggctagagaacatcatgtggaagcagatcagcaacgaactgaaccacatactactcgagaacgatatgaaattcacggttgtcgtgggcgacgccaacggcatcctggcacagggaaagaagatgatccgcccacagccaatggagcacaaatacagttggaagtcctgggggaaggcgaagattatcggagcagatatccagaatacaactttcatcattgatgggccagacaccccggagtgccccgacaatcagcgggcctggaacatctgggaggtggaggactacggcttcggtatctttacaaccaacatatggctgaagttacgagattcttatacccagatgtgcgatcaccgcctgatgagcgcggccatcaaggacagtaaagccgtccatgctgacatgggctactggatcgagagcgagaagaacgagacctggaagctggccagagcgagtttcatcgaggtgaagacgtgcacctggcccaagagccacaccctctggtctaacggagtgctggagagcgaaatgatcatacccaagatttacgggggcccgatctcccagcacaactacagacccggttatttcacacagacggccggcccatggcacttgggaaaactcgagctggacttcgatctatgcgaagggaccaccgtggtggttgacgagcattgtggcaatcgagggccgtcgctacggaccacgacagtcacgggcaagatcatccacgaatggtgttgccgctcctgcaccctgccacccctacggttccggggggaggacggctgctggtacgggatggagatccgacccgtgaaggagaaggaggaaaacctcgtgcgatccatggtatccgccggcagcggcgaggtggatagcttctccctgggcatcctgtgcgccagcattatgatagaggaggtgatgcggtcgcggtggtcgcggaagatgctcatgaccgggaccctagccgtcttccttctcctagttatggggcagctgacctggaacgacctcatccgcctatgcataatggtgggcgcgaacgcctccgaccgcatggggatgggtaccacctacttagccttgatggccactttcaagatgcggccaatgtttgcagtcgggctgctcttcaggcggttgaccagccgcgaggtactgctgctcacaatcggtctaagtctggtcgcaagcgtcgagctccccaatagcctggaggagctgggcgacgggctcgccatggggattatgatgctgaagttgctaacggagttccagccgcaccagctgtggatcaccctactctcgctgaccttcatcaaaaccacgctatccctagactacgcttggaagactactgcaatggcgctgagcatcgtttccctgttccccctctgcttaagcacaacgtcccaaaaaacaacttggcttccggtcctcctcggttcgttcggatgcaagcctctgaccatgttcctcatcacagagaataaaatctgggggaggaaatcctggcctctgaatgagggaattatggcgatcggtatcgtgtctatcctactgtccagcctgttgaagaacgatgtgcccctcgccgggccattaatagccggcggcatgctgattgcgtgttacgtcataagcggttccagcgcggacctctccctggagaaggccgccgaggtgtcttgggaacaggaggccgagcactccggcacaagccacaacatcctagtggaggtacaggacgacggcactatgaagataaaagacgaggagcgcgacgacacactcaccatcctgctgaaggcgacgttgctggcggtgagtggcgtgtaccccatgagtatacccgccaccctgttcgtctggtacttctggcagaagaaaaagcagcggtccggggtgctgtgggatacccccagcccgccagaagtggaaagagccgtccttgatgacggaatctaccggatcctgcagcgcggtctgttgggccggtcccaggtgggcgtgggcgtcttccaagacggcgtgttccatactatgtggcacgttacaaggggggccgtcctgatgtaccagggcaaacgcctagaaccctcctgggcctctgtgaagaaggacctcatctcctatggcgggggctggaggtttcaggggtcgtggaatacgggcgaagaggttcaggtcattgcggtggagcccgggaaaaacccgaagaacgtccagacaatgccaggtacattcaagacccctgaaggtgaggttggggccattgcactggacttcaagccaggcacaagcgggtcccccattgttaaccgggaggggaagatcgtgggactctacggaaatggcgtggtgaccaccagcggaacctacgtgagtgccatcgcccaggcgaaggcttctcaggaaggccctctccccgagattgaggacgaagtcttcaaaaagcgcaacctgacgattatggacttacacccggggtctggaaagacccggcgctacctgcccgccatggtacgtgaggccatcaagcgcaagttgcggaccttaattctggcgcccacgcgggtggtcgcctccgagatggccgaagctctgaaggggatgccaatccgctaccagaccaccgccgtcaagagcgaacatactgggagggagattgtagacctcatgtgtcacgcgacttttaccatgcgcctcttatcaccagtcagggtgcccaactataatatgatcatcatggacgaggcgcacttcactgaccctgcctcgatcgccgctaggggctatatctcaacccgggtcggtatgggcgaggcggccgcgattttcatgacggccacgccgcccggcagcgtagaggcctttccgcaatccaatgcggtgatccaggacgaggagcgcgacattccagagcggagctggaattccggatacgactggatcacggactttcccggcaagactgtctggttcgtcccctccatcaagtccgggaacgacatcgcaaactgcctacgcaagaacggcaagcgagtgatacaactctcgcgcaagacgttcgacaccgaataccagaagaccaaaaacaacgactgggattacgtggtaaccacagacatatccgagatgggagcaaacttccgggccgaccgcgtgatcgatccacggcgttgcctaaaacccgttatcctgaaagacggcccagagcgggtcattcttgcggggccgatgccggtgaccgtggccagtgctgcccagcgacgggggagaatcggacggaaccagaacaaagagggcgaccaatacgtctacatggggcagcccctgaataacgacgaggaccacgcccactggactgaggcgaagatgctcctcgataacataaacacgcccgaagggatcatcccggcccttttcgagccagagcgcgagaagtcagccgccatcgacggggagtaccgcctaagaggggaggcccgaaagacgttcgtggagttgatgaggcgcggggacttacccgtctggctgagttacaaggttgcgtccgaaggcttccaatacagcgacaggcgctggtgcttcgacggggagcgcaacaatcaggttttagaagagaacatggacgtcgagatatggactaaggagggtgagcgtaagaagctgcggccccgctggctggacgcaaggacctattcggatcccttggccctgcgcgagttcaaagagttcgcggccgggcggcgatcagtgagcggcgacctgatcctggaaataggcaagcttccacaacatctgacactccgggcccagaacgccctggacaaccttgttatgctccacaacagtgaacagggtggaaaggcctaccgccacgccatggaggagttacccgacaccatcgagacgctgatgctcctagcgctgatcgccgtcctcaccgggggggtgaccctattcttcctgagcggtaagggattaggcaaaacttcgataggtctgctatgcgttacggccagcagtgccttgctctggatggccagcgtcgagccgcattggattgcggcctccataatcttagaattcttcctcatggtactgctgataccagagcccgaccgtcaacgcacgccccaagacaaccagctcgcctatgtggttatcggcttgctgtttatgatcttgaccgtcgctgcaaacgaaatggggctgctagagaccacgaagaaggaccttggcatcgggcacgtggcagccgagaatcatcagcacgccacaatgcttgacgttgacctgcgaccggcctctgcctggaccttgtatgcggtggctacgacagtgatcacacccatgatgcgccacacgatagaaaacaccacggccaatatatcattgaccgccatcgccaaccaggccgccatcctgatgggtctcgataagggttggccgatcagtaaaatggatatcggggtccccctgcttgcgctcggctgctactcccaagtaaaccctcttactttgaccgccgcggtgttaatgctggtcgcccactacgccattatcgggcccggcttacaggctaaggccacacgggaggcgcagaagcgcacggccgccggtatcatgaagaaccccaccgtggacggcatagtggccatcgacctcgaccccgtcgtgtacgatgccaagttcgaaaagcagctgggtcagattatgttactcatcctgtgcactagccagatcctgctcatgcgtacgacctgggccctgtgcgagagtataacgctggctaccggcccgctcactaccctttgggaaggatctcccgggaagttctggaacacaaccatcgcggtgtccatggctaacatcttccggggaagctacctggccggcgcggggctcgctttcagcctgatgaagtcgcttggcgggggccgccgagggacgggtgcgcaaggggagacactaggggagaagtggaagcgccagttgaaccagctaagtaagagtgagttcaacacatacaagcggtcgggcataatggaagtcgaccgctccgaggccaaggaggggctcaagcggggcgagacaacgaagcacgcggtgagccgcgggacggcgaagctgcgctggttcgttgaacgcaacctggtcaagcccgagggcaaagtgatcgacctgggctgtggacgtggcggttggtcgtactactgcgccggtctcaagaaggtgaccgaggtcaaaggttacactaaaggcggtccaggccacgaggagccgattcccatggctacatacggctggaacctggttaagctccacagcgggaaggacgttttcttcatgccgcccgaaaagtgcgacaccctcctgtgcgacataggagagtcgtctccaaaccccaccatagaagaagggcgcacactgcgcgtcctcaagatggtagagccctggctgcgcggcaatcagttctgcataaaaatcttaaacccctacatgccgtccgtggtcgaaacgctcgagcaaatgcagcgcaagcacggagggatgctggtcagaaaccccctgtctcggaactccacgcacgagatgtactgggtaagctgcggcacggggaatatcgtatccgccgttaacatgacctcgcgtatgctcctgaaccgatttacgatggcgcaccgcaagccgacatacgagcgcgacgtcgacctgggcgccggtacccgtcacgtcgcagtcgaacccgaagtggccaacttggacatcatcggacaacgcattgagaatataaagaacgagcacaaatccacctggcactatgacgaggacaacccctacaagacctgggcctaccacggcagttacgaggtcaagccttccgggagcgcctccagcatggtgaatggtgtggtgcggctgctgaccaagccctgggacgtgatccctatggtcacccagatcgcaatgaccgacaccacccccttcgggcaacagcgcgtgtttaaggagaaggtggacaccaggacgccgagggctaagaggggcaccactcagatcatggaggtcaccgccaagtggctctggggctttctatcccgcaataaaaagccccgaatttgcactcgcgaggagttcacacgtaaagtacgcagtaatgccgcgattggcgccgtcttcgtcgacgaaaaccagtggaattcggcaaaggaggcagttgaggatgagcggttctgggatctggttcacagagaacgggagctccacaagcagggcaagtgtgcgacgtgtgtatataacatgatgggaaagcgggagaagaagctgggcgagttcgggaaagccaaaggctcgcgggccatctggtacatgtggctaggcgcgcggttcttagagttcgaagccctgggttttatgaacgaggaccactggttcagccgtgaaaacagcctgagcggcgtggaaggggagggactccataaactggggtacatcctgcgcgatatatcgaagatcccgggtggcaatatgtacgcggacgacacggcagggtgggacaccagaatcaccgaagacgacctccagaacgaggcgaagattacagaaatcatggagcctgagcacgccctactggcaacctcaatattcaagctaacctatcagaataaagtggtacgcgtgcagcgccccgcgaaaaacggcacggtaatggacgtcatttcccggcgtgatcagcggggcagcggacaagtgggcacgtacgggctcaacaccttcactaacatggaggtgcaactgatccggcagatggagtccgagggcatcttcctccccagcgaactggaaacgccaaacctggccgagagagtcctcgactggctggagaagcacggggccgagcgtctgaagaggatggccatctcaggcgacgattgcgtagttaagcccatcgacgaccgcttcgccaccgcgctcaccgcactgaacgatatggggaaggtccgcaaagacatcccacaatgggagcccagtaagggttggaacgactggcagcaggtgcctttctgctcccaccacttccaccagctgatcatgaaggacggccgcgaaattgtggtcccatgcagaaaccaggatgagcttgtggggagggccagagtgtcgcagggggccgggtggtccttacgcgagactgcctgcctgggcaagagctatgcgcagatgtggcagctcatgtacttccaccggcgcgacctccggctcgccgcgaatgcgatctgtagcgccgttcccgtggattgggtacccaccagtcgcacgacgtggagcatccacgcccaccaccaatggatgacgaccgaagacatgctctccgtttggaatcgggtttggatcgaggaaaatccgtggatggaggacaagacacacgtgagttcatgggaggaggtcccctacctagggaagcgcgaggaccagtggtgcggctctctaataggtctgaccgcccgcgccacctgggccaccaatatccaagtggccataaaccaggtgcggcgccttatcgggaatgaaaactacttggactacatgacctccatgaagcgttttaaaaacgaaagcgaccccgagggtgcactctggtga

SEQ ID NO: 23879 - RNA, 9879 nt, synthetic construct
  misc_feature 1..9879: note = derived and/or modified CDS sequence (opt11) from DENV-1__GQ868509__SS-prME
  source 1..9879: mol_type = other RNA
agcgtgaccatgctgctcatgctgctgccgaccgccctcgcctttcatcttaccacacgtggcggggagccccacatgatcgtctccaagcaggagcggggcaagagcctcttgttcaagacctcggcaggtgtgaacatgtgcactctgatcgccatggacctgggggagctctgcgaagataccatgacctataagtgcccccagatcaccgaagccgagcccgacgacgtggactgctggtgcaacgccacggacacatgggtcacctacggcacctgctcgcagaccggcgagcaccgcagggataagcgctctgtggccctggctccccacgttggcttgggactcgaaacccggaccgagacctggatgagctctgagggcgcctggaagcagatccagcgcgttgagacctgggcacttcgacaccctgggttcacggtgatcgccttgttcctcgcgcatgccataggtacgagcatcacccagaaggggattatcttcatcctacttatgctcgtgactccctccatggccatgcgctgcgtcgggatcggcaaccgcgatttcgtggagggtttgagcggggcgacatgggtggacgtcgtgctggagcacgggtcctgcgtgaccaccatggcgaaaaacaagcccaccttggacatcgagctgctgaagacggaagtcactaatcccgcaatcctccgcaagctgtgcatcgaggccaagatcagcaacaccaccacggattcccggtgtccgacgcagggcgaggccacactggtggaggagcaggacgctaatttcgtgtgccgtcggaccttcgtcgatcgcggctggggaaacggctgcggcctattcgggaaagggagcctgcttacgtgcgccaagttcaagtgcgtgaccaagctcgagggcaaaatcgtgcaatacgagaacttaaagtactccgttatcgtgaccgtgcacaccggtgaccagcaccaggtcgggaacgagacaaccgagcacggcaccatcgctaccatcacgccccaggctcccacgagcgagatccagctgactgactacggcgcccttacgctcgactgcagcccccggacgggcctggacttcaatgagatggttctcctaacgatgaaggagaaatcctggttagtacacaaacagtggttcctcgaccttccgctgccgtggacctccggtgcaagtaccagccaggagacctggaaccgccaggatctcctggtgactttcaagaccgcccacgcgaagaagcaggaagtggtagtgctgggctcccaagagggggccatgcacactgcactcaccggggccacggagatacagatgagcggcaccacaactatctttgcaggtcacctgaagtgcagactaaagatggacaaactcacgctgaagggaacctcctatgtgatgtgcaccgggagctttaagttggagaaggaggtggcggaaacacagcatggcacggtactggtgcaggttaagtatgagggcaccgacgcaccctgcaagatcccatttagcacccaggacgagaagggggtgacgcagaacggccgcctcatcacggcgaatcccatcgtgaccgataaggagaagcccgtcaatatcgagaccgaacccccattcggggagtcttatatcgtggtgggagccggcgaaaaggcgctgaagctgtcctggtttaagaagggtagctccatcggcaagatgtttgaggccaccgcccgcggggccagacggatggccatcctcggcgacacggcttgggacttcgggagcattggcggcgtcttcacgtccgtggggaagctggtgcatcaggtcttcggaactgcctacggggtactgttttctggcgtgtcctggacgatgaaaatagggatcggcatccttttaacgtggttgggccttaacagccgctccacctctctgtctatgacctgcatcgccgtcgggatggtgaccttatacctcggtgtgatggtccaggccgatagcgggtgcgtgatcaattggaaaggccgggaactgaagtgcgggtccggcatcttcgtgacgaatgaggttcacacttggaccgagcaatacaagttccaggccgacagcccgaagcgcctttccgcagctatcggcaaggcctgggaggaaggggtgtgcgggatacgatccgtaacccggctcgagaacatcatgtggaaacaaatcagcaacgaactgaaccatatcctcttggagaacgacatgaaattcaccgtagtggtgggggacgcgaacggcatactggcccaagggaagaagatgattaggccacagcccatggaacataaatactcctggaagtcatggggcaaggcgaagataatcggagccgacatacagaacaccaccttcattatcgacgggcccgacacaccggagtgcccagacaaccagcgggcctggaacatctgggaagtcgaggattacggcttcgggatcttcaccacgaacatctggctgaagctcagagactcctatacccagatgtgcgaccaccggcttatgtctgccgcaattaaagacagtaaagccgtgcacgccgatatgggctactggatcgagagcgagaagaacgagacctggaagctggcccgcgcctctttcatcgaggtgaagacgtgcacgtggcctaagagccacactctatggtccaatggggtgctggagagcgagatgatcatccccaagatctacgggggccctatatcccagcacaactaccgtcccggatacttcacgcaaacagccggcccttggcaccttgggaagctcgagctggacttcgacttatgcgagggcacgaccgtggtggttgacgagcactgcggcaatcgcggtccgtctctccgcaccaccacggttaccggcaagatcatccatgagtggtgctgccgctcctgcaccctcccgcccctccgattccgcggagaggacggctgctggtacgggatggagattcgacccgtgaaggagaaggaggagaacttagtgcggagcatggtgtccgccggctctggcgaggtggactccttctccttggggattctgtgcgccagcatcatgatcgaggaggtaatgagatctagatggagccgtaagatgctaatgaccggcacgctggccgtgttcctactcctgatcatggggcagctgacctggaacgacctcatccgcctgtgtatcatggtgggggccaacgcgtccgaccgcatggggatgggcaccacctatctggccctcatggccacgttcaagatgcggcccatgttcgccgtcggtctgctgttccggcggctcacgtctcgtgaggtccttctgctcaccatcgggctgtccctggtggcatctgtggagctccccaattcgcttgaggagctgggggacgggctcgcgatgggcatcatgatgctgaagctcctcaccgagttccaaccccaccagctgtggacgaccctgctcagcctgaccttcataaaaaccacgctgtccctagactatgcctggaagacaaccgccatggcactgagcatcgtgtccctgtttccgctctgcctgagcaccacgtcccagaagacaacctggctgccagtcctcctaggctccttcggttgcaagcccctgaccatgttcctcataaccgagaacaagatctggggcagaaagtcctggcccctgaatgaaggaattatggctatcggaattgtgagcatcctgctctccagtctgctgaaaaacgacgtgccgctcgccgggccgctgatcgccggcggaatgctgattgcctgctacgtcatctctgggtcctctgccgacctttccttggagaaggcagccgaagtgagctgggagcaggaggccgaacactccggtacgagccacaatatcttggtggaggtccaagacgacggcaccatgaagatcaaggacgaggagcgcgacgacaccctcaccatcctgctgaaggccacgctcttagccgtgtccggcgtgtaccccatgagcatccccgcaaccctgttcttatggtacttctggcagaaaaagaagcagcgctccggggtactgtgggacacccctagccctcccgaggtggagcgcgccgtgcttgacgacggaatctaccgcatcttacaacgcggcctactggggcggtcccaagttggcgtgggggtgttccaagatggcgtattccacaccatgtggcacgtgacgcgcggcgccgtactaatgtaccagggcaagaggttagagcccagctgggccagtgtcaagaaggacctgatcagctacggcgggggttggcgctttcaggggtcttggaacacaggcgaggaggtccaggtgatcgccgtagagcctggcaagaacccgaagaacgtgcagaccacccccggcacgttcaaaacccccgagggcgaggtgggggcgatagccctggactttaagcctggcacctctgggtctccgatcgtcaaccgcgagggcaagatcgtgggcctctacgggaacggagtggtcacaacgagcgggacatacgtgtccgccatcgcccaggccaaggcgagccaagagggcccgctacccgagatcgaggacgaagtgttcaaaaagcgcaacctaaccatcatggacctccacccggggagcggcaagacccgccgatacttacccgccatcgtaagggaggctataaagcgcaagctacggactctcatactggctcccacgcgcgtggtggcgtccgaaatggcagaggccctaaagggtatgcccatccgataccagacgaccgcggtaaaaagcgagcacacgggaagagagatcgtggatctcatgtgccacgccaccttcaccatgcgtctgctgtcccccgtgagagtccccaactacaacatgatcatcatggacgaggcccacttcacggatccggccagcatcgcggcacgaggctacatcagtacgagagtggggatgggcgaagccgcggccatctttatgaccgctacgccgcccgggagcgttgaagcgttcccgcagagcaacgccgtcatacaagatgaggagcgcgacatccccgagcggtcgtggaactccggctacgactggatcaccgacttccctggcaaaacagtgtggttcgtgccatccattaagagtgggaacgacatcgcgaactgcctccgcaagaatggcaagcgggttatccagctcagccggaagaccttcgacacggagtaccaaaagactaagaataacgactgggactacgttgtaaccaccgatatctctgagatgggagccaactttcgcgccgaccgcgtcatcgacccccggcgctgtttgaagccagtgattctcaaggacggcccggagcgggtaatccttgccgggccgatgcccgtcaccgtggcgtccgcggcccagcgcagaggccgcataggccggaatcagaataaggagggtgaccagtacgtatacatgggccaacccctgaacaacgatgaggatcacgcacattggacagaggcgaaaatgctcctggacaacatcaatacgccagaggggatcatcccggccctgttcgagcccgagcgcgagaagtctgccgccatagacggcgagtaccgtctccgcggggaggcccgcaagacctttgtcgagctgatgcggcgcggtgacctccccgtttggctctcctacaaagtcgcgtctgagggcttccagtacagtgaccggcgctggtgcttcgacggggagcggaacaaccaggtcctagaagagaacatggacgtggaaatctggacaaaggagggtgagcgcaagaagctgcggccccggtggctcgacgctcggacctattccgacccactggccttaagagagttcaaggagttcgccgccgggcggcggagcgtcagcggagatctcattctggaaatcggtaaactcccccaacacctaaccctccgggcccaaaacgccctggacaacctcgttatgctgcacaatagtgagcagggtggaaaggcctatcgccacgccatggaggagctgcccgacacgattgagaccctcatgctgctggccctcattgcagtgctgacggggggggtcaccctgttcttcctcagcgggaaaggccttggcaagacgtccatcgggctactctgtgtgaccgcctcgtccgctctgctatggatggcgtccgttgagccccactggatagccgcctccatcatcctggagttcttcctgatggtcctactcatcccggagccggaccggcagcgcacgccccaggataaccagctggcttacgtggtgataggcctcctatttatgatcttgaccgttgctgccaacgagatggggctactagagacgacgaagaaggacctggggatcgggcacgtggccgcggagaaccatcagcacgccaccatgctggacgtagacctccgacccgccagcgcctggacgctgtacgccgtcgcgacgaccgtgatcaccccaatgatgcgtcacacaatcgagaatacgaccgccaacatctccctgaccgccatcgcgaaccaggctgcgatactcatgggcctggacaagggctggcccatttcaaaaatggacatcggggtgccgctgctcgccctaggctgctactcgcaggtgaaccccctgaccctaacggccgcagtgttaatgttggtggcgcactacgccattatcgggccaggtctccaagcaaaggccacgcgggaggcccagaaacgcaccgcggcagggattatgaaaaaccccacagtcgacggaatcgttgccatcgacctggatccagtggtctacgacgccaagtttgaaaagcagctggggcagattatgctcctgatcttatgtacgagccagatcctcctgatgcgcaccacctgggccctgtgtgagtccatcaccctcgcgacgggccccctgaccactctgtgggagggtagcccagggaagttctggaacaccacgattgccgtatccatggccaacattttcagaggcagctatctcgcgggtgccgggctggctttttccctgatgaaatccctcggcggaggccgccgagggacgggcgcccagggtgaaaccttaggggagaagtggaagaggcagctgaatcaattgagcaagagcgaattcaacacctacaaacggagcgggattatggaggtggaccgatcggaggccaaagagggccttaagcggggtgaaacgaccaagcacgccgtcagccgcgggacagcgaagctgcggtggttcgtggagcgcaacctcgtgaagcccgagggtaaagtcattgaccttggctgcggacggggcgggtggtcctactactgtgccggcctgaagaaggtgaccgaggtaaagggctataccaagggcggcccgggccacgaggaacccatccccatggcgacgtacggatggaatctggtcaagctccacagcgggaaggacgtcttcttcatgccgcccgagaagtgcgataccctgttgtgcgacatcggagaatccagcccgaaccccaccatcgaggaggggcgcacactccgcgtgctgaagatggtggaaccctggctgcgcggcaatcaattctgcatcaagatcttgaacccctacatgccctccgtggtggaaacccttgagcagatgcaacggaagcacggcgggatgttagttcgcaatcctctctcgagaaactctacgcacgagatgtactgggtcagttgcggaaccgggaacatcgtgtccgccgtcaacatgacgagccgcatgctcctgaaccggttcaccatggcccacaggaagcccaccttcgagcgcgatgtggacctcggcgcgggcactagacacgttgccgtcgagcccgaggtggccaacctggacattatcgggcagcggatcgagaatatcaagaacgagcacaagtccacctggcactacgacgaggacaacccgtacaagacgtgggcttatcacggcagctacgaggtgaagccctccggctccgccagcagcatggttaacggcgtagtgaggctattgaccaagccttgggacgtcatccccatggtgacccagattgcgatgactgatacgaccccatttgggcagcagcgtgtctttaaggagaaggtggacacccggacgccgcgggccaagcgaggcacgacccagattatggaggtgaccgccaagtggctgtggggcttcctgtcccgcaacaagaagccccggatctgcactagggaggaattcacgaggaaggtccgcagcaacgccgcaatcggggcggtgttcgtggacgagaaccaatggaatagcgccaaagaggccgtcgaggacgagcggttttgggacctcgtccaccgcgagcgggagctgcacaagcagggcaagtgcgcgacctgcgtgtacaacatgatggggaagcgcgaaaagaagctgggcgagttcgggaaagcaaagggctcccgcgccatctggtatatgtggctgggcgcgaggttcctggagttcgaggccctggggttcatgaacgaagatcattggttcagccgggagaactccctcagcggggtcgagggggagggcctgcacaagctggggtatatcctccgcgacatatctaagatcccgggcggcaacatgtacgccgacgacacagccgggtgggatacgcggatcacggaagatgacctacaaaacgaggccaagatcacagacatcatggagcctgagcatgcgctgctcgccaccagcatcttcaagctgacctatcagaacaaagttgtgcgcgtccaacggcccgcaaagaacgggacggtgatggacgttatctcccgccgcgaccagcgggggagcggccaggtggggacctacgggcttaacaccttcacgaacatggaggtgcagctcattcgccagatggaatcagaaggcatcttcttgcctagcgaattagagacaccgaatctcgcggagcgggtgctggactggctggagaagcacggggccgagcgcctcaagaggatggccatctccggagacgattgcgtcgtgaagcctatcgacgaccgtttcgccacggcccttaccgcgctaaacgacatgggcaaggtgcggaaggacatccctcagtgggaacccagcaagggctggaacgattggcaacaggtcccattctgcagccatcactttcaccagcttatcatgaaggatggccgcgagatcgtggtgccttgtcggaaccaggacgagctggtcgggcgtgcccgagtgtcccagggcgcaggatggtccctgcgtgagaccgcttgcctcggtaagagctacgcacagatgtggcaactaatgtactttcaccggcgcgacctgagactagcggcgaacgcaatctgttccgccgtcccggtcgactgggtgcccactagtcgtacgacttggtcaattcacgcacaccatcagtggatgacgaccgaagacatgctgtctgtgtggaaccgggtctggattgaagagaacccgtggatggaggacaagacgcatgtaagctcctgggaggaggtgccctacctggggaagcgcgaggatcaatggtgcggcagcctcatcggcctgaccgcccgcgccacatgggcaaccaacatccaagtcgcgattaatcaagtgcgccgccttattgggaatgagaactacctcgactatatgactagcatgaagcggttcaagaacgagagcgaccctgagggcgcgctgtggtga

SEQ ID NO: 23880 - RNA, 9879 nt, synthetic construct
  misc_feature 1..9879: note = derived and/or modified CDS sequence (opt11) from DENV-1__GQ868510__SS-prME
  source 1..9879: mol_type = other RNA
agcgtgaccatgctgctaatgctgctgcccaccgccctcgcctttcacttgaccacccggggtggggaaccccacatgatcgtgtctaaacaggagcggggcaagagcctcctcttcaagaccagcgcgggtgtgaacatgtgcaccctaatagccatggacctgggcgagctctgtgaggacaccatgacctacaagtgtccccagatcacagaggccgaacccgacgacgtagactgctggtgcaacgcaacggacacgtgggtcacctatgggacgtgtagccagaccggcggccaccgccgggaaaagcgctccgtggcactggcgccccacgtagggctgggactcgagacgaggactgagacgtggatgagctccgagggagcctggaagcagatccagcgggtagagacatgggccctgcggcaccccggctttacggtaatcgccctgttcctcgcgcacgcgatcgggaccagcatcacccagaagggcatcatattcatcctgctgatgctggtgacaccctccatggcaatgcgttgcgtcgggatcggcaaccgggacttcgtagaaggcctgagcggagccacgtgggtagacgtggttctggaacacggatcgtgcgtgaccacgatggccaagaacaagcccaccctcgacatcgagctcctgaagacggaggtcaccaaccccgcgatcctccgcaagttgtgcatcgaggccaagatcagcaacacaacgacggactcccggtgcccgactcagggcgaggccaccctggttgaggagcaggatgccaacttcgtgtgcaggcgcaccttcgtcgaccgtggatggggcaatgggtgcggcctcttcgggaaaggctccctgctgacgtgcgccaagttcaagtgcgtgaccaaactcgagggcaagatcgtgcagtacgagaacctgaagtattccgtcatcgtgacagtgcacaccggggaccagcatcaggtgggcaacgagacgacagagcatgggaccattgcgaccataacgccccaggcccccacttcagagatccagctgaccgactacggcgccctcaccctcgactgcagcccccggaccgggctggactttaatgaaatggtgctcctgacgatgaaagagaaatcctggctggtccacaagcagtggtttctagacttgcccctgccctggacctccggcgctagtacctcgcaggagacctggaatcgccaggacctcctagtaaccttcaagaccgcccacgcgaagaaacaggaggtcgtcgtcctgggctcccaggagggggccatgcacaccgccctcaccggtgccacggagatccagaccagcgggaccaccactatattcgccggccacctgaagtgcagattgaagatggataagctcaccctgaagggaacctcctatgtgatgtgcaccggcagcttcaagctggagaaggaggtcgcggaaacgcagcacggcaccgtcctggtgcaggtcaaatacgagggtaccgacgcaccatgcaagatccccttctccacccaggacgaaaagggcgtgacgcagaacggacgcctcatcaccgctaaccctatcgtcaccgacaaagagaagcccgtgaacatcgagaccgagccacccttcggcgagtcttacatcgtggtgggcgccggggagaaggcgcttaagctgtcctggttcaagaagggctcctcaatcgggaagatgtttgaagccacggcccggggagcccgacggatggccatcctaggggacaccgcgtgggactttggcagcataggcggggtcttcacctccgtgggaaagctggtgcaccaggtgttcgggaccgcctacggcgttctgttcagcggggtgtcctggacgatgaagatcggcatcggcatcctcctcacctggctggggctcaatagccgctcgaccagcctgtccatgacctgcatcgccgtcggcatggtaacgctatacctcggggtgatggtccaggccgactccggctgtgtcatcaactggaaggggcgcgagctgaagtgcgggtccggcatcttcgtgaccaacgaagtccacacctggactgagcagtacaagtttcaggccgacagcccgaagcgtcttagcgcggccatcggaaaggcgtgggaggagggtgtgtgtgggatacgctcagccacccggctcgagaacataatgtggaagcagatctcaaacgagctgaaccacatcctgctcgagaacgacatgaagttcaccgtggtagtgggcgacgccaacgggatcctggcgcagggtaagaaaatgatccgcccccagccgatggagcacaagtactcctggaagtcctggggaaaggctaagatcatcggggccgacatccaaaacaccaccttcataatcgatggccccgacaccccggaatgccccgacatccagcgtgcctggaacatctgggaggtggaggactacgggttcgggatattcacaaccaacatatggctgaagctccgcgactcctacacccagatgtgcgaccaccgactcatgagcgccgccatcaaggactcaaaagcggtccacgccgacatgggctactggatcgagagcgaaaaaaacgagacctggaagctggcccgcgcctccttcatcgaggtgaagacgtgcacctggcccaagagccacaccctctggtccaacggggtgcttgagagtgaaatgatcatccccaagatttacggcgggcccatctcccagcataactaccggcccggctacttcacccaaacggcggggccctggcacctgggaaagctcgagctggacttcgacctgtgcgagggaacgaccgtcgtggttgatgagcactgcgggaaccgcggcccgagcctccggaccactaccgtcaccgggaagatcatccacgagtggtgctgccgctcctgcacgttaccgcccctgcgcttccgcggagaggacggatgctggtacggcatggagatccggccagtgaaagagaaggaggagaacctcgtgaggtcaatggtctccgccggctctggagaggtggatagcttctccctgggcatcttatgcgccagcatcatgatagaggaggtgatgcggtcccggtggagccgtaagatgctaatgacggggacgctggcggtgttcctgctcctgatcatgggtcagctgacctggaaggacctcatcagactgtgcatcatggtgggcgccaacgcctcggaccgtatgggcatgggcaccacatacttagccctcatggccaccttcaagatgagaccgatgttcgccgtggggctgctgttcagacggctgaccagccgcgaggtcctgctattaaccatcggcctgtccctggtggcgagcgtggagctccccaactccctggaggagctgggggacggcctcgccatgggcatcatgatgcttaagcttctcacggagttccagccccaccagctatggaccaccctactctcgttaaccttcatcaagaccaccttatccctcgactacgcctggaagaccaccgccatggcgctgagcattgtctcactgttcccactctgtctgtccacgacctcccaaaagacaacatggctcccggtactcctggggagcctgggctgcaagcccctcaccatgtttcttatcacggagaacaagatctgggggcgtaagtcttggcccctgaacgagggcatcatggctatcgggatcgtcagcatcctcctgtccagcctgctcaagaacgacgtgcccctggccggcccgctgattgccggaggaatgctcatagcctgctatgtgatcagcggctccagcgctgacctttcgctggagaaggccgccgaggtcagctgggaacaagaggccgaacactcgggtaccagccacaatatactcgtggaggtgcaggacgacggtacaatgaagatcaaggacgaggagcgcgacgacacgctgacgatactgctcaaggccacactgctggcagtctccggggtctaccccatgagcatccccgccaccttattcgtgtggtatttttggcagaagaagaagcagcggtccggcgtcctgtgggacacccccagcccgcccgaggtggagcgagccgtcctggacgacggcatctaccgcatcctgcagcgcgggctcctgggccggtcccaagtcggcgtgggggttttccaggacggggtctttcacacgatgtggcacgttacccgcggcgccgtgctgatgtaccagggcaagagactcgagccctcatgggcctctgttaagaaggatctgatcagctacgggggcggttggcgcttccaaggctcttggaataccggggaggaggtccaggtgatcgccgtcgagcccggcaagaaccccaagaacgtgcagaccacgcccggcaccttcaagactcccgagggggaagtgggcgccatcgccctggactttaagccagggaccagcggctctccgatcgtcaaccgggagggcaagatcgtggggctctatggtaacggggtggttacgacaagcggcacttacgtgtccgctatcgcccaggcgaaagccagccaagaaggtcccctgcccgagatcgaggatgaggttttcaagaagcgcaatctgaccatcatggacctccacccgggcagcggcaagacccggcggtacctccccgccattgtccgggaggccatcaagagaaagctccggactctcatcctggcccccacccgcgtggtggcctccgagatggccgaggccttaaagggaatgcccatccgctaccagaccactgctgttaagagcgagcacacaggccgggagatcgtggacctcatgtgccacgcaaccttcaccatgcgcctgctgtcgccagtgcgggtccccaactacaacatgatcatcatggacgaggcccactttacggacccggccagcatcgcggcccgcgggtatatctccacgcgggtgggcatgggggaggcggcagccatcttcatgaccgccacgccgcccggcagcgtggaagcgttcccccagtctaacgctgtcatccaggacgaggaacgcgacatccccgagcggtcctggaactccggatacgactggatcactgacttccccgggaaaaccgtctggttcgtccccagcatcaaatccggcaatgacatcgccaactgcctccgcaagaacggaaaacgggtcatccagctgagccgcaagaccttcgacaccgagtaccagaagacgaagaacaacgactgggactacgtggtcaccaccgacatctccgagatgggcgccaacttccgtgcagatagggtaatagacccccggcgctgcctcaagcccgtgattctcaaggacggaccggagcgggtgatcctggcgggcccgatgcccgtcaccgtggccagcgccgctcagcgcagaggccggatcggtcggaaccagaacaaggagggcgaccagtacgtgtacatggggcagcccctgaataatgacgaggaccacgcccactggaccgaagcgaagatgctacttgacaacattaacacccccgagggcatcatcccggccctgttcgagcccgagcgcgagaaatccgctgcgatcgatggcgagtaccgcctccggggcgaggccagaaagacgttcgtggagttaatgaggcgcggcgacctgcccgtgtggcttagctacaaggtcgcgtccgaggggttccagtacagcgatcggcgctggtgcttcgacggcgagcggaacaaccaagtgctggaggagaacatggacgttgagatctggacgaaggagggggagcgcaagaagctgcgtccccgctggctcgacgcccggacctactccgacccactggccctgcgcgagttcaaggagttcgcagccggccggagaagcgtcagcggcgatctcatcctggagatcgggaaactgccccaacacctcacgctgcgggcgcagaacgccctggataacctcgtgatgctgcacaactccgagcaaggggggaaggcctatcgccacgccatggaagaattgcccgacaccatcgagaccctaatgttgctggcgctcatagccgtgcttaccggcggggtcacgcttttcttcctcagcggcaagggcctcgggaagacctctatcggtctgttatgcgtgaccgccagctccgccctcctgtggatggccagcgtggagccccactggatcgcggcctccattatcctcgagttctttctcatggtcctgctaataccggagccggaccggcagcgcacgcctcaggacaaccaactggcatatgtcgtgatcggtctcctgttcatgatcctcaccgtcgcggccaacgaaatgggcctgctcgagactacaaagaaggacctggggataggccacgtggccgccgagaatcatcagcatgccactatgctggacgtggaccttcggccggccagcgcctggacgttgtacgcggtcgccaccaccgtgatcacccccatgatgcgacacacgatcgagaacaccaccgccaacatttccctgaccgccatcgccaaccaagctgccatcctcatgggcctcgacaaggggtggccgatcagcaagatggatatcggcgtgcccctcctcgccctcgggtgctactcccaggtcaacccactgacgcttactgccgcggttctgatgctggtggcgcactatgccatcataggccccggactccaagccaaggccacacgggaggcgcaaaagcggaccgccgccggcataatgaagaaccccacggtagacggcatcgttgccatcgacctggaccccgtggtgtacgacgccaagtttgagaagcagctagggcaaattatgctcctgatcctgtgcacaagccagatactcctgatgcgcaccacctgggctttgtgcgagagtataacgctcgcaaccgggccgctgaccaccctgtgggaggggagccccggcaagttctggaacacgaccatagccgtgtccatggccaacatcttccggggcagctacctcgccggggcgggcctggccttctccctgatgaagtccctaggtggcgggcgccggggcaccggcgcccagggggagaccctaggcgagaagtggaagcgccagctaaaccagctctccaagtccgaattcaatacttacaagcggagcgggatcatggaggtggatcgctccgaagccaaagaaggcctcaagaggggggaaacaaccaagcacgctgtcagccggggcacagccaaattacggtggtttgtggagaggaaccttgtgaagcccgagggcaaggtcatagacctcgggtgtggccgcgggggctggtcctactactgcgccgggctgaaaaaggttaccgaggtgaagggatacacgaagggcgggcccggccacgaggagccgattcccatggctacctacgggtggaacctggttaagctccactcaggcaaggacgtattctttatgcctcccgagaagtgcgataccctgctgtgcgacattggggagtccagcccgaaccccaccatcgaggagggccgcacgctccgggtgctgaagatggttgagccctggttgcgaggcaatcagttctgcatcaagatcttaaacccctatatgccgtccgtggtggaaaccctggagcaaatgcagcggaagcacgggggtatgctagtccgcaatcccctcagccggaactccacccatgagatgtattgggtgtcatgcggaacgggcaacatcgtgtccgccgtcaacatgacgagtaggatgctgctgaaccggttcaccatggcgcaccgcaaaccaacctacgagcgcgacgtggatctcggtgccgggacccggcacgtggccgtcgagcccgaggtggctaacctggacatcatcggacagcgcatcgagaacatcaagaacgagcataagagtacgtggcactacgatgaggacaacccgtacaaaacctgggcttaccacgggagctacgaggtgaagccctccggttcagcgtcctccatggtcaatggggttgtgcgcctgctcaccaagccctgggacgtcatcccaatggtgacgcagatcgcaatgaccgacaccaccccgttcggccagcagcgagtcttcaaggaaaaggtggacacccggacgccccgtgccaagcgtggcaccacccagataatggaagtaactgccaagtggctgtggggatttctgtcccggaacaagaagcccaggatctgcacgcgcgaggagttcacccggaaggtccgcagcaacgccgcaatcggcgccgtgttcgtggacgagaaccaatggaactcagccaaggaggccgtcgaggacgagcgcttctgggacctcgtacaccgtgagcgcgagttgcataagcagggcaagtgtgcgacctgcgtgtacaacatgatgggcaagcgagagaagaagctgggggaattcggcaaagccaaaggctcccgggccatctggtacatgtggctcggggcccggttcctggagttcgaggctctgggtttcatgaacgaagaccattggttcagccgagagaactccctctctggggtggagggcgaggggctgcacaaattaggctacattcttcgcgatatctccaagataccgggcgggaacatgtacgcggacgacaccgccggctgggacacgcggatcaccgaggacgacctgcagaacgaggctaaaataaccgacatcatggagcccgagcacgccctgctcgccaccagcatatttaagttgacgtaccagaacaaggtggtgcgcgtccagcgcccggcgaagaacgggaccgtgatggacgtgatctcccggcgcgaccagcggggaagcggccaggtagggacctacggccttaatacattcacgaacatggaggtgcagctcattcgccagatggagtccgaagggatcttcttaccctccgagctggagacaccgaacctcgcagaacgggtgctggactggctgggcaagcatggggccgagcgcctcaagcgaatggcgatcagtggcgacgactgcgtcgtgaagcccatcgacgaccgctttgcaaccgcgctgaccgccctgaacgacatgggcaaagtgcggaaggacatcccccagtgggagcccagcaaggggtggaacgactggcagcaggtcccgttttgttcccatcacttccaccagctcatcatgaaggacggcagagaaatagtggtcccctgtcggaatcaggacgagctggtcgggcgcgcccgggtgagccaaggtgccggttggtccctgcgcgagaccgcctgcttaggcaagagttacgcgcagatgtggcagctgatgtacttccatcggcgcgacctgcggctcgctgccaatgccatctgttccgcggtgcccgtcgactgggtgcccacgagccgcaccacgtggagcatccacgcgcaccaccagtggatgaccacggaggatatgctgtccgtatggaaccgtgtctggatcgaggagaacccgtggatggaggacaagacccacgtgagctcctgggaggaggtgccttatctggggaagagggaggatcagtggtgcgggagcctcattggactgaccgccagagccacctgggccacgaacatccaggtcgcgatcaatcaagtgcggagactgataggcaacgagaactacctcgactacatgacatccatgaagcggttcaagaacgagagcgatcccgaaggcgccttgtggtaa

SEQ ID NO: 23881 - RNA, 9879 nt, synthetic construct
  misc_feature 1..9879: note = derived and/or modified CDS sequence (opt11) from DENV-1__GQ868511__SS-prME
  source 1..9879: mol_type = other RNA
agcgtaacaatgttactcatgttgctaccgaccgcgctcgctttccacctgacgactcgtggaggggaaccgcacatgatagtcagtaaacaggaacgggggaaatccttactctttaagacgagcgcgggggtcaacatgtgcaccctaatagcgatggacctcggagaactttgcgaagacaccatgacgtacaagtgcccgcagatcacggaagcggaaccagacgacgtggactgctggtgcaatgcgacggacacatgggtgacatacgggacctgcagccagacgggggaacacaggcgagacaaacggagtgtggctcttgcgccacacgtcgggttagggttagaaacacgcacagaaacttggatgtcaagtgaaggcgcgtggaagcaaatacagagagttgaaacatgggcacttcgacaccctggctttactgtcatagcactcttcctcgcacacgcaatcggcacatcaattacgcaaaaaggcataattttcatactgttgatgcttgttacgccatcgatggcgatgcggtgcgtcggaattgggaacagagatttcgtagaaggacttagcggcgccacctgggttgacgtagtactcgaacacggctcatgcgtaactaccatggcaaagaacaaaccaacgttagacattgaactcctcaaaaccgaagtaacaaacccagccatactccggaaactgtgcatagaagctaaaatatctaacacaaccacagactcccgctgtcccacccagggagaagcaaccctagtcgaagaacaagacgctaatttcgtttgtagacgcacattcgtcgaccggggttggggcaacggttgcggtttgttcggaaaggggtcactgctcacgtgcgcgaagttcaaatgcgtcactaagctcgaaggtaagatcgtccagtacgagaacctaaaatacagtgtgatagtaacagttcacacgggtgaccagcaccaggtaggaaacgagaccaccgaacacggtaccatcgcgacaataacaccgcaggcaccgacgtccgaaatacagttgaccgattacggtgccctgactctggattgctcaccaaggacaggcctggatttcaacgaaatggtacttcttaccatgaaagaaaagagttggctagtccacaaacaatggttcttagacctaccgcttccttggaccagcggcgcgtctaccagccaggaaacttggaatcgacaagacctcctggttacatttaaaacagcacacgcaaagaaacaggaggtagtggtcctaggcagccaagagggagcgatgcacaccgcgctcactggagcaactgaaatccaaacaagcgggacaaccacaatatttgcagggcacctaacgtgcaggctcaagatggacaaattaaccttaaaggggacaagctacgtgatgtgtaccggttcattcaaactagaaaaggaagtcgccgaaacgcaacacggaacggtcctggtgcaggtaaaatatgaagggacggacgcaccatgcaaaataccatttagtacccaggacgagaagggagtaacacagaatggccgactgataacggcaaaccccattgtcacagacaaggaaaaaccggtaaacatagaaaccgagccgcccttcggagaatcatacatcgtggtaggagcgggggaaaaagcgctaaaactcagctggttcaagaaaggatctagcatagggaagatgttcgaagctacggcgcgcggtgcaaggaggatggcaatactaggtgacactgcgtgggatttcgggtccatcgggggtgttttcacctcagtcggcaaactggtccaccaggtctttggtactgcttacggcgtactgttctcaggcgtaagctggacaatgaaaatcggcatcggaatactcctcacgtggctaggcctaaactcgcgaagcacgagcctctcaatgacctgtatcgcagtaggaatggtgacactatacctcggcgtaatggtgcaggccgactccgggtgtgtcatcaactggaaaggtcgggaacttaagtgcggatcgggcatattcgtgaccaacgaggtccacacgtggactgagcaatataaattccaagcagacagccccaaacgcttgagcgcagcaatagggaaagcctgggaggaaggggtgtgcggcatacggagtgcgactcgtctcgagaacataatgtggaaacaaataagcaacgaactaaatcacatcctcttggaaaacgacatgaaatttacggtggtagtgggcgacgccaatggcattctcgcacaagggaagaaaatgattagaccgcaacccatggagcataaatacagctggaaaagttggggaaaagccaaaatcatcggtgccgatatccaaaacacgaccttcataatcgacggccctgacacgccagaatgcccggacaaccaaagggcatggaacatatgggaggttgaggactatgggtttggaattttcaccaccaatatatggttaaaacttcgggacagctacacccaaatgtgtgaccaccgtttgatgtccgcagcgatcaaggactccaaggcggtacacgcagatatgggctactggattgagtcagagaaaaatgagacctggaagctagcccgggcctcgttcattgaagtgaagacgtgcacctggccaaaaagccatacactgtggtcgaacggggtcctggaatctgaaatgataatcccaaagatatacggcggcccgatttcacaacacaactacaggcctgggtacttcactcaaacagctggaccgtggcacctgggcaaactagagcttgatttcgacctttgcgaaggaaccacggtcgtcgtagatgagcactgcggcaaccgcggccccagcctacggaccacaactgttacgggaaaaataatacacgagtggtgctgtcggtcctgcacactgccgcccctacggttccgaggcgaagatggatgctggtacgggatggaaatcagaccagtgaaggagaaagaagagaacttagtccggagcatggtgtcagccggaagcggcgaagtcgactccttcagtctaggaatcctgtgcgcgtccatcatgatagaggaagtgatgaggtcccgatggagcaggaaaatgctaatgaccgggacacttgcagtcttcctgctattggttatgggacagctcacgtggaatgaccttataagactctgtatcatggtaggggcaaacgcttcagaccgaatgggaatgggaacaacatatctagccttgatggccacatttaagatgagaccaatgttcgcagtcggactcttattcagacggttaacaagccgcgaagtacttctacttactatcgggctgtcattggtggctagcgtggagctgccgaacagcctcgaagaattaggggacggacttgctatgggcatcatgatgttgaaactgctcacagagttccagccccaccagctatggacaaccctactatccctaacgttcattaagacaacgttgagcttggactacgcctggaaaaccacagccatggccttaagcatagtaagtttatttccactatgtctaagcaccacaagccaaaagaccacttggttgccggtattgttagggagcttcggttgtaagccgttgacgatgttcttaattacagagaataaaatctggggacgcaaatcgtggccgctaaacgagggaattatggcaataggaatcgtctcgatactcctttccagcttactaaagaacgacgtaccactggccgggccactaatcgctggcggcatgctaatagcctgctacgttatctcgggaagcagtgcagatctatcactagagaaagcagccgaggtctcgtgggagcaggaagcagaacactccgggaccagccataacattttggtcgaagtccaagatgacggcaccatgaagatcaaagacgaagaacgcgacgacacactgacaatattactaaaagccacgctcctagcagtgagtggcgtataccccatgagtattccggccacactcttcgtatggtacttctggcaaaagaaaaagcagcgtagtggagtactctgggacacacccagcccaccagaagtcgaacgagcagtactcgatgacggtatctacaggattctccaaagaggcctactaggaaggagccaagtaggcgtaggagtgttccaggatggggtgttccacacaatgtggcatgtaacgcgcggtgcagtgctaatgtaccaaggaaagaggctagagcctagctgggcatcggttaagaaagacttaatatcttatgggggaggctggcgcttccaaggtagctggaacactggggaagaagtccaggtcatcgcagtggaaccagggaaaaaccccaaaaacgttcaaacaaccccaggaacattcaaaacaccagaaggggaagtaggcgcaattgccctagacttcaagcccgggaccagcggcagcccaatagtaaatagagagggaaaaattgtggggctctacggcaacggcgttgtgaccacttcgggaacctacgtatccgccatcgcacaagcgaaagcgtcccaggaaggcccgcttccggaaatagaagacgaggtgttcaaaaagcgcaacctaactatcatggacctacacccaggaagtggcaaaacgcgccgatatttaccagcaatcgtaagagaagcaataaagaagaaacttcggaccctaatactggcaccaacgagagtagtcgcttccgaaatggcagaagccttaaaaggaatgcccatcagataccagactacagctgtcaaatccgaacacactggacgcgagatagtagacttaatgtgtcacgctacattcacaatgaggcttctctcaccggtgcgggtcccaaattacaacatgatcattatggacgaggcccacttcaccgatcctgcgtcgatcgctgccaggggatatatcagcacgagggtcggcatgggcgaagccgccgcaatcttcatgaccgcgaccccgccaggcagcgtggaagcattcccacaatccaacgccgtaattcaagacgaagaaagagatattcccgagcgttcatggaacagtggctacgactggatcaccgatttccctggcaagacagtgtggttcgtgcccagcatcaagagtggaaacgatatagcgaactgcctacggaagaatgggaagagagtaattcagctctccaggaaaacgttcgacacagagtatcagaaaaccaagaacaacgattgggactacgttgtgacaacggacatttcagagatgggagccaatttccgagccgaccgtgtgatagacccaagacgatgcctaaaaccagtcatactaaaggacggaccggaaagagtaattttagcgggaccaatgccagttacagtagcctcagcagcgcaacggcggggcagaataggcaggaatcagaataaagagggagatcagtacgtctacatgggccaaccactaaacaacgacgaggaccatgcgcactggacggaagcgaaaatgctcctagacaatattaacaccccagaggggataatacctgccctattcgagcccgaaagagagaaaagcgcagcaatcgacggagaataccgcctcaggggcgaagctaggaaaacattcgtggagctaatgcgcagaggcgatctccccgtatggctgagctacaaagtggcttctgagggctttcaatactcggacaggagatggtgcttcgacggggaacgaaacaaccaggtcttagaagaaaatatggacgtcgagatttggacgaaagaaggagagcgaaagaaactgcggccccgatggctcgacgccaggacatacagcgacccactagccctcagggagttcaaagagttcgcggcagggcgcaggagtgtaagcggggatctcatcctcgagataggaaaactaccacaacatctaacgctgcgggcccaaaatgccttagataacctggtaatgctccacaactccgagcaagggggtaaagcgtacagacacgcaatggaggaactaccggacacgattgaaacacttatgctattagcactcattgcagtcttaaccggcggtgtcaccctatttttcttgtcagggaaaggactcggaaagacatcgatcggactgttgtgtgtaaccgcatcgagcgctctgctatggatggccagcgtcgagccacactggatcgccgcaagtataatcctagagttcttcctaatggtgctccttattcccgaacccgatcgtcaacgcaccccacaggataaccaactcgcttacgtagtcataggcctcctcttcatgattctcactgtggcagcaaacgaaatgggactcctagaaacaaccaagaaggacttagggattggacatgtggccgcggagaatcatcaacacgcaaccatgctcgacgtcgacctcaggccggcgagcgcgtggaccctctacgcggttgcgactacggtcatcacccccatgatgcggcacactatcgaaaatacaaccgccaacatcagtctaacagcgatagcgaaccaagcagcgatccttatgggcctggacaaaggatggcccattagtaaaatggatatcggggtgccgctactggcgctaggctgctactcccaggtcaacccattaaccctgaccgccgcggttctcatgttagtcgcccactacgctattataggaccgggcctacaagcgaaggccacacgggaggcacaaaagcgtacagctgcaggcataatgaaaaaccctaccgtcgatggaattgtagcaattgacctcgacccagtagtatacgatgccaaatttgagaagcaactcggacaaataatgctcctgattctctgcactagccagatattactcatgcgtacaacctgggcactgtgcgagagcataacactagcaacgggccctctcaccacactctgggaaggcagcccagggaaattttggaatacgacaattgcggtaagtatggctaatatattcagaggctcgtacctcgcaggcgcagggctagccttctcattaatgaaatcactcggtggagggagacgtggaaccggagcacaaggcgagacgctcggcgaaaaatggaaaagacaattgaaccaattgagtaaatcggagttcaacgcctacaagcgatctggcataatggaagtggaccgttcggaagcgaaagagggcctaaagagaggtgaaaccacaaagcacgcggtcagtcggggcacagctaagctgcgatggttcgtggaacgaaacttggttaaacccgagggcaaggttatagacctcggatgcggtagaggagggtggtcctactactgtgcgggcctaaagaaagtcactgaagtaaaaggatacaccaaaggagggcccggccacgaggagcccatcccaatggccacgtacgggtggaaccttgtaaaactccacagtggaaaagatgttttctttatgccacccgaaaagtgcgacaccctactttgcgacattggagaatcctcacccaacccaacgattgaagagggaagaacgttaagagtactaaagatggtagaaccatggttgcggggaaatcaattctgtataaagatcctgaacccatacatgccatcggtcgtcgaaacactcgaacagatgcaaaggaagcatggaggcatgctcgtcagaaaccccctctcacgcaatagcacccacgaaatgtactgggtctcgtgtgggacggggaacatcgtcagcgcggtaaatatgaccagtagaatgctgctcaatcgattcacgatggctcatcgaaagcctacctacgagagagacgtagacctcggagccggaacacgtcacgtggcagtagagccagaagtggcaaacctagacataataggccagcggatcgaaaacatcaaaaacgaacataaaagcacctggcattacgacgaggacaacccgtacaagacttgggcctaccacggtagctacgaagtgaaacccagcggttcagcctcctccatggtcaacggtgtggtgcgactgctcacaaaaccatgggatgtaataccaatggtaacccaaatagcaatgaccgacactacgcctttcggacaacagagagtatttaaagaaaaagtggacaccagaactccgagggctaaacgaggaacaacccagatcatggaggtaacagcaaagtggctatggggatttctatcaagaaacaagaaacctagaatatgcacaagggaagaatttactaggaaggtccgatcaaacgcagctatcggcgccgtctttgtagacgaaaatcaatggaactcagccaaagaagctgtcgaagatgagagcttctgggacctcgtacataaagaaagagagctccacaaacagggcaaatgcgccacctgtgtctataatatgatggggaagcgggaaaagaaacttggagaatttgggaaagcgaagggaagccgggcaatctggtacatgtggctcggagcgagattcttggagttcgaagctctgggattcatgaacgaggaccactggtttagccgcgaaaactcattatctggcgtcgaaggggagggactgcacaaacttgggtatatacttagagatatcagcaaaattcctgggggaaacatgtatgccgacgacaccgcaggatgggacactcgaataacagaagacgacctacaaaatgaggccaaaatcacagagattatggaacccgagcacgccctactggccacaagtatcttcaaactgacgtatcagaacaaagtggttcgagtacagcgtccagccaaaaacggcacggtaatggacgtcatctcgcgccgcgaccagcgtggcagtggccaggtgggcacatacgggctcaacacattcacgaacatgggggtccaactcatccgccaaatggagtcggaagggatattcctaccctctgagctcgaaaccccaaatctggcggaacgagtgcttgactggctagaaaaacacggcgcggaaaggctgaagagaatggcaattagcggcgacgattgcgtagtcaaaccgatcgacgacagattcgcaacagcgctcacggctctgaatgacatggggaaggtaaggaaagacataccgcagtgggaaccatcgaaggggtggaacgactggcaacaagtgcctttctgcagccaccacttccaccagctaataatgaaagacgggagggaaatcgtagtcccgtgtagaaaccaggacgaattagtgggtcgcgccagggtcagccaaggtgccggatggagcctgcgagaaacagcgtgcctgggaaaaagctacgcacaaatgtggcaactcatgtacttccataggcgggacttaaggcttgcggccaacgccatctgctccgccgtccccgtagactgggtaccaacatcgcgcacaacgtggtcgatccatgctcaccaccagtggatgaccacggaggacatgctcagcgtgtggaatcgcgtatggatcgaggagaacccgtggatggaagacaaaacccacgtttccagttgggaagaggtcccatacctggggaaacgtgaggaccaatggtgtggaagcctcatcggcctcacagcccgcgcaacgtgggcaacgaatattcaggtcgcaataaaccaggtccgccgactaataggcaacgaaaactatctcgactacatgacgagcatgaaaaggttcaaaaatgaaagcgatcccgagggggcgctctggtaa

SEQ ID NO: 23882 - RNA, 9879 nt, synthetic construct
  misc_feature 1..9879: note = derived and/or modified CDS sequence (opt11) from DENV-1__GQ868512__SS-prME
  source 1..9879: mol_type = other RNA
agcgtgaccatgctactcatgctgctgcccaccgccctggccttccacctgaccacccggggcggggaaccccacatgatcgtgagcaagcaggagagaggtaaaagcttactgtttaaaaccagcgctggtgttaatatgtgcaccctgatcgccatggacttaggcgagctctgtgaggacaccatgacctacaagtgcccccaaatcaccgaggcggagcccgacgacgtcgactgctggtgcaatgccacggatacctgggtgacctacgggacctgctctcagaccggcgagcaccgccgggacaagcgctccgtggccttggctcctcacgtgggcttagggctcgagacccgtaccgaaacgtggatgagctccgagggcgcctggaagcaaatccagcgcgtcgagacctgggccttaaggcaccccgggttcacggtgatcgctctgttcctggcgcacgccattggtaccagcatcacccagaaggggatcatattcatcctgctgatgctcgtgaccccctccatggccatgcgctgcgtcggcatcggcaaccgggacttcgttgaagggctgagcggcgccacgtgggtggacgtcgtcctggagcacgggtcatgcgtcaccaccatggccaagaacaagcccaccctcgacatcgaactgctgaagacggaggtcaccaaccctgcaatcctccgaaagctgtgcatcgaagccaagatctctaacaccaccaccgattcccgctgccctacccagggagaggccaccttggtggaggagcaagacgccaacttcgtatgccgccgcacgttcgtggaccgcggctggggaaacggctgcggcctcttcggaaaggggtccctgctcacgtgcgccaagttcaagtgtgttaccaagctcgaaggtaaaatcgtgcagtacgaaaacctgaagtatagcgtcatcgtaaccgtccacaccggcgaccagcaccaagtcgggaatgagacgaccgagcatggcaccatcgcgaccataacgccgcaagctcctacgtcagagatccagctgaccgactacggggccctcaccctggactgcagcccccggaccggcctagacttcaatgagatggtacttctgaccatgaaggagaaatcctggctggtgcacaagcagtggttcctcgacctcccgctgccctggacctccggggccagcacttctcaggagacctggaaccgccaagacctcctggtgactttcaagacagcccacgccaaaaagcaagaagtggtcgtgctgggctcccaagagggcgccatgcacaccgccctgacgggggccacggagatccagacttccggcaccaccacgatctttgcagggcacttaaagtgccggctgaagatggacaaactcacgcttaagggcacctcctacgtgatgtgcacggggagctttaagctggagaaggaggtcgctgaaacgcaacatggcaccgtgctggtgcaggtgaagtacgagggcacggacgccccatgcaagatccccttctccacccaggacgagaaaggggtaacgcagaatggccgtctcatcaccgccaacccgatcgtgaccgacaaagagaaacctgtcaacatcgagactgagccgcccttcggggagagctacatcgtggtgggggccggagagaaggcgctgaagctgtcctggttcaagaaggggagcagtattgggaagatgtttgaggccacggcccgcggtgcccgccggatggctatcctcggcgacaccgcgtgggacttcgggagcattggaggcgtcttcacctctgtggggaagctcgtgcaccaggtcttcggtaccgcctacggggtgctctttagcggtgtgtcgtggacgatgaagatagggatcggcatccttctgacatggctaggcctcaatagccgctcgacctcactgtccatgacctgcatcgccgtcgggatggtgacgctgtatctcggcgtgatggtccaggctgacagcgggtgtgtgatcaactggaaaggccgcgagctgaagtgcggctccggcatcttcgtgaccaacgaggtccatacctggaccgagcagtacaagttccaggcagactctcctaagcggctgtctgcagcaatcggcaaggcctgggaggagggggtttgcggcattcgctccgccacccggctagaaaacatcatgtggaagcaaatcagcaacgagctgaatcacatcctgctcgagaacgacatgaagttcacggtggtcgttggagacgccaacggcatcctggctcaggggaaaaagatgatccggccccagcccatggaacacaagtactcctggaagtcctggggcaaagccaagatcatcggcgctgatatccagaacaccaccttcatcatcgacgggccagataccccggagtgtcccgacaaccagcgggcctggaacatatgggaggtggaggactacggctttgggatctttactacgaacatatggctgaagctccgcgatagctacactcagatgtgcgaccatagattaatgagtgcggccataaaggactccaaggccgtccacgccgacatgggctactggatcgagagcgaaaagaacgaaacatggaagctggcgcgcgcgtccttcattgaagttaagacttgcacctggcccaaatcacacaccctctggtccaacggggtcctggagagcgaaatgataatccccaagatctatggaggaccgatctcccagcacaactaccggcccgggtatttcacacaaacggccggcccctggcacctggggaagctcgagctggacttcgacctgtgcgaaggtacgacagtcgtggtggacgagcactgcggaaaccgagggccgtcgctcaggacaaccaccgtaaccggcaagatcatccacgaatggtgctgccgctcctgcaccctgccgcccctgaggttccgtggggaggacggctgctggtacggaatggaaatcaggcccgtgaaggagaaagaagagaaccttgtgaggagcatggtctctgccggcagcggggaggtggactcattctctctagggatcctgtgcgtgagtatcatgattgaggaggtcatgcggtcacgctggagccggaagatgctcatgacgggcaccctggctgtgttcctgctcctggtgatgggtcagctgacctggaacgacttgatcaggctgtgtatcatggtcggcgccaacgcatccgaccgcatggggatgggcaccacgtacctggccctcatggccaccttcaagatgcggccgatgttcgccgtggggctgctgtttcgccggttaaccagccgcgaggtgttactgctcaccatcgggctgtcgttagttgccagcgtggagctccccaactccctggaggagttgggcgatggactcgcgatgggcatcatgatgcttaagctattgacagagttccagccccaccaactgtggacgaccctcctcagcctgaccttcatcaagacgaccctatctctcgactatgcctggaagaccacggccatggccctgagcatagtgtccctattccccctctgcctgagcacgacctcccaaaagaccacctggctccctgtgctcctgggcagcttcgggtgcaagcccctgaccatgttcctcatcacggagaataaaatatggggacgcaagtcttggcccctgaacgaggggatcatggcgatcggcatcgtaagcatcttgctctcttcactgctgaaaaatgatgtcccgcttgccgggccactgatcgcgggtggcatgctgatcgcctgctacgtcataagcgggtccagtgcggacctttccctggagaaggcggccgaggtaagctgggagcaggaggccgagcactccggcaccagccacaacatcctcgtcgaggtacaggacgacgggaccatgaagatcaaggacgaggagcgcgacgataccctcaccatacttctaaaggccactcttttagctgtgtcaggcgtctaccccatgtcaatacccgcgacactcttcgtgtggtatttctggcagaagaagaagcagcggtccggcgtgctctgggacacccccagcccccccgaagtcgagcgcgccgtgctggacgacgggatctaccggatcttacaacgcggactgctcgggagaagccaggtcggcgtcggggtgtttcaggacggcgtgttccacacgatgtggcacgtcacgcgcggagccgtgctgatgtaccagggcaagagactggagcccagctgggcgtccgtgaagaaggacctcatctcctacggagggggctggcgcttccaagggtcttggaacaccggcgaagaggtccaggtgatcgctgtcgagcccgggaagaacccgaagaacgttcaaaccacccccggcactttcaaaacacccgagggcgaagtgggggcgattgccctggactttaagcccggcaccagcggctcaccgatcgtcaaccgggagggcaaaattgtcggcctgtacgggaacggcgtggtgacgaccagcgggacctacgtctccgcaattgcgcaggctaaggcgagccaggagggtcccctgcccgagatcgaagacgaggtttttaagaaacggaacctgaccataatggacctgcacccagggagcggcaagacgcggcgctacctccccgcgatcgtgcgggaggccatcaagaggaagctgcggaccttgatcctcgcccccaccagggtggtggcctcggagatggccgaggccctaaagggtatgcccattcgctaccagaccacggccgtgaagagcgagcacaccgggcgagagatcgtcgatcttatgtgccacgccaccttcaccatgcgcctactgtcccctgtgcgcgttccaaactacaacatgatcatcatggacgaggcccactttacggaccccgccagcatcgcagcccgcggctacatatcgacgcgagtcggaatgggagaggcggcggccatctttatgaccgctacgccaccaggcagcgtggaagccttcccgcagtccaatgccgtcatccaggacgaagagcgcgacatccccgagcggtcatggaactccgggtacgattggatcacggacttcccaggtaaaaccgtctggttcgtgccctcgatcaagagcggcaacgacatcgcgaactgcctgagaaaaaatggaaaacgggtcatacagctctctcgcaagacattcgacaccgagtaccaaaagacgaagaacaacgactgggactatgtcgtgaccactgacatctccgaaatgggggccaatttccgggccgaccgcgtgatcgacccgcggcgatgcttgaagcccgtaatactaaaggacggccccgagcgggtgatcctcgccggcccgatgcccgtgaccgtggcgagcgccgcccaaagaaggggccggattggccgtaaccagaacaaggagggagaccagtacgtgtacatgggacagcccctcaacaacgacgaggaccacgcccactggacggaggccaaaatgctgctcgacaacatcaacacccctgagggaatcatcccggcactgttcgaaccggagcgtgagaagagcgccgccatcgacggcgagtatcgcctccgcggggaggcccgcaagaccttcgtcgagttgatgagacgaggcgacctgcccgtgtggctcagctacaaggtcgcttctgagggcttccagtactcggatcgtcgctggtgcttcgatggggagcgtaacaatcaggtcctcgaggagaatatggacgtggagatatggaccaaggaaggggagcgcaagaaactgcggccgcgctggcttgacgcgcggacctacagtgacccgctcgccctgcgcgagttcaaagagttcgccgccggtcggcgcagcgtgagcggcgacctgatcctcgagatcggcaagctgccccagcacctgacactgcgtgcccagaacgctctggacaatctggtcatgctgcacaactccgagcagggcgggaaggcctaccgtcacgccatggaggagctccccgacaccatcgagaccctgatgctcctagcccttatcgcggtgttaacagggggcgtgacgctgttcttcctcagcgggaagggcctcgggaagacctccatcggtctgctttgcgtcaccgccagctccgccttgctctggatggccagcgtggaaccccactggatcgccgcatccatcatcctggagtttttcctaatggtgttactaatcccggagcccgaccggcagcgcaccccccaagacaaccaactcgcctacgttgtgatcggcctgctgttcatgatcctcactgtggccgccaacgagatgggtctgctcgagaccactaaaaaggatctcggcattgggcacgtcgccgcggaaaaccaccagcacgccaccatgctggacgtggacctgagaccggctagcgcctggacgctctacgccgttgcgacgaccgtgatcacccctatgatgcgccatacaattgagaacaccaccgccaatatctccctgaccgccatcgctaaccaggcagcgatcctgatgggcctcgacaagggctggcccataagtaagatggacataggtgtgcccctgctggcccttggctgttacagccaggtgaacccactgacgctaacggcagctgtcctcatgctggtggcgcactacgccattatcggccccggtctgcaggccaaggccacccgggaggcacaaaaacggaccgcggctggcatcatgaagaaccccacggtggacggaatcgtcgccatcgatcttgaccccgtggtgtacgacgctaagttcgagaagcagctgggccagatcatgctgctcatactctgtacctcgcaaattctgctcatgcgcacgacctgggccctgtgcgaatccataacgctagcgacgggcccgctgaccaccctttgggaggggagccccgggaagttttggaacacgacaatcgccgtctccatggcgaacatattccggggcagctacttggcaggcgccggtctcgccttcagtctgatgaagtcactcggcgggggccgccgcgggaccggcgcccagggcgagacgctaggcgagaagtggaagcgccagctgaaccagctgtccaagtccgagttcaacacctataagcggtccggcatcatggaagtggaccgttcagaggccaaggaggggctgaagcggggtgagactacaaagcatgccgtgagtcgcggaaccgcgaagctgcggtggttcgttgagcgcaatctcgttaagcccgagggcaaggtgatcgacctgggctgtgggcggggggggtggtcctactactgcgccggcctcaaaaaggtcaccgaggtgaagggttacaccaagggcggccccgggcacgaggagccgatccccatggccacttacggctggaacttagtgaaactgcactctgggaaggatgtcttcttcatgccccccgagaaatgtgataccctcctgtgtgatattggagagtccagccccaaccccactattgaggaggggcgcacgttgcgcgtgctaaagatggtagagccctggctgcgcggcaaccaattctgcatcaagattctgaatccctacatgccgtctgtcgtggaggcgctcgaacagatgcagcgtaagcacggcggcatgctggtgcggaaccccttgagccggaactccacccacgagatgtactgggtctcatgtggcaccgggaacatagtgtcagccgtgaacatgaccagcagaatgctcctcaaccggtttactatggcgcatcggaagcccacctacgagcgcgacgtcgatctgggcgctggcacgcggcatgtggcggtggaacctgaggttgccaacctcgacatcattggccagcgtatcgagaacatcaaaaacgagcataagtccacctggcattatgacgaggacaacccgtacaagacttgggcttatcacggtagctacgaggtgaaaccctccgggagcgcttccagtatggtgaacggcgtcgtgcggctactgaccaagccctgggacgtcatacccatggtgacccagatcgccatgactgacacgacccctttcgggcaacagcgcgtattcaaggagaaggtcgacactcggaccccccgtgctaagcggggaaccacccagatcatggaagtgaccgccaagtggctctggggcttcctgtcccgcaacaagaagcctcggatctgcacccgagaggagttcacccggaaggtgcggagcaacgccgcgatcggggccgttttcgtagacgagaaccaatggaacagcgccaaggaggccgtcgaagacgagcggttttgggacctggtccatcgcgagcgggagctgcacaagcaaggcaagtgcgcgacctgcgtgtataacatgatggggaagcgggagaagaagctgggcgagttcgggaaggccaagggctcccgggccatctggtacatgtggttaggagcacgcttcctcgagttcgaggccctggggtttatgaacgaggaccactggttctcccgggagaacagcctgtcaggggtggaaggggagggtctccacaagctggggtatatcctacgcgatatctccaagatcccaggcggcaacatgtatgctgacgacaccgcagggtgggacacccggatcacggaggacgacctccagaacgaggcgaagataaccgagataatggaacccgagcacgctctgctggccactagcatcttcaaactcacctaccagaacaaggttgtgcgagtccagcgccccgcgaagaatggcacggtcatggatgtgatctcccgtcgtgaccagcgtgggagcggtcaggtgggcacctacgggctcaacactttcactaacatggaggttcagctgatccggcagatggaatctgagggcatcttcttacctagcgagctcgagacaccgaacctggccgagcgggttttggactggcttgagaagcacggtgccgagaggctgaaacgtatggcgatctccggcgacgactgtgtggtcaaacccatcgacgatcgcttcgctaccgcgctcaccgccttaaacgacatggggaaggtgcggaaggacatccctcagtgggagccctcgaagggctggaacgactggcagcaggtccctttctgttcccaccacttccaccaacttatcatgaaagacggccgcgagatcgttgtgccctgccggaaccaggacgagcttgttgggcgcgccagggtcagccagggcgctggctggagccttcgcgagactgcctgcctcggcaagagctacgcccagatgtggcaactcatgtatttccatagacgcgacctgcgactggccgcgaatgccatctgctccgcggtgcccgtggactgggtgcccaccagtcgcacgacctggagcatccacgcccaccaccagtggatgaccaccgaggacatgttatccgtgtggaaccgggtgtggatcgaagagaatccatggatggaggacaagacccacgtcagctcctgggaggaggtgccttacctgggcaagcgcgaagaccagtggtgtggcagcctgatcggtctcaccgcccgcgcaacctgggccaccaacatccaggttgcgatcaaccaagtccggcggctgatcgggaacgaaaactacctggactacatgacatccatgaagcggtttaagaacgagtcagaccctgagggagccctatggtga

SEQ ID NO: 23883 - RNA, 9879 nt, synthetic construct
  misc_feature 1..9879: note = derived and/or modified CDS sequence (opt11) from DENV-1__GU131970__SS-prME
  source 1..9879: mol_type = other RNA
agcgtaaccatgcttttgatgctgctgcctaccgcactcgccttccacttgacgacgcggggaggggagccccacatgatcgtgagcaagcaagagaggggaaaaagcctcctgtttaagacctcagccggggtcaacatgtgcaccctgatcgcaatggacctgggcgagctgtgcgaggatacgatgacctacaaatgtccgcagattaccgaagccgagcccgacgacgtggattgctggtgcaatgccaccgacacgtgggtgacatacggcacgtgtagccagaccggcgagcaccgacgggagaagcgctccgtggccctcgcgccccacgtgggtcttgggttagagacgcggacagagacctggatgtcatccgagggcgcctggaagcagatccagcgcgtcgagacctgggcacttagacatcctggattcacggtgatcgccctgttcctcgcgcacgccatcggcacctctatcacccaaaaagggatcatcttcatactattaatgctcgtgaccccctccatggccatgagatgcgtcggcatcggcaatcgggactttgttgaggggctgagcggcgccacgtgggtggacgtcgtgctggagcacggctcatgcgtcaccaccatggccaagaacaaacctacgctcgacatcgagctgctgaagacggaagtcactaacccagcgatcctccggaagctgtgcattgaggccaaaatcagcaacaccaccacggactcccggtgtcccacccagggggaggccacgctcgtggaggaacaggacgctaactttgtgtgccgccggacattcgtagaccgcggctgggggaatggctgcggcctcttcggcaaggggagcctgctgacgtgcgccaagtttaagtgcgtgacgaagctcgaaggtaagatcgtgcagtacgaaaacctgaagtattccgttatcgtcacggtgcacaccggcgaccagcaccaggtcgggaacgagacgaccgagcacggaaccatcgcgaccatcaccccccaagcccccacgagcgagatccagctgaccgactacggcgctctaaccctggactgctccccccggaccggactggacttcaacgagatggtgttgttaacgatgaaggagaagtcctggctggtccacaagcaatggttcctcgacctgccgcttccctggacctccggggccagtaccagccaagagacctggaatcgccaggacctcctggtgacttttaagacagcccacgcgaaaaagcaagaagtggtcgtgctaggctcccaggagggagctatgcacaccgctctcaccggggccaccgagatccagacctccggcaccaccactatcttcgcggggcacctaaagtgccggctgaagatggacaaactcaccctgaagggcacctcctacgttatgtgtaccgggagcttcaaactggagaaagaggtcgcggaaacgcagcacggcacggttctggtgcaggtcaagtacgaaggcaccgatgctccctgcaagatccccttttccacccaggacgagaagggggtgacacagaacggccgtctcattaccgccaacccgatcgttaccgacaaggagaaacccgtcaacatcgagactgaaccgcccttcggtgagagctatatcgtggtgggcgccggcgagaaggcactgaagttaagctggttcaagaagggaagctcaatcggtaagatgttcgaagcgactgcccgcggtgccagacgtatggccatcctaggcgacaccgcatgggatttcgggtctatcggcggcgtcttcacgtcggtcgggaagttggtgcaccaggtattcggcaccgcctacggggtgctgttcagcggcgtgtcctggactatgaagatcgggataggcatactcttgacctggctgggcctcaactcgcgttcaacttctctgtccatgacctgcattgctgtcgggatggtgacactgtacctcggcgtcatggtacaggccgacagcgggtgcgtgatcaactggaaaggccgcgagctcaagtgcgggagtggcatcttcgttacaaacgaagtccacacatggaccgagcagtacaagttccaagccgactccccgaaaagactgtctgcggctataggcaaggcctgggaggagggggtgtgcggcatccgatccgccaccagactggaaaacatcatgtggaagcagatcagcaacgagctgaaccacatactgctcgaaaatgacatgaaattcacggtggtcgttggtgacgcgaacggcatccttgcccaggggaagaagaccatcaggcctcaacccatggaacataagtactcctggaagtcctggggtaaagcgaagatcatcggcgctgacatccaaaacacgaccttcattatcgacgggcctgacacgccggagtgtcccgacaaccagcgggcctggaacatatgggaggtggaggattacgggtttggtatcttcaccaccaatatctggctgaagctccgcgactcctacacccagatgtgcgatcaccggctgatgtccgcagctatcaaggactccaaggccgtccacgccgatatggggtactggatcgaaagcgagaagaacgagacttggaagctggcccgcgcgtccttcattgaggtgaagacctgcacctggccgaaaagccacaccctctggtccaatggcgtgctggagtcagagatgatcatcccaaagatttatgggggcccgatctctcagcataactaccggcccgggtacttcacccaaaccgccggcccctggcacctggggaagctcgagttagacttcgacctgtgcgagggcaccacggtcgtggtggatgagcactgcgggaaccgcggtccgagtctccggacaactaccgttaccggcaagataatccacgagtggtgctgccgctcctgcacgctgcctcctctgcgttttcggggggaggacggctgctggtacggtatggagatcaggcccgtcaaagagaaggaggagaatctcgtacgcagcatggtgagcgcaggcagcggcgaggtggacagcttctccctcgggatcctgtgcgtaagcatcatgatcgaggaggtcatgagatcccgctggagccgaaaaatgctcatgaccggcaccctggccgtgttcctgctgctgatcatgggtcagctaacctggaaggacttaattcgcttatgtatcatggtgggcgccaacgcttccgaccgcatgggaatgggcacgacctacctggccctcatggccaccttcaagatgagaccgatgttcgcggtgggcttgttattccgccggctaacctctcgggaagtgctgctgctcacgatagggctgtccctggttgctagcgtcgaattgcccaactccctagaggagctcggcgacgggctcgcgatgggcatcatgatgctaaaactgttgaccgagtttcatccccaccagctttggaccacgctgctcagcctgactttcatcaagacgaccctgtccctggactacgcgtggaagacgacggcaatggcactgagcatagtatctttatttcccctctgcctgagcacgacctcccagaagaccacctggctgccggttctactaggcagcttcgggtgcaagcccctgacgatgtttcttatcaccgagaacaagatctggggcaggaaatcctggcccctgaacgaggggattatggcgatcggcattgtgagtatcctgctctccagcctgctgaagaacgacgtgcccttagcggggcctctcatcgccggcggcatgctgatcgcctgctatgtcatctcagggtcaagcgcagacctctccctcgagaaggcggcagaggtgtcctgggagcaggaagccgagcatagcggcactagccataacattctcgtcgaggttcaggacgacgggaccatgaagatcaaggatgaggaacgcgatgacacgcttaccatcctgctgaaggcaaccctcctggccgtaagtggagtgtatcccatgagcatccccgcgaccctcttcgtgtggtacttttggcaaaagaagaagcagcggtcgggggttctttgggacacgcccagtccgcccgaagtggagcgcgccgtactggacgacggcatatacagaatcctgcagcgcgggctgctcgggcggtcccaggtcggcgtgggggtctttcaggatggggtgttccacacgatgtggcacgtgacgcgcggggccgtcctgatgtatcagggcaagcggctggaacccagctgggcctctgttaagaaggacctcatcagctatgggggcggatggcgcttccaggggtcctggaacaccggggaggaggtgcaagtcatagccgtggagcccgggaagaacccgaagaatgtccagacaactcccggcaccttcaagactcctgaaggtgaggtaggggcgatcgccctggactttaagccagggacgagcgggagcccgatcgtgaacagggagggtaagatagtgggcctatacgggaatggcgtggtgactactagcgggacctacgtgtctgccatcgcccaggctaaggcgagccaggagggccccctccccgagattgaagacgaagtattcaaaaagcgcaatctaacgatcatggacttacacccggggagcggcaagacccgcaggtatctcccggctattgttcgggaggccatcaagcgcaagttgcggaccctgatcctcgccccgacccgcgtggttgcgagtgagatggccgaggccctgaaggggatgcccatccgataccaaacaaccgccgtgaagagcgagcacaccggtcgagagattgtggatctgatgtgccacgccaccttcacgatgcgactgctgtccccggttcgcgtgcccaactacaacatgatcatcatggacgaggcgcacttcaccgacccagccagcatcgccgcccgcggctacatttccacccgtgtgggcatgggcgaagctgcggcaatcttcatgaccgccacgcccccgggctctgtcgaagcgttcccccagtccaacgccgttatccaggatgaagagcgcgacatccccgaacggagctggaactcgggctatgattggatcaccgacttcccagggaaaactgtgtggttcgttccgagcataaaatccggaaacgacatcgcgaactgcctgcgcaagaacggcaagcgggtgatccaactcagtcgtaaaactttcgacacggaataccagaagacaaaaaataacgactgggactatgtggtcaccaccgacatatccgagatgggggccaatttccgcgccgaccgcgtgattgaccccagacgctgcctgaagcctgtgatcctgaaggacgggcccgagcgggttatcctagcagggccgatgcccgtgacggtggcgtcagccgcgcagaggcggggcaggatcgggaggaaccagaacaaggagggggatcaatacgtctacatgggacagcccctgaacaacgatgaggaccacgcccattggaccgaggccaagatgctcttagacaacataaacacccccgaggggatcataccggcactcttcgagcccgaacgcgagaagagcgccgccatcgacggcgagtatcgcctgcgcggggaggcccgcaagactttcgtggagctcatgcgtcgcggcgacttacccgtttggttgtcgtacaaggtggcctccgagggcttccagtatagcgaccggcgatggtgcttcgacggggagcggaataaccaggtactcgaggagaacatggacgtcgagatctggaccaaggaaggcgagcgcaagaaactgcggccccgctggttagacgcgcggacctacagtgacccgctggccctgcgcgagttcaaggagttcgccgccgggcgtaggagcgtgagcggcgatttgattctcgagatcggcaagctgccccagcacctgaccctaagggcccagaacgcgctggacaacctggtgatgctccataattcagagcagggcgggaaggcctaccgccacgccatggaggaactgcccgacaccatcgagactctgatgcttctggccttaatcgcggtcctaacaggcggcgtcactctgttcttcttgagcgggaaaggtcttgggaagacctccatcggactgctgtgcgtgaccgccagctccgccctcctgtggatggccagcgtggagccccactggatcgcggcgtccatcatcctggagttcttcttgatggtgttacttattcctgagcctgatcgtcagcgcacgccccaggacaaccagctcgcctacgtggtcatcgggctcctgttcatgattctcaccgtggcagccaacgagatggggttgctggagaccacgaaaaaggacctcgggatcggtcacgtggccgcagagaatcaccagcacgccactatgctggatgttgacttacggccggcctccgcctggaccctctacgccgtcgcgactaccgtgatcactcccatgatgcgccacaccatcgagaacactaccgccaacatctccctgacggccatcgcgaaccaggccgccatcctgatgggcctcgacaagggctggcccataagcaagatggacatcggggtacccctgctggcactcggctgttactcacaggtgaacccgctgacactaaccgccgcagtgctcatgctagtcgcgcactacgccatcattgggccaggcttacaggccaaggccaccagggaggcccaaaagagaacggcggccgggatcatgaagaaccccaccgtggacggcatcgtggccatcgacctcgaccccgtcgtgtacgacgccaaattcgagaagcagctcggccagatcatgctgctcatcttgtgcaccagccagatactgttgatgaggactacgtgggccctgtgcgagtccatcaccctggcgaccgggccgctcaccacgctgtgggaaggcagccccgggaagttctggaatacaaccatcgcagtctccatggccaacatcttccggggctcatatcttgcgggcgccgggctcgccttctccctgatgaagagcctgggagggggccgccgggggaccggcgcccaaggagagacgctcggggagaagtggaagcgtcagctgaatcagttatccaagtccgagttcaacacatacaagcggagtggcatcatggaagtcgaccgaagtgaggccaaggaggggctgaaacggggggagaccaccaagcacgccgtgagcagagggaccgcgaagctgcggtggttcgttgagcgcaaccttgtcaagcctgagggcaaagtgatcgacctgggttgcgggcggggcgggtggtcctactattgcgccggcctcaaaaaggtgacggaagtcaaggggtacaccaagggcggccccgggcacgaggagccgatcccaatggccacctacggttggaacctggtaaagcttcacagcgggaaggacgtgttcttcatgccgcccgagaagtgcgacaccctcctatgcgacatcggcgagtccagcccgaaccccacgattgaggaggggcgcaccctacgagtactcaagatggtggagccctggttacgcggcaaccagttttgtatcaagatcctgaacccctacatgccgtccgtggtcgagactctcgagcagatgcagcggaaacacggcggcatgctggtgcgcaacccacttagccggaactccacccacgagatgtactgggtctcatgcggtacagggaacatcgttagtgccgtcaacatgaccagcagaatgcttttgaaccggttcaccatggctcaccgaaagcccacctacgagcgcgacgtggacctgggcgcgggcacgcggcacgtcgccgtggagcctgaggtggccaacctcgacatcatcgggcagcgcatcgagaatatcaagaacgagcacaagagtacctggcactatgacgaggacaacccgtacaagacgtgggcttaccacggcagctacgaggtcaaaccgtccgggagtgcgtccagcatggtgaacggcgtggtccggctgctgaccaagccctgggacgttatccccatggtcacgcagatcgcgatgaccgacaccactccgttcggacagcagcgcgtattcaaagagaaggtggacacccggactccccgggccaagcggggcacgacccagataatggaagtcaccgccaagtggctctgggggttcctgtcccgcaacaagaagccccggatctgtacgcgcgaggagttcacccggaaggtgcgcagcaacgccgccattggggcggtgttcgtcgatgagaaccaatggaactcggcgaaggaggccgtggaggacgagcggttctgggacctggtgcatcgcgaacgagagctccataaacagggcaagtgtgcgacctgcgtttacaacatgatggggaagagagagaagaagctgggggagttcgggaaggcgaagggcagcagggccatctggtatatgtggctgggggcgcgcttcctcgagttcgaggcgcttgggttcatgaatgaggatcactggtttagccgggagaacagcttgagtggcgtggagggggagggcctccacaaactcgggtacatcttacgtgacatctcgaagatcccgggcggcaatatgtacgcagacgacacggcggggtgggacacccgcatcacggaagacgacctacagaacgaggccaagatcaccgacatcatggagcccgaacacgcgctgctggccacgagcatcttcaagctcacctaccaaaacaaggtggtccgcgttcagcgccccgcgaagaacgggaccgtgatggacgtcatctcgcggcgcgaccagcgggggagcggccaggtcggcacttacgggttaaacacgttcaccaacatggaggtgcagctgatccggcaaatggagtccgagggaatcttcctcccctcggaactggagaccccgaaccttgcggagcgtgtcctcgactggttagagaagcacggagctgaacgcctgaaaagaatggccatttccggcgacgattgcgttgtaaagcccatcgacgaccgctttgccaccgccctcaccgcgctgaacgacatggggaaggtccggaaggacatcccccagtgggagcccagcaagggctggaacgactggcagcaggtcccgttctgttcccatcacttccaccaactgatcatgaaggacggccgagagatcgtcgtgccgtgtcggaaccaggacgagctggtagggagagcacgggtttcgcagggcgccggttggtccctgaaggaaacggcttgcttaggcaagagctacgctcagatgtggcagcttatgtacttccaccgccgggacctacgtcttgcggccaacgccatctgctctgccgtccccgtggactgggtccctaccagccggaccacttggagcatccacgcacatcaccagtggatgactaccgaggacatgctctccgtttggaaccgcgtgtggatcgaggagaacccgtggatggaggacaagacccacgtgtcctcctgggaggaggtcccctatctggggaagcgggaggaccagtggtgtggctcgctgattggcctcaccgcccgcgcaacgtgggctaccaatatccaggtggccatcaaccaggtgcgccggctgatcggtaacgagaactacctagactacatgacctccatgaaacgcttcaagaacgagagcgaccccgaaggcgccctctggtaa

SEQ ID NO: 23884 - RNA, 9879 nt, synthetic construct
  misc_feature 1..9879: note = derived and/or modified CDS sequence (opt11) from DENV-1__KF955427__SS-prME
  source 1..9879: mol_type = other RNA
agcgtcaccatgctgctaatgctgttgccgacagctctcgcattccacctgaccaccagagggggcgagccgcatatgatcgtgtccaagcaggagcggggcaagagcttgctattcaagaccagtgctggggttaacatgtgtaccctgattgccatggatctgggtgaactatgcgaggacaccatgacttacaagtgcccccagatcaccgaagccgagcccgacgacgtggattgctggtgtaatgccaccgatacctgggtcacctacgggacctgcagccagaccggcgagcaccgtcgggataagaggagcgtggccctggcgccccacgtgggcctggggctagagacgcggaccgagacctggatgtccagcgagggtgcctggaagcagatccaacgggtggagacttgggccctgcgtcatcccgggtttacggttatcgctttgttcctcgcccacgccataggtacatccatcacgcagaaggggatcatcttcatcctgctgatgctcgtgactccctccatggccatgcgctgcgtaggcatcggcaacagagactttgtggaggggctgagcggcgcgacgtgggtcgacgtcgtgctggagcacgggtcctgtgtaaccaccatggccaagaacaagcctaccctcgacatcgagcttcttaagaccgaagtcaccaatcccgcgatcttgcgcaagctctgcatcgaggcaaagatcagcaacaccacaacggatagtcggtgtcccacacaaggcgaggccaccttggtggaggaacaagacgctaactttgtgtgccgccggaccttcgtcgatcgagggtggggtaatggttgcggcctcttcggcaagggtagcctcctgacgtgcgcgaagttcaagtgtgtgactaaacttgagggcaagatcgtacagtacgagaacctgaagtactctgtgatcgtgaccgtgcacaccggcgatcagcaccaggtcgggaacgaaacgactgagcacggcactatcgccaccatcacgccccaggctcccaccagtgagatccagctaaccgactacggggccctcaccctagactgcagccccaggaccggccttgacttcaacgagatggtgctactgaccatgaaggagaagtcctggttagtccacaagcagtggttcctcgacctgcccttgccctggacgtccggggccagcacctcacaggaaacgtggaaccgccaggacctactggtcacgttcaagaccgcccacgcgaagaagcaggaagtggtcgtgctgggttctcaggagggggccatgcacaccgcctggaccggggcgacggagatccagaccagcggcacgaccactatcttcgccggccacctcaagtggcggctcaagatggacaaacttaccctcaaaggcacctcctacgtgatgtgcacggggagtttcaaacttgagaaagaagtggcagagacgcaacacgggacaggcctagtccaagtaaagtacgaggggacagacgccccctgcaagatcccgttctccgcccaggacgagaaaggagtcacccagaacggccgactgatcacggctaaccccatcgtgaccgacaaggaaaagcccgttaatatcgaaaccgagccgccattcggcgagagctacatcgtcgttggcgcgggggagaaggcccttaagctctcctggttcaagaagggcagctccatcgggaagatgttcgaagccaccgccaggggcgcccgcaggatggcgatcctcggggacacggcctgggacttcggttcaatcggcggcgtgttcacctccgtcggcaaacttgtgcaccaggtgttcggtaccgcctatggcgtcctgttctctggggtgagctggacaatgaagatcggtatcggcatcctgctcacgtggctggggctgaatagccgctccaccagcctgtccatgacttgcatcgccgtgggtatggtcaccctgtacctgggggtaatggtgcaggctgatagcggctgcgttatcaactggaaaggtcgcgaattaaagtgcggctcgggcatcttcgtgactaacgaagtgcacacctggaccgagcagtacaagtttcaggcggatagccccaagcggctgagcgccgccatcggcaaggcctgggaggaaggagtctgtgggatccgatccgcgacccggctggagaatatcatgtggaagcagataagcaacgagctcaatcacattctgctggaaaacgacatgaagttcacagtggtggtcggtgacgcgaacggtatcttggcccagggtaagaagatgatccggccccagcccatggagcacaagtactcctggaagtcctggggaaaggccaagattatcggggccgatattcaaaacacgaccttcattatcgatggtcccgataccccggagtgcccggataatcagcgggcgtggaacatctgggaggtggaggactacgggttcggcatcttcaccacgaacatctggctgaaactgcgagattcctacactcagatgtgcgaccacagattgatgagcgccgccatcaaggactccaaggccgttcacgccgacatgggctactggatcgaaagcgagaagaacgaaacctggaagctggcgcgtgcttccttcatcgaggtcaaaacctgcacgtggcccaaaagccataccctatggtccaacggggtgctcgagtcggagatgattatccccaagatttatggcgggccgatcagccaacacaactatcggcccggctacttcacccagaccgcaggaccctggcacctcgggaagctggaattggacttcgacctgtgcgagggcacgactgtagtcgttgacgagcattgcgggaaccgcggtccttcgctgcgtaccacaacggtgaccggaaagatcatccacgaatggtgctgccgatcttgcaccctgccgcccctgcgtttccgtggcgaagacggctgctggtacggcatggagatccggcctgtcaaggagaaggaggaaaatctggtgcgctccatggtctccgccggcagcggagaggttgatagcttctccttaggtatcctgtgcgcctctataatgatcgaggaagtgatgcggtcacgctggagccggaagatgctgatgaccgggacgctcgcggtgttcctgctcctcgtaatgggccagctgacctggaacgatctgatccgcctatgcatcatggtgggggccaacgcttccgaccgcatgggaatgggcactacctacctggcgctgatggctacgttcaagatgcgcccgatgttcgcggtcgggctccttttccgccggctgacatcccgcgaggtcttgctgctgaccatcggcctctccctagtggccagcgtcgagctgccgaactcacttgaggagctgggtgacggtctggcgatggggatcatgatgctgaagctgctaaccgagttccagccccaccaactttggacgacactgctatctctcactttcattaagaccacgttgagtctggactacgcctggaagaccacggccatggccttaagcatcgtctccctgttccccctgtgcctctctaccacttcccagaaaaccacttggttgccggtgctgttggggagcttcggctgtaagcccctgaccatgttcctgattaccgaaaataaaatctgggggcggaagtcctggcccctcaacgagggcatcatggccatcgggatcgtcagcatactgctgtcctcactcttaaagaacgacgtgcccctgccagaccccctcatcgccggcggcatcctgatcgcctgctacgtgatcagcgggtcttcagcggatctgtccctggagaaggccgccgagatgagctgggagcaggaggccgaacactccggcacgagccacaacatcctggtagaggtgcaggacgacggacccatgaagatcaaagatgaggaacgggacgacactctaacaatcttactgaaagctaccctgctcgcggtgtccggcgtctaccctatgagcataccaggaacgcttttcgtatggtacttctggcaaaagaagaaacagcgttccggcgtcctgtgggacacccccagtccccctaaagtcgagagggcggtgttggacgacggtatctaccggatcctacagagggggctgctgggtcggagccaggtaggggtcggagtgttccaggacggggtgttccacaccatgtggcacgtcacccgaggcgccgtgctcatgtaccagggcaagcggctggagccgagctgggccagcgttaagaaggacctgatatcctacgggggaggttggcgttttcaaggtagctggaatacgggcgaagaagtgcaagtgatcgccgtggagcccggcaagaaccccaagaacgtccagaccactcctggcaccttcaagactccggaaggagaggtcggcgcgatcgcccttgactttaagccggggacctcaggctcccccatcgtcaacagagaggggaagatcgtcgggttatatggcaatggggtcgtcaccaccagcggcacgtatgtctccgccattgcccaggctaaggccagccaagaagggccgttacccgaaatcgaggatgaggttttcaagaagcgcaacctcaccataatggacctccatcccggcagtggcaagacccggcgctaccttcccgccattgttcgggaggctatcaagcgcaagctccggaccctgatcctggccccaacccgagttgtggcgtccgaaatggccgaggccctcaaagggatgccaatccgctaccagacgaccgcggtcaagagcgagcacaccggccgggagatagtcgacctgatgtgccacgccacgttcacaatgcgccttctctcccccgtgcgggtgcccaattacaacatgattatcatggacgaggcgcacttcaccgacccggctagcatcgccgcgagggggtacatatccaccagagtcggcatgggggaagcagcggccattttcatgacggcaacgccgcccggcagcgtggaggctttcccacagtccaatgccgtaattcaggacgaggagcgcgacatcccggagcgaagctggaacagtggctatgactggataaccgacttccccgggaagaccgtctggttcgtcccctcgatcaagtcaggcaatgatatcgcgaattgcctgcgcaagaacggcaagcgggtgatccaattgagccgcaagacgttcgacaccgagtaccagaagaccaagaacaacgactgggactacgtcgtgacaacggacatttccgagatgggcgccaactttcgggccgaccgcgtgatcgacccacggcgctgcctcaaaccggttatcctgaaggacgggcccgagagagtgatcctggccgggcccatgcccgtaacagttgcgagcgccgcccagcgccggggccgcataggtcgtaatcagaacaaggagggcgaccagtacgtgtatatggggcagccgctaaacaatgacgaggaccacgctcactggacagaagcaaagatgctattagataacatcaacacacccgagggtattatacccgcactctttgagcctgagcgcgagaagtccgccgccatcgacggggaatatcgcctgcggggcgaggcgcgcaagacgttcgtggagttaatgcggcgcggcgaccttccggtctggctaagctacaaggtggcctccgaaggtttccagtactccgacaggcgctggtgcttcgacggcgagcggaacaaccaggtcctggaggaaaacatggacgtggaaatctggaccaaagaaggggagcggaagaagctccggccacgctggcttgacgcgcggacgtactccgaccccctcgccctccgcgagttcaaggagtttgctgctggccggcgcagcattagcggagacctgattctggagattgggaagctcccccaacacctgaccctgcgggcccagaacgcgctcgacaacctggtgatgctgcacaactccgagcagggcgggaaggcctatcgccacgccatggaggaactcccggacaccatcgagacgctgatgctcctcgccctgatagcggtcctgaccggcggggtgaccctcttcttcctgagcggaaagggcctggggaagacttccataggcctcctgtgtgtgacggccagctccgccctgctctggatggccagtgtcgagccccattggattgccgcgtccatcatcctggagttctttctgatggtgctcctgatacccgagccggaccggcagcgcacgccccaggacaaccagctagcgtacgtggtcattgggctgctgttcatgatcctgaccgtggccgccaatgagatgggcctactggagaccacgaagaaggacctggggataggacacgtagccgcggagaaccaccaacacgcaaccatgctggacgtcgacctgcggcccgctagcgcctggaccttatacgctgtggcgactacagtgatcacgccgatgatgcgccacaccatcgagaataccacggccaatatctccctcaccgccatcgccaaccaggcggcgatcctgatgggactggacaaggggtggccgatctctaagatggacatcggcgtccccctcctggcactggggtgctactcccaggttaacccgctaacgctgaccgccgcagtgctgatgctcgtggcgcactacgccatcatcggccccgggctgcaggcgaaggccacgcgggaggcacagaagaggaccgcggccggcatcatgaaaaatccgaccgtggacggcatcgtcgccattgacctggacccagtcgtgtatgacgccaagtttgagaagcaactggggcaaatcatgctactgatcctctgcaccagccagatcctgctgatgcgcacgacctgggccctctgcgagtccattacactggcgaccggccccctaacgaccctgtgggaagggagcccggggaagttctggaataccacgatcgccgtatccatggccaacatcttccggggcagctaccttgccggtgcaggcctggcattcagcctcatgaagtccctcggtggcgggcgccgtgggacgggcgcccagggcgaaaccctgggcgagaagtggaagcgccagctcaaccagctgagtaagagcgaatttaacacttacaagcggagcgggatcatggaggtcgaccgaagtgaggcgaaggagggcctgaagcgcggggagaccacgaagcacgccgtgagccggggcacagcgaagctccggtggtttgttgaacgcaacctggtcaagccggagggcaaggtcatcgacctggggtgtggacgcggcggttggtcatactactgcgccgggctgaaaaaggtgaccgaggtcaagggctacaccaagggagggcccggccacgaggagcccatccccatggccacctatgggtggaacctcgtgaagctgcacagcggtaaggacgtgttcttcatgcctcccgaaaagtgtgacacgctgctctgcgacatcggggagtcctcgcccaaccccactatcgaggagggtcgcacactgcgggtcttaaagatggtggagccctggctccgcggcaaccagttctgcatcaagatcctgaacccctacatgccttccgtggtcgagacgctggagcagatgcaacggaagcacggaggcatgctcgtgcggaacccactgagccgcaactccacgcacgagatgtactgggttagctgcggcactgggaacatcgtctccgccgtgaacatgacttcgcgcatgttgctcaatcggttcaccatggcccaccgcaagcctacgtacgagcgcgatgtggacctgggcgcggggacccgccacgtagccgtagagcccgaagtggccaacctagatatcatcggccagcggatcgagaatatcaagaacgagcataagtcaacctggcactacgacgaggacaacccttataagacctgggcctaccacgggagctacgaggtcaagccctccggcagcgcttctagcatggtgaacggggtggtacggctactgacgaaaccgtgggatgtgatccccatggtcacccagatcgccatgactgacaccactcctttcggtcagcagcgcgtttttaaggagaaagtggacacccggaccccaagggccaagcgaggcaccactcaaatcatggaggtcaccgcaaaatggctctgggggtttctctccagaaacaagaaaccccggatctgcacccgtgaggagttcacccggaaagtacggagcaacgccgccataggcgcggtgttcgtcgacgagaaccaatggaactcagcgaaggaggctgtggaggacgagaggttctgggatctggtgcaccgcgagagagaactgcacaagcaagggaaatgcgcgacgtgcgtttacaatatgatgggaaagcgcgagaagaagctcggggagttcggcaaagcgaaaggctcccgagcaatctggtacatgtggctgggggctcgcttcctggagtttgaggcgctcggcttcatgaatgaggaccactggtttagccgagagaactctctgtcaggggtggagggcgagggactgcacaaacttggctacattctgcgcgatatctccaagatccccggcgggaacatgtacgccgatgacacagcgggctgggacacccggatcaccgaggacgatctgcagaacgaggctaaaatcacagagattatggagcccgagcacgccctacttgcgaccagcatcttcaaactgacttatcagaacaaggtggtccgagtgcagcgcccggccaagaacggaaccgtgatggacgtcatctcccgcagggatcagagagggtcgggccaagtgggaacctacggcctcaacacgttcaccaacatggaggttcagctgatccgccaaatggagtcagagggaatcttcttacccagtgagctcgagaccccaaatctggcggaaagagtcctggactggctagagaagcacggcgccgagcggctgaagcggatggccatctccggggacgactgcgtggtgaaacccattgacgaccgcttcgccacagcactgacagcgctcaatgacatgggcaaggtgcggaaggacatcccgcaatgggagcctagcaaaggctggaatgactggcagcaggtccccttctgcagccaccacttccaccagctgatcatgaaggacggacgcgaaatcgtggtcccatgccggaatcaggacgagctcgttggccgcgcccgggtgagccaaggagccggctggtccctccgcgagaccgcctgcctgggcaaatcgtacgcccagatgtggcagctgatgtacttccacagaagggacctcagactggcagccaacgcgatttgctccgccgtcccagtggactgggttcccaccagccgcaccacgtggagcatccacgcgcatcaccagtggatgactaccgaggacatgttatccgtctggaaccgggtgtggattgaggagaacccctggatggaggacaagacacatgtgtcgtcctgggaagaggtgccgtacctcggcaagcgtgaggaccagtggtgcggttctttgatcgggctgacggcccgcgcaacgtgggccaccaacatacaggtggccattaaccaagttcgtcgcctcatcggcaatgaaaactatctggactacatgacctccatgaagcgattcaagaacgagagcgatcctgaaggggcgctgtggtaa

SEQ ID NO: 23885 - RNA, 9879 nt, synthetic construct
  misc_feature 1..9879: note = derived and/or modified CDS sequence (opt11) from DENV-1__GQ868513__SS-prME
  source 1..9879: mol_type = other RNA
agtgtgaccatgctattaatgctgcttcccacagccctcgcattccacctgaccacccgaggcggggagccccacatgatcgtcagcaagcaagagcgtggcaagagcctcttattcaagacgagcgcgggggtgaatatgtgtaccctgatcgccatggatctaggcgagctctgcgaagacaccatgacctacaaatgcccccagataaccgaagccgagcccgacgacgtagactgctggtgcaatgcgaccgacacgtgggtgacctacgggacatgcagccagaccggcgagcaccgacgggacaaacgctccgttgccctggctccgcacgtcggactgggtctcgagactcgaaccgagacctggatgagcagtgagggcgcttggaaacagatccagcgcgtcgagacctgggctctcagacaccccgggttcacagtgatcgccctgttcctcgcacacgctattggaacctcgataacccagaaggggatcatcttcatcttgctgatgctcgtgaccccctcgatggccatgcgctgcgtgggcatcgggaaccgcgacttcgtggaggggctgagcggcgccacgtgggtggacgttgtgttagagcacgggtcctgcgtgaccactatggcgaagaataagcccaccttagacatcgagcttctgaagacagaggtcaccaaccccgcaatcctccgcaaactgtgcatcgaagcaaaaatcagcaatacaaccacggactcccggtgcccgacccagggagaggccaccctagtggaagagcaggacgccaactttgtatgccggcggacctttgtcgaccggggctggggtaacggctgtggcctgttcggcaaggggtctctgctcacgtgcgctaagttcaagtgcgtgactaaattagagggcaagatcgtgcagtatgagaatctgaagtactccgtcatcgtaaccgtgcacaccggtgaccagcaccaagttgggaacgagactaccgaacacggcaccatcgcgaccatcacgccccaggcgcccacgtccgagattcagctaaccgactacggggccctaaccctggactgttctccccggacgggcctagacttcaacgagatggtcctgctcacgatgaaggagaagtcctggctggtgcacaagcagtggttcctcgatctgccgctgccctggaccagtggcgcgagcacaagtcaggagacctggaatcgccaggatctacttgtaacgtttaagacagcccatgcgaagaagcaggaggtggttgttctgggctcccaggagggagccatgcccaccgccctcacaggggccacggagatacaaaccagcggaaccaccacgatcttcgcgggtcatctgaagtgcagactgaagatggacaaactcactctaaaagggacctcctacgtgatgtgcactgggagcttcaagcttgagaaagaggtcgcggagacgcaacacggcaccgtgctggtacaagtcaagtacgagggtaccgacgctccttgcaagatcccgttttccacccaagacgaaaagggggtgacacagaacggccgacttataaccgccaacccaatagtgaccgacaaggagaagcccgtgaacatcgaaaccgagccccctttcggggagagctacatcgtggtgggcgctggggagaaggcgcttaaattgtcctggttcaagaagggctcctccatcggcaagatgttcgaggctacggcccgcggggccagacggatggcaatcttaggtgacacggcgtgggacttcgggagcattggcggcgtctttacctctgtgggcaagctagtgcaccaagtctttgggactgcctacggcgtcctgttcagcggcgtatcctggactatgaagatcggaatcggcatcctcctgacgtggttaggactcaacagccgctccaccagcctgtccatgacgtgtattgccgtcggtatggtgacgctctatctcggcgtgatggtccaggctgacagcggctgcgtgatcaactggaagggccgcgagcttaagtgcgggtccggcatcttcgtgaccaatgaggtccatacctggaccgagcagtataagttccaggctgacagccccaagagactgtcggctgccataggaaaggcctgggaggaaggggtgtgcgggatccgcagcgcaacgcggttagagaatataatgtggaagcaaataagcaacgaactcaaccacatcttactcgagaacgacatgaagtttacggtggtcgtgggggacgccaacggcatactggcgcagggcaagaagatgatacgcccacaacccatggagcacaagtactcctggaagtcctggggcaaggccaagataatcggtgccgacatccagaacaccactttcatcatcgatgggcccgacacccccgagtgtcctgacaatcagcgggcctggaacatttgggaggtggaagactacggcttcgggatctttacgaccaacatctggctgaagctcagagacagttatacacagatgtgcgaccaccggctgatgagcgccgccatcaaggactccaaggccgtccacgccgacatgggctattggatcgagtctgaaaaaaacgaaacctggaagctggcacgcgccagtttcatcgaagtgaagacctgcacctggcccaaaagccacacactctggagtaacggcgtgctggagtccgaaatgattatcccgaagatctatgggggccccatctctcaacacaactaccgtcccggatacttcacccaaactgcaggcccgtggcacctggggaagctggagctggacttcgacttatgtgaaggcactaccgtcgtggtggacgaacactgcggcaaccgcgggccatccctcagaacaactaccgttaccgggaagatcatccatgagtggtgttgccgctcctgcaccctgccgcccctgcggtttcgcggggaagacggctgttggtacgggatggaaattcggccggtcaaggagaaggaagagaacctcgtgcgcagcatggtctcagctggcagcggcgaggtggacagctttagcctggggatcctgtgtgccagcatcatgatcgaggaggtaatgagatcacgctggagccggaagatgctcatgacaggaaccctggcagtcttcctgctcctggtgatggggcagctgacctggaacgacttaatccgtttatgcatcatggtaggagccaacgcctccgaccgcatgggaatgggcactacatatcttgcgctaatggccacgttcaagatgcggcccatgttcgccgtagggctgctgtttcgcagattgaccagccgcgaggtgctgctgttaacaatcggtctgtccctggtcgcgtcagttgagctaccgaactccctggaggaactgggcgacgggctcgctatgggcatcatgatgctgaagctgctcacggagttccagccccatcagttgtggataacccttctcagccttaccttcatcaagaccacgctgtctctcgattatgcctggaagaccaccgccatggctctgagtatcgtgtccctgttccccctgtgcctgagcaccacttcgcagaagaccacctggcttcccgtcctcctaggctctttcggctgtaagccgttaaccatgtttttaattaccgagaataaaatatggggccggaagtcctggccccttaacgaggggattatggccattggcattgtctccatcctgctctcctccttactgaagaacgacgtgccgctggcagggcccctgatcgccggaggaatgcttatcgcgtgctacgtcatatcggggtcgagcgccgacctctccctggagaaggccgccgaggtgagctgggagcaggaggccgagcactccggcacaagtcacaacatacttgtggaggttcaagacgacgggaccatgaagatcaaggacgaggagagggacgacaccctcaccatccttctgaaggcaacgctcctggctgtctcgggcgtgtatcccatgtccatcccggccaccctgttcgtctggtacttctggcagaagaagaagcagcggtccggcgttttgtgggacaccccgtctccgcccgaggtggagagagctgtcctggacgacgggatctatcggatcctgcagcgaggcctcctcggtaggtcccaggtgggcgtaggggtcttccaggacggtgtgttccataccatgtggcacgtgacccgcggggcagtcctgatgtaccagggaaagcggctggagccgagttgggcgtccgtaaagaaggacctcatcagctacggagggggctggcgcttccaggggtcctggaacaccggcgaagaagtgcaggtcatcgcggtggagcctgggaagaaccccaaaaacgtgcaaacgatgcccggcacgttcaagacgcccgaaggggaggtcggggcaatcgccctggatttcaaaccaggcaccagcgggtccccgatagtgaaccgggaaggcaaaattgtgggcctgtacggaaacggggtcgtgaccaccagtgggacttacgtatccgccatcgcacaggcaaaagcgagccaggagggcccattaccggagatcgaggacgaggtcttcaaaaagaggaatctaaccatcatggaccttcaccccgggagcggcaagacccgccgctacctcccggcaatggtgcgggaggccatcaagcgcaagcttcgaaccctgatcctcgctcccacgcgagtagtcgcctccgagatggccgaggccctgaagggcatgccgatccgctaccagaccaccgccgtcaaaagcgaacacaccgggcgggagatcgtggacctaatgtgtcatgcgacgttcaccatgagactcctctccccggtccgggtccccaattacaacatgatcattatggacgaggcccacttcactgacccggccagcattgccgcccgaggctacatcagcacccgagtggggatgggcgaggcagccgctatatttatgaccgccaccccgcccgggtcggtcgaggccttcccccagtcaaacgcggtgatccaggacgaggaacgcgacatccctgagcggagctggaactccggctatgactggataaccgatttccccgggaagaccgtgtggttcgtcccctcaattaagtccgggaacgacatcgccaactgtctgcgcaagaacggtaaacgggtgatccagctcagccgcaagacattcgacacggagtaccagaagaccaagaacaatgactgggactatgtagtcaccactgacatctccgagatgggggccaacttccgggccgaccgcgtgatcgacccccggcgctgccttaagcctgtgatcttgaaggacggcccggagcgggtgatcctcgcggggcccatgccagtaactgtcgccagcgccgcgcagcgccggggtagaatcgggcggaaccagaacaaggagggagaccagtacgtctacatgggccagccactaaataatgacgaggatcacgcacactggaccgaggcgaaaatgcttctcgacaacatcaacaccccggaagggataatccccgccttgttcgagcccgagcgcgagaagtctgctgctatcgacggcgagtaccgcctgagaggggaggcgcgcaagacattcgtagagctcatgcggcgaggggacctgcccgtgtggctgagctacaaggttgcgtcagagggatttcagtacagcgacagacgctggtgcttcgacggggagaggaacaaccaagtcctcgaggagaacatggacgtcgagatatggacaaaggaaggcgagagaaagaagttgcgtccacgctggctggacgctcggacgtactccgacccactcgccctgcgagagttcaaggagttcgccgccgggcggcgctctgtttcgggcgatcttattttggagattggcaagctcccacaacacctgaccctcagagcgcaaaacgccttagacaacttagtgatgctgcataactccgaacaaggcgggaaggcctaccgccatgctatggaggagctgcccgacaccatcgagacgttaatgctcctggcgctgatcgccgtcctgacgggaggagtgaccctgttctttctgagcggtaagggcctcggcaagacgagcatcggactgctgtgcgtgacggcgagttccgccctcctgtggatggcaagcgtcgagccacactggatcgcggcctccatcatcctggagttcttcctcatggtgctgcttatccctgagcctgacaggcagcgcactcctcaggataatcagttggcctacgtggtaatcggtctcctgttcatgattctcaccgtggctgccaacgagatggggctgttggaaaccacgaagaaggacttgggcatcgggcatgttgcggccgagaatcaccagcacgctaccatgctggacgttgacttacggccggccagcgcatggacgctctatgcggtggccaccacggtgatcacccccatgatgcggcacactatcgagaataccacggccaacatcagtctgacggctatagctaaccaggcggccatcctgatgggcctagacaagggctggccaatctcaaagatggacatcggggtcccgttgctggcactcggctgctactcccaagtgaaccccctgaccttaaccgctgcggtactcatgctggtcgcgcactacgcaataatcgggccgggccttcaggcgaaggccacgcgcgaagcgcagaagcgaaccgccgctggaatcatgaagaaccccaccgtggacgggatcgtggccatcgacctggacccggtcgtgtatgacgcgaagtttgagaaacaactgggtcaaatcatgctactcatcctttgcaccagccagatcctgctcatgcgaacaacctgggcgctgtgcgagtccataacactggctacgggccccctcactaccctgtgggagggtagccccggcaagttctggaacacaaccatcgccgtgtcgatggcaaacatcttccggggcagctacctggccggtgccggcttagcgttttccttaatgaaatccctgggcgggggcagacgggggacgggcgcgcagggggagaccctaggggagaagtggaaacgccaactgaaccaattatccaagtcggagttcaacacttacaagcggagcgggatcatggaggtcgaccgatccgaggccaaggagggactcaagcggggtgagaccacaaagcacgcggtgtctcgcgggaccgctaagctgcggtggtttgtcgaacgaaatctggtcaaacccgagggcaaggtaattgacctcggctgcgggcggggcggttggtcctactactgtgctggcctcaagaaggtcaccgaggtcaaggggtacaccaagggcggcccggggcacgaggaacccatccccatggctacgtacggctggaacctggtgaagctgcacagcggcaaggatgtcttcttcatgcccccggaaaagtgtgatacgcttttgtgcgacatcggcgaatctagccccaacccgactatcgaagaggggcgcacgctgcgggtcttgaaaatggtggagccgtggttacgtggcaatcagttctgtatcaagatcctgaacccatatatgccaagcgtggtcgagaccctcgagcaaatgcagcggaagcacggcgggatgctcgtccgcaacccgctgtctcggaactccacgcatgagatgtactgggtgagctgcggcaccggcaacatcgtctccgcggtgaacatgacgagcaggatgctcttgaaccggttcaccatggcgcaccgcaagccaacctacgagagggacgtcgacctgggcgccggaacccgccacgtcgcagtagaaccggaggttgccaaccttgacatcatcggacaacgcatagagaatatcaagaacgagcacaaatccacctggcactacgatgaggacaatccgtacaagacctgggcctaccacggcagctacgaagtaaagccctcagggagcgcatctagtatggtgaacggagtcgtacggcttctgacgaagccctgggacgttatccctatggtcacccagatcgctatgaccgacactacgcccttcggccagcagcgcgtgtttaaggagaaggtagacacccggacaccccgcgccaagcggggcactacccaaatcatggaggtcacggccaagtggctctggggattcttgtcacggaacaagaaaccacggatctgcaccagagaggaattcacccggaaggttcgcagcaatgccgcgataggtgccgtgttcgtcgacgagaatcaatggaacagcgctaaggaagctgtcgaggacgagcgcttctgggatctggtccacagggagcgggaactacacaagcagggtaaatgcgcgacgtgcgtgtacaacatgatggggaagcgcgagaagaagctgggcgagttcggtaaagccaaggggtcacgggctatttggtacatgtggctcggtgctcggttcctcgaattcgaagccctggggttcatgaacgaagatcactggttcagccgagagaactccctgtcaggcgtggagggggaaggactccacaaactcggatacatcctacgagatatctcaaagatcccggggggcaacatgtacgcggacgacaccgccgggtgggacacccggataaccgaggacgacctccagaacgaggccaagatcactgagataatggagcccgagcacgcattactagccacgagcattttcaagctcacctaccagaacaaggtagtccgcgtgcagagacccgccaagaacggcaccgttatggacgtgatatcccgccgtgaccaacgggggagcggccaagtgggcacatacgggctgaacaccttcacgaatatggaggtgcagctgatccgccagatggagagtgagggcatctttttgccaagcgagctcgaaacccccaacttggccgaacgggtcctcgactggctggagaaacacggggccgagagactaaaacggatggccatcagcggcgatgactgcgtagtgaagcccatcgacgatcgcttcgccacggcgctcacggcgctgaacgacatggggaaagtcaggaaggatattccccagtgggagccaagtaaaggctggaacgattggcagcaggttcccttctgctcccaccacttccatcagttaataatgaaagacggccgcgagatcgtggtcccctgtcggaaccaggatgagctagttgggcgcgcccgagtgagccagggcgcggggtggtccctgcgcgagacagcatgtctaggtaagtcctatgctcagatgtggcagcttatgtacttccaccggcgggacttgcggctggccgccaacgccatttgctccgcagtccccgttgactgggtgccgacctcgcgcaccacctggagcatccacgcgcaccaccagtggatgaccactgaagacatgctctctgtatggaatcgggtatggatcgaggagaacccctggatggaggacaagacccacgtaagttcttgggaggaagtcccctacctgggcaagcgtgaggaccagtggtgcggctctctgattggcttgacggcccgcgccacatgggccaccaacatccaggtggctatcaaccaggttcggcgcctgatcggtaacgagaattacctggactacatgacgtccatgaagcggttcaagaacgagagcgaccccgagggcgccttatggtga

SEQ ID NO: 23886 - RNA, 9879 nt, synthetic construct
  misc_feature 1..9879: note = derived and/or modified CDS sequence (opt11) from DENV-1__GU131973__SS-prME
  source 1..9879: mol_type = other RNA
tctgttacaatgcttctaatgctacttcctacagccctggccttccacctgactacaaggggcggtgaaccacacatgatagtaagtaaacaagaacgaggcaaatcgctacttttcaaaacatccgccggtgtcaatatgtgtacgctaatcgcaatggacctaggggaattgtgtgaagacacaatgacctataaatgtccgcaaataacggaagcagaaccggatgacgtggactgctggtgtaacgcgaccgacacctgggtgacgtatgggacgtgtagtcagacaggagagcatcgacgagataaacgcagcgtagccctagcgccacatgttggcttgggcctagaaaccaggacagagacgtggatgtcttccgagggggcatggaaacaaatacagagggtagagacctgggccctccgccatccaggattcacggtgatagctttatttctcgcacacgcgataggtacgagcataacgcagaagggtataatcttcatattactcatgctcgtaacgccctcgatggctatgaggtgcgtcggaatagggaatcgggacttcgtagagggattgagtggggcgacctgggtcgacgtcgttctagaacatgggagctgtgtaacaacaatggccaagaacaaaccaacccttgacatagagttactgaaaacggaggttaccaatcccgctatactcagaaaactgtgcatcgaggctaaaatctccaacaccaccaccgactcgcgttgtccaacacaaggcgaggccacgcttgtagaggagcaggacgcaaacttcgtctgcagacgaacattcgtcgaccggggctggggaaacggctgcggactgtttggcaaaggaagcctactcacatgtgccaaatttaaatgtgtcacgaaactagaagggaagattgtgcagtacgagaacctcaagtactcagtcatcgtcacggtccacaccggggaccaacatcaggtcggaaatgaaaccacggaacacggcaccatcgctacaataacaccccaggctccgacatcggaaatccaactcaccgattacggagcactgaccttggactgctcccccagaaccggtctagatttcaatgaaatggtcctactgaccatgaaagagaagtcctggctcgtgcacaaacaatggttcctagaccttccactcccatggaccagtggagcatcaacgagccaagaaacatggaacaggcaagacctcctagttacattcaaaacagcgcacgctaaaaagcaagaggtagtagtactcgggtcccaagaaggggctatgcatactgcactcacaggagcgacagagatacagacttccggcactaccacgatattcgcgggacacctgaaatgcagactgaaaatggacaaactgacgctcaagggcaccagctacgtcatgtgtacaggatccttcaaattagaaaaagaagtggcggaaacacagcacggcaccgtcctagtacaagtaaagtacgaggggacggacgcgccgtgtaagatacctttcagcacacaagatgaaaaaggcgtaacgcaaaatggacgcctaatcaccgcgaacccgatagtaacggataaagagaaacccgtgaacatagagactgaaccgccctttggagaatcctacatagtcgtcggcgccggcgaaaaagcactaaagctaagctggtttaagaaaggatcctctataggcaagatgtttgaagcaacagccaggggtgcgcgccgaatggcaattcttggcgacacagcatgggacttcgggagcattggtggagtatttacgagcgtcggaaagctagtacaccaagtcttcggaacggcgtacggcgtcctcttcagtggagtctcctggacaatgaaaataggaataggcattctactgacctggcttggacttaactcacggtccactagcctaagcatgacctgtatagcagtaggaatggtcaccctgtacctgggagttatggtccaagcggattcagggtgcgttatcaactggaaggggagggagttaaaatgcgggtcagggatcttcgtcaccaacgaagtacacacttggacggaacaatacaagtttcaggcagactcgccgaagcgattaagtgcagctatagggaaagcctgggaagaaggtgtatgcgggataaggtcagcgacgcgcctggagaatattatgtggaaacagatcagcaacgagcttaatcacattctactggaaaacgatatgaagttcaccgttgtagtaggggatgcaaacgggatcctggcgcaaggcaagaaaatgattaggccgcaacccatggagcacaagtacagctggaagtcatgggggaaagctaagataataggcgccgacatccaaaacacaactttcatcatagatgggccggacactccagaatgccctgataatcagcgggcgtggaacatctgggaagtcgaagattacggctttggaatcttcaccaccaacatatggttgaagctgcgagactcctacacacaaatgtgcgaccacagattaatgtccgccgcgataaaagatagtaaggctgttcatgcggatatgggatattggatagaatctgagaaaaatgaaacatggaaactggctcgagcatctttcatcgaggtaaaaacttgtacatggccgaaatctcacacgctatggtctaacggcgtattggagagtgagatgataatacccaaaatctacgggggccctattagccaacataactaccgaccagggtactttacgcaaaccgcaggcccatggcatcttgggaaacttgagctggacttcgacttatgtgaaggcaccacagtagtagtagatgaacactgcggaaatagagggccctccctccggactactacggtcacaggcaagataattcatgagtggtgctgtagaagttgcacgctgcccccgctgcggtttcggggcgaggacgggtgctggtatggcatggagatccgcccagtaaaggaaaaagaagagaatctcgtgcgctctatggtttcagcaggttcgggagaagtggacagcttcagcttaggcattctgtgcgtgagcataatgatcgaagaagtaatgcggagccgttggtcacgcaagatgctaatgacagggacactggcggtgttcctactcctcgtaatgggccaactgacatggaacgacctgattcggctgtgtatcatggtcggcgcgaacgccagtgacagaatgggaatggggactacctacctcgcgctcatggcaaccttcaagatgcgacctatgttcgccgtaggactactcttcagacggctcacgtctcgcgaggtactactgctgaccattgggctctccctggtcgcgagcgtagaactgccaaacagcctagaagaactcggagatggactagcgatggggataatgatgctgaaactactgaccgagtttcaaccacaccagctatggacgacgctcttgagcctaacgttcattaagacaacattaagtctggactatgcgtggaaaactacggctatggccctttcaatcgtatcgctattccctctatgtctatcaacgacctcgcaaaagaccacatggttaccagtcctcttaggcagtttcggctgcaaacctctgacgatgttccttatcacggagaacaaaatctgggggagaaaaagctggccactcaacgaaggtatcatggcaataggcatagtgtcaatcttgttaagtagccttctcaaaaacgacgtcccactagcaggcccactaatagcaggcgggatgctgattgcatgctacgtaatttccggaagttccgcagatttaagcctggaaaaagccgcggaagtcagctgggaacaggaggccgaacacagtggaacgtcccacaatatcctagtcgaagtgcaagacgacggaacgatgaagatcaaggacgaagaacgggacgatacgctcacgatactactcaaagcaacgcttttggcagtatcaggggtctacccaatgtcaattccggcaacgctattcgtttggtacttttggcagaaaaagaaacaaagatcaggggtcctatgggacaccccatcgccccctgaggtagaaagggccgtactcgatgacggcatctacaggatccttcaacggggcctactaggcaggtcacaagtgggcgtaggagtattccaagacggcgtcttccacacaatgtggcacgtaaccagaggcgcggtcctcatgtaccaagggaaacgcctagagccgagttgggcaagtgtaaagaaagaccttataagctacggcgggggatggaggttccagggtagctggaacacgggagaagaggtccaagtgatagcggttgaaccgggcaaaaatccgaaaaatgtgcaaaccacgcccggaacttttaaaacaccggagggagaagtcggagccatagccttagacttcaaaccagggacctcagggtccccaatagtaaacagggaaggcaagatagtaggactatacggtaacggggtggtcacaaccagtgggacgtacgtcagtgcgatcgcgcaggcgaaagcctcccaggaaggcccactacccgaaatcgaagacgaagtattcaagaaacgaaatctaactattatggaccttcatcccgggtcaggaaagacccgccgttatctcccagctatcgtacgagaagccataaaacggaagatgcgcacgctgatactggcccctacacgtgtcgtagcatccgagatggccgaagcattaaaaggaatgcccatcagataccaaacaaccgccgtgaaatcggaacacacgggccgcgagatagtggatctgatgtgccacgcaacttttacaatgcgcctgctctcgcccgtcagagtacctaactataatatgatcatcatggacgaagctcacttcaccgacccagccagcatcgccgcacggggctacatcagcacccgagtcgggatgggagaagcagccgccatcttcatgacggccacgccaccggggagcgtcgaagcattcccgcaaagcaatgcggtaatccaagatgaggaacgagatatccccgagcgctcatggaactcagggtatgactggatcacggacttccctggcaaaacagtctggttcgtgccatcgatcaagagtggcaatgacatagctaactgcctgcgcaaaaacggaaagagggttatccaactttctcggaagactttcgacactgagtaccagaaaaccaaaaacaacgactgggattacgtcgtaacgacggatatctccgagatgggtgctaactttcgcgccgaccgagttatagatccacgccgctgcttgaaacccgtaatactcaaggacggccccgaaagagtcatcttggcggggccgatgcccgttaccgtcgcgtcggctgcgcaaagacgtggccgtatcggccgaaaccaaaacaaggaaggagatcagtatgtatacatgggtcaacccttaaataacgacgaagaccacgcacactggaccgaagccaagatgctcctcgacaacataaacaccccggaaggaataatacccgcattgttcgagcccgaaagggagaagtcggcggccatagacggagaatacagactaagaggggaagcacggaaaacgtttgtcgaattgatgagaagaggggatctgcccgtctggctatcatacaaggtcgccagtgaaggcttccagtactcagaccgcagatggtgcttcgacggcgaaaggaacaaccaggtgctagaagagaacatggacgttgaaatatggaccaaggaaggcgaaaggaagaaactcagaccccgatggttagacgcaagaacctatagcgatccactggcgctgagagagttcaaggagttcgctgcaggtaggcgcagcgtaagcggagacttgatactagaaataggcaaattgccacagcacctaacgctacgggcgcagaacgccctggacaacctagtaatgctgcataactctgagcaaggagggaaagcctacaggcacgccatggaagaactgccggacacaatagaaactctcatgctgctggccctgatagcggtcctcacgggaggggtcacgttattctttctctccgggaaaggccttgggaaaacttcaataggtctcctatgcgtcaccgcgtcctcggcactgttatggatggcaagcgtcgagccccactggatagccgcaagcatcatcctagagttcttcctcatggtcctcttaatacccgaaccagatcgccaaagaacaccccaagataaccagctcgcatatgtagtaatcgggctcctcttcatgatactcaccgtagctgctaatgagatggggctgctcgaaaccacaaagaaggacctaggcatcggacacgtggcggcagagaaccatcaacacgccactatgctcgatgtggacctacgtcccgcgtctgcttggaccctgtacgcagtggcaacaacggtaatcacacccatgatgagacatacgatagagaacacaacggcaaacatcagcctcaccgccatagcaaatcaagccgcgatactaatgggcctagacaaaggatggcccatctccaagatggacataggagtcccgcttctggcactagggtgctactcccaagtgaacccacttacgcttaccgcggccgttctaatgctagtcgcccactacgccatcataggaccaggcctgcaagcaaaggccacaagggaggcccaaaagcgcaccgccgccggtataatgaagaacccaacggtagatggcatcgtagcgatcgacctagacccggtagtctacgacgcgaaatttgaaaagcagctagggcaaataatgttgctaatcttgtgtaccagccagatcctgctcatgcgaacaacctgggccttatgcgaatcgattacccttgcgaccgggccactaactacactatgggaagggagcccaggcaaattctggaacacaacaatagcggtttcgatggcaaacatcttccgaggcagctacctcgctggggcgggtctcgcgtttagcctcatgaaatcactcggcggaggacgtagaggaacaggcgcccaaggcgagaccctgggagaaaaatggaaaaggcaacttaaccaactatccaagagtgagttcaatacctacaaaaggtcaggaatcatggaggtcgacaggtctgaggcaaaagaaggtttaaaacgcggcgaaacaacaaaacatgcggtaagcagaggcacagcaaagctcagatggtttgtagaacgaaacctcgtcaaacccgaaggaaaagttatcgacctaggctgcggcagaggaggctggagctattactgcgcaggcctcaagaaagtaaccgaagtcaaaggttataccaaagggggcccggggcacgaagaacccatccctatggccacctacgggtggaacctggtaaaactgcacagtggaaaagacgtatttttcatgccacccgagaagtgcgacaccctcttatgcgacataggggaatcgtcccccaacccaaccatcgaggaaggccgcacgcttcgcgtacttaagatggtagaaccctggctgcgcggcaaccagttctgcatcaagatcctgaacccatacatgcccagcgttgtggaagcgttagaacagatgcagcggaaacacggtggaatgctcgtccgcaatccactctcgcggaactccactcacgagatgtactgggtatcctgcgggacggggaacatcgtctcagccgtgaacatgacaagcagaatgctgttaaaccgattcaccatggcacacaggaagccaacttacgaacgggatgtcgaccttggagcgggaacgagacatgtagccgtcgaaccagaggtagctaacttggacatcataggacaacgtatcgaaaacatcaagaatgaacataaatccacgtggcactacgacgaagacaacccatataagacctgggcataccacggcagctacgaagtcaaaccaagtggctcagcaagtagcatggtaaatggcgtagtccgcctcctgaccaaaccgtgggatgtaataccaatggttacacaaatcgcaatgacagacaccacacccttcggccaacaacgggtgttcaaagagaaggttgatacacgtacgccacgtgcgaaaagggggacaacacaaatcatggaggtcacagcaaagtggctctgggggttcctcagccggaacaaaaagccgcggatctgcacacgagaggaatttacgcgaaaagttcgatcaaatgcggcaatcggagctgtattcgtggacgaaaaccaatggaacagtgcgaaggaggccgtcgaagacgaacggttctgggatctcgttcatcgggaacgggaacttcacaagcaggggaagtgcgctacatgcgtatacaacatgatgggtaaacgcgaaaagaagttgggcgagttcggcaaggccaaggggagcagagccatatggtacatgtggctcggcgcgcgtttcctcgagttcgaggccctagggttcatgaacgaggatcactggttcagcagggagaactcactgagcggtgtagaaggagagggactgcataagctaggatacattctccgggatataagcaagatcccaggagggaacatgtacgcggacgatacagctggatgggatacccgtataacggaggacgatttacagaacgaagcaaagataaccgaaatcatggagcctgaacacgcactactcgcgacaagcatcttcaaactcacataccagaacaaagtagttcgcgttcaaagaccggccaagaacgggaccgtaatggacgtgatctcacgcagagaccaacgagggtccggccaggtcggaacatacggtctgaacacgtttacgaacatggaagtgcagctaatcagacaaatggagagcgaaggaatattcttgccctcagagttagaaaccccaaacctcgctgagagggtcctagactggctcgaaaaacacggagccgaacgcctgaaaaggatggcaataagcggagacgattgtgtggtaaaacctatagacgacagattcgcaacggcacttacggccctcaacgatatgggcaaggtaagaaaagatataccccagtgggaaccgagcaagggctggaacgactggcaacaagtaccattctgctctcatcattttcaccagcttataatgaaagacggaagagagattgtggtcccttgtcggaaccaagacgagttggttggcagagcaagagtaagccagggcgccggctggagtttacgcgaaacagcatgcctaggaaagtcatacgcccaaatgtggcaattaatgtacttccacagaagggacttgagactggccgcgaacgcaatatgctccgccgtccctgtagactgggtaccgacatcgcgcaccacctggtcaatacacgcacaccaccagtggatgacgaccgaggatatgctctccgtctggaacagggtatggatcgaagaaaacccatggatggaagacaagacacacgtctcatcgtgggaagaggtaccatacctggggaaacgtgaggatcaatggtgcggctcactgatcggtctaaccgctcgagcaacctgggcaacaaatatacaagtagcaataaaccaggtacggcgattgattggcaacgaaaattacttagactacatgacgtcgatgaagcgcttcaaaaatgaatcggaccctgaaggagcactttggtag

SEQ ID NO: 23887 - RNA, 9879 nt, synthetic construct
  misc_feature 1..9879: note = derived and/or modified CDS sequence (opt11) from DENV-1__GQ868517__SS-prME
  source 1..9879: mol_type = other RNA
agcgtgacaatgctgctcatgctgctacccaccgctctcgccttccacctgaccaccagaggcggggagccgcacatgatcgtgagcaagcaggagagaggcaagagcctcctgttcaaaacttccgccggtgtgaacatgtgcacgctgatcgccatggatctgggcgagctctgcgaggacactatgacctacaagtgcccacagattaccgaggccgagccggacgatgtggactgctggtgcaacgcaaccgacacttgggtgacatatgggacctgctcacagaccggtgagcaccggcgggacaaacgctccgtcgccctggcgccccacgtgggcctgggtctcgagactcggaccgagacatggatgagcagtgagggcgcctggaagcagatacagagagtcgagacctgggccttgcggcacccggggtttacggtgatcgccttattcctcgcgcacgccatcggcaccagcatcacccagaagggcatcatctttatcctgctgatgctcgtaaccccctccatggccatgaggtgcgtcggcatcgggaacagagacttcgtggagggactgagcggcgccacgtgggtggacgtcgtcctggagcatgggtcctgcgtgaccaccatggccaagaacaaacccaccctcgacatcgagctgctgaagaccgaggtcacaaacccggcgatcttgcgaaagctttgcatcgaggcgaagatcagcaacacaaccacggattcgcggtgtccgacccagggagaggcgaccctcgtggaggagcaggacgcaaacttcgtctgcagacggaccttcgttgacaggggctgggggaatggctgtggcctcttcgggaaggggagcctactgacgtgcgcaaagttcaagtgcgtgacaaagctcgagggcaaaattgtgcaatacgaaaacctgaagtactccgtgatcgtgaccgtacacacaggcgaccagcaccaggtagggaacgagacgactgaacacggcaccatcgcaaccatcactccacaggcccccacgtccgagatccagctaaccgactatggggccctgaccctggactgcagcccccggaccggcttagactttaatgagatggtactccttacgatgaaggaaaagtcatggctggtacacaagcaatggttcctcgacctgccgctgccctggacctccggcgccagtacaagccaggagacctggaatcgccaggatctcctggtgacgttcaaaaccgcacacgctaaaaagcaggaggtggtcgtgttaggctcccaagaaggggccatgcacaccgccctcaccggtgcaacggagatccagacctcgggcaccaccacgatcttcgccgggcacctgaagtgtcgactaaagatggataagctcacactgaagggcacctcctacgtcatgtgtaccgggagcttcaagctggaaaaggaggtcgctgagacgcagcatggcaccgtcctggtgcaggtcaagtatgagggcaccgacgccccctgcaagatccccttcctcacccaagatgagaagggagtaacgcaaaacggccgcctgatcaccgcaaacccgatagtgaccgacaaggagaagcctgtgaacattgagaccgagccgcccttcggggagtcatacatcgtggtgggcgccggcgaaaaggcgttaaagcttagctggtttaagaaggggtcctcgattgggaaaatgtttgaggctaccgcccgcggggcccgccgaatggccatcctgggcgacaccgcgtgggacttcgggtctatcggcggcgtcttcaccagcgtggggaagctagtgcaccaggtctttggcaccgcctacggggtcctcttcagcggcgtgagctggacgatgaaaatcgggattggcatcctgctgacatggctcggcctgaacagccgcagcacatccttgagcatgacttgcatcgccgtagggatggtgacgctctacctgggggtgatggtccaggccgactccgggtgcgtgatcaattggaaagggagagagctgaagtgcggaagcggcattttcgtcaccaacgaagtccacacctggaccgagcagtacaaattccaggccgactccccgaagcgcctcagcgcggccatcggcaaggcttgggaggagggtgtatgcggcatcagaagcgctacgcggctggagaacataatgtggaagcagatcagtaacgagctgaatcacatcctcctcgagaatgacatgaaattcacggtggtcgtgggggacgccaacggaatcctggcgcagggtaagaagatgattaggccccagcccatggaacacaagtacagctggaagtcctggggtaaagccaaaatcatcggtgcggacatccagaacaccaccttcataatcgacgggcccgacaccccggaatgtccagacaatcagcgggcatggaacatctgggaggtggaggactacggattcggaatctttacaaccaacatatggctcaaactgagggacagctacacccagatgtgcgatcaccgattgatgtccgcagccattaaggacagcaaagccgtccacgccgacatgggctattggatcgagtctgagaagaacgagacctggaaactcgcccgcgcatcattcatcgaggtgaagacgtgtacctggcccaagtcccatacactatggagcaacggcgtgctggagtccgagatgatcattcccaagatctacgggggccctataagccagcacaactaccgtccggggtatttcacccagacagcagggccttggcacctcgggaagctggagctggactttgacctctgcgagggaacaaccgtcgtggtggacgagcattgtgggaaccggggtccatccctgcggacaacaacagtcacaggcaagatcatccacgagtggtgctgccgcagctgcaccttaccgcccctccggttccgcggcgaagacggttgttggtacggcatggagatccggcccgtcaaggaaaaagaagagaatttagtgcgctccatggtcagcgccggcagcggcgaggttgattcattcagcctgggaattctctgtgcctccatcatgatcgaagaggtgatgcggagccgctggtcccggaagatgttaatgacgggcactctggccgtcttcctcctgttaataatggggcagctcacctggaatgacctgatccgattgtgtatcatggtgggcgcgaacgccagcgaccgcatgggcatgggcactacctacctcgcccttatggccaccttcaagatgcggccgatgttcgccgtggggctcctcttcagacggctgacctcgcgtgaagtcctcctcctgactataggtctgagcctcgtggcgagtgtggaactgcccaatagcctggaggagctcggagacgggctggccatgggaatcatgatgctgaagctcctcacggagtttcagccccaccagctatggaccacactgctgtctctgactttcattaagacgaccctctctctggattacgcctggaagaccacagccatggtcctgtcgatcgtgagcctcttccccctgtgtttgtccacgaccagccagaaaactacttggctgccggtcctgctgggctccttcgggtgcaagccccttaccatgtttctgatcacggagaacaagatctggggtcggaagagctggcccctgaacgaagggattatggcgatcggcatcgtgtccatcctcctaagcagtctgctcaagaacgacgtgcccttggccggaccgctgatcgctgggggcatgctcatcgcctgttacgtcatcagcggatcctccgccgacttgagcctggagaaggcggcagaagtttcctgggagcaggaggctgagcactcgggcacatcccacaacatcctcgtggaggtccaggatgacgggaccatgaaaatcaaggacgaggaacgcgacgacaccctgacaatcctcttgaaggctactttgcttgccgtctcaggagtttacccgatgtccatacccgcgaccttattcgtgtggtacttctggcagaaaaagaagcaacggtcgggggtgctgtgggacaccccgtccccgccagaagtggagagagccgttttggatgacggaatataccggattcttcagcgcggcctcctgggcaggtcccaggtgggcgtgggggtctttcaggacggcgttttccacacgatgtggcacgtcacccgcggggcggtcctgatgtatcagggcaagcggctcgagccctcttgggccagcgtgaaaaaggacctgatctcctacggaggtggatggcgattccagggtagctggaacaccggcgaggaggtgcaggtgatcgccgtggagcctgggaagaacccgaagaacgtgcagaccacgcccggcacctttaagacccctgagggtgaggtcggtgctattgcactggatttcaaaccgggcacatccgggagcccgatcgtgaaccgggagggcaagatcgtgggcctctacgggaacggcgtcgtgacaacctccgggacgtacgtgagcgccatagcccaagccaaggcgtcccaggagggccccctgccagagattgaagacgaggtatttaaaaaacgcaacctgacaatcatggacctccaccctgggagcggcaagacgagacgctacctgccagccatcgtgagggaggctattaagcgcaagctgcgcaccctcattcttgcccccacccgcgtggtcgcgagcgagatggccgaggccctaaagggcatgcccatccgttaccagactactgccgttaagtccgagcacactgggcgtgagatcgtggacctcatgtgccacgccacctttactatgcgtctgctgagccctgtacgggttcccaactacaacatgattatcatggacgaggcgcatttcacggaccccgcatccatcgccgcccgcggctacatcagcacccgtgtggggatgggcgaagccgcggcgattttcatgactgccacgccgccggggtccgtcgaggccttcccccagagcaacgctgtgatccaggatgaggaacgcgacatcccggagcgatcctggaactctggctacgactggatcacggacttccctggaaaaaccgtctggttcgtcccctctatcaagagcgggaacgacatcgcgaactgtctccgcaagaacggcaagcgggtgatccagctgtcacgcaagactttcgataccgagtaccagaagacaaagaacaacgactgggactacgtggtgaccaccgacataagcgagatgggggccaacttccgggcagaccgtgtaatcgacccccggcgctgtctgaaacctgtgatcctcaaggacggccccgagcgagtcatcttagccgggccgatgcccgtgaccgtggcgtccgccgcgcagcgccggggccgcatcggccggaatcagaacaaggaaggggaccagtacgtctacatgggccaacccctgaacaacgacgaggaccacgcccactggaccgaggccaagatgctcctggacaacatcaacacccccgagggtatcatcccggcgctcttcgaacccgagcgcgagaagtccgcagcgatcgacggcgagtaccgcctccgcggcgaagcccgcaagacattcgttgaactgatgcgccgaggcgacctgcccgtttggctatcgtacaaggtggccagcgagggctttcagtattccgaccggcgctggtgcttcgacggggagcgtaacaaccaggttctggaggaaaacatggatgtcgaaatctggaccaaggagggcgagcgcaagaaactgaggccccgctggctcgacgcgcggacctacagtgacccgctcgccctgcgcgagtttaaagagtttgccgccgggcgaagatccgtaagcggcgacctcatcctggagattggcaagttgcctcagcacttaacgctgagagctcagaacgcgctggataacctcgtaatgctgcacaacagcgaacaaggagggaaagcctaccgccacgccatggaggaactgcccgacaccatcgagacattgatgctgctggctctcatcgccgtcctgaccgggggcgtgacgctgttttttctctccgggaaggggctagggaagacctctatcgggctgctatgcgtcaccgccagcagcgccttgttgtggatggcctccgtcgagccccattggatcgccgcgagcatcatcctcgagttcttcttgatggtgctgctgatccctgagccagaccgtcagcgcacaccccaggacaaccagctggcctacgtggttatcgggctcctcttcatgatcctcacggtggccgccaacgagatggggctgctcgaaaccactaagaaagacctgggcatcgggcacgtggccgcggagaatcaccagcacgccacgatgctggacgttgacttgagaccggcctccgcctggacgctgtacgctgttgcgactactgtgatcacccctatgatgcggcacacgatcgagaacaccactgcgaacatctcattgacggccatagccaaccaagcggcgatactcatgggcttggacaagggctggcccatctccaagatggacatcggggtacccctgctcgccctgggctgctacagccaggtgaacccgctcactctcaccgctgccgttctgatgctggtcgcgcactacgccatcatcgggcccggcttacaggcaaaggctactcgggaggcccaaaagcgcacggcggcagggatcatgaagaacccgacggtcgacggcattgtggccatcgatctggaccccgtggtgtacgacgccaagttcgagaagcaactaggccagatcatgctcctgatattatgtacctcacagatcctcttgatgcgcaccacctgggcgctgtgcgaaagcattacgttagcgaccgggccgttgaccaccctgtgggagggctccccagggaagttctggaacacgaccattgccgtgagcatggccaacatattccggggctcctatttagctggtgccggcctagcgttctctttaatgaagtccctcggcgggggccgccggggaaccggtgcccagggcgagaccctcggtgagaagtggaagaggcagctgaaccagctcagcaagtccgaattcaacacgtacaagcggagcggcatcatggaggtcgacaggtcagaggccaaggagggcctgaagcgcggcgagacaaccaaacacgcagtatcgagaggcaccgctaagctgcgttggtttgtcgagcgcaacttagtcaagccagagggcaaggtgatcgatctaggctgcggtcggggggggtggagctactactgtgccggcctgaagaaagtcaccgaggtcaaaggatacacaaagggtgggcccgggcacgaggaaccgatccccatggccacttacgggtggaacttagtgaagctccactcaggcaaagacgtgttctttatgccgcccgagaagtgcgacaccctgctttgtgacatcggggagagctccccgaatcccactatagaggaggggcgcactctacgggtactgaagatggtggagccctggctgcgcggcaaccagttctgcatcaagatactcaatccatacatgccgtctgtagtcgagaccctcgagcagatgcagcgtaagcacggcgggatgctggttcgcaaccccctttcccggaatagcacccacgagatgtactgggtttcgtgtggcaccggtaacatcgtctctgccgtgaacatgacgtccagaatgcttcttaaccggttcaccatggcccacagaaagcccacattcgagcgcgacgtggacctcggcgcggggacgcggcacgtggccgtggagccggaggtggccaacttagacatcatcgggcagcgcatcgagaacattaagaacgaacacaagagcacgtggcactacgatgaggacaacccgtacaagacctgggcctatcacggctcatacgaggtcaagccctctggatctgctagcagtatggtaaacggggtggttcggctgctcacaaaaccgtgggacgtgatacccatggtcacacaaatcgccatgacggatacgaccccattcggccagcagcgagtgttcaaggagaaagtggatacgcggacgcccagagctaagcggggcaccacccagatcatggaggttaccgcaaagtggctgtggggcttcctcagccgaaataaaaagccccggatctgcaccagagaggagttcacccggaaggtgagatccaacgcagccatcggggcggtgtttgtagacgagaaccagtggaacagcgccaaggaggcagtggaggacgaacggttctgggacctcgtgcatcgcgaacgggagctgcataaacagggcaagtgcgcgacttgcgtctacaacatgatgggtaagcgggagaagaaactgggggagttcgggaaggcgaagggcagccgggctatctggtacatgtggctcggcgcccggttcctagagttcgaggccctcggcttcatgaacgaggaccactggttctcgcgtgaaaacagcctctccggggtcgagggcgaaggcttacacaagctggggtacatcctccgcgacatcagcaagatccccggggggaatatgtacgccgatgacaccgcagggtgggacacgaggatcacagaggacgatttacagaatgaggctaaaatcaccgacatcatggaacccgagcacgccctcctcgctacctccatattcaagctgacctaccaaaataaggtggtcagggttcagcgccccgctaagaacggcaccgtgatggacgtcataagccggagggaccagagagggtccggccaagtggggacctacggcctgaacaccttcacgaacatggaagttcaactgatccgccaaatggagagcgagggcatcttcctgccctccgagctggaaaccccgaacctcgcagagcgagtgctggactggctcgagaagcacggtgcagagcgcctcaaacggatggctatcagcggcgacgactgcgtcgtgaagcccatcgacgaccgctttgccacagctctgaccgcgctgaacgacatggggaaagtccggaaggacatcccccagtgggaaccttccaagggctggaatgactggcaacaagtccctttctgcagccaccacttccaccagcttattatgaaggacggcagggaaatagtggttccctgccggaaccaagacgagctagtaggtagagcccgagtgtcccagggggccggttggagtctgcgcgaaaccgcctgcctcggcaaatcgtatgcccagatgtggcagctaatgtactttcatcggcgcgacctgcggctcgcggccaacgccatctgcagcgccgtccctgtggactgggtgcctacttctcgcaccacgtggagcatccacgcgcatcaccagtggatgaccacggaagatatgctgagcgtctggaaccgggtgtggatcgaggagaacccgtggatggaggataagacccacgtgtccagctgggaggaggtcccttacctgggtaagagagaggaccaatggtgcggctccctcatcggtctgaccgcccgcgccacctgggctacaaacatacaggtggctataaaccaggtccggcgcctgatcgggaatgagaactacctcgactacatgacctctatgaagcggtttaagaatgagtccgaccctgaaggagcgctgtggtga

SEQ ID NO: 23888 - RNA, 9879 nt, synthetic construct
  misc_feature 1..9879: note = derived and/or modified CDS sequence (opt11) from DENV-1__GU131976__SS-prME
  source 1..9879: mol_type = other RNA
tcagtgaccatgctgctcatgctgctgcccaccgccctcgccttccacctcaccacccggggcggggagccgcacatgatcgtaagcaagcaggagagaggcaagagcctcctgttcaagacctctgctggggtgaacatgtgtacactcatcgccatggatctgggcgagttgtgcgaggacaccatgacctacaaatgcccccagatcacagaggcagagcccgacgacgtggactgctggtgcaacgccaccgacacctgggtcacttacggtacatgcagccagacgggcgagcaccggcgggacaaacgctccgtggccctggcgccccacgtcggactggggctcgaaacgcggactgagacctggatgagctccgagggcgcctggaaacagatccaacgcgtcgagacatgggcgctacggcaccccgggttcacggtgatcgccctgttcctagcgcacgctataggcaccagcatcactcagaagggaattatattcatcctgctgatgctagtgaccccctccatggccatgcgctgcgtcggcattggcaatcgggatttcgtagaggggctgagcggcgcgacctgggtggacgtcgtgctggagcacggttcctgcgttacgaccatggccaagaacaagcctactctcgacatcgaactgctgaagacggaagtgaccaaccccgcaatcctccgcaagctgtgcatagaggctaagatcagcaacacgaccactgactcccgatgcccgacccaaggcgaggccaccttggtggaggagcaggacgccaacttcgtgtgccgccggacgttcgtcgaccggggctgggggaacggctgcggcctgttcggcaaggggagcctgctgacgtgcgccaagttcaagtgcgtgaccaagctggagggcaagatcgttcagtacgagaacctcaagtactccgtcatcgttactgtacacaccggcgaccagcatcaggtcgggaacgagacgaccgagcacggcaccatagctaccataacgccccaggcccctaccagcgagatccagctgaccgactacggggccctcaccctggactgcagcccccgtaccggtctggacttcaacgagatggtgctcctgacgatgaaggagaagtcatggctggtgcacaagcagtggttccttgacctgccgcttccctggaccagcggggccagcaccagccaggagacctggaacaggcaggacctcctggtgacctttaaaaccgcccacgcgaagaagcaggaggtagtcgtcctgggctcccaggagggcgccatgcataccgccttaactggggccacggaaatacagacaagcggtaccaccacaatcttcgccgggcacctgaagtgccggctgaagatggacaagctcacactgaaaggcacctcctacgtgatgtgtacaggtagcttcaagctggagaaggaggttgcagagacgcagcacggcaccgtactggtacaggtcaagtacgagggcaccgacgccccctgcaagatccccttttccacccaggacgagaagggggtgacgcagaacggccgcctcatcaccgccaacccgatcgtaaccgataaagaaaagcccgtcaacattgagaccgaaccgccattcggggagagctacatcgtggtgggggccggagagaaggcgctgaagctgtcctggttcaagaaggggagctccatcggcaagatgttcgaggccacagcccgcggggcccgccggatggccatcttgggcgacaccgcgtgggacttcgggagcattggcggcgtattcacctccgtggggaagctggtgcaccaagtatttggcaccgcctacggggttctgttctccggcgtgagctggacgatgaagatcgggatcggtatcctcctgacctggctggggctaaacagccgctccacaagcctgtccatgacctgtatagccgtggggatggtgacgctctacctcggcgtgatggttcaggccgacagcgggtgtgtgatcaactggaagggccgcgagctgaagtgcgggtccggcatcttcgtgaccaatgaggtccacacctggaccgagcagtacaagttccaagccgattcgccgaagcggctgtccgctgccatcggcaaggcctgggaggagggagtgtgcggcatccgctctgccacccggctcgagaacattatgtggaaacaaatctctaacgagctgaaccacatcctgctcgagaacgacatgaagttcacagtggtcgtcggggacgccaacggaatcctggcacaggggaagaaaatgatccgcccccagcccatggagcacaagtattcctggaagagttgggggaaggccaaaatcatcggcgccgacatccagaacacaacgttcatcatcgacgggccagataccccggagtgccccgacaaccagcgggcctggaatatctgggaggtggaggactacgggttcgggatcttcacgaccaacatctggctgaagctccgcgactcctacacccagatgtgcgaccaccgactgatgagcgcggccatcaaagactccaaggcggtccacgccgacatgggctactggatcgagagcgagaagaacgagacctggaagctcgcccgcgcgtcgttcattgaggtgaagacgtgcacctggcccaagagccacaccctctggagtaacggcgtgctagagagcgagatgatcatcccaaagatctacgggggaccgatctcccagcacaactaccggcccgggtacttcacccaaacggccggcccctggcacctggggaagctcgaactagatttcgatctctgcgagggcaccaccgtcgtggtggacgagcactgcggcaatcggggtccatcgctccgtaccacgactgtcaccggcaagatcatccacgagtggtgctgccgctcctgcaccttgccacccctgaggttcaggggggaggacggctgctggtacgggatggagatccgtcccgttaaggagaaagaggagaacctcgtgcgctcaatggtttctgccggctcgggcgaggtggatagcttctccctggggatcctgtgcgcaagcttgatgatcgaggaggttatgcggtcacgctggagccggaagatgctaatgacgggaacactggctgtctttctcctgctgataatggggcagctcacctggaacgacctgatccgcctgtgcatcatggtaggcgcgaacgcctccgacaggatgggtatgggaaccacgtacctcgcattaatggccaccttcaagatgagaccgatgtttgccgtggggttattgttcagacggctgaccagccgcgaggtcttactcctgacgatcggtctgtccctcgttgcaagtgttgagctgcccaactccctggaggagctcggcgacgggcttgccatgggcatcatgatgttaaaactcctgacggagttccagccccaccagttatggaccaccctcctgagcctgactttcatcaagacgaccctctccctggactacgcctggaagacaaccgcgatggcccttagcatcgtctccctcttccccctgtgcctgagcacgacctcccagaagaccacctggctcccggtgctgctaggcagctttgggtgcaagcccttgaccatgttccttatcacggagaacaagatctgggggcgtaagtcctggccgctgaatgagggtataatggcaatcggaatcgtcagcatcctcctgtccagcctgctcaagaacgacgtgcctctggcggggccgcttatagccggcggcatgctcattgcctgctacgtgatcagcggttccagtgcggatctctccttggagaaggccgccgaggtcagctgggaacaggaggccgaacactccggcacgagccacaacatattagtggaggtacaagacgacggcaccatgaagatcaaggatgaggagcgcgacgacaccctgacgattctgctcaaggccacgctgctggcggtctccggtgtgtaccccatgagcatcccggccaccctattcgtatggtacttctggcagaagaagaaacagcgatccggggttctgtgggacacccccagcccgccggaggtggagcgcgccgtactggacgacggcatctatcggatcctgcagaggggcctcctggggcgtagtcaggtcggcgtaggggtgttccaggacggtgtattccatacgatgtggcacgtgacccgaggcgcggtgctgatgtatcagggcaagcggttagaaccgtcatgggcatctgtcaagaaggacctcatctcgtacggcgggggctggcgctttcaggggagctggaacaccggcgaggaggtccaggtgattgcggtcgagcccgggaagaacccgaaaaacgtacagaccacgcctggcacctttaaaacccccgagggtgaggtgggggccatcgccctggacttcaagcccggcaccagcggctccccgatcgtcaaccgggaaggcaaaatcgttggcctctatgggaacggcgtggtaacgacctccggaacctacgtgtctgccatagcccaggccaaggccagtcaggaaggccccctgcccgagatcgaggacgaggtgttcaagaagaggaacctaactattatggacctccacccggggagcggcaagactcggcgctacctgcccgccatcgttcgggaggcgataaaaaggaagctgaggacgctcatcctggcgcccaccagggtggtggcctccgaaatggccgaggccctgaagggaatgcccatccgctaccagaccacggcggttaagtcagagcacaccgggcgggagatcgtagacttaatgtgccacgcaaccttcaccatgcgcctgctttccccagtgcgggtccccaactacaatatgatcatcatggacgaggcccacttcacggaccccgccagcatcgcggcccgcggctacatctccactcgggtggggatgggcgaggcggcagcgatcttcatgaccgccacgccgcccgggtcggtggaagccttcccccagtctaacgcggttatccaagacgaagagcgcgacatccccgaaagatcctggaactctggctacgactggatcacggacttccccggcaaaactgtgtggttcgttccgtccatcaagtccgggaacgatatcgcaaactgtctccggaaaaacggcaagcgggtcatacagctgagccgcaagaccttcgacaccgagtaccagaaaacgaaaaacaacgactgggactatgtggtgaccaccgatatatccgagatgggggccaacttccgcgcggaccgcgtcatcgacccccggcgctgcctgaagcccgtcatcctcaaggacggccccgaacgcgtgatcctggcagggccgatgcccgtaactgttgcctcagccgcccagcgccgaggccgcatcggccggaaccagaacaaggagggggatcagtacgtgtatatgggccagccccttaacaatgatgaagaccacgcacattggacggaggcgaagatgctcctggacaacatcaatacccccgagggcatcattccggctctcttcgagcccgagcgcgagaaatccgccgctatcgatggcgagtaccgtctacgcggggaagcgcgcaagacctttgtcgagttaatgcgacgcggcgacttacccgtgtggctcagttacaaggtcgcgtccgaaggcttccagtactctgaccgtcgctggtgcttcgacggagagcggaacaaccaggtcctcgaggaaaacatggacgtggagatctggaccaaggagggcgagcgcaaaaagctgcggcctagatggctcgatgcccggacgtattccgaccccctggccctccgcgagttcaaggaattcgccgccgggcggcgcagtgtctctggcgaccttatcctcgaaataggtaaattgccccagcacctgacgctgaaggcgcaaaacgcgctggacaacctcgtgatgctacacaactccgagcaaggggggaaggcgtaccggcacgccatggaagagctgcccgacaccatagagaccctcatgctgctggcgctcatcgccgtgctgaccgggggcgtcacgctgtttttcctcagcgggaagggcctgggcaagacatccatcgggctgctctgcgtgaccgccagttcagccctgctgtggatggcctcggtggagccccactggattgccgcttccatcatcctcgagtttttcctgatggtcctgctcatcccggagcccgataggcagcgcactccccaggataaccagctggcctacgtggtgataggcctcctctttatgatcctgacggtcgccgccaacgagatggggttgctcgagacaacaaagaaagatctgggcatcgggcacgtggcggccgagaaccaccaacatgccaccatgctggacgtggacctccgcccggccagcgcctggacgctgtacgcggtcgctaccaccgtgatcacccccatgatgcggcacacgatcgagaacaccaccgccaacatctccctgaccgccatcgccaaccaggcggcgatcctcatgggcttggacaaaggctggccaatctctaagatggatatcggcgtgcccctgctcgccctgggctgctatagtcaagtaaacccactgacgctcaccgctgctgtgctgatgctggtggcccactacgccatcatcggccccggcctccaggccaaggccacccgcgaggcgcagaagcgtaccgccgccgggatcatgaagaaccccacggtcgacggcatcgttgctatcgacctggatcccgttgtctacgacgctaaattcgagaagcagctgggccagatcatgctcctgatcctttgcaccagccagatactactgatgcggaccacctgggcgctgtgcgagtccataacgctcgccacagggcctttgacaaccctatgggagggctcacccggcaagttctggaacacgaccatcgccgtgtccatggccaacatcttcaggggcagctacttggccggggcagggctggccttttccttaatgaagtccctcggcgggggccggcgcgggaccggcgcccagggcgagaccctgggggagaagtggaagcggcagctgaaccaactctcgaaaagtgagttcaacacgtacaagcgaagcggcatcatggaagtggacagatctgaggcaaaagaggggctgaagcgcggcgaaaccacaaagcacgcggtcagccgggggaccgccaagctgcgctggttcgtggagcggaacctggtgaagcccgagggcaaggtcatcgatctcggctgcgggcgcggcgggtggtcctactactgcgccgggctgaaaaaggtgaccgaggtgaaggggtacacgaagggcggccctgggcacgaggaaccgatccctatggcaacctacggttggaacctggtgaagctccactcgggtaaggacgtgttcttcatgccgcccgagaagtgcgacactcttctgtgcgacataggcgagtccagcccaaatcccaccatcgaagaggggcgaacgctccgcgtgctgaagatggtcgagccgtggctgcggggtaaccagttttgcatcaagatactcaacccatatatgccgtccgtggtggagaccctggagcagatgcagcgcaagcatggcgggatgctggtccgaaatcccctcagccgcaactccacccacgaaatgtactgggtcagctgcggcaccgggaatatcgtctccgccgtaaacatgacgagccggatgctgctgaaccgtttcaccatggcgcaccgtaagcccacgtttgagcgagatgtggacctcggagcggggacccgccacgtggcggtcgagcccgaagtagccaaccttgacatcatagggcaacggatcgagaatataaagaacgagcacaagtccacgtggcattacgatgaagacaacccgtacaagacctgggcctaccacggctcatacgaggtcaagccctcggggagcgcgtcctcgatggtcaacggcgtcgtacgcctgctcaccaaaccatgggacgtcatccctatggtgacgcagatcgccatgacagataccaccccgttcggccagcagcgggtattcaaggagaaggtggacactcgcacgccccgggccaagcgcggcaccacccagattatggaggtgaccgccaagtggctgtggggcttcctgtcccgtaacaagaagccccgcatctgcacgcgggaggagttcacccgaaaggtccggagcaatgcagctatcggggccgtgttcgtggacgagaatcagtggaattctgccaaggaggccgtcgaggacgagcgcttctgggacctcgtgcaccgtgagcgcgagctgcacaagcaaggcaagtgcgcgacgtgcgtgtataacatgatgggcaagcgggagaagaaacttggcgagttcgggaaggccaagggctcccgcgccatctggtacatgtggttaggggccagattcctggagttcgaggccttggggtttatgaacgaagaccactggttcagccgcgagaactcccttagcggcgtagagggggagggcctgcacaagctggggtacatcctccgggacatctccaagatcccgggcggaaacatgtacgcagacgacaccgccgggtgggacacgcgcatcactgaggacgatctgcagaacgaggccaagatcaccgatatcatggaacccgagcacgccctgctcgccacctccatctttaaactgacgtaccagaacaaggtcgtgcgggtacagcgcccggcgaagaacggcaccgtgatggatgtgatctcccgacgggaccagcgcgggagcggccaggtcggcacctatgggctgaacaccttcacgaatatggaggttcagttaatccggcagatggagtctgagggcatctttttacctagcgagttggagaccccgaacctcgcagagcgcgtgctggactggcttgagaagcacgggaccgagaggttgaagcgcatggccatctccggagacgattgcgtcgtcaagcccatcgacgaccggtttgccaccgccctgaccgcgttgaacgacatggggaaggtgcgcaaggacattccccagtgggagccgagcaagggctggaacgactggcagcaggtaccattctgctcccaccactttcaccagctcatcatgaaagacggccgcgagattgtggtgccctgccgcaaccaggacgagctagttgggcgggcccgcgtcagccaaggcgccggatggtccctgcgggagacggcctgtctcggaaagtcctacgcccagatgtggcaactgatgtactttcatcgccgggacctgcgcctcgcggccaacgccatctgctcggccgtacccgtcgactgggtgcccacgagccggactacctggagcatccacgcgcaccaccagtggatgacgacggaggacatgctgtccgtgtggaatcgagtctggatcgaggagaatccgtggatggaggataagacccacgtgagctcctgggaggaagtgccctacctcgggaagcgggaggaccagtggtgcggctcactcatcggcttaaccgcccgtgccacgtgggctaccaatattcaggttgccatcaaccaagtgcgcaggctgatcgggaacgagaactacctcgactatatgacctccatgaagcgcttcaagaacgagagcgatcccgagggcgcgctatggtga

SEQ ID NO: 23889 - RNA, 9879 nt, synthetic construct
  misc_feature 1..9879: note = derived and/or modified CDS sequence (opt11) from DENV-1__GQ868518__SS-prME
  source 1..9879: mol_type = other RNA
tcggtgacaatgctgctcatgctgctgcccaccgccctggcgtttcacctcacgaccagaggcggggagccccacatgatcgtgagcaagcaggagcggggcaagagcctcctcttcaaaaccagcgcgggggttaacatgtgcacacttatcgccatggacctgggggaactatgcgaggacacaatgacctataagtgccctcagatcacagaagccgagcccgatgacgtggactgctggtgcaacgctaccgatacgtgggtgacctacggtacctgtagccaaacgggcgaacaccgccgggataagcgctccgtggccctggccccccacgtgggactggggctagagacgcggaccgaaacctggatgagctccgagggagcctggaagcagatccagcgcgtcgagacctgggccctgcggcaccccgggttcacggtaatcgccctattcctcgcgcatgctatcggcacctcgattacacaaaaagggatcatcttcatcctgctgatgctcgtgactccctccatggccatgcgctgcgttggcattggaaaccgggacttcgtggaaggcctgtccggcgcaacttgggtggatgtcgtgctggagcacgggagctgcgtgaccaccatggctaagaacaagcccaccctcgatatcgagctgctaaagacggaggtgaccaatccagcgatactcagaaagttatgtatcgaggccaagatcagcaataccaccactgactccagatgccccacccagggcgaggccaccctcgtggaagagcaggacgccaactttgtatgcaggaggacctttgtcgaccgcggttggggcaacgggtgcggcttgttcggcaaggggtcactactgacgtgtgcgaagttcaagtgcgtgacgaagctcgaggggaaaattgtacagtacgagaacctgaaatacagcgtcattgttaccgtgcacactggggaccagcaccaggtaggcaacgagacgaccgagcacggcactatagcgaccatcacgccgcaggcccccacgagcgaaatacaactgaccgactatggggccctcaccctcgactgcagcccacggaccggcctggacttcaacgagatggtgctcctgaccatgaaggagaagtcttggctggttcataagcaatggttcttagatctgccgctgccctggacctccggggccagcacaagccaggagacctggaatcgacaagacctcctcgtgacgttcaagaccgcacacgcgaagaagcaggaggtggtcgttctgggcagtcaagaaggcgcgatgcacaccgctttaactggcgccacggagatccagaccagcggtacgacaacgatattcgccgggcacttaaagtgccggctgaagatggacaagctcacgttaaagggtacctcctacgtaatgtgcaccgggagcttcaagctggagaaggaagtcgcggaaacgcagcatggtaccgtgctggtgcaggtcaaatacgagggcactgacgccccctgcaagatacccttctcgacccaggatgaaaagggtgtaacgcagaacggccgccttataaccgccaaccccatcgtaaccgacaaggagaagcctgtcaacatcgagactgagcctccctttggcgagagctatatcgtggtgggggctggcgagaaggcgttaaagctctcctggttcaagaaggggagcagcatcggcaagatgttcgaggcgaccgcccgcggcgcccggcggatggccatcctcggcgacacggcgtgggacttcgggtctatcggcggggtattcacctccgtgggtaagctggtgcaccaggtgttcggcaccgcctatggtgtgcttttctcgggcgtgagctggacgatgaagatcgggatcgggatcctcctgacttggctgggcttgaatagtcgttccacctcgctgtccatgacgtgtattgctgtagggatggtgacgctatatctgggcgttatggtccaagccgacagcgggtgcgttataaactggaagggccgcgaattaaaatgcggatccgggatcttcgttaccaacgaagtacacacgtggaccgagcaatacaagttccaggccgacagcccgaagcggctgtctgcggcaatcggcaaggcgtgggaggagggggtgtgcggcatccggtccgccactcggctcgagaacatcatgtggaagcaaatcagcaatgagctgaaccacattcttctcgaaaacgatatgaagttcaccgtggttgtcggggacgccaacggtatcctggctcaggggaaaaagatgattcgtccacagcccatggagcacaaatactcttggaaatcatggggaaaggccaagatcatcggtgcggacatccagaatacgacgtttatcatcgacgggcccgacaccccggagtgccccgacaaccagcgcgcctggaacatctgggaagtggaggactacgggttcgggatattcacgaccaatatatggctgaagcttcgagactcctacacccagatgtgtgaccaccggctgatgtcggcggccatcaaggactccaaggccgtccacgccgacatgggctactggattgagagcgagaagaacgagacgtggaagctggcccgcgcgagctttatcgaggtcaagacgtgcacctggcccaaatctcatacactgtggtccaatggggtactggagtcggaaatgatcattccaaagatctacgggggtccgatctcccagcacaactaccgaccagggtactttactcagacagccggcccctggcacttaggcaagctcgagctggacttcgacctgtgcgagggcaccaccgtcgtggtggacgagcattgtggcaacagagggccgagcctccgaaccacgaccgtgaccggcaagatcatacacgagtggtgctgccgcagctgcactctgccccccctgaggttccgaggggaggatggctgctggtacgggatggagatacggcccgttaaggagaaggaggaaaacctcgtgcgcagcatggtgtccgccggtagcggcgaggtggacagcttctccttagggatcctgtgcgccagcatcatgatagaggaggtaatgcggagccgatggagccggaagatgctcatgactggcaccttagctgtcttcctgctgctggtgatgggacagctgacttggaacgacctcatccgcctgtgtatcatggtgggcgcgaacgcctctgaccgcatgggaatgggtactacttatcttgccctcatggccacctttaaaatgcgaccaatgttcgccgtcggcctgctgttcagaagactcaccagccgggaggtactgctgttaaccatcgggctatccttggtggctagcgtggagctccccaattccttggaggagctgggcgacgggttggcaatgggaattatgatgcttaagctactcactgagttccagccccaccaactgtggaccaccctgctaagcctgaccttcattaagacgaccctgtcccttgactacgcctggaagacgaccgccatggcgctgagcatagtgagtctgttcccactatgcctgtcgacgacctcgcagaaaaccacttggctgccggtcctcctggggagcttcgggtgcaagcctctaacaatgttcctcatcactgaaaacaagatttggggccggaagtcctggcccctgaacgaggggataatggccatcggcattgtctctatccttctctcgagcctgttgaagaatgatgtgcccctcgccggaccgctgatcgccggcggcatgctcatagcctgctacgtcattagcggatcctcagcggacctctcgctggagaaggcggccgaggtgagctgggagcaggaggccgaacacagcggtcccagccacaacatcctggtggaagtccaggatgacgggaccatgaagataaaggacgaagagcgcgacgacaccctcactattctgcttaaggcgacgttgcttgcagtgtccggcgtgtaccccatgagcatcccagctaccctgttcgtctggtatttctggcagaagaaaaagcagcgttccggggtgctctgggacacaccgtcccctcccgaagtggagcgtgccgtcctagacgacggtatctacagaatactgcaacgcggactgctggggaggtcgcaggtgggagtgggggtctttcaggacggtgtgttccacaccatgtggcacgtgacgcgcggggctgtgctcatgtatcagggtaagcggctggagcccagctgggcatccgtgaagaaagatctaatcagctacggcgggggctggcgctttcgtgggtcctggaatacaggcgaagaggtgcaggtcatcgcggtggaaccgggcaagaacccaaagaacgtgcagaccacacccggcacgttcaagacccccgaaggcgaggtcggtgccatcgccctggactttaagccgggcaccagcgggtcccccatagtgaaccgcgagggtaagatcgtaggtctgtacggtaatggcgtggtgaccaccagcgggacctacgtatccgccatcgcgcaggcgaaggccagccaggagggccccctcccggagattgaagacgaggtcttcaaaaaacgcaacctgaccataatggaccttcaccccggcagcgggaagacccgccggtacctccccgccatcgtgagagaggccatcaagcggaagctgcgcacgctgattcttgcgcccacccgcgtagtggcctccgagatggccgaggccctgaaaggcatgccgatccggtaccagaccaccgccgtcaagtcggaacacactgggagggagatcgtggacctgatgtgccacgcgacatttaccatgcggctactgtcacccgtccgcgtgccaaactacaacatgatcatcatggacgaggcccacttcacagaccccgccagtatcgccgccaggggctacatcagtacgagggtggggatgggcgaggcggccgcaatcttcatgaccgccacaccgcccgggtccgttgaggcctttccccagtccaacgcagttatccaggacgaggaacgggacatacccgagcgcagctggaactccggctacgactggatcaccgacttcccgggcaagacagtgtggtttgtcccgagcatcaaatccggaaacgacatcgccaactgtttgcggaaaaacggcaagcgtgtgatccagctgtcccggaaaaccttcgacacggagtatcagaaaaccaagaacaacgactgggactacgtggtaacgacggacatctccgaaatgggggccaactttagagccgaccgggttatcgacccacgccgatgcctcaagcccgtgatcctaaaggacggccccgagcgcgtcatactcgcggggcctatgcccgtgaccgtggccagtgcggctcaacggcgcggccgtatcggcagaaatcagaacaaggagggcgaccagtatgtgtacatgggccagcctttaaacaatgacgaggaccacgcccattggaccgaggcgaaaatgctgttagacaacataaacacgcctgaggggatcataccggctctgttcgagccggaacgcgagaagtcagccgccatagacggcgagtatcgccttcgcggggaggcacggaagaccttcgtagagctcatgcgacggggcgacctgccagtctggcttagctataaggtggcttcagagggtttccagtactctgacaggagatggtgtttcgacggggagcggaacaaccaggtgctcgaagagaacatggacgtcgagatctggaccaaggagggtgagcgcaagaagcttcgtccgagatggctggacgcccgcacttacagtgacccactggccctgcgggagtttaaggagttcgccgccgggcgtcggagtgtcagcggcgacctgatccttgagatcggtaaactgccgcaacacttaacctcccgcgcacaaaacgccctcgacaacctggtgatgctgcacaactccgagcagggcgggaaggcttaccggcacgccatggaagagcttcccgacacaatcgaaaccctgatgctgctcgccttaatcgccgtacttacaggtggcgtcaccctcttcttcttatctgggaagggcctgggaaagacgagcatcggcctcctgtgcgtgaccgcctccagtgcactgctctggatggccagtgtcgagccgcactggatcgcagcgtctattatcttggagttcttcctgatggtcctcctgatccctgagcctgatcgccagagaaccccgcaggataaccagctcgcgtacgtggtcatcggcctactctttatgatcctgacagtggccgctaacgagatggggctcctggagaccacgaagaaagacctcggcatcggacatgtggcggccgagaaccaccagcacgccaccatgttagacgtcgacctgagacccgcctcagcctggaccctgtatgcggtagcgacgaccgttatcacccccatgatgcgtcacacgatcgagaatacgaccgccaacatctctctcaccgcgattgcaaaccaggcggccattctaatgggcctggacaagggctggcccatcagtaagatggacattggagtacctctcctggccctgggatgctacagccaagtgaacccgctcaccctgacggccgcggtgctgatgctcgtcgcccactacgcaatcatagggcccggcctgcaggccaaggccacccgcgaggcgcagaagcggaccgcagccggtatcatgaagaaccccaccgtggacggcattgtggccattgacctcgaccccgttgtgtacgacgccaagttcgaaaagcagctcggccaaatcatgctgctgattctctgcacgtcccagatcctcctgatgcggaccacctgggcgttatgtgagagcatcaccctggccacgggaccactgactaccctctgggaggggtcccctgggaagttttggaatacgaccatagccgtgtcaatggctaacatatttcgcggctcctatctggccggcgcggggttagccttctcgttgatgaagtccctgggcgggggacggcgtgggaccggcgcccagggcgagaccctgggcgaaaagtggaaacggcagctcaaccagctgagtaaatcagagttcaacacctacaagcgctccggaatcatggaggtcgacagaagcgaggctaaggaggggctaaagcgcggcgagacgactaagcatgcggtgtcacggggcacggcgaagcttcgctggttcgtggagcggaaccttgtcaagcccgaaggaaaggttatcgaccttggctgcgggcgaggtgggtggtcctactactgcgccgggctgaagaaggttaccgaggtcaaagggtacaccaagggtggcccgggccacgaagagcccatccccatggccacgtacggctggaacttggtgaagcttcactccgggaaagatgtgttcttcatgcccccggagaagtgcgacacgctgctctgcgacatcggcgagagctcccccaaccccaccatcgaagaggggcggacactgcgggtcctcaagatggtggagccctggcttcggggtaatcagttttgcatcaagatcctgaacccgtatatgccaagcgtggtcgagacgctggagcaaatgcagcgcaaacacggcgggatgttagtgcggaatcccttatcccgcaacagcacccacgagatgtactgggtatcctgtggtaccggaaacatcgtatctgcagtgaacatgacctcccgcatgctgctcaaccgtttcacgatggcgcaccggaagccaacctatgagcgggacgtggacctgggcgccggcacgcgccacgtcgccgtggaaccagaggtggctaacctagacataattgggcaacggatcgagaacataaagaacgagcacaagagtacctggcactacgacgaggataacccctacaagacgtgggcctaccacggcagctacgaggtcaagcccagcggctccgcgagctccatggtgaatggtgtggtccgcttattaaccaagccatgggatgtcataccgatggtcacgcagattgccatgactgacacgacccccttcggacagcagcgggtgttcaaggagaaggtggacacgcgcacgccccgagctaagcgcggcacgacgcagataatggaggtcaccgccaagtggctgtggggattcctcagccggaacaagaagccgcgcatatgtacgcgggaagagttcacgcgtaaagtgcgcagtaacgccgcgatcggggcggtgttcgtggacgagaatcagtggaacagcgccaaggaggccgtggaggacgagcgcttctgggacctggtgcaccgggagcgcgagctgcacaaacagggcaaatgcgcgacctgcgtatacaacatgatggggaagcgggagaagaagctcggggaattcggcaaggccaaaggcagccgcgccatctggtacatgtggctgggggcacggttcctggagttcgaggcacttggtttcatgaacgaagatcattggttcagtcgagagaacagcctgtccggagttgagggggagggtcttcacaagttgggctacatcttgcgagacatctctaagatccccggtggcaatatgtacgcggacgacacagcagggtgggacacccgaatcacagaggacgatctgcagaacgaagccaagataaccgagatcatggagccggagcatgccttgttagccacctcaatcttcaagctgacttaccagaacaaagtggttcgcgtgcagcgcccggcgaagaacggcaccgttatggacgtgatctcccgccgggatcaaagaggctctgggcaggtggggacctacggcctcaacacctttaccaacatggaggtgcagctgatccggcaaatggagtctgaaggtatcttcttgccctccgagctcgaaacccccaacctcgcggaacgcgtcctggactggctcgagaagcatggggccgagcgtctgaagcgcatggccatctccggcgacgactgcgttgtgaaacccattgacgatcgctttgccaccgccctgacggccctcaacgacatggggaaagtgcgcaaagacatcccccaatgggaaccgtcgaagggctggaacgactggcagcaggttcccttctgcagccaccacttccaccagctaataatgaaggacggacgggagatcgtggtcccctgccggaaccaggatgagctggtgggacgtgcccgcgtctcccagggcgcagggtggagcctccgggagacggcctgcctgggcaagtcctacgcacagatgtggcagctgatgtactttcatcgcagagacctccgcctggcggccaacgccatctgtagcgctgttcccgtggactgggtgccgacttcccggacgacctggtccatccacgcccaccaccagtggatgaccactgaggatatgctgagcgtctggaaccgcgtatggatagaggagaacccgtggatggaggacaagacgcacgtgtccagctgggaggaagtcccctatttggggaagcgcgaggatcagtggtgtggctccctgatcggactcaccgcccgagctacgtgggccaccaacattcaggtggcgattaatcaagtgcgccggctcatcgggaacgaaaactacttggactacatgacgagcatgaagcgcttcaagaacgagtctgaccctgagggcgccctgtggtga

SEQ ID NO: 23890 - RNA, 9879 nt, synthetic construct
  misc_feature 1..9879: note = derived and/or modified CDS sequence (opt11) from DENV-1__GQ868519__SS-prME
  source 1..9879: mol_type = other RNA
agcgtgaccatgctgctcatgctactgcccaccgccctcgctttccacctgaccacgcgggggggcgagccccacatgatagtgagcaagcaggagcggggcaagagcctcctgtttaagacatccgcgggcgtgaacatgtgtactctgatcgccatggacttaggtgagctctgcgaggacaccatgacctacaagtgccctcagataaccgaggccgaacccgacgacgtcgactgctggtgcaacgcaacggacacctgggttacgtatggtacttgctcccagactggcgaacaccgacgggacaagcgctccgtggccctagcgccccacgtgggcctggggctcgagacacggaccgagacctggatgagctccgagggggcgtggaagcagatccagcgcgtcgagacctgggccctgcggcatcccggtttcacggtgatagctttattcttagcgcatgcaatcggcaccagcatcacccaaaaggggattattttcatcctactgatgctcgtgaccccgtccatggcgatgcgctgtgttggaataggcaatagagacttcgtggaggggctgagcggcgcgacatgggtggacgtcgtgctcgagcacgggtcctgcgtaaccaccatggcaaaaaacaagccaaccctcgacatcgagctgctgaagaccgaagtcaccaaccccgcgatcctcagaaagctgtgtatcgaagcgaagatcagcaacacaaccacggactcccggtgcccgacccagggcgaggccaccctggtggaggagcaagatgccaacttcgtgtgcaggcggacctttgtggatcgcggttgggggaacggctgcggcctgttcggcaaggggagcctgctgacgtgcgccaagttcaagtgcgtgaccaagctcgagggcaaaatcgtgcaatacgaaaacctgaagtactccgtcatcgtgaccgtgcacaccggagatcaacaccaggtggggaacgagacgactgagcacggcaccatcgcgacaatcacgccccaggcaccgacgagtgagatacagctgacagactacggagccctcaccctggactgctcacccaggacggggctggacttcaacgagatggtgctcctcaccatgaaggagaagtcctggctagtacataagcagtggttcctcgacctgccgttgccctggacctccggggccagcaccagccaggaaacatggaatcgacaagacctactggtgaccttcaagacggcccacgccaagaagcaggaggtggtcgtgttgggaagccaagagggcgcgatgcacactgccctcaccggagccacagagatccagaccagcggtacgacaacgatctttgccgggcacctgaagtgccggctgaagatggacaagctcaccctgaagggaaccagttacgtgatgtgcacgggtagttttaaactggagaaagaggtcgcggagacgcagcacggcaccgtgctggtgcaggtcaagtacgagggcaccgacgcgccctgtaaaatccccttcctgacccaagacgagaagggcgtgactcagaatgggcgcctgatcaccgccaaccctatcgtgaccgacaaggagaagcccgtcaacatcgagaccgaaccgcccttcggggagtcctacatcgttgtgggcgccggcgaaaaggcgttgaagctcagctggtttaagaaggggtccagcatcggcaagatgttcgaggccacggcccgcggggctcgccggatggccatactgggggacaccgcgtgggactttgggtccataggcggcgtcttcaccagcgtcggtaagctggtccaccaggttttcggcaccgcctatggggtcctgttcagcggcgttagctggacgatgaaaatcgggatcgggatattgttgacctggctcggcttaaactccagaagcacgtccctgtccatgacgtgtatcgccgtcgggatggtgacactctacctgggcgtgatggtccaggcagactccggctgcgtgatcaattggaagggccgggagctaaagtgcgggagtggcatattcgtgaccaatgaagtacacacctggacagaacagtacaagttccaagcggactccccaaagcggctctccgcggccatcggcaaggcctgggaagagggcgtgtgcggaatccgctcggccacacggttagagaacatcatgtggaagcagatcagcaacgagctcaaccacattctcctggagaacgacatgaaattcacggtcgtcgtgggggacgccaacgggatcttagctcaggggaaaaagatgatccgcccccaacccatggagcataagtacagttggaagtcctgggggaaggccaagatcatcggggcggacattcagaataccaccttcatcatagacggccccgatactccggagtgccccgacaatcagcgggcctggaatatctgggaggtggaggactacggctttgggatcttcacaaccaatatctggctcaagctgagagacagctacactcagatgtgcgaccaccggttaatgagtgcggcgataaaggatagcaaggcggtacacgctgacatgggatactggatcgagtccgagaagaatgagacctggaagctcgctcgcgcgagcttcatcgaggtgaagacgtgcacctggcccaagtcccacaccctgtggagcaacggcgtactggaatccgagatgatcatccccaaaatctacgggggcccgatcagccagcataattatcgacccgggtacttcacccagacggctggcccatggcacctcgggaagctagagctggactttgacctctgcgagggaaccacagtcgtggttgacgaacactgcggaaaccgcgggccgtctttgcggaccacgaccgtcaccggcaaaattatccacgagtggtgttgccgcagctgcaccctgccgccgctccggttccgtggggaggacggctgctggtacgggatggagatccggcccgtgaaagaaaaggaggaaaacctggtacgctccatggtcagcgccggttccggcgaggtggacagtttcagcctggggattctctgcgcctccatcatgatagaggaagtgatgaggagccgctggtcccgaaagatgctcatgacaggcaccttggcggtctttctactgctggtgatgggtcagctcacatggaatgatctgatccgcctgtgcatcatggtgggggcgaacgccagcgatcgcatggggatgggcaccacatacttagccctcatggcaaccttcaagatgcgaccgatgttcgccgtaggtctcctcttccgccggctcaccagccgcgaggttctgcttctgaccatagggctgagcctcgtggcctctgtcgaattacccaacagcctggaggagctcggcgatggtttggccatgggcatcatgatgttgaagctcctgacggagttccagccccaccagctttggatcaccctcctttcgttgacgttcatcaagaccacgctcagtctggactacgcctggaagacaacagcaatggcgctgtccatcgtaagcctcttccccttatgcctctccaccacgagtcagaagaccacctggctgccggtcctgctgggttcctttgggtgtaagcctctcactatgttcctcataaccgaaaataagatatggggtcgcaagagctggcccctgaacgagggaattatggccatagggatcgtgagcatcttgctgagctcccttctcaagaacgacgtgccactggccggaccgttgatcgccggcggcatgctcatcgcatgttacgtcataagcgggagctccgctgacctgtccctggaaaaggccgctgaggtgtcctgggagcaggaggccgagcactccggcacatcacacaacatcctggtggaggtccaggacgacggaacgatgaaaataaaggacgaggagcgcgacgacaccctgacgatcctgctcaaggccacactgctagctgtgagcggcgtgtacccaatgtccattccagctaccctgttcgtctggtacttttggcagaaaaagaagcagcggtccggggtgctgtgggacactcccagtccgccggaggtggagcgagccgtcctggacgatggaatctaccggatcctacagcgcggcctcttggggcgatctcaggtgggcgtcggggtcttccaagatggcgtgttccacacaatgtggcacgtgacgcggggagccgttctgatgtaccagggcaaacggcttgagccctcatgggcgagcgtgaagaaggatctgatatcctacggcgggggctggcgcttccagggttcatggaacaccggtgaagaggtgcaggtcatcgcggtcgaacccgggaagaatccgaagaacgtgcagaccatgcccggcactttcaaaacgcccgaaggcgaagttggagccatcgccctggacttcaagcccggcacgtccgggagcccgatcgtgaaccgtgagggcaaaatcgtgggcctctacggcaacggcgtcgtgacaacttccgggacgtacgtgtcggccatcgctcaggcgaaggcctcccaagagggccccctgcccgagatcgaggatgaggtcttcaagaagcgcaacctgaccatcatggatctccaccccgggagcggtaagacccggcgctacctgcccgccatggtgcgggaagcaattaagcgcaagctgagaactctcatactcgcgcccacgcgcgtggttgccagcgagatggccgaagccctgaagggcatgccgatacgataccagaccaccgccgtgaagtctgagcacacggggcgagagattgtggacctcatgtgccacgcgacgtttactatgcgtctgctatcgccggtcagggtgcccaactacaacatgatcattatggacgaggcccacttcaccgacccggcctctatcgccgcccgtggctacatcagcacgcgggtagggatgggcgaggcggcggctatctttatgactgccacccctcctgggtcggtcgaggccttcccccaaagcaacgcggtcatccaggacgaggagcgcgacatacccgagcggtcatggaacagtggttacgactggatcaccgattttcccgggaagaccgtgtggtttgtccccagtatcaagagcgggaacgacatagccaactgccttcgcaagaacggtaagcgagttatacagctgtcccgcaaaacatttgacacggagtaccagaaaaccaagaacaacgactgggactacgtggtcaccacggatatcagcgagatgggggccaacttccgggccgaccgcgtgatcgacccacggcgctgccttaagcccgttatcttaaaagacggccccgagcgggttatcctggctgggccgatgccggtgaccgtcgcgtccgccgcccagcgaagaggccgcataggtcggaaccagaataaggagggggaccaatacgtatatatgggccagcccctgaacaacgacgaggaccacgcccactggaccgaggcgaagatgctcctcgataacatcaacaccccagaggggatcataccggccctgtttgagcccgaacgcgagaaatcagccgccatcgacggtgagtaccgcctccgcggggaggcgcggaagacgttcgtggagctgatgcggaggggcgacctgcccgtctggctctcctacaaggtggctagcgaaggcttccagtactccgaccggcgctggtgcttcgacggagagcgaaacaaccaggttttggaggagaacatggacgtcgagatctggaccaaggaaggtgagcgcaagaagttacggccccgctggctcgacgcccggacgtatagcgaccctctggccctgcgcgagtttaaggagttcgcagccgggcggcgctcagttagcggcgacctcatcctggagataggcaaacttcctcagcacctcaccttacgggcgcaaaacgccctagataacctagtgatgctgcacaatagcgagcagggggggaaggcctaccgccatgccatggaagagctgccagatactatcgagacgttgatgctactggcgcttatcgccgtcctgacaggtggcgtgaccctgttcttcctcagtgggaagggcctgggcaagaccagcataggcctgctatgcgttacggcctccagcgccctactgtggatggcctccgtggagccccactggatcgcagcgagcatcatcctcgagttcttcctgatggtactgcttatcccggagcccgacagacagcgcacgccacaggacaaccagctcgcctacgttgtcatcggcctcctcttcatgatcctgaccgtagccgccaatgagatgggcctgctcgagaccaccaagaaagacctgggcatagggcacgtcgcagccgaaaaccaccagcatgccacaatgctggacgtcgacctccggccggcctcggcctggacgttatacgcggtggcaaccacggttatcacccccatgatgcgccatacaatagagaacaccacggccaacatcagcctgaccgccatcgcaaaccaggcggccatactcatgggcctggacaaggggtggcccatctccaagatggacataggggtccccctactcgccttgggctgctactcacaggtcaacccgctgacccttacagccgctgtgcttatgctggtcgcccattacgcgatcattgggcccggcctccaggccaaggccacacgtgaggcccagaagaggaccgccgccgggatcatgaagaaccctaccgtggacggcatcgtggccatcgacctggaccccgtcgtgtacgacgccaagttcgagaagcagctgggtcagattatgctcctgatcctgtgcacgagccaaatcctcctgatgagaacgacttgggctctgtgcgagtcaattaccctcgccaccgggccgctgaccaccctttgggagggctcacccggtaagttctggaacaccaccatcgccgtgagtatggcgaatatatttcggggcagttacttagccggcgcaggactggcctttagtctgatgaagtcccttgggggcggccgacggggaacgggcgcccagggcgagacactgggggagaagtggaagcgccagctgaaccaactttcaaagtccgagtttaacacttataagagaagcggcatcatggaggtcgacagaagcgaagcaaaggagggcctgaagcggggcgagaccacgaagcacgcggtgtcccgcgggacagccaagttacggtggtttgtggagcgcaacctggtcaaacccgagggcaaggtgatagacctcggctgcgggcggggcgggtggtcgtactactgcgccggcctaaagaaggtgaccgaggtcaaagggtacacgaagggcggtcccgggcatgaggaaccgatacctatggcgacgtacggctggaatcttgtgaagttgcattccgggaaggacgtgttcttcatgccccccgagaagtgcgataccctcctgtgcgacataggcgagtcttccccgaacccaacaattgaggaggggcgtaccctacgggtactgaagatggtggagccctggttgagaggcaaccagttctgcatcaagattctgaatccctacatgccgagcgttgtagagaccctagaacagatgcagcgcaagcatggagggatgctggtgcgcaaccctctctcccggaacagcacgcatgagatgtattgggtatcctgcgggaccggtaacatagtcagcgctgtgaacatgacctcccggatgctgctgaaccggttcaccatggcgcaccgcaagcccacgtacgagcgcgatgtagatctcggcgccggcacccggcacgtcgccgtggagcccgaggtggccaatctggacattatcgggcagcgcatcgagaacatcaagaacgagcacaagtcgacctggcactacgatgaggacaacccgtacaagacatgggcctatcacgggtcctacgaggttaagcccagtgggtccgccagctccatggtgaacggcgtggtccggctgttgacgaagccctgggacgtgatccccatggtaacacaaatcgccatgaccgataccacgccttttgggcagcagcgcgttttcaaggagaaagtggacacccggacgccccgtgccaagcggggcacgacgcagatcatggaggtcaccgcaaagtggctgtggggcttcctgagccgaaacaaaaagccccggatctgtacccgggaggagttcacccgcaaagtgaggtccaacgcggcgataggggccgtgttcgtcgatgagaaccagtggaactcggccaaagaggccgtggaggacgagagattttgggatttggtgcaccgcgaacgggagctgcataaacaaggcaagtgcgcgacgtgcgtctacaacatgatggggaagcgcgagaagaagctcggcgagttcgggaaggccaaaggcagccgggccatttggtacatgtggctcggggccagattcctggagttcgaggccctgggcttcatgaacgaggaccactggttctcccgggagaactccttaagcggcgtggagggtgaagggctgcacaagctggggtacatcttgcgcgacatcagtaagatccccggcggcaatatgtacgcggatgataccgccgggtgggatacgcggattactgaggacgacctccaaaatgaggccaagatcaccgagattatggagcccgagcacgcccttctcgctacgtccatcttcaagctgacctaccaaaacaaggtggtcagggtccaacgcccagcgaaaaacggcaccgtgatggacgtaatcagccgtcgcgatcaacgtggctccggccaggtgggcacgtacgggctgaacacctttaccaacatggaggtgcagctcatccgccagatggagagcgagggaatcttcttaccttccgagctggagaccccgaacctcgcggagcgggtactggactggctggagaagcatggggcggaacgcctaaagcggatggccatcagcggcgacgactgcgtggtgaagcccatcgacgaccgcttcgcaactgctctgaccgcgttgaacgatatggggaaggtccgcaaggacatcccgcagtgggagccctcaaagggctggaacgactggcagcaggtcccgttctgcagccaccacttccatcagttaattatgaaggacgggagagagatcgtggtcccctgccggaatcaagacgagcttgtgggtcgcgcccgggtgtcccagggcgccggttggagcctccgcgagacggcctgcctgggcaaatcctacgcccagatgtggcagcttatgtatttccaccggcgcgacctacggttggcggccaacgctatctgctctgcggtgccagtggactgggtgccgacctcccgcaccacatggagcatccacgcccaccaccagtggatgaccaccgaggacatgctgagcgtgtggaaccgggtgtggatcgaggaaaacccatggatggaagacaaaacccacgtgtccagctgggaggaagtgccctatctggggaagcgtgaagatcaatggtgcgggtcgctcatcggcctgaccgcccgcgccacctgggccaccaacatccaggttgcgatcaaccaggtgcggcgcttaatcgggaacgagaactacctcgattacatgaccagcatgaagcggtttaagaacgagtccgatccagagggtgccctgtggtaa

SEQ ID NO: 23891 - RNA, 9879 nt, synthetic construct
  misc_feature 1..9879: note = derived and/or modified CDS sequence (opt11) from DENV-1__KF955443__SS-prME
  source 1..9879: mol_type = other RNA
tctgtcaccatgctactcatgctactgcccaccgccctcgcctttcacctgaccacccggggcggggagccacacatgatcgtaagcaagcaggaacgcggcaagagcctcctgttcaaaacctcagccggtgtgaacatgtgcaccctcatagcaatggacctgggcgagttgtgcgaagacacgatgacctacaagtgcccccagatcaccgaagccgagcccgacgacgtagactgctggtgcaacgccaccgacacctgggtcacctacgggacgtgcagccagaccggcgagcaccggcgggataagcgctccgtggccctggcaccccacgtgggcctggggctcgagacgcggaccgagacctggatgtcctcagagggcgcctggaagcaaatccaacgcgtcgagacctgggcccttagacaccccgggttcacggtgatcgcgttatttctcgcgcacgcaattggcacctctatcactcagaaggggatcatcttcatcctgctgatgctcgtaactccctccatggcgatgcgctgcgtcgggatcggcaaccgggacttcgtggaggggctgtcgggggccacatgggtggacgtcgtgctggagcacgggtcctgcgtgaccacaatggcgaagaacaagcccaccctcgacatagagctgttgaagaccgaggtcaccaaccccgcgatcctccgcaagctgtgcattgaagcaaagataagcaacaccactacggattcccggtgcccgacccagggcgaggccaccctggtcgaggagcaggatgccaacttcgtgtgccgccggaccttcgtcgaccgcggctgggggaacggttgcggcctgttcggcaaggggagcctgttaacgtgcgccaagtttaagtgcgtcactaagctcgaggggaagatcgtccagtacgagaatctgaagtactccgtcatagtgaccgtgcataccggcgaccagcaccaggtcgggaacgagacgaccgagcatggtaccatcgcgaccatcactccccaggccccgacgagcgagatccaactgaccgactacggggccctcacactggactgcagccccagaaccggcctggacttcaacgagatggtgctcctcacgatgaaggagaagtcctggctagtccacaagcagtggttcctcgacctgcccctgccgtggacatccggggcctcgaccagccaggaaacctggaaccgccaggacctcttagtgacgttcaagacagcccacgcgaaaaagcaggaggtggtcgtactggggtcacaggagggcgcgatgcataccgccttgaccggggcaacggagatccagatgagcggcaccaccaccatcttcgcagggcacctgaagtgccggctgaagatggacaagctcacgttgaagggcaccagctacgtgatgtgcacggggtcgttcaagctggagaaagaagtcgcggagacccagcacggcacggtcctggtgcaggtgaagtacgagggcaccgacgccccctgcaagatccccttctccacccaggacgagaagggtgttacccagaacggtcgcctcataacggccaatccgatcgtgaccgacaaggagaagcccgtcaacatcgaaaccgagccgcccttcggggagagctacatagtggtgggtgccggcgagaaggccctgaaactctcctggttcaagaagggaagcagcataggcaagatgttcgaagccacagcccgcggggcgaggcgtatggcaatcctcggggatacggcttgggacttcgggagcatcggtggagtgttcacctcggttgggaagcttgtgcaccaggtcttcggaaccgcctacggggtgctgttcagcggcgtctcctggaccatgaagattgggatcggcatcctcctgacgtggctgggcctcaacagccgctccacaagcctttccatgacctgtatagccgtagggatggtgaccctctatctcggcgtgatggtccaggcagacagcgggtgcgtgatcaattggaagggccgagagctgaagtgcgggagcggtatcttcgtgacgaatgaggtacacacctggacagagcagtataagttccaggccgatagcccgaagcggctgagcgcggctatcggcaaggcctgggaagagggcgtgtgcggcatccgctccgtgactcggctcgaaaacattatgtggaagcagattagtaacgagctgaaccacatcctactcgaaaatgacatgaagttcacggtcgtggtgggggacgccaacggcatcctggcccagggtaagaagatgatacgcccccaacccatggagcacaagtattcctggaagtcctgggggaaggcgaagataatcggcgccgacatccaaaacacgacctttatcattgacgggccagacactcctgagtgcccagacaaccagcgggcatggaacatctgggaggtggaggactacggcttcgggatcttcaccacgaacatctggctgaagcttcgcgactcctacacacagatgtgcgaccaccgtctgatgagcgccgcgattaaggactccaaggccgtccacgcggatatgggctactggatcgagagcgagaaaaacgagacctggaagctggccagagcctccttcatcgaagtcaagacgtgtacgtggcccaagtcacacaccctctggtccaacggtgtcctggagagcgagatgatcatccccaagatctacgggggccctatctcccagcataactaccggcctgggtacttcacccaaaccgcgggcccgtggcacctgggcaagctcgagctggattttgacctttgcgagggcacgaccgtggtcgtcgacgagcactgtggcaacagggggccgagcctacggacgaccacggtgaccggcaaaataatccacgagtggtgctgccgctcatgcacccttccccccctgaggttccgcggggaggacggctgctggtacggaatggaaatccggcccgtgaaggagaaggaggagaatctcgtccgcagcatggtgtccgccggcagcggcgaggtggacagcttctccctggggatcctctgtgccagcatcatgatcgaagaggtcatgcggagccgctggagccggaagatgctcatgaccggcacgctagccgtgttcctgctcctgatcatggggcagctgacctggaatgacctcatccgcctgtgcatcatggtgggcgcaaatgcgtccgaccgcatgggcatgggcaccacctacctggccctcatggccacgttcaagatgcggccaatgttcgcagtagggctgcttttccgtcggctcacatcacgcgaggtgttactactcacgatcggactgtccctggtggcctcggtcgagctccccaactccctggaggagctgggcgacggtctggcgatgggcatcatgatgttgaagctgctcaccgagttccagccgcaccagttatggacgaccctgctcagcttaacattcatcaagaccacgctgtccctcgactacgcctggaagaccactgccatggccctgagcatcgtgtccctgttcccgctctgcctgagcactacgtcccagaaaaccacctggctgccggtgctcctgggctccttcgggtgcaaacccctaaccatgttcctcattaccgagaacaagatatggggccggaaatcctggcccctaaacgagggaatcatggcgatcggcatcgtgagcatcctgctctcttcgctgctgaagaatgacgtgcccctcgccggaccgctaatcgcgggcggcatgctgatcgcctgctacgtaatcagcggctccagcgcagacctctccctggagaaggcggccgaggtgagctgggagcaggaggccgagcactccggtacgagtcacaacatcctggtggaggttcaagacgacgggaccatgaaaataaaagacgaggagcgcgacgacaccctcaccatcttgctgaaggccacactcctggcagtgtccggtgtgtacccgatgagcatccccgcgaccctgttcctctggtacttctggcagaagaagaagcagcggtcgggggtcctgtgggacaccccctcgccgcccgaagtagagcgcgccgtcctggacgacggcatctaccggatcctgcagcgcggcctgctggggcgatcccaggtcggagtcggggtgttccaggacggcgtctttcacaccatgtggcacgttacgagaggggccgtgctgatgtaccagggcaagcgcctcgagcccagctgggcctccgtcaagaaagacctgatcagctacggtgggggctggagattccaagggtcctggaacacgggcgaggaggtccaggtgatcgccgtagagcccgggaaaaacccgaagaacgtgcagaccacccccggcacgttcaagactcccgagggcgaagtgggcgcgatcgccttggacttcaaaccaggcacctctggctccccgatcgtcaaccgggagggcaaaatcgtcgggctatacgggaacggtgttgtcaccacgtcagggacctacgtgtcagccatcgcccaggccaaagcgtctcaggagggtcccctgcccgagatcgaggacgaggtgttcaagaaacgcaaccttactatcatggacctccacccggggagcggcaagacccgtcgctacctgccggccattgtccgggaggccataaagcgcaagctgcgcacgctcattctagccccaacccgcgtggttgcgtccgagatggccgaagccctgaaaggcatgcctatccgttaccagaccaccgccgtcaagagcgaacacaccgggcgggagatagtcgatctaatgtgccacgccaccttcaccatgcgcctgctgtccccggtgagagtgcctaattacaacatgatcatcatggacgaagcgcacttcaccgaccccgccagcattgccgcccgcggctacatctccacgcgggtggggatgggcgaggccgcggctatctttatgaccgctacgccgcccgggagcgtagaggccttcccccagagcaatgcggtcattcaggacgaggagcgtgacatcccagaacggagctggaactcaggctatgactggatcaccgacttccccggtaagacggtgtggttcgtgcccagcatcaagtccggaaacgacatcgcgaattgtctccgcaagaacggcaagcgggtcatccagctcagccgcaagactttcgacaccgagtaccagaagacgaagaataacgactgggactacgtggtgacgaccgacatctccgagatgggggcaaacttccgggctgacagagtcattgacccccggcgctgcctgaagcccgtaattctcaaagacggcccggagcgggtgatcttggctgggccgatgcctgtcactgtcgcgagcgccgcccagcgccggggccgcattgggcggaaccagaataaagagggggatcagtacgtgtatatgggccaaccgctgaataatgacgaggaccacgcccactggaccgaggccaagatgctcctggataacatcaacacgcccgaaggtattattccggcgctcttcgagcccgagcgggaaaagtcagcggccatcgatggcgagtaccgcctccgcggtgaagcccgcaagaccttcgtagagttaatgcggcggggcgacctccccgtgtggctctcatataaggtcgcttccgagggattccagtacagcgaccggcgctggtgcttcgacggggaacggaacaaccaggtgctggaggagaacatggacgtggaaatctggaccaaggagggcgaacgcaagaagctgcggccacgctggctcgacgcacggacctacagtgacccgctggccctgcgcgagtttaaggagttcgccgccgggcggcggagtgtcagcggcgacctaatcctggagatcggcaagctgccccagcacctcacactgcgggcccagaacgcgctcgacaacctcgtgatgctgcacaactccgagcagggcgggaaagcctaccgccatgccatggaggagctgcccgacacgatagaaacgctcatgctgctagcgctcatcgcggtgctgaccgggggcgtcaccctcttcttcctcagcgggaagggcttgggcaagacgtccatcgggctgctctgcgttactgcctcctccgccctgctgtggatggcctccgtggaaccacactggatcgccgcgtctatcatcctcgagtttttcctcatggtgctgttaatcccggagcccgaccggcagcgcaccccccaagacaaccaactcgcctatgtggtgatcggcctgttgttcatgatcctgacagtcgccgccaacgagatgggcctgctcgagacgaccaaaaaggacctgggaatcggtcacgtagccgcggagaaccaccagcacgccaccatgctggacgttgacctccggccagccagcgcctggaccttatacgccgtcgccacgaccgtgataacccccatgatgcgacataccatcgagaacacgaccgccaacatatccctgaccgccatcgccaatcaggccgcaatcttaatgggcctggacaagggctggcccattagcaagatggacatcggggtgcccttgctcgcccttggctgctactcccaggtcaacccgctgaccctcacggccgcagtcctcatgcttgttgcccactacgccatcatcggccccggcctccaggccaaagccacccgggaggctcagaagcgcacagcggccgggatcatgaagaacccgaccgtcgatggcattgttgccatcgacctggaccccgtggtctacgacgccaaattcgagaagcagctggggcagatcatgctcttgatcctgtgcacgagccagatcctcttgatgcgcaccacctgggccctttgcgagagcattaccctcgcgacgggcccgctgacaaccctgtgggagggcagccccgggaaattctggaacactacgatcgccgtgtcaatggctaacatctttagaggcagctacttagccggcgccgggctcgcgttctccctgatgaagtccctcgggggtggccgccgagggaccggcgcccagggcgaaactctgggggagaagtggaagcgtcagctgaaccagctctccaagtccgagttcaacacctacaagcggagcggcatcatggaggtggaccgctccgaggccaaagaggggctgaaacggggcgagacgacaaagcacgccgtaagcagagggacagcgaagctgcggtggttcgtggagcgcaatctggtgaagcccgaaggcaaggtcatagacctcggatgtgggcggggcggttggtcctactattgtgccggcctgaagaaggtaaccgaggtgaaggggtacaccaaggggggccccgggcacgaggagccgatccccatggccacttacggatggaccctggtcaagctccacagcgggaaagacgtgttcttcatgccgcccgagaagtgcgacaccttgctgtgtgatatcggcgaatccagcccgaaccccaccatcgaagaggggcgcacactccgggtgctgaagatggtcgagccctggctgcgcggcaaccagttttgcatcaaaatcctcaacccgtacatgccttcagtggtggagaccctggagcagatgcagcggaagcacggcgggatgttggtccgcaacccgctgagccggaactccacccacgagatgtactgggtgtcgtgcggcacagggaacattgtgtccgcggtcaacatgacgagccgcatgctgctgaaccggttcaccatggcccaccgcaagcccacattcgagagggacgtggacctcggcgcgggcactcggcatgtggccgtcgagcctgaggttgccaacctggacatcattgggcagcgcatcgagaacatcaagaacgagcacaaatcgacgtggcattacgacgaggacaacccgtacaagacctgggcctaccacggctcttacgaggtcaagccctccggtagcgcgtccagcatggtcaacggcgtggtgcggctactaaccaagccgtgggacgtcatccccatggtgacccagatcgcgatgacggacaccaccccgttcgggcagcagcgagtcttcaaggaaaaggtggacacccggactccccgcgccaagcggggcaccacacagatcatggaggtcaccgcgaaatggctgtggggcttcctgtcccgcaacaagaagcccaggatctgcacgagagaggagttcacccggaaggtccgcagcaatgccgccataggagcggtcttcgtggacgagaaccagtggaacagcgccaaggaggcagtcgaggacgagcggttctgggacttggtacatcgcgaacgagaactgcacaagcagggcaagtgcgcgacctgcgtgtacaacatgatggggaagcgcgagaagaagctaggcgagttcgggaaggcgaagggctcaagagccatctggtacatgtggctcggggcccgctttctggagttcgaggccctggggttcatgaacgaggaccactggttcagccgggagaactcgctctcgggcgtcgagggggaaggcctgcacaagctggggtatatcctccgtgacatcagcaagatcccgggcgggaacatgtacgccgacgacaccgcggggtgggacacgagaatcacggaggatgatctgcaaaacgaggccaagattaccgatatcatggaacccgagcacgccctgttagccaccagcatcttcaagttgacctaccagaacaaggtggtccgcgtccagaggccggcgaagaatggcaccgtgatggacgtgatctcccggcgcgaccagcggggatctggccaggtgggcacctatgggctgaacacctttactaacatggaggtgcagctgattagacagatggagtccgagggcatttttctgccctccgagttagagaccccaaacctcgccgagagggtgctggactggctggagaagcacggggccgagcgcctcaagaggatggccatctcgggcgacgactgcgtcgtgaagcccatcgatgacaggttcgcaaccgccctgaccgcgttaaacgacatggggaaggtgcggaaggacatcccccagtgggagcccagcaagggctggaacgactggcaacaggttccgttctgctcccaccacttccaccagctcatcatgaaggacggccgcgagatcgtggtgccgtgccggaaccaggacgagttagtcggccgagcccgtgtcagccagggggccgggtggtccctgagggaaaccgcctgtctcggcaagagctacgcccagatgtggcagctgatgtacttccatcggcgcgacctgcggctcgcagccaacgcgatctgctccgccgtgcccgtcgactgggtgcccacgagccgcaccacatggtcaatccacgcgcaccaccaatggatgaccacggaggacatgctgtcggtgtggaaccgggtatggatcgaggagaacccgtggatggaggacaaaacccacgtgagctcctgggaagaggtgccctatctcgggaaacgcgaggaccagtggtgcggcagcctgatcggcctgaccgcccgcgccacctgggccacaaacatccaggtcgccatcaaccaggtgcggcgcctgatcggcaacgagaactacctcgactacatgacctccatgaagcggttcaagaacgagagcgaccccgaaggcgcactttggtga

SEQ ID NO: 23892 - RNA, 9879 nt, synthetic construct
  misc_feature 1..9879: note = derived and/or modified CDS sequence (opt11) from DENV-1__GQ868520__SS-prME
  source 1..9879: mol_type = other RNA
tcggtgacgatgttgctcatgcttttgccgaccgcacttgccttccacctgactacccggggcggcgagccccacatgatcgtgagcaagcaggagcggggcaagagcctcctattcaagaccagcgcgggggtcaacatgtgcaccctgatcgccatggatctgggtgaactctgcgaggacacgatgacctacaagtgcccccagatcaccgaggccgagcccgacgacgttgactgctggtgcaatgccacagatacatgggtgacctacgggacctgcagccagaccggcgagcatcgccgggacaagcgctctgtagcgctggcgccccacgttggcttggggctcgaaacccggaccgagacctggatgtcgtccgagggcgcatggaaacaaattcagcgcgtcgagacctgggccctgcggcaccccgggtttaccgtgatcgctctcttcctcgcgcatgccatcgggactagcatcactcagaaggggatcatcttcatcctgctgatgctcgtgacccccagtatggccatgcgttgcgtgggcattggcaaccgggattttgtcgaagggttgagcggtgccacgtgggttgacgtcgtgctggaacacgggtcctgcgtcaccaccatggctaagaacaagcccacccttgacatcgagctcttgaagacagaggtcaccaaccctgcgatcctccgcaagctgtgtatcgaggccaaaataagcaataccaccacggactcccggtgcccaacccaaggtgaggccaccttggtggaggagcaggatgccaactttgtttgtcgccgaaccttcgtggatcgcggctgggggaatggatgcggcttattcggcaaggggagccttttaacttgcgccaaattcaaatgtgtgaccaagctagagggcaagatagttcaatacgagaacctgaaatactccgtgatcgttaccgtgcacaccggcgaccagcaccaggtcgggaacgaaacgaccgagcacggcaccatcgccaccataacacctcaggcccccacgagcgaaatccagcttacggactacggcgcgctcacccttgactgtagcccccggaccggcctggacttcaacgagatggtcctcttgaccatgaaggagaagtcctggctagtccacaagcagtggttcctcgacctgccgctcccctggacctccggggccagtaccagccaggagacctggaaccgccaggacctcttggttacgttcaagaccgcccacgcgaagaagcaggaggtggtcgttttaggttcccaagagggcgccatgcataccgccctcactggagccacggaaatccaaaccagcggcaccaccaccatctttgccgggcacctgaagtgtcggttaaagatggacaaactcaccttgaagggcacctcctatgttatgtgcacagggagcttcaagctggagaaggaggtcgcggagacgcagcacggtaccgtcctggtgcaggtcaaatatgagggaaccgacgccccctgcaagattccgttcagcacccaggacgagaagggggtgacgcagaacggccgcctcatcaccgccaacccgatcgtgaccgacaaggaaaagcccgtaaacatcgagaccgaaccacccttcggggaaagctacatcgtggtcggcgccggggaaaaggcgctgaagctgtcctggttcaagaaagggtcctccataggcaaaatgttcgaggccacggcacgcggagcccgccgtatggccatcctcggcgacaccgcgtgggacttcggtagcatcggcggcgtcttcacttccgtggggaaacttgtgcaccaggtcttcggcaccgcctacggggtgctgttcagcggagtatcctggacgatgaagatcgggatcggaatactcctgacctggcttggcctcaacagtcgctcgaccagcttgtccatgacctgtatcgccgtcgggatggtcactctgtaccttggcgtgatggtccaagccgatagcggatgcgtgataaactggaagggaagggagttgaagtgcgggagcggcatcttcgtaacgaacgaggtccacacctggaccgagcagtacaagtttcaggccgacagtccgaagcggctgagcgcggccatcggcaaggcctgggaggagggggtgtgcggcatccgttccgccacccggctcgagaacatcatgtggaagcagataagcaacgagctgaatcatatcctattagaaaatgatatgaagttcaccgtggtcgttggggacgccaatggcattctggcgcaggggaagaagatgatccgcccccagcccatggagcacaagtactcctggaagtcctggggcaaggccaagatcatcggtgccgacatccagaatacgacctttatcatcgacgggcccgacacaccggagtgccccgacaaccagcgagcctggaacatatgggaggtagaagactatgggttcgggatctttacgacgaacatctggctgaagctccgcgactcctacacccagatgtgcgaccaccggctgatgagcgcggccatcaaggactcgaaggccgtccacgccgatatggggtactggatagagtctgagaaaaatgagacctggaagctggcccgcgcttccttcatcgaggtgaagacgtgcacctggcccaagagccacaccctctggtccaacggcgtgttggagagcgagatgatcatccccaaaatctacggtggtccgatctctcagcacaactaccggcccgggtacttcacccagacggccggcccgtggcacctggggaaattggagctggacttcgacttatgcgagggcacgaccgtcgtggttgacgagcattgcggcaaccgcgggccgagcctccgcaccacgaccgtcaccggcaagatcatccatgaatggtgctgccgctcctgcacgctgccgcccctgcggtttcgcggtgaggacggctgctggtacgggatggagattcggcccgtgaaggagaaggaggagaatctcgtgaggagcatggtctcagctggaagcggcgaggtggacagcttcagtttggggatcttgtgcgccagtataatgatcgaggaggtaatgcggtcccgctggagcagaaagatgctcatgaccggcactctggccgtcttcctgctcctggttatggggcagctgacctggaacgacctcatccgcctgtgtatcatggtgggcgcgaacgcgtccgatcgcatgggaatgggaaccacgtacctggccctaatggccacatttaagatgcggccgatgtttgccgtcgggttattgttccgtcggctgaccagtcgcgaggtgctgctcctcaccattgggttgtccctcgtagccagcgtcgagctccccaactccctggaggagctgggggacgggctcgccatgggaataatgatgctgaagctgctcacagagttccagccccaccagctctggaccaccctgctcagccttaccttcattaagacgactctaagcctagactatgcctggaagaccaccgccatggccctgagcatcgtgagtttattccctctctgcctgagcaccacctcccagaaaacgacgtggctgcccgtcctcctgggcagcttcgggtgcaagcccctgaccatgttccttatcaccgagaacaagatttggggccggaaaagttggccactgaacgaggggatcatggccatcggtatcgtctcaatcctgctctcctcactgttaaagaacgatgtgccactcgctggcccgctgatcgccggcggtatgctgatcgcctgctatgtcatcagtgggtccagcgcggacctctccctggagaaggccgccgaggtgagctgggaacaggaggctgagcactccggcaccagccataacatcctggttgaagtccaagacgacggtacgatgaagatcaaggacgaggaacgcgacgataccttaacaatcctcctgaaggccaccttactggcagtgtccggcgtttaccccatgagcatccccgccaccctgtttgtatggtacttctggcagaagaagaagcagcggtccggggtgctatgggacacccctagcccaccagaggtggagagagctgtcctggacgatggcatctatcggatcctgcagcgcggcctactcgggcggtcccaggtgggcgtgggggtcttccaggacggagtgttccacacgatgtggcacgtgactcgcggggccgtcctgatgtaccaggggaaacggctagagccttcgtgggcgtccgttaagaaagatctcatctcttacggaggaggctggcgcttccagggatcctggaacaccggcgaggaggtgcaggtcatcgcggtggagcccgggaaaaacccgaagaatgtgcagacaatgcccggcaccttcaagacccccgagggcgaagtcggggccatcgcgctagacttcaagcccggcacaagcggatccccgatcgtgaaccgggagggcaagatcgttggcctgtacgggaacggggttgttaccacgagcgggacctacgtatcagccatcgctcaggcaaaagctagccaggaaggccctttacccgagatcgaggacgaggtttttaagaagcgtaatctgacaatcatggacctgcaccctgggtcaggcaagacgcggcgttacttgcccgccatggtgagggaggccatcaagcgcaagctgcgaacgctgatcctcgcgcctacccgcgtggtcgcctccgaaatggcagaggccctgaagggaatgcctatccgctaccaaaccaccgccgtcaagagcgagcacacgggacgggaaattgtggacctgatgtgccacgcgacattcactatgcgcttactgtccccggtccgcgtgccgaactacaatatgatcatcatggacgaggcccattttaccgaccccgcgtcgatagccgcccgcggctacatatctacgcgtgtggggatgggcgaggcggccgccatcttcatgaccgccacgccgcccgggagcgtcgaggccttcccccagtccaacgcggttatccaggacgaggagcgcgacattcccgaacggtcgtggaactccggctacgactggatcaccgacttccctggcaaaacggtgtggttcgtacccagcatcaagtccggaaatgacatagcaaactgcctgaggaagaacggcaaacgggtaatacaactaagccgcaagacctttgacaccgagtaccaaaagactaaaaacaacgactgggactacgtggtcacgaccgacatatccgagatgggcgccaacttccgggctgatcgcgtgatcgaccccagacgttgtctgaagcccgtgatcctgaaggatggccctgagagggtaatcttggcgggaccgatgcccgtaacggtggccagcgccgcccagcgccgggggaggatcgggcggaaccagaacaaagagggagaccagtacgtatacatgggccagcccctcaacaacgacgaggaccacgcccattggacggaagcgaaaatgctgctcgacaacattaacacacccgaggggatcatcccggccttatttgagcccgagcgcgagaaatccgccgccatcgatggcgagtaccgtctcaggggggaggcgcgcaagaccttcgtggagttgatgcggcggggagacctgcccgtctggcttagctacaaagtggcgtctgagggattccagtatagcgaccggcgctggtgtttcgacggagagcgtaacaaccaggtgcttgaagagaacatggacgttgagatctggacgaaggagggagagcgcaagaagctgcgcccccgctggctcgacgcgcggacctattccgacccgctagccctgcgcgaatttaaggagttcgccgccgggaggcgtagcgtgagtggcgacctcatcttggagattggcaagctgcctcagcatctaaccctccgggcgcagaacgccctggacaacctggtgatgctccacaactccgaacaaggcggtaaggcctaccgccatgcgatggaggaactgcccgatactatagagaccctgatgctcctggccctcatcgcggtgctcaccgggggcgtgaccctgttcttcttgagcgggaagggcctcggcaagacgtctatcgggctgctgtgcgttaccgcgagcagcgccctcctgtggatggccagcgtcgagccccactggatcgcggcctccatcatcctggagttcttcttgatggtgctgctgatcccggaaccggaccggcagcgcacgcctcaggacaaccagttagcgtacgtggtgatcggcctgctgttcatgatcctcacggttgccgccaacgaaatggggctgctggagacgaccaagaaggacttaggcatcgggcacgtggcggccgagaaccaccagcatgccaccatgctagacgtggacctacggccggccagcgcctggaccctatacgcggtggccacaaccgtgataacccctatgatgcgccacacaatcgagaacacgaccgctaacatctccctgaccgcaattgccaaccaggctgccatcttaatgggactcgacaagggttggccgataagtaagatggacatcggggtccccttgctggcactcggttgctacagccaggtgaacccgctgaccctgacggccgcggtgcttatgctagtcgcccactatgccatcatcggacccggcctgcaggccaaagccacccgggaggcgcaaaagcggaccgccgccggcataatgaaaaatcccactgtggacggcatcgtggccatcgacctcgaccccgtcgtctacgacgccaaattcgagaagcagctgggccaaatcatgctgctgatactgtgcacgagccagatcctgctgatgcgaaccacctgggctctgtgcgagtccataaccctggctacggggccgctaaccaccctgtgggagggctctccgggtaaattctggaatacaacgatcgccgtgtctatggccaatatcttccggggcagttatctggccggcgcgggtttagccttctcactgatgaagtcactgggcggtggccggcgcgggaccggcgcccagggtgagaccctcggagagaagtggaagcgccagctgaaccagttatccaagagcgagtttaatacctacaagcgcagcggaatcatggaggtcgaccgcagcgaggcaaaggaagggctcaagcggggcgagacgaccaagcatgccgtgagccgcgggaccgctaaactccgctggttcgtggagaggaacctcgtcaagcccgaaggcaaggtgattgacctcggctgtgggcggggaggttggtcctactactgcgctgggctcaagaaggtgaccgaagtaaaggggtacacgaagggcggccccgggcacgaggaaccgatcccaatggccacgtacggatggaacctggtgaagttacacagcgggaaagacgtgttcttcatgccgcccgagaagtgcgacacactcttgtgtgacatcggcgagtcaagtccgaaccccacgatcgaggaggggcgcacccttcgggtcctaaaaatggtggagccgtggcttcgcgggaaccagttctgcataaagatcctgaacccctacatgccgtccgttgtcgagacgctcgagcaaatgcagcggaagcacggtggcatgctagtgaggaatcccctgtcacgcaactccactcacgagatgtactgggtctcctgcggtaccggtaatatcgtctccgctgtgaacatgacctctcgcatgttgttgaaccggttcacgatggcgcaccgcaagcccacttacgaacgagacgtggatctcggcgccggcaccagacacgttgccgtcgagccggaggtagcgaacctcgacatcatcggacagagaatcgagaacatcaagaacgagcacaagtccacttggcattacgatgaggacaatccgtacaagacgtgggcctaccacggcagctacgaagtcaagccctccgggagcgcgagcagcatggtgaacggcgtagtccgtctgctgaccaagccatgggacgtgatccccatggtcacccagatagccatgaccgacactaccccattcgggcagcagcgcgtgtttaaggagaaggttgacacccgcaccccccgggctaaacgggggacgacccagatcatggaggtcacagcaaagtggttgtggggcttcctgtcccgtaataagaaaccccggatctgcacccgcgaggagttcacgagaaaggtgcgctcgaacgctgcgatcggggccgtgttcgtcgacgagaaccagtggaacagcgccaaagaagctgtggaggatgagcggttctgggacttagtgcaccgggagcgggagctccacaaacagggcaagtgcgcgacgtgtgtctataacatgatggggaagcgcgagaagaagctgggcgaattcgggaaggccaaaggctcccgggccatctggtacatgtggctgggcgcccgcttcctcgagtttgaggccctggggttcatgaatgaggaccactggttcagccgggagaattctctgagcggcgtggagggggaaggcttgcacaagctagggtacatcctcagagacatttccaagataccgggtggcaacatgtacgcggatgataccgccgggtgggacactcggatcactgaagacgacttacagaacgaagccaaaatcaccgagatcatggaaccggagcacgccctgctggcaaccagcatcttcaagctcacctaccagaacaaggtggtgcgagtccagagacccgcgaagaacggcacggtgatggacgtcatcagtcgtagagaccaaagggggtcgggccaggtgggcacctacgggctgaacaccttcacgaacatggaggtgcagctgatccgccagatggagtctgaaggcatctttcttcccagtgagctggaaacgcccaatctagccgagcgcgtccttgactggctggagaagcacggggctgaacggctgaaaagaatggccatctccggcgacgactgtgtggtgaagcccattgatgaccgcttcgccactgccctgactgccctgaacgatatggggaaggtccgtaaggacatcccccagtgggaaccgagcaagggctggaacgactggcagcaggtcccgttctgctcccaccacttccaccaattgatcatgaaggatggccgcgagatcgttgtcccgtgtcggaaccaggatgagctcgtggggcgcgcacgcgtgagccagggcgctgggtggtccctgcgcgagaccgcctgcttaggcaagagctacgcccagatgtggcagttgatgtacttccaccgccgcgacctgcggctggccgcaaacgccatctgctctgccgtccccgtggattgggtgcctaccagccgcacgacctggagcatccacgcccaccatcaatggatgactaccgaagacatgctcagtgtgtggaacagagtgtggatcgaggaaaacccgtggatggaggataagacgcacgtgagctcctgggaggaggtcccctacctgggaaagcgcgaggaccagtggtgcggcagtctaattggcctaaccgcccgagccacttgggccaccaacatccaggttgctatcaaccaagtgcggcgactgatcgggaacgagaactacctggactacatgacgtccatgaagcggttcaagaacgaaagcgaccccgagggcgcgctctggtga

SEQ ID NO: 23893 - RNA, 9879 nt, synthetic construct
  misc_feature 1..9879: note = derived and/or modified CDS sequence (opt11) from DENV-1__GQ868522__SS-prME
  source 1..9879: mol_type = other RNA
agcgtgaccatgctgcttatgctgctgcccaccgccctcgccttccacctgaccacccggggcggagaaccccacatgatagtgagcaagcaggagcggggcaagagcctcctgtttaagaccagtgctggggtgaacatgtgcaccttaattgccatggacctgggtgagctctgcgaggacacaatgacctacaagtgcccccagatcaccgaggctgagcccgatgacgtcgattgctggtgcaatgccaccgacacctgggtcacctacgggacctgcagccagactggcgagcaccggcgggacaagcgctccgtggcgctggcgccccacgtgggcctgggtctcgagacccggactgagacgtggatgagctccgagggcgcctggaagcagatccagcgcgtcgagacctgggccctgcgtcaccccgggttcacagtgatcgccttattcctagcgcacgcgatcggcaccagcatcacccagaaagggatcattttcatcctgctgatgctcgtgactccctcaatggccatgcgctgcgtcggcattggcaaccgggacttcgtggaagggctgagcggcgccacgtgggtggacgtcgtgctggaacacggcagctgcgttaccactatggccaaaaacaaaccaaccctcgacatcgaactgctgaagacggaggtcaccaaccccgcgatcctccgcaagctgtgcatcgaggccaagatcagcaacaccaccacggactcccggtgcccgacccagggcgaagccactctggtggaagaacaggacgccaacttcgtgtgccgccgaaccttcgtcgaccgcggctgggggaacggctgcggcctcttcggcaaggggagcctgttaacgtgcgccaagttcaaatgtgtgaccaaactcgagggcaagatcgttcagtacgagaacctgaagtactctgtgatcgtgaccgtgcacaccggcgaccagcaccaggtcgggaatgaaactaccgaacacggcaccatcgcgaccatcacgccccaggcacccacgagcgagatccagctaaccgactacggggccctcaccctggactgcagcccccggacgggcctcgacttcaacgagatggtattgctgactatgaaggagaagtcatggctggtgcataagcagtggttcctcgacctgcctctgccgtggacctccggggccagcaccagtcaggagacctggaaccgccaggaccttctggtgacgttcaagaccgcacacgcgaagaagcaagaagtggtcgttctgggttcccaggagggcgccatgcataccgcgttgaccggggcaacggagatccagaccagcggcaccaccacgatcttcgcagggcacctaaagtgccggctgaagatggacaaacttaccctgaagggcacctcctacgtgatgtgtaccgggagcttcaagttggaaaaggaagtcgcggagacacaacacggcacagtgttggtgcaggtcaagtacgagggcaccgacgccccttgcaagattcccttcagcacccaggatgagaaaggagtgacgcagaacggccgtctaatcaccgccaacccgatcgtaaccgacaaagagaagcctgtcaacatcgagacagagccgcccttcggggagagctacatcgtggtgggcgccggcgagaaggcgctgaagctgtcttggttcaagaaggggagctccatcggcaagatgttcgaggcaaccgcccgcggggcccgccggatggcgatcctcggtgatactgcctgggacttcggtagcatcggcggcgtcttcacctccgtggggaagctggtgcaccaggtcttcggcaccgcgtacggagtacttttcagcggcgtgtcatggacgatgaagatcgggatcggaatcctcttaacatggctgggcctgaacagccgttccaccagcctgtccatgacctgcatcgccgtcgggatggtcactctgtacctcggagtgatggtccaagccgacagcggttgcgtgataaactggaaaggccgggagttaaagtgcgggtccggcatcttcgtgacgaacgaggtccacacctggaccgagcagtacaagttccaggctgacagccctaaacggctgagcgcggcaatcggtaaagcctgggaggagggggtctgcggcatccgctccgctacccggctcgagaacattatgtggaagcagatcagcaacgagctaaaccatatactgctcgagaacgacatgaagttcacggtggtggtaggggacgccaacggcatcctggcccaggggaagaagatgattcgcccccagcccatggagcataagtactcctggaagtcctggggcaaggccaaaatcataggtgccgatatccagaacactacctttatcatcgatgggcccgacaccccggagtgccccgacaaccagcgggcctggaacatctgggaggtggaggactacggcttcgggattttcacgaccaacatctggctgaagctccgcgactcctacacccagatgtgcgaccaccggctgatgtccgcggcgatcaaggactccaaggccgtccacgctgacatgggctactggatcgagagcgagaagaatgagacctggaagctggctcgcgcgtccttcatagaggtgaagacgtgcacctggcccaagtcacacaccctctggtctaacggcgtgctggagtctgaaatgatcatacccaagatctatgggggcccgatctcccagcacaactaccgccccgggtacttcacccagacggccggcccctggcacctggggaaactagagctggacttcgacctgtgcgaaggcaccaccgtcgttgtggacgaacactgcggcaacagagggccgagcctccggaccactaccgtcaccggcaagatcatccacgagtggtgctgtagatcctgcaccctgccgcccctgcggttccgcggggaggacggatgctggtatgggatggagatcagacccgtgaaggagaaggaggagaacctcgtgcgctccatggtctctgcgggcagtggcgaggtggatagcttctccctggggatcctgtgcgccagcatcatgatcgaggaggtgatgcggtcccgctggagccggaagatgctcatgacgggcaccctggccgttttcctcctcctggtgatggggcagctgacttggaacgacctcatccgcctgtgcatcatggtaggcgcgaatgcttccgaccgcatggggatgggcaccacgtacctggccctcatggccaccttcaaaatgcggcctatgttcgccgtcgggctgctgttccgccgactgacctcacgcgaggtgctgctgctcaccatcggcctttccctggtggcgagcgtcgaactccctaactccctggaggagctgggggacgggctcgccatgggcatcatgatgctgaagctactcacggagttccagccccaccagctgtggatcaccctcttaagcctgacctttatcaagaccacgttatccctcgactacgcctggaagaccaccgccatggcgctgagcatcgtgtccctgttccccctctgcctcagcacaacgtcccagaagacgacctggctgccggtcctcctgggcagcttcgggtgcaagcccctgaccatgttcctcattaccgagaacaagatctggggccggaaatcctggcccttgaacgaaggtatcatggctatcggcatcgtgagcatcctgctatccagccttctgaagaatgacgtgcccctcgccgggccgctgatcgccggcggcatgctgatcgcctgctacgtcatcagcgggtccagcgcggatctctccctggagaaggccgccgaggtgagctgggagcaggaggccgagcactccggcacgtcacacaacatcctggtggaggtccaggacgacgggactatgaagatcaaagacgaggagcgcgacgacacccttaccatcctgttaaaggcgacgctcctggcggtgtccggcgtgtaccccatgagcatccccgccactctgtttgtctggtatttctggcagaagaaaaagcagcgctccggggtcctctgggacacccccagcccgcccgaagtggagcgcgccgtgctggatgacggcatctaccgaatcctgcagcgcggcctgctcgggcggtcccaggtgggcgtgggggtcttccaggacggtgtgttccacaccatgtggcacgtgacgcgcggagcagtgctgatgtaccagggcaagcggctggagcccagctgggcctcagtgaagaaggacctgatcagctacggcgggggctggcgcttccaggggtcctggaacactggcgaggaagtgcaggtcatcgccgtggagcccgggaagaacccgaagaacgtgcagaccatgccaggcaccttcaagacgccggagggcgaggtcggggccattgctctggacttcaagcccggcacaagcgggtccccgatcgtgaatcgggagggcaagatcgtgggcctatacgggaacggcgtcgtgaccaccagtggcacgtatgtgtccgctatcgcccaggcgaaggcaagtcaggaaggccccctccccgagatcgaggacgaggtcttcaagaaacgtaaccttacaattatggatctgcacccgggtagcggcaagacccggcgatacctccccgctatggtgcgggaggccatcaaacgcaagctacggaccctgatccttgcgcccacgagggtggtcgcgtccgagatggccgaggccctgaagggcatgcccatccgctatcagaccaccgccgtaaagagcgagcacaccgggcgggagattgtggacctgatgtgccacgctacattcaccatgcgcctcctgtcccccgtccgggtgcccaattacaatatgataatcatggatgaggcccacttcaccgaccccgccagcattgccgcgcgcggctacatctcaacacgggtggggatgggagaagcggctgccatcttcatgacggccactccgcccgggagcgtcgaggccttcccccagtccaacgcggtaatccaggacgaggagcgcgacatccccgagcggagctggaactccggctacgactggatcaccgacttccccggaaagaccgtttggttcgtccccagcattaagtcaggcaacgacatcgccaactgcctgcgcaagaacggcaagcgggttatccagttgagcagaaagacattcgacaccgaataccagaagaccaagaataacgactgggactacgtggtcacgaccgacatttccgaaatgggggccaacttccgggccgaccgcgtgattgacccccggcgctgtctgaagccggtgatcctgaaggatggccccgagcgggttatcttggcggggccgatgcctgtcaccgtggcgagcgccgcccagcgccggggacggatcggccggaaccagaacaaggagggggaccagtacgtctacatgggccaacccctgaacaacgacgaggaccacgcccactggaccgaggcgaagatgctgctcgacaacatcaacacccccgaggggataatccctgccctgttcgagcccgagcgggagaagtccgccgcaatcgacggcgagtaccgcctgcgcggggaagcccgcaagacgttcgtggagctcatgcgccgaggggacctgcccgtatggctgagctacaaagtggcgtccgagggctttcagtacagcgaccggcgctggtgtttcgacggggagcggaacaaccaggtgctcgaggagaacatggacgtcgagatctggacgaaggagggcgagcgcaagaaactgcggccccgatggctggacgcccggacctactccgacccgctcgctctgcgtgagttcaaggagttcgccgccgggcgacgctcggtcagcggcgacctgatcctcgagatcggcaagctaccccagcacctgaccctccgggcgcagaacgccctggacaacctggtcatgctccacaactccgagcagggcgggaaggcctaccgccatgccatggaggagctgcccgacaccatcgagacgctgatgctcctggcgttgatcgccgtcctcaccgggggcgtaaccctgttcttcctatctgggaagggcctcggcaaaacctccatcgggctgctgtgcgtgacagccagttccgcgctcctgtggatggccagcgtcgaaccccactggatcgcagcctccataatcctggagttcttcctcatggtgctgctgattccggagcccgaccggcaacgcacaccccaggacaaccagctcgcctacgtggtcatcggcctactcttcatgatcttaaccgtggccgccaacgagatggggttgctggaaaccacgaagaaggacctgggcatcggtcacgtggcggccgagaaccaccagcacgcaaccatgctggacgtggatctgcggccggccagcgcctggaccttatacgcggtggccaccacggtgatcaccccgatgatgaggcacacaatcgagaacaccacggccaacatctccctgactgcgatcgccaaccaggcggccatcctgatgggtctcgacaaaggctggcccatcagcaagatggacatcggggtcccccttctggccctcggctgctactcccaggtcaaccctctgactctgaccgctgcggtgctcatgctggtcgcccactacgccatcatcgggcccggcctgcaggcgaaggcgacgcgtgaggcgcaaaagcgcacggcggctggaatcatgaagaaccccaccgtggacggcatcgtcgccatagacctcgatcccgtcgtgtacgacgccaagttcgagaagcaactggggcagatcatgctgctcatcctgtgcaccagccaaatcctgctcatgcgcacgacctgggcgttgtgcgagtccatcaccctggcaaccgggccgctcacgaccctgtgggagggctctcccgggaagttttggaacactaccatcgccgtgtccatggccaacatcttccggggcagctacctggctggcgcgggtctcgccttctccctgatgaagtccctgggcggagggcgccggggaacgggcgcccagggcgagaccctcggggagaagtggaagcgtcagctcaaccaactgtccaaaagcgagttcaacacctacaagcgaagcggcataatggaggtcgaccgcagcgaggccaaggaggggctcaagcggggcgagaccacgaagcatgcggtgagccgcggaacagccaagctgcggtggttcgttgagcgcaacttagttaagcccgaaggcaaggtcatcgacctgggctgcgggagaggagggtggtcctattactgtgcagggcttaagaaagtaaccgaagtcaaggggtacaccaaagggggccccgggcacgaggagccgatccccatggcgacctacggctggaatctggtgaagctgcacagcgggaaggacgtgttcttcatgccgcccgagaagtgcgacacgcttctgtgcgacatcggcgagtccagcccgaaccccaccatcgaggaggggcgcaccctgcgggtcttgaagatggtggaaccctggctgcgcggcaaccaattctgcataaagatcctgaacccctacatgccgtccgtggtcgagactctcgagcagatgcaacggaagcatggtgggatgctggtgcgcaatcccctgtctaggaactccacgcacgaaatgtactgggtgagctgcggcacaggaaacatcgtcagcgccgtaaacatgactagccgcatgctcctgaaccggttcactatggcgcaccggaagcccacgtacgaacgcgacgtggacctgggagcaggcacccggcacgtcgcggtggaaccagaggtggccaacctcgacatcatcgggcagcgcatcgaaaatatcaagaacgagcacaagtctacctggcactacgatgaggacaacccgtacaagacctgggcctaccacggtagctacgaggtcaagccctccgggtctgcctccagcatggttaacggcgttgtccggctgttaacgaagccttgggacgtgatccccatggtcacccagatcgccatgaccgacaccacgccgttcggacagcagcgcgtgttcaaggagaaggtggacacccggacgcctcgggccaagcggggcaccacgcagatcatggaggtcaccgccaaatggctctggggcttcctgtcccgcaacaagaagccccggatctgcacccgcgaggagttcacccggaaggtgcgctccaacgccgcgatcggggccgtgtttgtcgacgagaaccagtggaactcggccaaggaggccgtggaggacgagcgattctgggacctggtgcaccgcgagcgagagctccataagcagggcaagtgcgcgacgtgcgtctacaacatgatggggaagcgcgagaagaagctgggcgagttcgggaaggccaagggctcccgggccatctggtacatgtggctaggagcccgcttcctcgagttcgaggccctagggttcatgaacgaggatcactggttcagcagagaaaactccttgagcggcgttgagggggagggcctccacaagctggggtacatcctgcgagacatctccaagatccctggcggcaatatgtacgcagatgacaccgccggttgggacacacggattaccgaggacgacctccagaacgaggccaagatcacggagatcatggagccggagcacgccctgctggccaccagcattttcaagctaacataccagaacaaggtggtacgcgtgcagcgccccgcgaagaacggcaccgtgatggacgtcatatcccgccgcgaccagcggggtagcggccaggtgggcacatacggtctgaacaccttcaccaacatggaggtgcagctgatccgccaaatggagtccgagggcatattcctgcccagcgaactggaaaccccaaatttggccgagcgagtcctcgactggctagagaagcacggggccgagcgcctgaagcggatggccatttccggcgacgactgcgtggtgaagcccatcgatgaccgcttcgccacggcgttaaccgccttaaacgacatgggtaaggtccggaaggacattcctcagtgggagcccagcaagggctggaacgactggcagcaggccccgttttgctcccaccactttcaccagctgatcatgaaggacggccgcgagatcgtggtgccctgccggaaccaggatgagctcgtcgggcgcgctcgggtgagccagggagccgggtggtcgctgcgagagaccgcgtgtctgggcaagagttacgcgcagatgtggcagctcatgtacttccaccggcgcgacctgcggctggcggccaacgcaatctgctccgccgtgccagtcgactgggtgcccaccagccgcaccacgtggagcatccacgcgcaccaccaatggatgaccaccgaggacatgctatccgtgtggaatcgggtctggatcgaggagaatccgtggatggaggacaagacccacgtgagctcctgggaggaggtgccctacctggggaagcgggaggatcagtggtgcggcagcctgatcggtctcacggcccgcgccacgtgggcgaccaacatccaagtcgccattaaccaggtgcggcgcctaatcgggaacgagaactacctagactacatgacctccatgaagcggttcaaaaacgagagcgaccccgaaggcgccttgtggtag

SEQ ID NO: 23894 - RNA, 9879 nt, synthetic construct
  misc_feature 1..9879: note = derived and/or modified CDS sequence (opt11) from DENV-1__HQ166036__SS-prME
  source 1..9879: mol_type = other RNA
agcgtgactatgctgctcatgctgctgcccaccgccctcgcttttcatcttacgaccagaggcggggagccccacatgatcgtgtctaagcaggagagaggcaagagcctccttttcaaaacctcagcgggggtgaatatgtgcaccctgatcgcgatggatctgggcgagctctgcgaggataccatgacctacaagtgcccgcagatcacagaggcggagcccgacgacgtagactgctggtgcaacgccacggacacatgggtgacctacgggacctgttcgcaaaccggcgagcaccgccgggacaagcgctccgtggcgctagcgccccacgtgggcctcgggttggagactcggaccgagacatggatgtcctcggaaggggcctggaaacagatccagcgcgtcgagacctgggccctgcgacatcccggtttcactgtgatcgccttattcctcgcgcacgccataggaacgtcgataactcagaagggtatcatcttcatactgctaatgctcgtcacgccctccatggcaatgaggtgcgtcggaatcggcaatcgggatttcgtggaggggctgagcggggccacgtgggtggacgtcgtgctggaacacggctcatgtgtgaccaccatggccaaaaacaagcccaccctcgacatcgaactgttgaagacagaagtgaccaatcccgcgatattaaggaagctgtgcatcgaagcgaagatctccaatacaaccacagactcccggtgtccaacacagggggaagccacactggtagaagagcaagatgccaactttgtgtgtcgccggactttcgtcgaccgcggttgggggaacgggtgcggcctatttggcaagggaagcctgctgacatgtgccaaattcaagtgcgtcaccaagctcgaagggaagatcgtgcagtacgagaacttaaagtactccgtgatcgtgaccgtgcataccggcgaccagcaccaggtcgggaacgagacgaccgaacacggcactatcgcgacgatcacgccccaggcccccacgagcgagatccagctgaccgattacggcgctctaacgctggactgcagcccccggaccgggctggacttcaatgagatggtgctcctgacgatgaaagagaaatcctggctggtccacaagcagtggttcctcgatcttccgctgccatggacttccggcgcgagcacctcccaggagacatggaaccgccaggacctgctggtcactttcaagaccgctcacgccaagaaacaggaagtggtcgtgctcggatcccaggaaggcgccatgcacaccgcactcacaggggctacggagatccagacgagcggcaccaccacgatcttcgccgggcacctgaagtgtcggctgaagatggataaactcaccctgaagggcacttcctacgtgatgtgtaccgggagcttcaagctggagaaggaagtcgcagaaacgcagcacggcaccgttctggtgcaagtcaagtacgagggcacagacgccccctgcaaaatccccttctccacccaggatgagaagggggtgacgcaaaacggccgcctcataaccgccaacccgatagttaccgacaaggagaaacccgtcaacattgaaaccgagccaccattcggggagagctatatcgtggtaggcgcgggcgagaaggcactaaagctgtcctggttcaaaaaggggtcaagcattggcaagatgttcgaggccacggcacgcggggccaggcggatggccatcctcggcgacaccgcgtgggacttcgggagcatcggtggcgtcttcacctccgtggggaagctggtgcaccaagtgttcggtacagcctacggggtgttattctccggagtgtcctggacgatgaagatcgggatcggtattctcctgacctggcttggcctcaactcccgctcaacctcgctgtccatgacttgcatcgccgtggggatggtaacattatacctcggggtgatggtacaggcggacagcgggtgcgtgatcaactggaaaggccgcgagctcaaatgtgggtccggtatctttgtgaccaacgaggtccacacttggaccgagcagtacaagttccaagccgacagcccgaagcggctcagcgcggccataggcaaagcctgggaagagggggtgtgcggcattaggagcgctaccagattagagaacattatgtggaagcagattagcaatgagctcaaccacatactgctcgaaaacgacatgaagttcactgttgtggtgggagacgcaaacgggattctggcgcagggaaagaaaatgatacgaccccagccgatggagcacaagtacagctggaagtcctggggcaaggccaagataatcggcgccgacatccagaacactaccttcatcatcgatgggcccgacacgccggagtgccccgacaaccagcgtgcctggaatatctgggaggtggaagactacggcttcggtatcttcacgacgaacatctggctcaagctccgcgactcctacacccagatgtgcgaccaccgcctgatgagcgcggcaatcaaagactcgaaggccgtccacgcggacatgggatactggatcgagagtgagaagaacgagacctggaagctcgcacgcgcgtccttcatcgaggtgaagacttgcacttggcccaaaagccacaccctctggtccaacggcgtgttggaaagtgagatgataatccccaagatctacggaggcccgatctctcagcacaactaccggcctgggtacttcacgcagacggccggtccctggcatttggggaaacttgagctggacttcgacctgtgtgagggtaccaccgtcgtagtggacgagcactgcggcaaccgcgggcctagcctccggactacgacagtcaccggaaagattatccacgaatggtgctgccgatcttgcaccctcccgcccctgcgtttccgcggggaggacggctgctggtacgggatggaaatcagacccgtaaaggagaaggaggagaacctcgttcgcagcatggtctccgccggcagcggcgaagttgacagtttctctctgggcatcttatgtgccagtatcatgatagaggaagtgatgcgctcccgatggagccggaagatgctgatgacaggcacccttgcagtctttctgctcctggtaatgggacaattaacctggaacgacctcatccgcctctgtatcatggtcggcgcgaatgcatccgaccgcatggggatggggactacatacctggccctcatggccacctttaagatgagaccgatgttcgccgttggcctgctgttccgtcggctcacctcacgcgaggtgctcctgctcaccatcggactgagtctcgtagcctcggtcgagttgcccaacagcttggaggaactgggggacgggctcgctatgggcatcatgatgctgaagctgctcactgagttccagccccaccagctctggacgaccctgctatcactaacctttattaaaaccaccctatcgctggattacgcctggaagaccaccgccatggcgctgtctatcgtgtcgctgttccccttgtgcctgagcacgacctcgcaaaagaccacctggctaccagtcctccttggcagcttcgggtgcaagcccctgaccatgttcctcatcaccgaaaacaagatttggggacggaagtcctggcctctaaatgaagggatcatggccatcggcatcgtgagcatcctgttatctagcctactgaaaaacgacgtgcccctggcagggccgctgattgccggcggcatgctgatcgcctgctatgtaatcagcggttcgagcgcggacttatctctggagaaggccgccgaggtgagctgggagcaggaagcagagcattccggcaccagccacaacatcttagtagaagttcaggacgacggaaccatgaaaatcaaggacgaggagcgggacgacactttaacgatcctgctgaaggccaccctcctggcagtgagcggcgtgtaccccatgagcattcccgctaccttattcgtctggtacttctggcagaaaaagaagcagcggtccggggttttgtgggacacccccagccctccagaggtggaacgcgccgtcctggacgatggaatctaccggatcctgcagaggggcttactggggcgatcccaggtgggcgtgggagtcttccaggacggcgtgttccacacgatgtggcacgtgacccgcggcgcggttctgatgtaccaaggcaagcggctggagccctcctgggcgtccgtaaaaaaggaccttatctcttacggcggggggtggaggtttcgcgggtcttggaacacaggggaggaggtgcaggttatagcggtagagcccgggaagaaccccaagaacgtccagaccacgccgggcactttcaagacccccgaaggcgaagtcggggccatcgccctggatttcaagcccggcaccagtggctctccgattgtgaaccgcgagggcaaaatcgtgggcctctacgggaacggcgttgtgacaaccagcggaacgtacgtgtccgcaatcgcccaagccaaggcctcacaggagggccccctccccgagatcgaagacgaggtcttcaagaaacggaatctgaccatcatggacctgcacccgggaagcggcaagacgcgccgttacctccctgccatcgtgcgcgaggctatcaaacggaagctgcgcaccctgatcctagcgcccacccgtgtcgtcgcatccgagatggcggaggccctgaagggcatgcccatcagataccagaccacggccgtcaagagtgagcacacggggcgagagatcgtagacctgatgtgccatgcgaccttcaccatgaggctcctatcccccgtacgcgtgcccaattacaacatgatcatcatggacgaggcccactttactgaccctgcaagcatcgcggcccggggatacatctccacccgagtcggcatgggggaagcagcagccatctttatgaccgccacaccgcccgggagcgtcgaggccttcccgcagtccaacgctgtgatccaggatgaggagcgggacatcccagagcgaagctggaactcggggtacgattggataaccgacttccccggcaagacagtgtggtttgtcccaagcatcaagtccgggaacgacatcgccaactgcttacgcaagaacggcaaaagagtcattcagctcagcagaaaaaccttcgacaccgagtaccagaagacgaagaacaatgactgggattacgtggtcacgaccgacatctcggagatgggggccaacttcagggccgatcgggtgatcgacccccgccggtgccttaaacccgtgatactcaaggatggcccggagcgcgtaatactcgctggccccatgcccgtgactgtagccagcgcagcccagagacgcgggcgaatcggtaggaaccagaacaaggagggggaccagtacgtctacatgggtcagcccctaaacaacgacgaagaccacgcccactggaccgaggcgaagatgcttttggacaacatcaacacacccgaagggatcatccccgccctttttgagcctgaacgcgagaagtccgctgctattgacggcgaatacaggctgcgcggggaagcgcggaaaaccttcgtcgagctcatgagacggggcgacttacccgtttggctgagctataaggtggcgtccgaaggcttccagtacagcgatcgccggtggtgcttcgacggtgagagaaacaatcaggtgttagaagagaacatggacgtcgaaatctggaccaaggagggcgagcggaagaagctgcgcccccggtggctggatgcccgcacatactcggacccactcgccctgcgggagttcaaggagtttgccgccgggcgccggtctgtcagcggagacctgattctcgagatcgggaagctacctcagcacctgacgtctcgcgcacaaaacgcgctcgataacctggtgatgctccataactcagagcagggcgggaaggcgtatcgccatgccatggaggagctccctgacaccatcgaaacgcttatgctgctcgcgctgatcgccgtcctgacgggaggggtgaccctctttttcctttcggggaagggcctaggcaagacttccatcgggctcctgtgcgtcactgcctcatccgctctgctctggatggcttccgtcgagccccactggatcgcggcaagcatcatcctggagttctttctaatggttctcctgattccggagcccgaccgacagcggacgccccaggacaatcagctagcctatgtggttatcggcctcctgttcatgatcctgacggtagccgcgaacgaaatggggctcctggaaaccaccaaaaaggacctgggcatcgggcacgtagcggccgagaaccaccagcacgctacgatgcttgacgtcgacctgaggcccgcctccgcctggaccttgtatgcggtcgcgactaccgtaatcacccctatgatgagacacacgatcgaaaacactactgccaacatatccctgacggccatcgccaaccaggcggccatactcatgggcctggataagggctggcccatctccaagatggacatcggggtccccctgctggccctgggctgctacagccaggtgaaccctctcactctaaccgccgccgtgctgatgttggtagcgcattacgctataatcgggccgggcctgcaggcgaaggcaaccagggaggcgcaaaagagaactgcggccgggatcatgaagaatcccacagtggacggaatcgtggccatcgacctggacccagtcgtgtatgatgccaagttcgagaagcaactcgggcagataatgttgctgatcctctgcacgagtcaaatcctgctgatgcggaccacctgggctctctgtgaaagcatcactctcgcaacgggccccctgacaaccctgtgggaaggatccccaggaaaattctggaatacgaccatagccgtgagcatggccaacatatttcgggggtcgtatctggccggggccgggcttgcctttagcttaatgaagtccctgggcggggggcggcgtggtacgggcgcacagggcgagactcttggcgagaagtggaagcgacagctcaaccagctgtcaaaaagcgagttcaacacgtacaagcgctcgggaatcatggaggtagacaggtcggaggcaaaggaggggctgaagcgcggggagaccaccaaacatgcggtgtcccgggggacggcgaaactccgctggttcgtggagcggaatcttgtcaagcccgagggaaaggtgatcgacctgggttgcgggagaggggggtggagctactactgcgcaggcctaaaaaaggtgaccgaggtcaagggttatacgaagggaggccctgggcacgaggagccgattcccatggccacctacggctggaacctggtcaagctgcactccggcaaggacgtgtttttcatgcccccagaaaagtgcgatacccttctctgcgacatcggcgagtcatcaccgaacccgaccatagaggaaggtcggacccttcgcgtcttaaagatggtggagccctggctccggggtaaccagttctgcataaagatcctgaacccatacatgcccagcgtggtcgagacccttgagcagatgcaacgcaaacatggcgggatgctcgttcggaaccctctgtctcgaaacagcacacacgagatgtactgggtgtcctgcggcaccgggaacatcgtcagcgctgtgaacatgacctcccgcatgctgctcaaccgatttaccatggcgcaccgcaagcccacttacgaacgggatgtggacttgggcgcgggtacccggcatgttgccgtagaaccagaggtagccaacctagacattatcggacagcggattgagaacatcaagaacgagcacaaatccacgtggcactacgatgaggacaacccctacaagacctgggcctaccacgggtcctacgaggtcaaacctagtggttcagcgagctccatggttaacggcgtggtccgcctcctgaccaagccttgggacgtgataccgatggtcacgcagatagccatgacggacactaccccgttcggtcagcagagggtgttcaaggagaaagtggacactaggactccccgggctaagagaggcaccacgcagattatggaggtgaccgccaagtggctatggggcttcctcagcaggaacaagaaaccccgcatttgcacgcgagaggagttcaccagaaaggtgcggagcaatgccgccattggggccgtattcgtggatgagaaccagtggaacagtgccaaagaggccgtggaggacgagcgcttctgggatttagtgcaccgggagcgcgagctccacaagcagggcaagtgcgctacctgcgtatataacatgatggggaagcgggagaaaaagttaggggagttcggcaaggccaagggcagccgtgccatatggtacatgtggctgggcgcacgtttcctggagttcgaggccctcgggttcatgaacgaggaccactggttctccagagagaatagtttgtcgggcgtggaaggggaaggactacataagctcgggtacatcttacgcgacattagcaagatcccgggaggcaacatgtacgcggatgacaccgccggatgggacacaaggatcaccgaggacgacctgcagaacgaggccaagatcacggagatcatggagcccgagcacgcccttcttgcgaccagtatcttcaagctgacgtatcagaacaaggtagtacgcgtgcagcgccccgcgaagaatggaaccgtgatggacgtcatctctcggcgcgaccagcgtggatccggccaggtgggcacatacggactcaataccttcactaacatggaagtccagttgattcggcagatggagagcgaggggatcttcctgccctcagagctcgaaactccgaacctggccgagcgcgtcctagactggctcgagaaacacggggcggagcggctcaagcgcatggccatcagcggcgacgactgtgtggtgaagcccatcgatgaccggttcgcgaccgcgttgaccgcactcaacgacatggggaaggtacgcaaggacatcccccagtgggagccctccaaaggctggaacgactggcagcaggtcccgttttgcagccaccatttccaccagctgatcatgaaggacggccgggagatcgtcgtcccttgccgcaatcaggacgaactggtaggtcgggcccgcgtgagccaaggagccggttggagcctccgggagaccgcttgcttaggcaagtcctacgcgcaaatgtggcagctgatgtacttccatcgccgggacctccgtctggccgccaacgccatatgtagcgcagtccccgtagactgggtgcccactagcaggactacctggtccattcacgcccaccaccagtggatgacgacggaggacatgctgagcgtctggaaccgcgtctggatagaggagaatccgtggatggaggataagacccacgtgagtagctgggaggaggtcccctacctcggaaagagagaggaccagtggtgcggctccctgatcggcctgacggcccgggccacatgggccacgaacatccaggtggctatcaaccaggtgcggcggctgatcggaaatgagaattacctggactacatgaccagcatgaaacgcttcaaaaacgagtccgaccccgaaggtgccctttggtga

SEQ ID NO: 23895 - RNA, 9879 nt, synthetic construct
  misc_feature 1..9879: note = derived and/or modified CDS sequence (opt11) from DENV-1__GU131981__SS-prME
  source 1..9879: mol_type = other RNA
agcgtgactatgcttcttatgctgctaccaaccgccctcgccttccacctgacgacccggggtggggagccccatatgatcgtttcaaagcaggagcggggcaagagcctactattcaagaccagcgctggggttaacatgtgcaccttaattgccatggatcttggggagctctgcgaggacaccatgacctacaagtgcccccagattaccgaggccgagcccgacgacgtggactgctggtgtaacgccaccgatacgtgggtcacctacggtacctgctcacaaaccggcgaacaccgccgggacaagcgctccgtggccctggcgccccacgtgggccttgggctcgagacccggaccgagacctggatgagctccgaaggcgcctggaagcagatccagcgcgtcgagacctgggccctgcgtcaccccgggttcaccgtcatcgcgctgtttttagcgcacgccatcggcaccagcatcacccagaagggtatcatctttatcctgctcatgctcgtgaccccctccatggccatgaggtgcgtcggcatcggcaaccgggacttcgtggaggggctgtctggcgccacgtgggtggacgtggtgctggagcacgggtcgtgcgtgaccaccatggccaaaaacaaacccaccctcgacatcgaactgctaaagacggaggtcaccaatccggccatcctccgcaagctgtgtatcgaagctaagatcagcaacaccaccacggactcccggtgcccgacccaaggggaggcgaccttggtggaggagcaggacgccaacttcgtctgtcgcaggacattcgtcgaccgcggctgggggaatgggtgtggcctctttggcaaagggagtctgctgacttgcgctaaattcaaatgcgtcaccaagttggagggcaagatcgtgcaatacgagaatctgaagtactccgtcatagtgaccgtgcacaccggcgaccagcaccaagtcgggaacgagacaaccgagcacggcaccatcgcgactatcacgcctcaggcccctacgagcgaaatacagctaacggactacggggccctcacattggactgcagcccccggaccgggctggacttcaacgagatggtgctgctaacgatgaaggagaagtcctggttggtgcacaagcagtggttcctcgacctgccgctgccctggacctccggggcctctaccagccaggagacctggaaccgccaggacctcctggtgacgttcaagacagctcacgccaagaagcaagaggtggtagtgttgggctcgcaggagggagccatgcacaccgccttaaccggggccactgagatccagacctcaggcaccactacgattttcgccgggcacctcaagtgccgcctgaagatggacaagctcaccttaaaaggcacctcctacgtgatgtgtacggggagcttcaaactggagaaggaggtagcggagacgcagcacggaaccgtgcttgtacaggttaaatacgagggcacagacgctccctgcaagatccccttctccacgcaggacgagaagggggtcacgcagaacggccgcttaattacggccaacccgattgtgaccgataaggagaagcccgtcaacatcgagaccgagccgcccttcggggaaagttacatcatggtgggcgccggcgaaaaggcgctgaagctgagctggttcaagaaggggagctccatcggaaagatgttcgaggccacggcgcgcggggctcgtcggatggctatcctcggcgacaccgcgtgggatttcgggagcatcggtggcgtgttcacctccgtcgggaagctagtgcaccaggtattcggcacagcgtacggggtgttattcagcggcgtatcgtggacaatgaagatcgggatcggaatcctcctgacctggctgggtcttaacagccgctccaccagcctgtccatgacgtgcatcgccgtggggatggtcacgttatatttaggcgtgatggtgcaagccgacagcgggtgcgtgatcaactggaaaggccgcgagctgaaatgcgggtcaggaatatttgttaccaacgaagtgcacacctggaccgagcaatacaagttccaagccgacagccccaaacggttgagcgcggcgattggcaaggcctgggaagagggcgtttgcggcataaggtccgccactcggctcgagaacatcatgtggaagcagatcagcaacgagctgaaccacatactcttagagaacgatatgaagttcacagtggtagtgggtgacgccaacggcatcctggcccagggaaagaagatgatccgcccccagccgatggagcacaagtactcctggaagtcctggggcaaggcaaagatcatcggcgccgacattcaaaacaccaccttcattatagacgggcccgacaccccggagtgtcccgacaaccagcgtgcctggaacatctgggaagttgaggactacggctttgggatcttcacgaccaacatctggctgaaattgcgcgattcctacacccagatgtgcgaccaccggctgatgtcagcggctatcaaagactccaaggcagtgcacgccgacatgggatactggatcgagagtgagaagaacgagacctggaagctcgctcgcgcgtccttcatcgaggtcaagacgtgcacctggcctaaaagccacaccctctggtccaacggtgtgctggaaagcgagatgataatacccaagatctacggcggaccgatctcccagcacaactaccgccccgggtatttcacccagacggccggcccctggcacttggggaagctcgagctggatttcgatctttgcgagggcaccaccgtggtcgtggacgagcactgtggcaatcgcgggccgagccttcggaccacgaccgttacaggcaaaatcatccacgaatggtgctgccgctcctgcacgctgccgccgctgcggttccgcggcgaggatggctgctggtatgggatggagatccggcccgtcaaggagaaggaggagaacctcgtacgcagcatggtgtccgctggcagcggagaggtcgacagcttcagcctagggatcctctgcgccagcatcatgattgaggaggtgatgcgcagtcggtggtcaagaaagatgctcatgacgggcacgctggccgtgttcctgctcctagtcatggggcagctgacctggaacgacctcatccgcctgtgcatcatggtgggcgcaaacgcctccgaccgaatggggatgggcaccacgtacctggcccttatggccacctttaagatgcggccaatgtttgccgtgggactgctgttccgccggctcacaagccgcgaagtcctgctgctcactatagggctgtccctggtcgcgagcgtggagttgcccaactcgttagaagaacttggcgacgggttagccatgggtatcatgatgctgaagctgctgacggagttccagccccaccagctttggatcaccttactcagcctgacattcataaaaacgactctgtccctcgactacgcctggaagaccaccgccatggctctgagcatcgtgtctctattccccctctgcctgtccacaacgagtcagaagaccacgtggctcccggtcttgctgggcagcttcggctgcaagcccttgaccatgttcctcatcaccgagaataagatctggggccggaagtcttggcccttaaacgaggggataatggccatcggcatcgtctcgatcctgctctctagtctgcttaagaatgacgtgcccctcgccggtccgctgatcgccggcggcatgctgattgcgtgctacgtgataagcggctccagcgcggacttaagtctggagaaggcagccgaggtaagttgggagcaggaggccgagcattccggaacgagccacaacatactggtggaggtacaagacgacgggaccatgaagataaaggacgaggagcgcgatgacaccctaaccatcctgttgaaggccacgctcctggcggtctccggcgtgtaccccatgagcataccggcaactctattcgtgtggtacttctggcagaagaaaaagcagcggtccggtgtcctctgggacaccccaagcccgcccgaggtcgagagggccgtgctggatgacggcatataccggattttacagcggggactgctcgggcgttcccaggtcggcgtgggggttttccaggatggcgtattccacaccatgtggcacgttacgcgcggggcggtactaatgtaccagggcaagcggctggagccctcctgggcctcggtcaagaaagacctcatcagctacggcgggggctggcgcttccaggggtcctggaatactggcgaggaagtccaggtgatcgctgtggagcccgggaagaacccgaagaacgtgcagaccatgcccggcaccttcaagacgcccgagggggaggtgggagcgatagctttggactttaagcccggaaccagcgggtccccgatcgtcaaccgggaaggcaagatcgtaggcctgtatgggaacggagtggtgaccactagcggcacatacgtgtccgccatcgcccaggcaaaggcaagccaagagggtcccctaccggaaatagaagacgaggtgttcaagaagaggaacctgaccataatggatctgcacccgggctctggcaagacccggcgttatctgccagccatggtccgagaggcaatcaagcgaaaactgcgcaccctcattctagcccccacacgcgtggtggccagcgaaatggccgaagccctgaagggcatgcccatccgctaccagaccacggcggtaaagagcgagcacactgggagagagattgtggatctgatgtgccacgcgaccttcacaatgcgcctgttaagcccggtgcgggtccccaactacaacatgattatcatggatgaggcccacttcacagacccggccagcatcgccgcgcgcgggtacatctcgacccgtgtcgggatgggcgaggcggccgccattttcatgacagccacgccgcccggttctgttgaggcgttcccacagtccaatgcggtcatccaggacgaagaacgcgacatccccgagcggagttggaactctggctatgattggatcaccgacttccccggtaagaccgtgtggttcgtgccctctatcaagtccgggaacgacatagccaactgtctgcgcaaaaacggcaagcgagtcattcagctcagtcgtaagacgttcgacaccgagtaccagaagactaagaacaatgattgggactacgttgtgacaacggacatctccgagatgggtgccaacttcagagcagatcgcgttattgacccccgccgctgcctgaagcccgtcatcctgaaagacggccccgagcgggtgatcctcgcgggcccaatgccggtcactgttgcctctgccgctcagcgccgtggccgcatcggacgtaaccaaaacaaggagggagaccagtatgtgtacatgggccagccgctgaacaacgacgaggaccacgcacactggaccgaggcgaagatgctgctcgacaacatcaacacacccgaagggataatcccggccctgttcgagcctgagcgcgagaagagtgccgccattgacggcgagtaccgcttaagaggggaggcccggaagacgttcgttgagttgatgcggcgcggcgacttgcccgtatggctcagctacaaggtagcgagtgagggcttccagtactcagaccggagatggtgcttcgacggggagcggaacaaccaggtgctcgaagagaatatggacgtggagatctggaccaaggagggcgaacgcaagaaacttcgcccccgttggctggacgcccgaacctactcggacccgctcgcacttcgggagttcaaggagttcgccgccggacggcgcagtgtctctggagatcttatcctcgagattggcaaacttccccagcacctgaccctccgggcgcagaacgcgctggacaacctagtcatgctgcacaactccgagcagggcgggaaggcctaccggcacgccatggaggagctgcccgacactatcgagacgctcatgctgctcgcgctgatcgccgtacttactggaggggtcacactattcttcctgagcggcaaaggcctgggcaagacctcaatcggactgctgtgtgtgacggcatcgtcggcactcttgtggatggcatcagtggagccccactggattgcggcctccattatactggagttctttctcatggttctgctgatcccggagcccgaccggcaacgtacgccccaggataaccaactggcctatgtggtgataggtctattattcatgatcctcacggttgccgccaacgaaatggggctgctggagactacgaagaaagacctcggcatcgggcatgtggcggccgaaaatcatcagcatgccaccatgcttgacgtggacctgcggcctgccagcgcctggacattatacgcggtagcgaccaccgtgatcacccccatgatgcgccacacgattgagaacaccacggccaacatctccctgaccgccatcgccaaccaggccgccatccttatggggttggataagggctggcccatctccaagatggacattggggtgcccttgctggccctcggctgctactcgcaggtcaaccctctgacccttaccgccgcggtgctcatgctggtggcccattatgccatcatcgggccaggcctgcaggccaaggccacgcgggaggcgcagaagcgcaccgccgctgggataatgaagaaccccaccgtcgacggcatcgtggccatcgacctcgatccagttgtctacgatgccaagtttgaaaagcagcttggtcagattatgctactcatcctgtgcacgagccagatcttactcatgcgcacgacctgggcgctgtgcgagtcaattaccctggccaccggaccgttgacgaccctgtgggagggatcaccagggaagttctggaacaccaccatcgcggtatccatggctaatatctttcgtggcagctacctagccggcgccgggttagcattcagtcttatgaagtccctgggcgggggtcgccggggaaccggggcccagggggagaccctcggggagaagtggaaacgacaactgaaccaattaagtaagagcgagttcaacacctacaagcggagcggcatcatggaggtggacagatcagaggctaaggaggggctcaagcggggcgagaccacgaagcatgcggtcagccgcgggaccgccaagctgcggtggttcgtcgaacgcaacctggtcaagccggagggcaaggtcatcgacctcgggtgcggtcgaggcggttggtcctactactgcgcgggcctcaagaaggtgaccgaggtgaagggatacacgaagggcggcccagggcacgaggagccgatccccatggcgacgtacggatggaacctggtcaagctgcacagcgggaaggacgtgttcttcatgccgcccgagaagtgcgacactctcctgtgcgacatcggcgagagcagcccgaaccccaccatcgaagaggggcgcaccttacgggtgctgaagatggtagagccctggctgcgaggcaatcaattctgcatcaagatcctgaacccctacatgccgtctgttgtagagaccctcgaacagatgcagcggaagcacggcgggatgctggtccgcaaccccctgagccgtaactccactcacgagatgtactgggtgagctgcggcaccgggaacatcgtgtccgcagtcaatatgacctctcgcatgttgctgaatcgcttcaccatggcgcaccgaaagcccacgtacgagcgcgacgtggacctcggcgctgggactaggcacgttgccgtcgagcccgaggtggccaatctcgacatcatcggtcagcgcatcgagaatattaagaacgagcacaagtccacctggcactacgacgaggacaacccgtacaagacctgggcctatcacggcagctacgaggtgaagccgtccgggtcagcgtccagcatggtgaatggcgttgtgcggttgctgaccaagccctgggatgtcatccccatggtgacccagatagccatgaccgacaccacgccgttcgggcagcaacgcgtcttcaaagaaaaggtggacacccggacaccccgggcaaagaggggcacaacgcagatcatggaggtgacagcaaaatggctgtggggcttcctgtccaggaataagaagccccggatttgcacgcgagaggagtttacacggaaagtccgcagcaacgcggcgatcggggctgtgttcgtggacgagaaccaatggaacagcgcaaaggaagccgttgaagatgagcggttctgggatctggtgcacagagagcgggagttacacaagcagggcaagtgcgccacttgcgtgtacaacatgatggggaagcgcgagaaaaagctgggagagttcggcaaggccaagggctcccgggccatctggtacatgtggttaggcgcccgcttcttagagttcgaggccctgggatttatgaacgaggaccactggttcagccgggagaactccctgtctggcgtcgaaggggagggcctccacaagctgggatatatcctgagagacatctccaaaatcccgggcggcaacatgtacgcggacgacacagccgggtgggatacacggatcaccgaggacgacctgcagaacgaggccaagattacggagatcatggaacccgagcatgcccttctggcaaccagcatctttaagctcacctatcagaacaaagtggtgcgcgtccagcgacccgcgaagaacggaaccgttatggacgtgatctcacggcgagaccagcgagggagcggccaggtcggtacctacggtctgaacaccttcacaaacatggaggtgcagctgatccgccagatggaatccgagggtatctttcttcccagcgagctggagaccccgaacttagctgagagagtgctcgattggcttgagaagcacggggccgagcgcctgaaacgtatggccatcagcggcgatgactgcgtcgtgaagcccatcgacgacagattcgccacggcgctcaccgccctgaacgacatgggcaaggtgagaaaggacatcccccagtgggagcctagcaaaggctggaatgattggcagcaggtcccgttctgctcccatcacttccaccagctgatcatgaaagacggccgagagatcgtggtgccctgtcggaaccaagacgagctggtagggagagctcgcgtcagccagggggccgggtggtccctgagagagaccgcatgcctgggcaaatcctacgcgcaaatgtggcagctcatgtacttccaccggcgcgacctgaggctggccgccaatgccatctgctccgctgtgcccgtcgactgggtgcccaccagccgtaccacgtggagcattcacgcccaccaccagtggatgactactgaggatatgctctcagtgtggaaccgggtctggatcgaggagaacccgtggatggaggataagacccacgtgagctcttgggaagaagtgccatacctggggaagagagaggaccagtggtgcggcagcctcatcggattaacggcccgggccacctgggccaccaacatacaggtcgcgattaatcaagtgcggcgcctgatcgggaacgagaactaccttgactacatgaccagtatgaagcggttcaagaacgagagcgacccagagggcgccctctggtag

SEQ ID NO: 23896 - RNA, 9879 nt, synthetic construct
  misc_feature 1..9879: note = derived and/or modified CDS sequence (opt11) from DENV-1__GQ868529__SS-prME
  source 1..9879: mol_type = other RNA
tctgtgacgatgcttctcatgctactgcccaccgccctcgccttccacctgacgacccggggcggagaaccccacatgatcgtgagcaagcaggaacggggcaagagcctcttgttcaagacctcagcgggcgtgaacatgtgcaccctgattgcaatggacctgggcgagttgtgcgaggacaccatgacctacaagtgcccccaaataacggaagccgagccagacgacgtcgactgctggtgcaatgcgactgacacttgggtgacctacgggacgtgtagccagactggcgaacaccggagagacaaacggtccgtggccctggcgccacatgtgggactggggctcgagacgcgcacagagacctggatgagctccgaaggagcctggaagcagatccagcgcgtcgagacttgggccctgaggcaccccgggtttacagtgatcgccttcttcctggcgcacgcgattggcaccagcatcacccagaaggggatcatattcatcctcctcatgctggtgaccccctccatggctatgcgctgcgtcggaatcggcaacagggattttgtcgaggggctcagcggcgcgacgtgggtagatgtcgtgctagaacacgggtcctgtgtgaccaccatggcgaagaacaagcccaccctggacatcgagctgctgaaaacggaggtcaccaaccccgccatcctacgcaagctttgcatcgaggcaaaaatcagcaataccaccacggacagccggtgcccgacccagggcgaggccaccctggtggaggagcaggacgccaatttcgtgtgtcgcagaacctttgtcgacagaggctgggggaacggctgcgggctgtttggtaaggggagcctcctgacgtgcgccaagttcaagtgcgtgacaaagctggagggcaagaccgtgcagtacgaaaaccttaagtactccgtcatcgtgaccgtgcacacgggcgaccagcaccaggtcgggaacgagaccaccgagcacggtaccatcgcgaccatcaccccccaggcccctaccagcgagatccagttaaccgactacggggccttgaccctcgactgtagcccgcggactggcctggacttcaacgagatggtactgctcactatgaaggagaagtcctggctggtccacaagcagtggttcctggatctccctctgccctggacctcgggggcctcgaccagccaggagacatggaaccgccaggatttgctcgtgaccttcaagaccgcccacgcgaaaaagcaggaggtggtggttctgggctcgcaggagggagccatgcacaccgccctgacgggggccaccgaaatccaaaccagcggcactactacaatctttgccgggcacctcaaatgccggctgaagatggacaagctgacccttaagggcacctcctacgtgatgtgcaccgggtcattcaagctggagaaagaggtcgcggagacccagcacggcaccgtgctggttcaggttaagtacgagggaactgacgccccatgtaagatccccttctcaacgcaagacgagaagggggtgacccagaacggccgcctgattaccgccaatcctattgttaccgacaaggaaaagcccgtgaacatcgagacggaaccgcccttcggggagagctacatcgtggtcggcgccggcgagaaggcgctcaagctgtcctggttcaagaagggcagctcaatcggcaagatgttcgaggccaccgctcgcggggcacgtcggatggcgatcctgggcgacaccgcgtgggacttcgggtctatcggcggcgtcttcacctccgtggggaagctcgtgcaccaggtctttggcactgcgtacggggtgctgttcagcggcgtatcctggaccatgaagatcgggatcggcatcctgctcacgtggctaggcctgaactcacgctccacgagcctcagtatgacgtgcatcgctgtcgggatggtgaccctctacctgggcgtgatggtacaagccgacagcgggtgcgtgataaactggaagggccgcgagctcaagtgcgggtccggcatattcgtgaccaacgaggtccacacctggaccgagcaatacaagtttcaggccgacagcccgaagcggctgagcgcagccatcggcaaggcctgggaggagggggtgtgcgggatccgctccgccacgcggctggagaacatcatgtggaagcagatcagcaacgaactcaaccacatcctattggagaacgacatgaagttcacggtggtcgtgggggatgccaacggcatcctcgcgcaggggaagaagatgatccgcccacagcccatggagcacaagtactcatggaaatcatggggcaaggccaagatcatcggagccgacatccagaacacaacctttatcattgacgggcccgacacgccggaatgccccgacaaccagcgggcatggaacatctgggaggtggaggactacggctttgggatcttcaccaccaacatctggctgaagctgcgcgactcatacacccagatgtgcgaccaccggcttatgtcggcagctatcaaggacagtaaggcagtgcacgccgacatgggctattggatcgagagcgagaagaacgagacgtggaagctggcaagggcttccttcatcgaggtgaagacctgcacgtggccgaagagccatacgctgtggtccaatggcgtgctcgagagcgaaatgatcatccccaagatatacgggggcccgatctcacagcacaactaccggcccgggtacttcacgcagatcgccggcccctggcacctagggaagctggaactcgattttgacttatgtgagggtaccaccgtcgtggtggacgagcattgcggcaaccgcgggccaagcctgcggaccaccaccgtcaccggcaagatcatccacgagtggtgctgccgctcctgcaccctcccgcccttgcggtttcgcggggaggatggctgctggtacgggatggagatccggcccgtgaaggagaaggaggagaacttggtacgcagcatggtctccgccggctcgggagaggtagacagcttttccctggggatcctgtgcgccagcatcatgatagaggaagtcatgcgatcccgctggagccggaaaatgctgatgacgggcacgctggccgtcttcctgctgctcgtgatggggcagctgacctggaacgacctgattcgcctctgcatcatggtgggggcgaatgcctcggaccgtatggggatgggcaccacgtacttagccctgatggccaccttcaagatgcggccgatgtttgcggtaggccttttattccggcggctgaccagccgcgaggtgctccttctgaccatcgggctctccctggtggcgtccgtcgagctccccaactccctcgaggagcttggcgacggcctggcgatggggattatgatgctaaagctgctgacggagttccagcctcaccagttgtggaccacccttctgagcttaacctttatcaagacgacgctgtccctggactatgcctggaagaccaccgccatggcacttagcatcgtttccctgttcccgctgtgtctcagcacgacctcccagaagaccacctggctcccggtccttctcggcagcttcgggtgcaaaccccttaccatgttccttatcactgagaacaagatctggggcagaaagagttggcccctcaatgaagggatcatggccatcgggattgttagcatcctcctgtccagcctcctgaagaacgacgtgccactggccgggccgctcatcgcgggcggcatgctgatcgcttgttacgtcattagcgggtccagcgcggacctgtccctcgagaaggccgccgaggtgtcgtgggagcaggaggcagagcattcaggcaccagccacaacatcctggtggaagtgcaagacgatgggactatgaagattaaggacgaagagagagacgacaccctgacgatcctactgaaggccaccctgttggcggtgtccggcgtgtacccgatgtctatccccgccaccctgttcgtctggtacttctggcagaagaagaagcagcggtccggggtgctgtgggacactccgagcccgcctgaagtagagcgcgccgtcctcgacgacggaatctaccggatcctgcagcgcggcctgctggggcgctcacaggtgggcgtcggggtcttccaggacggcgtgttccacactatgtggcacgtgaccaggggggccgtcctcatgtaccaggggaagcggctggagcccagctgggccagcgtgaagaaggacctgatctcctacggagggggctggcgcttccaggggagttggaacaccggcgaggaggtgcaggtcatcgcggtggagcccggtaaaaaccctaagaacgtgcagaccacgcccggcaccttcaagacacccgaaggcgaggtcggggccatcgccctcgactttaagcccggtaccagcgggtccccgatcgtgaaccgggagggcaagatcgtcgggctgtatgggaacggcgtcgtgacgacctcgggcacgtacgtgtccgcgatcgcccaggcgaaagccagccaggagggccccctaccggagatcgaggatgaagtcttcaaaaagcgcaacctgaccatcatggacctgcacccggggagcggcaagacgcggcgctatctgcctgccatggtgcgggaggcaatcaagcgcaagttgcggaccctgatcctcgcgccaacccgcgtcgtcgcctccgagatggccgaggcactcaagggcatgcccatacggtaccagaccacggccgtgaagagcgagcacaccggacgggaaatcgtggacttgatgtgccacgcgacgttcacaatgcgcctgctctccccggtccgagtgcccaactacaatatgattatcatggatgaggcccacttcacggaccccgccagcatcgccgcccgcggctacatctccacccgggtgggaatgggcgaagctgccgccatcttcatgaccgccactccgcccgggagcgtcgaggccttcccccagtccaacgcggtgatccaagacgaggagagggatatcccggagcggagctggaactccggctacgactggatcacggactttccgggcaagaccgtgtggttcgtacccagtatcaagtctgggaacgacatcgcgaactgcctgaggaagaacggcaaacgggtgatccaactgagccgcaagaccttcgacaccgagtaccagaaaacgaagaacaacgactgggactacgttgtcaccacggacatttccgagatgggggccaacttccgggccgaccgcgttatcgacccccggcgctgcctcaagcccgtaattctgaaggacggccccgagcgggtgatccttgcggggccgatgccagtgaccgtggcaagcgcggcccagcgccggggccgcatcggacggaaccagaacaaggagggagaccagtacgtctacatgggacagcctctcaataacgacgaggaccacgcccactggacggaggccaagatgctgctggacaacatcaatacacctgaggggataatcccggccctattcgagcctgaacgcgagaagtccgccgccatcgacggcgagtacagactgcgcggagaagctcgcaagacctttgtggagctgatgcggcgcggcgacctccccgtttggctgagctacaaggtggcgtccgagggcttccagtacagcgaccggcggtggtgcttcgacggggagcggaacaatcaggtcctggaggaaaacatggacgtcgaaatctggactaaggagggcgagcgcaagaagcttcggccccgctggctagacgcccgtacatactccgacccactggccctccgcgagtttaaggaattcgccgccgggcggagaagcgtgtccggtgacctgatgctggagatcggcaagctcccccagcatctgacactgcgcgcgcagaacgccctcgacaacctggtgatgcttcacaactcggagcagggcgggaaggcttaccgccacgcaatggaggagctccccgacactatcgagaccctgatgctactcgcgctgatcgccgtcctaaccgggggtgtgaccttgttcttcctgagcggcaagggcctgggcaaaacctccatcggtctcctatgcgtgacagccagctccgccctgttgtggatggcctcagtcgagccccactggatcgcggcctcaatcatcctggaattcttcctgatggtgttactgatcccggagcccgaccggcagcgcacgccccaggacaaccagctggcctatgtggtcatcggcctcctgttcatgatcctcacggtagccgccaacgagatggggctcctggagaccaccaagaaggacctgggcatcgggcacgtggcggccgagaaccaccagcacgcgaccatgctcgacgtcgacctgcggccagccagcgcttggactctctacgcggtggctaccacggtgatcacccccatgatgcgccacacgatcgagaacaccaccgctaacataagtttaacagctatcgccaaccaggcggccatcctgatgggcctggacaaaggctggcccatcagcaaaatggacatcggggtccccctcttagccctgggctgctactcccaggtgaatccgttgacccttaccgccgcggtgctgatgctcgtcgcccactacgccatcatcggacccggtctgcaggctaaggccacacgggaggcacaaaagcgcaccgccgccggcatcatgaagaaccccaccgtggacggcatcgtggccatcgacctggacccagttgtgtacgacgcaaagtttgagaagcaactcggccagatcatgttgctgatcttatgcaccagccagatcttattaatgcgcactacctgggcgttatgcgagagcatcacgctggccactggccctctgactaccctctgggagggctcccccggaaagttctggaatacgacaattgccgtgtccatggccaacatctttcggggcagctacctggccggggcgggactggccttctccctcatgaagtccctgggcgggggccgccgtggaaccggtgctcagggcgagacccttggggaaaagtggaagcgccagttaaaccagctgtccaaaagcgaattcaacacgtataagcggagcggcatcatggaggtcgaccgctccgaggctaaggaggggctgaagcggggcgagactacgaagcacgcggttagccgcgggaccgcaaagctacgctggttcgtagagcgcaacttggtcaagcccgagggcaaagtgatcgacctgggttgcggtcggggagggtggtcctactactgtgctggcctgaagaaggtaactgaggtcaagggatatactaagggcggcctaggtcacgaggaccccatcccaatggccacgtacggctggaacctagtgaagctgctcgccgggaaggacgtgtttttcatgccgcccgagaagtgcgataccctgttgtgtgacatcggcgaaagctccccgaaccccaccatcgaggaaggacgaacgttacgggtgctgaagatggtggagccctggctgcgcggcaaccagttctgtatcaagatcctcaacccgtacatgcctagcgtggtggagaccctggagcagatgcagcggaagcacggcgggatgctggtgcgcaaccctctctcccgaaattccacccacgagatgtactgggtgtcctgcggcacggggaatatcgtaagcgcggtgaatatgacgtcccgcatgctgctgaaccggttcacgatggcccaccgcaagcccacctacgaacgtgacgtcgacctcggcgccggcacccggcacgtcgcagtcgagcccgaggtggccaacctggacataatcgggcaacgcatcgaaaacatcaaaaacgagcacaagagcacatggcattacgacgaagacaacccctacaagacatgggcgtaccacggctcctacgaggtgaaaccgagcgggagcgcctcgtccatggtcaacggtgtggtccggctgctcaccaagccctgggacgtgatccccatggtcacccagatcgccatgacggacaccaccccctttgggcagcaacgcgtgttcaaggagaaggtggacacccggacgccacgcgccaagcggggcaccacccagatcatggaggtcaccgccaaatggctgtggggcttcttgagccgtaacaaaaaaccccggatctgcactcgcgaagagttcacccgtaaagtgcgctcaaacgcggccatcggggctgtgttcgtcgatgagaaccaatggaacagcgcgaaggaggcggtagaagatgaacggttctgggacttagtgcatcgcgagagggagctgcacaagcaaggcaagtgcgcgacctgcgtatataacatgatgggaaaacgcgagaagaaactgggggagttcggaaaggccaagggtagccgggccatctggtatatgtggctcggcgcccgcttcctggagttcgaagcgctggggttcatgaacgaggaccactggttctcacgggagaactccctctccggcgtggagggggagggcctgcacaagctcgggtacatccttcgagacatctccaagatccccggcggaaatatgtacgccgacgacactgccgggtgggacacgcgtatcacggaagacgatttgcaaaatgaggccaagatcacggagatcatggagccggagcatgcgctgctcgcgacgtcgatcttcaagctgacgtatcagaacaaagtggtcagggtccagcgacccgccaagaacggcaccgtgatggacgtcattagccggcgcgaccagcgcgggtccggccaagtgggaacctacgggctgaacacgttcacgaacatggaagtgcagctcatccgccagatggagagcgagggcatcttcctgcccagcgagctggagacccccaacctcgcggagcgggtccttgactggctggagaagcacggggccgagcgactcaagcggatggcgatcagcggcgacgactgcgtggtaaaaccgatcgacgatcgcttcgcgacagccttaacggcccttaacgacatgggtaaagtccggaaggatatcccccagtgggagccctccaaaggctggaacgactggcagcaggtccccttctgcagccaccacttccaccagctcatcatgaaggacggccgcgagatcgtggtcccgtgccggaaccaggatgagctggtggggcgtgcccgggtgtctcagggcgccgggtggagcctgcgcgagacggcgtgcttaggcaagtcctacgcacagatgtggcagctgatgtacttccaccggcgcgacctgcggctcgccgccaacgcgatctgctcggctgtccccgtggactgggtccccacgagccgtaccacctggtcgatccacgctcaccaccagtggatgaccacggaagatatgctgagcgtctggaaccgggtgtggatcgaggagaatccatggatggaagacaagacccacgtgtccagctgggaggaagtaccgtacctgggtaaacgcgaggaccagtggtgcggcagtcttatcggcctaaccgcacgcgccacctgggcgacgaacatccaggtggccatcaaccaggtgaggcgcctgatcgggaacgagaactacctcgactacatgacgagcatgaaacggttcaagaacgagtccgaccccgagggcgccctttggtga

SEQ ID NO: 23897 - RNA, 9879 nt, synthetic construct
  misc_feature 1..9879: note = derived and/or modified CDS sequence (opt11) from DENV-1__GQ868531__SS-prME
  source 1..9879: mol_type = other RNA
agtgttacaatgctgctaatgctgctgcccactgctttggccttccatttgaccacccggggcggagagccccacatgatagtgagcaaacaggagcggggcaagagccttttattcaagacctctgctggcgtgaacatgtgtacactgatcgccatggatctaggagagctttgtgaagacaccatgacatacaaatgcccccaaatcactgaggcagagcctgacgacgtggactgctggtgcaatgcaacagatacctgggtgacctacgggacctgcagccagaccggagaacatcgccgggacaaacgcagtgtggcgcttgcgccccacgttggcttggggctcgagaccagaaccgagacctggatgagctccgagggcgcttggaagcagatacagcgcgttgaaacctgggcccttcgtcaccccggattcaccgtgattgccctgttcttagcgcacgcgataggcacctcaatcacccagaaggggataatcttcatcctgctgatgctagtgactcccagcatggccatgaggtgcgtcggcatcggaaaccgggacttcgtggaggggctcagcggcgcgacgtgggtggatgtcgtgctggagcacggttcctgcgtgaccaccatggccaaaaacaagcccacgctcgacatcgagctgctgaagacggaggtcacgaacccagcgatcctcagaaagctttgtatcgaggctaagatctccaacacaacgacggactcccggtgcccaacccaaggcgaagcgactctcgtagaagaacaggacgccaacttcgtgtgcaggaggaccttcgtcgacagaggatgggggaacggctgcggccttttcggcaagggcagcctactgacatgcgccaagttcaagtgcgtgaccaagcttgaaggcaagatcgtgcagtacgaaaacctaaagtattccgtcattgtgaccgtacacaccggcgatcagcatcaggtcgggaatgaaacaacagaacacggcaccattgccaccatcacgccccaggcccccacgagcgagatacagctgactgattacggggcactcaccctagactgcagcccccggaccgggctggacttcaacgaaatggtgctcctgacgatgaaggagaaatcctggctggtccacaaacagtggttccttgacctgccgctgccatggaccagcggggcgagtacgagccaagagacatggaacagacaggacctcctggttaccttcaagaccgcacacgccaagaagcaagaggtcgtcgtcctgggcagtcaggaaggcgcaatgcacaccgccctcaccggcgcgacagagatacagaccagcggcactaccacgatcttcgcggggcacctaaagtgccgcctgaagatggacaaattaaccctgaagggcacgagctacgttatgtgcaccgggagcttcaagctggagaaggaggtcgcggagacgcagcacggcaccgtattggtgcaggtcaagtacgagggcaccgacgcaccctgcaaaattcccttctcaacgcaggatgaaaagggggtgacgcagaacggccgcctaatcaccgccaaccctatcgtgactgacaaggagaaaccggtcaacatcgagacagagccgcccttcggagaatcatacatcgtggttggcgctggcgagaaggcgctgaaactgtcctggttcaagaagggcagcagcatcggcaagatgttcgaggccactgcccgcggcgcccgtcggatggccatcctcggggacaccgcgtgggatttcgggagcataggcggcgtcttcacctccgtggggaagctggtgcaccaagtctttggcaccgcctacggagtgctgttcagcggcgtttcctggacgatgaagatcggaatagggatcttacttacttggctgggcctcaacagccgctccaccagcttatccatgacctgtatcgccgtcggcatggtgacgttgtaccttggggtgatggtccaggccgactctgggtgtgtgataaactggaagggccgcgagctgaagtgcggctccggcattttcgtcaccaacgaggtccacacctggaccgagcagtacaagtttcaagccgatagcccaaagcgactgagcgctgccatcgggaaggcctgggaggagggcgtctgcgggatacgttccgccacccggctcgagaatataatgtggaagcagattagcaacgagctcaaccatattctgctcgaaaacgacatgaaattcacggtggtcgtgggagacgccaacggcatcttagcccaaggtaagaagatgatccgcccccaaccaatggagcataaatactcctggaagtcgtggggcaaagccaagatcatcggcgccgatatccaaaacaccacttttattatcgacggcccagacaccccggaatgccccgataaccaacgggcttggaacatatgggaggtagaggactacggtttcgggatcttcacaaccaacatctggctgaagctacgcgacagttacacccagatgtgcgatcaccgactaatgagcgcggcgataaaagatagcaaagcagtccacgcagatatgggttattggatcgagtcagagaagaacgaaacgtggaagctggcccgcgcgtccttcatcgaggtgaagacgtgcacctggcccaaaagccacaccctatggtccaacggcgtccttgagagcgaaatgatcataccgaaaatctacggtggcccgataagtcaacataactaccggcccgggtacttcacccagactgccggcccatggcacctggggaagctcgagctggatttcgacctgtgcgagggcaccacggtcgtggtggacgagcactgcggcaaccgcgggccaagtctcaggaccacgaccgtaaccggtaagatcatccacgaatggtgctgccggagttgcaccctgccccccctgcgtttccggggcgaggacggctgctggtacgggatggaaattcggcccgtgaaggagaaggaagagaatctggttagatcaatggtctccgcaggttccggtgaggtcgacagtttctccctggggatcctgtgcgtatcgattatgatcgaggaagtaatgcggtcccgctggagccggaagatgttaatgacgggaaccctggccgtattcctgttactcgtgatggggcaattgacctggaacgatctcatccgcctttgcatcatggttggcgcaaatgcatcagaccggatggggatgggtaccacgtatttagccctcatggctacgttcaagatgcggccaatgtttgcggtggggctgctgtttcgccggttaaccagtcgcgaggtgttgctgctaaccataggtctgtccctggtcgcctctgtggagttacctaactccctggaggaacttggcgatgggctcgcgatgggcatcatgatgctgaagctgttgacggagtttcaaccccaccagctgtggacgaccttgctcagcttgacgttcatcaagactacgctgtccttagactacgcttggaagaccaccgctatggcgctgagcatcgtgtccctgttccctttgtgcctttccacgacctcacagaaaacgacctggctgccggtgctccttggcagcttcgggtgtaagcccctgacgatgttcctaatcacagaaaacaagatctggggccgcaagtcctggccgctcaacgaagggatcatggctatcggcattgtgagcatcttgttatccagcctcttgaagaacgatgtacctctcgccggaccgctgatcgccggcggaatgttgatcgcctgttacgtgatctcgggttcctctgcggacctcagcttggagaaggcggccgaggtgtcttgggagcaagaggccgaacactccggcaccagtcacaacatactggtagaggtgcaggacgacggtacgatgaagatcaaggacgaggaacgcgatgacaccttgacgatattactgaaggccaccttactcgctgtgtccggcgtctaccccatgtcgatccccgccaccctgttcgtctggtacttctggcagaagaagaagcaacggtccggagtgctctgggacacccccagcccacctgaggtcgagcgggccgtgctggacgacggcatctatcggatcctgcagaggggcctgctgggtcggtcccaggtgggcgtcggcgtgttccaggatggcgtgttccatactatgtggcatgtcacgcgaggagcagttctgatgtaccaaggcaagcgtttagagccatcctgggcttccgtgaagaaggacctcatcagctacggaggtggctggcgattccaagggtcttggaataccggagaggaggtccaggttatcgccgttgaacccggtaaaaatcctaagaacgtccagacgactcccggaacttttaagactccagagggcgaggtaggggcgattgcactcgacttcaaacccggcaccagcggcagccctattgtgaaccgggaaggcaagatcgttgggttatacgggaacggcgtcgtgacaacttccgggacctacgtctccgccattgcccaggctaaggcgtcgcaggagggacctttacccgagattgaagatgaggtgttcaagaagcgcaatttaaccatcatggacctgcatccgggcagcggcaagactcggcgctacctccccgcgatcgtgcgtgaagccattaaacgcaagctgcggaccctgatcctcgccccgacccgcgtcgtcgcatctgagatggctgaggcccttaaggggatgcccattcgctatcagaccaccgcggtcaagtcagagcacacggggcgggaaatagtcgaccttatgtgccacgcgactttcacaatgaggctgttgtcgccagtgcgggtgcccaactataacatgatcatcatggacgaggcgcacttcacggatcccgcgtcaatcgcagccaggggctatatctctactcgggtcggcatgggcgaggccgcggctatcttcatgacagccacgccgcccgggagcgtcgaagcctttccccaaagtaacgccgtgatccaggacgaggagagggatatcccggaacggagctggaactccggctacgactggatcactgacttccccggaaaaacggtctggttcgtgccaagcatcaagtctggaaatgacatcgcgaattgtttgcgcaaaaacggcaagcgggtgatccagctctcacgcaagaccttcgataccgagtaccaaaagacgaagaacaacgactgggactatgtcgtgaccaccgacatctcggagatgggggccaatttccgggccgacagagtaatcgacccccgtcggtgccttaagcccgtcatcctaaaagacgggcccgagcgggtgatactagccggcccgatgcccgtgaccgtcgcgtctgccgcccagcgccggggtcgcatcgggcgtaaccaaaacaaggagggagaccagtacgtgtacatgggtcagcccctaaacaacgacgaagaccacgcgcattggacggaggccaagatgctgctcgataacatcaacacccccgaagggattataccagccttattcgagccggagcgcgagaagtcggccgctatagacggcgagtaccgcctacgtggggaggcccgcaagaccttcgtagagctcatgcggcgcggcgacctaccagtgtggttaagctacaaagtagcctcagagggcttccagtacagcgaccgccgctggtgctttgatggtgagcggaacaaccaggtacttgaggagaacatggacgtggagatctggacgaaggaaggtgagcgcaagaaactcaggccccggtggctggacgcgaggacttattccgaccccctggccttacgcgagttcaaggaattcgctgccgggaggcgaagcgtttcaggcgacttaatcctcgagattggcaagctgccccagcatctgacattacgggcccagaacgcgctagataatctggtcatgctacacaacagcgagcagggtgggaaggcgtatcgtcacgccatggaagagctgcccgacacgatcgagaccttaatgttattagccctgattgcagtgctcacgggcggcgtgaccctgttcttcctcagcgggaagggactgggcaagacctccatcgggctgctgtgcgtcaccgcctcatcagccctcctctggatggccagcgtcgagccgcattggatcgctgcgagcatcatcctggagttcttcctcatggttctgctgatcccggaacccgacaggcagcgcacgccccaggacaatcaactcgcgtacgtcgtgatagggctgctgtttatgattctgactgtggccgcaaatgagatggggctactggagaccactaagaaggatcttggcatcgggcacgtcgccgccgagaaccaccagcatgccaccatgctggatgttgacctgcggcccgcgagcgcttggacgttatacgcagtggccactaccgttatcacccccatgatgcgccacacgattgagaataccaccgcgaacatctccctgaccgctattgccaaccaggccgcaatcctaatgggcctagacaaggggtggcccatctcaaagatggacattggggtgcctctgctagcgcttgggtgctatagccaggtgaatccacttaccctgaccgccgctgtcctcatgcttgtggcgcactatgccatcataggtcccggtctacaggcaaaggccacccgcgaggctcagaaacgcacagctgctggcattatgaaaaaccccacggtggatggtatcgtggctatcgacttagaccccgtggtctacgacgccaagtttgagaaacaactagggcagatcatgctgctcatcctgtgcactagccaaatcctgctcatgcgcactacctgggccctctgcgagtctatcactctggcgacagggccgctcacgaccctctgggagggcagccccgggaagttctggaacacgaccatcgccgtctccatggccaacatattccggggcagctaccttgcaggcgccggcctcgccttcagtctgatgaagtccctgggcgggggccgcagagggacgggggcccagggcgagacactcggggaaaagtggaagcgccagctgaaccaattgtccaagagcgagttcaacacgtataagaggagcggcataatggaggtggacagaagcgaggcgaaggaggggctcaaacggggcgagaccaccaagcatgcagtgagtcgaggcaccgcgaagctccggtggttcgtcgagcgaaacctggtgaagcccgagggcaaggtgatcgacttgggctgcgggcggggcgggtggtcttactactgcgctggcttgaaaaaagtcacagaggtcaagggttacacgaaaggcgggcccggccatgaggagccgatccctatggccacctacgggtggaacctagtgaaacttcacagcgggaaggacgtcttcttcatgccacctgaaaagtgtgacaccctcctctgtgacattggggagtcatctcctaaccctaccatcgaggaagggcgcacgctgcgggtgctcaagatggtcgagccctggctgcgtggaaaccagttctgcattaagatactgaacccctacatgcctagtgtcgtggaggccctagagcagatgcagcggaagcacggggggatgcttgtgcgcaaccccctcagtcggaattccacccacgagatgtactgggtctcatgtgggacagggaacatagttagcgccgtgaacatgaccagccgcatgctgttgaaccggttcacgatggcgcatagaaagcctacctacgagcgggacgtcgacctgggcgcaggcacccggcacgtggcggtcgagcccgaggttgcgaacctcgatattataggccaacgcatagaaaacataaagaatgagcacaagagtacctggcactacgacgaggacaatccgtacaagacgtgggcgtaccacggtagctatgaggtgaagccatccggtagcgcatcgagcatggttaacggcgtcgtgcgcttactcaccaagccttgggatgtcatccccatggtgactcagatcgcaatgaccgatacaaccccgttcgggcagcagcgcgtgtttaaggagaaggtcgatacacggacgccacgggcgaagcggggtacgacgcagatcatggaggtcaccgctaagtggctctggggcttcctgtcacgcaataagaagccacggatttgcacccgagaggagttcacgcggaaggtccgctctaacgccgcgatcggggccgtcttcgtggacgagaaccagtggaattcggccaaggaggccgtggaagacgagcggttttgggacctggttcaccgcgagcgggagctacataaacagggcaaatgcgccacctgcgtgtacaatatgatgggtaagcgcgagaagaaactgggcgagtttgggaaagccaagggctcaagagccatctggtacatgtggttgggcgcgcgcttcttggagttcgaggccttagggttcatgaatgaggaccattggttcagccgggagaactctctgagcggagtcgagggggaggggcttcacaaattgggttacatcctgcgcgacatcagtaagatcccgggcggcaacatgtacgccgacgacactgccgggtgggataccagaatcacggaggacgacttgcagaacgaggccaagataaccgagatcatggaacccgagcacgcactgctggcaaccagcatctttaagttaacctatcagaataaggtggttcgcgttcagcgccccgcgaagaacggcacggtcatggacgtcatttcccggcgcgatcagagggggagcggccaggtcggcacgtacgggctgaacacatttacgaacatggaggtacaactgatcaggcagatggagtccgaggggatctttctcccaagtgagttagagacgcctaacctggccgagcgggtgctcgactggctagaaaagcacggggccgaacgcttaaagagaatggccatctccggcgacgattgcgtggtcaagcccatcgacgaccgatttgccaccgcgctcaccgcactgaacgacatgggaaaggtgcgcaaggacatcccacagtgggagcccagcaagggctggaacgactggcagcaagtgccgttctgctcccaccacttccaccagctgatcatgaaggacgggcgtgaaatagtcgttccttgccggaaccaagacgagctcgtgggacgcgccagggtgagccagggggccgggtggagtctgcgcgagacggcctgtctgggcaaaagctacgcccagatgtggcagctaatgtattttcaccgacgagatcttcggttggccgccaacgccatatccagcgcagtgcccgtcgactgggtccctacgtcccgcactacctggtcaatccacgcccaccaccagtggatgacaaccgaggacatgctcagcgtgtggaaccgggtgtggattgaggagaacccgtggatggaagacaagactcacgtctctagctgggaggaggttccgtacctgggtaaacgcgaggaccagtggtgtggatccctaattggcctaacggcccgcgccacttgggccaccaacatccaggtggcgatcaatcaagtacggcgcctgataggtaacgagaattacctcgattacatgacatctatgaagcggttcaagaacgagtccgatcccgaaggcgcactctggtga

SEQ ID NO: 23898 - RNA, 9879 nt, synthetic construct
  misc_feature 1..9879: note = derived and/or modified CDS sequence (opt11) from DENV-1__GU131983__SS-prME
  source 1..9879: mol_type = other RNA
tcagtgaccatgctgctcatgttgctgcccaccgccctcgcattccacctaaccacccggggtggggagccccacatgatagtgagcaagcaggagcgtggcaagagcctcctgttcaaaacgagcgcgggcgtgaacatgtgcacactgattgccatggacttgggggagctatgcgaggacactatgacctacaagtgcccccagattaccgaggcagagcccgacgacgtggactgctggtgcaacgccaccgacacatgggtgacctacggtacctgcagtcagactggcgagcatcgccgggacaagcgctcggttgcattggcgccccacgtggggcttgggctcgagacgcggaccgagacctggatgagctcggagggcgcctggaagcagatacagcgcgtggagacctgggcgctgaggcaccccgggttcacggtgatagcccttttcctcgcgcacgccatcggcaccagcatcacacagaaggggatcatcttcatcctgctgatgctcgttaccccttccatggccatgcgctgtgtcggcatcggtaaccgggacttcgtggaggggctcagcggcgccacgtgggtggacgtcgtgctggaacacggatcctgcgtaacaaccatggccaaaaacaagcccacactcgatatcgaactgctgaagacggaggtcacaaaccccgcaatcctcagaaagctgtgcatcgaggcaaagatcagcaataccacaacggattcgagatgcccgacacagggcgaggccaccctggtggaggagcaggacgccaacttcgtgtgccgccggaccttcgtcgaccgtggctgggggaatgggtgcggcctcttcggcaaggggagcctgctgacgtgcgccaagttcaagtgcgtaactaaactcgagggcaagatcgtgcagtacgagaacctgaaatattccgtcatcgtgaccgtgcacaccggcgaccaacaccaagtcgggaacgagacgaccgagcacggtaccatcgcgaccataacgccccaggccccgacgagcgagatccaactgaccgactacggggccctcaccctggactgcagcccccggaccggcttggacttcaacgagatggtgttactgacgatgaaggaaaagtcctggctggtacacaaacagtggtttctcgatctgccgctgccatggacctccggggcaagcaccagccaagagacatggaaccggcaggacctcttggtgacgtttaagaccgcgcacgcgaagaagcaggaggtggtggtgctgggctcccaggaaggcgccatgcacaccgctctcaccggggccacggagatacagaccagcggaaccaccacgatctttgccgggcacctgaagtgccggctgaagatggacaagctcaccctaaagggtacctcctatgtgatgtgcaccgggagcttcaagctggagaaggaggtcgcggagacgcaacacggcacagtgctggtgcaggtcaagtacgagggcaccgacgccccctgcaagatccccttctcgactcaagacgagaagggggtcacgcagaatggtaggctcataaccgccaacccgatcgtgacggataaggagaagcccgtaaacatcgagaccgaaccgcccttcggcgagagctacatcgtggtgggcgccggcgagaaggccctcaagctgtcttggttcaaaaagggaagctccatcgggaagatgttcgaagccacggcccgaggggcgcgcaggatggccatcctcggcgacaccgcgtgggacttcggatcgatcggcggggtcttcacctccgtggggaagctggtgcaccaggtctttggcaccgcctacggggtgctgttcagcggcgtctcttggacgatgaagatcgggatcggcatcctcttaacctggcttggcctcaacagccgctccaccagcctgtccatgacttgcatcgccgtcgggatggtgacgctgtacctcggcgtcatggtccaggccgacagcgggtgcgtgatcaactggaaggggagagagctgaaatgcgggtccggcatcttcgtgaccaacgaggtccacacctggaccgagcaatacaagttccaggccgacagcccgaagcggttgagcgcggctatcggaaaggcatgggaggagggggtgtgcggcattcgttcggccacgaggcttgagaacatcatgtggaagcagataagcaacgagctgaaccacatcttactggagaacgacatgaagttcacggtggtcgtgggcgacgccaacggaatcctggcgcaggggaagaagatgatccgcccacagcccatggagcacaagtactcctggaagtcctggggcaaggccaagatcatcggtgccgacatccagaacaccaccttcatcatcgatgggcccgacaccccggagtgccccgacaaccagcgggcctggaacatatgggaggttgaggactatggctttggaatcttcacgaccaacatctggctgaagctccgcgactcctacacccagatgtgcgaccaccgtctgatgagcgcggccatcaaggactccaaggctgtccacgccgacatgggttattggatcgagtctgagaagaacgaaacctggaagctggcccgtgcgtccttcatcgaagtaaaaacgtgcacctggcccaaaagccacaccctatggtccaatggcgtcctggagagcgagatgatcatccccaagatctacgggggccctatctcccaacacaattacagacccgggtactttacccagactgccggaccctggcacttagggaagctcgagctggacttcgacctttgtgagggcaccaccgtcgtggtggacgagcactgtggtaaccgcgggccgagtcttcggaccacgaccgtcaccggtaagatcatccatgagtggtgctgccgctcctgcaccctgccgcctctgcggttccggggggaggacggttgctggtacgggatggagatccggcccgtgaaggagaaggaggagaacctcgtgcggagcatggtctccgccggaagcggcgaggtggacagcttctcactggggattctgtgcgccagcattatgatcgaggaggtgatgcggtcccgctggagccggaaaatgctcatgattggcacgctggccgtcttcctgctcctcgtaatggggcagctgacatggaacgatctcatccgcctatgcatcatggtgggggcgaacgcctccgaccgcatggggatgggcaccacctacctggccctcatggccacgttcaagatgcggccgatgttcgccgtcggcctcctgttccgccgtttaacctcacgcgaggtgctgctgctcacgatcgggctgtccctggtggcgagcgtcgagctgcccaactccctggaggaactgggtgacggcctcgccatgggcattatgatgctcaagctcctcaccgagttccagccccaccaactgtggaccaccctgctcagcctgaccttcatcaagaccacgttatccctcgactacgcctggaaaaccaccgctatggctctcagcatcgtgtccctcttccccctctgcctgagcaccacgtcccagaagactacctggctgccggtcctcctgggctcgttcggatgcaaacccctgacaatgtttctcattacagagaataaaatttggggacggaagtcctggcccctgaacgagggcatcatggccatcggcatcgtgagcatcctgttatcctctctgctgaagaacgacgtgccgctcgcagggccgctgatcgccggcggcatgctgatcgcctgctacgtaatcagcgggagttctgcggacctcagcctagagaaggccgccgaggtgagctgggagcaagaggccgagcattccggaacgagccacaacatcctggtagaggtccaggacgacgggaccatgaagatcaaggacgaagagcgcgacgacacactcaccatccttctgaaggcaacgctcctggcggtgtccggcgtttaccccatgagcatccccgccaccttgttcgtctggtacttctggcagaagaagaagcagcggtccggcgttctctgggatacccccagcccgcccgaggtggaacgcgctgtcctggacgacggcatctaccgaatccttcagcgtggcctactcgggcgatcgcaggtgggagtaggggtcttccaggacggcgtcttccacaccatgtggcacgtgacgaggggggccgtactgatgtaccagggcaagcggctagagcccagctgggcatccgtgaaaaaggacctcatcagctacggagggggctggcgcttccaggggtcttggaacaccggggaagaagtgcaggtcatcgcggtggagcccgggaagaaccccaagaacgtgcagaccactcccggcacgttcaagacccccgaaggcgaggtcggggcaatcgccctggactttaagcccggcaccagcgggtccccgatcgtcaaccgggagggcaagatcgtgggcctgtacggcaacggcgtcgtgaccacgagcgggacctacgtatccgcaatcgcccaggcgaaggcctcccaggagggtcccctccccgagatcgaagacgaggttttcaagaagaggaacctgaccataatggacctgcatcctgggagcggcaaaacccggcgatacttacccgctattgtacgggaggccataaagcgcaagctgcgaacgctgatcttagcgcccacacgcgttgtcgcctccgagatggccgaggccctgaagggcatgcccatccgctaccagactaccgcagtcaagagcgagcacacggggcgggagatcgtggacctgatgtgccacgcaaccttcaccatgcgccttctatctccagtccgggtgcccaactacaacatgatcatcatggacgaggcccacttcaccgaccccgccagcatcgccgcccgcggttacatctccaccagggtggggatgggcgaggcggccgccatcttcatgaccgccacgccgcccgggagcgtcgaagctttcccccagtccaatgcggtcatacaggacgaggagcgcgacatccccgagcgcagctggaactccgggtacgactggatcaccgacttcccgggcaagacggtgtggtttgtccccagcatcaagtccgggaacgacatcgccaactgcctgcgcaagaacgggaaacgggttattcagctcagccgcaaaactttcgacaccgagtaccagaagaccaaaaacaacgactgggactatgtggtgacgaccgacatctccgagatgggtgccaacttccgggccgaccgcgtgatcgaccccagacgctgcctgaagcccgtgatcctgaaagacggtccggagcgggtcatcctcgcagggccaatgcctgtgaccgtggccagcgccgcccagcgccggggccggatcggtcgcaaccagaacaaggagggggaccaatacgtctacatgggccagcctttaaataacgacgaggaccatgcacactggacggaggccaagatgctgctcgataacatcaacacccccgaggggatcatcccagccctgttcgagcccgagcgcgagaagtcggctgccatagacggcgagtaccgcctgcgtggcgaggcccgaaagacctttgtggagctcatgcgtcgcggcgatctgcccgtatggctgagctataaagtcgcgtcagagggcttccagtacagcgaccggcgctggtgtttcgacggggagcggaataaccaggtactcgaggagaacatggatgtcgagatctggaccaaggagggcgagcgcaagaagttacggccccggtggcttgacgcccggacctactccgatcctttggccctgcgcgaattcaaagagttcgctgccgggcggcgctcggtgtccggcgacctgatcctcgagatcgggaagctgccccagcacctgaccctccgtgcgcagaacgctttggacaacctggtgatgctccataacagcgagcagggcgggaaggcctaccgccacgccatggaagagttaccagacactatagagaccctgatgctcctggcgctgatcgcggtcctaacggggggcgtgaccctgttcttcctgagcggtaagggcctcggcaagacatcaatcgggctgctgtgcgtgacggcctcctccgccttactgtggatggccagcgtggagccccactggatcgcggcctccatcatactggagttcttccttatggtgctgctgatcccggagccagaccggcagcgcactccccaggacaaccaactcgcctacgtggtcatcggcctgctgttcatgatcctcaccgtggccgccaacgagatggggctgttggagacgaccaagaaggacctcggcatcgggcacgtggcggccgagaaccaccagcacgcaaccatgctggacgtcgacctgcggccggccagcgcctggaccctctatgctgtggctacgaccgtgattaccccaatgatgagacacaccatagagaacacgactgccaatatctccctgactgccatcgccaaccaggcggccatcttgatggggcttgacaagggctggcccatcagcaaaatggacatcggggtccccctgctggccctcggctgctactcccaggttaacccgctgactctcacggccgcggttctcatgctagtcgcccactacgctatcatcgggcccggcctgcaagccaaagcaactcgggaagcgcagaagcgcaccgcagccgggatcatgaagaaccccaccgtagatggtatcgtggcaatcgacctcgaccccgtggtgtacgacgccaagtttgaaaagcaactgggccagatcatgctcctcatcctgtgtacgagccagatcctgctcatgcgcaccacatgggcgctctgtgagtccatcaccctggccacggggcctctcaccaccctgtgggagggctcgcccgggaagttctggaacacgacgatcgccgtgtccatggccaacatcttccggggctcatacctggccggcgcggggctcgccttctccctcatgaaatccctgggcgggggccgccggggcacgggcgcccagggcgagaccctaggggagaagtggaagcgccagctgaaccaactttccaagagcgagttcaacacctacaagcggagcggcatcatggaggtcgaccgctccgaagccaaagaaggactcaagcggggtgagacaaccaagcacgcggtgagccgagggaccgccaagctgcggtggttcgtggagagaaacctagtcaagcccgagggcaaggtaatcgacctgggctgtgggcggggtggatggtcgtactactgcgctggcctcaagaaggtaaccgaggtcaaggggtacaccaagggcgggcccggccatgaggagccgatccctatggccacgtacggctggaacctcgtgaagctccactcaggaaaggacgtgttcttcatgccgcccgagaagtgcgacaccctcttgtgcgacatcggcgagtccagcccgaaccccacgatcgaggaggggcgcacgctgcgcgtcctcaagatggtggagccctggctgagggggaatcagttctgcatcaagatcctaaacccctacatgccgtccgttgtcgagacgctcgagcaaatgcagcgtaagcacggcggcatgctggtgcgcaaccccctgagcaggaactccacccatgagatgtactgggtgagctgtggcaccgggaatatcgtcagcgccgtgaacatgaccagccgaatgctactgaaccggtttacgatggcgcaccgcaagcccacttacgagcgcgacgtggacctgggcgccggcacccggcacgtagccgtggagcccgaggttgccaacttggacataatcgggcagcggatcgagaacatcaagaacgaacacaagtccacctggcattacgacgaggacaacccgtacaagacgtgggcctaccacggcagctacgaggtaaagccctccgggagcgcgtccagcatggtgaatggcgtggttcggctgctgaccaagccatgggacgtgatccccatggtcacccagatcgccatgaccgacacgaccccgttcgggcagcaacgcgtgttcaaggagaaggtagacacccggacgcccagggccaagcggggcacgactcaaatcatggaggtcaccgccaagtggctctggggcttcctttcccgcaacaagaagccccggatatgcacgcgcgaggaatttacgcggaaggtgcgcagcaacgccgcgatcggggccgtgttcgtcgatgagaaccagtggaacagcgccaaggaggcagtggaggacgagcggttctgggacctagtgcaccgcgagcgggagctacacaagcagggaaagtgtgcgacctgcgtctacaatatgatggggaagcgcgagaagaagctgggcgagttcgggaaggccaagggcagtcgggctatctggtacatgtggctgggcgcccgcttcctcgaattcgaggccctggggtttatgaatgaggaccactggttcagccgtgaaaactcgctaagcggcgtggaaggggagggcctccacaaacttgggtacatcctgcgagacatttccaagatcccgggtggcaacatgtacgcggacgacacggccgggtgggataccaggataacggaggacgacttgcaaaacgaggccaagattacggagatcatggagcccgagcacgccctgcttgccacctcaatcttcaagctcacctaccagaacaaggtggtccgcgtgcagcgccccgcgaagaacggaacggtcatggacgtcatcagtcgacgcgaccaacgagggagcggccaggtgggtacctacggcctgaacaccttcaccaacatggaggtgcagttaatacgccagatggagtccgaagagatcttcctccccagcgagttagaaacgccgaacctggccgagcgggtcctcgactggctggagaagcacggcgccgagcgcttaaagcggatggccatttccggggacgattgcgtggtgaagcccattgacgaccgcttcgccaccgcgctcaccgctttgaacgatatgggtaaggtccggaaggacatcccccagtgggagcccagtaaggggtggaacgactggcagcaggtcccgttctgttcacaccacttccaccagttgatcatgaaggacggacgcgagatcgtcgtcccatgccgcaaccaggacgaactcgtgggccgcgcccgggtaagccagggggccggctggtccctgcgagagacagcatgccttggcaaaagctacgcgcagatgtggcaactcatgtactttcaccggagagacctgcgtctggccgcaaacgcgatctgctccgcggtccccgtggactgggtgcctacgagccgcacaacttggtcaattcacgcccaccaccaatggatgaccaccgaggacatgttgtccgtctggaaccgggtgtggatagaagagaacccgtggatggaggacaagacgcacgtaagctcgtgggaggaggtcccctatctgggcaagcgcgaggaccagtggtgcgggagtctaatcggcctcaccgcgcgcgccacatgggccaccaacatacaggtggcgataaaccaggtccggcgcctcatcggcaacgaaaactacctggactacatgacctccatgaagaggttcaagaacgagagcgaccccgagggggccctctggtga

SEQ ID NO: 23899 - RNA, 9879 nt, synthetic construct
  misc_feature 1..9879: note = derived and/or modified CDS sequence (opt11) from DENV-1__GQ868532__SS-prME
  source 1..9879: mol_type = other RNA
agcgtgaccatgctcctcatgctgctgccaaccgccctggcattccacctgacgacccggggcggggagccacatatgatcgtaagcaagcaagagaggggtaagagcttactgttcaagacctcagcgggggtgaatatgtgcaccctcatcgccatggacctaggggagctctgcgaagacacgatgacttataagtgcccccagatcaccgaagcagagcccgatgatgtagactgctggtgcaatgccaccgacacatgggtcacatacgggacatgcagccaaaccggcgagcaccgccgggataagagatccgtggcgctcgcccctcacgtcgggttggggctggagactcggaccgagacctggatgagctccgagggcgcatggaagcaaatccagcgtgttgagacttgggccctgcggcacccggggttcacggtgatcgccctgtttctcgcgcacgccatcgggaccagcatcacgcagaaggggatcatcttcattcttctgatgctcgttaccccctccatggcgatgcgctgcgtcggcatcgggaaccgggactttgtggaagggttaagtggcgcaacctgggtcgacgtcgtgttagagcacggcagttgcgtaaccaccatggccaaaaataagcctacgttggacatcgaattacttaagacagaggtcaccaacccggcgatcttgcgcaagctgtgtattgaagctaagataagcaataccaccactgacagccgctgccccacgcagggcgaggcgaccttagtagaggagcaggacgcgaacttcgtgtgtcgccggaccttcgtcgacaggggttggggtaacgggtgcggcctgttcggaaaagggtcactactaacgtgcgccaagttcaagtgcgttactaaacttgagggcaagatcgtgcagtacgagaacctaaaatatagtgtcatagtgaccgtgcacaccggggaccagcaccaagtcgggaacgaaacgacggagcacggcaccatagcgaccatcacgccccaggcacccaccagcgagatccagctaaccgactatggagccctcaccctcgattgcagcccaagaaccggcctggatttcaacgagatggtcctgctgacgatgaaggaaaagtcttggctggtgcataagcaatggttcctcgatctgccgctgccctggacgagcggcgctagcacatcccaggaaacgtggaaccgccaagacctgctggtgacatttaagactgcccacgctaagaagcaggaggttgttgtcctgggttctcaggagggagccatgcatactgcccttacgggggccacagagatccagacctccgggacgaccacgatcttcgccggtcacctaaagtgccggttgaagatggacaagctcacacttaagggaacgagctatgtgatgtgcaccgggagcttcaaacttgagaaagaagtggcggagacgcagcacggcacagtgctggtccaggtcaagtatgaaggcaccgatgccccgtgtaagatcccgttctcgacccaggacgagaagggggtgacgcaaaacgggcgactcattacggccaaccctatcgtgaccgacaaggagaagccggtgaacatcgaaacggagccaccattcggggagagctatatcgtcgtgggcgccggggagaaagccctgaagctgtcctggttcaagaaggggtcatccatcggcaagatgttcgaggcaaccgccagaggggcgagacggatggccatcctcggcgatacggcgtgggactttgggagcatcggcggcgtcttcacctcagtgggtaagctcgttcatcaggtcttcggcaccgcctacggggtgcttttctccggcgtttcctggacgatgaaaatcgggatcggcatcctactgacttggcttggtctaaattcacgctcgaccagcctgtcgatgacctgcatcgcagtcgggatggtgacgctgtacctcggagtgatggtccaggctgatagcggttgtgtgattaactggaagggccgcgagttgaaatgtgggagtggcattttcgtgaccaacgaggtccatacgtggaccgaacagtacaaattccaggcagactcgccgaagcggctgagtgcggccatcggaaaggcctgggaagagggcgtttgcggcatcagaagtgcgacccggctcgagaacatcatgtggaagcagatctccaacgagctgaaccacatactgctcgagaacgacatgaagttcactgtggtcgttggtgacgcaaacggcatcctggcacaggggaagaagatgatccgcccacagcccatggaacacaagtactcatggaagtcctggggtaaagcaaagatcatcggcgccgacatccaaaacactacgttcattatcgatggccccgatacgccggagtgcccggacaatcaacgagcttggaacatctgggaagtcgaggactacggctttggtatcttcacgaccaacatctggctaaagttgcgtgactcctatactcaaatgtgcgaccaccgactgatgagcgcggccatcaaggattccaaggccgttcacgccgacatgggctactggatcgagtcagagaaaaacgagacctggaaattggccagagcttccttcatagaggtgaagacttgtacctggcctaagagccacaccctctggagtaacggcgtgttggagagtgagatgattatccccaagatatacggcggcccgatttcacagcacaattaccggcccggatacttcacccagacggcggggccctggcacctggggaaactcgaactagatttcgacttatgcgaagggacaactgtagtagtggatgagcactgcggcaaccgcggtccaagccttaggactacgacggtaaccggcaagatcatccacgagtggtgctgccgctcctgcaccctcccgcccttgcgatttcgaggcgaggacggctgctggtacgggatggagatccggcccgtgaaagaaaaagaggagaaccttgtgagaagcatggtgtccgcaggaagcggtgaagtcgacagtttttctttagggatcctgtgtgcctccataatgatcgaagaggtgatgcggtcccgttggtcgcggaaaatgttgatgactggaacactggcggtcttccttctcctggtgatggggcagctgacctggaacgacctcattcgcttatgtatcatggtgggcgctaatgcgtccgaccgcatgggtatgggcaccacgtatctagcactaatggccaccttcaaaatgagaccgatgttcgcggtcgggctcctgttccgtcggctaaccagtcgcgaggtgctgttgctcaccattggtctaagtctagtggcaagcgttgagctcccgaactcgctggaggagcttggcgacgggctggccatgggcatcatgatgctcaagctgctcacggagttccagccccatcagctatggatcaccctgctcagcttaacttttataaagaccacgttatccctcgattatgcctggaagaccaccgccatggcgctgtctatcgtgtccctgttccccctatgcctgtcgactacgtcacagaagactacctggctaccggtacttttaggcagcttcggatgtaagcctttgaccatgttccttatcacggagaacaagatctggggacggaagtcatggcctctcaacgaggggatcatggccatcgggatagtgtcaatcctgttatcctcgctgctaaagaacgacgtgcctctcgctgggcccctcattgccggaggtatgctgatagcctgttacgtgatttccggaaattccgcggacctaagcctagaaaaggccgcagaagtgtcctgggagcaggaggccgaacatagcggcacgagccacaacattctggtggaagtccaagacgatggtacaatgaaaatcaaggatgaagaacgcgacgacacgctcacgatcctgttaaaggctactctacttgcggtgagcggagtgtacccgatgtccataccagcgaccttgttcgtctggtatttttggcagaaaaagaagcagcgcagcggggttctgtgggataccccttccccaccggaagtggagcgggccgtacttgacgacgggatttaccgaatcttgcagcgcggcctgctcgggcgtagccaggttggggtaggggtgttccaggacggtgtgttccacactatgtggcacgttactagaggggccgttctgatgtaccagggcaagcggcttgaaccctcctgggcgtcggtcaagaaggacttaatcagttatggcggcggctggcgcttccaggggtcgtggaataccggagaggaggttcaggtcatcgccgtagagccaggtaagaacccgaagaacgtacagacaatgcccggaacgttcaagacccccgaaggcgaggtcggggccatcgccctggatttcaagcccgggacctcagggtctccgatcgtgaatcgggagggcaaaatcgtaggcctatatgggaacggcgtggtgaccacctccgggacatacgtcagcgccatcgcccaggcaaaggcctcccaggaagggccgccgcccgagattgaggacgaagtctttaagaagcgcaatctgaccatcatggacctccatccaggctccggcaagactcgtaggtatctacccgccatggtgcgagaagcgatcaagcgaaaactccggactctgatcctggcgccaacgcgcgtggtcgctagcgagatggcagaggcgctcaagggtatgccaatccgctaccagaccacggcagtaaagtctgagcacaccgggcgggaaatcgtggacctgatgtgccacgcgaccttcaccatgcgcctgctgagccccgtcagggtgcccaactacaacatgataattatggacgaggcccactttacagaccccgcctcgatcgccgctcgcgggtacatctcaacccgggtggggatgggcgaggcggctgcaatctttatgaccgcgacaccacccggttccgttgaggccttcccccagtctaatgcagtgatccaagacgaggaacgcgacatccctgaacggtcttggaactctggctacgactggatcaccgacttcccgggcaagaccgtatggttcgttccctccatcaagagcgggaatgatatcgccaattgcctgcgcaagaatggcaagcgcgttatccagctgtcccgaaaaacatttgataccgaataccaaaagaccaagaacaatgattgggactatgtggtgaccacggatatcagcgagatgggggccaactttcgagccgaccgtgtaatcgatccacggagatgccttaaacctgtgatcttaaaggacggacccgagcgggtcatcctcgcgggacccatgcccgtgacagttgcctcggccgcacagcgacggggccgtatcggccgaaatcaaaacaaggagggggaccagtacgtctacatgggccagcccttaaacaacgatgaagatcacgcgcactggactgaggcgaagatgctgctggacaatattaacacgccggaggggatcatccccgccctcttcgagcccgagcgggagaagagtgccgccatagacggcgaatacaggctaagaggggaggcccgtaaaacgttcgtggagctcatgcggagaggagacctccccgtttggttgtcctacaaggtggcatcggagggcttccagtattcggaccggcgctggtgtttcgacggcgaacggaacaaccaggttctcgaggagaatatggacgttgagatctggactaaggagggggagcgtaagaaactccggccgaggtggctggacgctcgtacctatagtgatccgctagccctccgggagtttaaggagttcgccgccggcagacgtagcgtgagcggcgacctaattctggaaatcggaaagctcccgcagcacctgaccctgcgggcgcaaaacgccctcgataacttagttatgctgcacaactccgagcagggagggaaggcataccgccatgccatggaggaactccccgacacaatcgagacgctgatgctgttgacgttaatcgcggtcctgaccgggggcgtgaccctgttcttcttgtccgggaaaggtctgggcaagaccagcataggattgctctgcgtgaccgcctcctctgcactgctttggatggcctcagtggaacctcattggatcgctgcgagcataattctggaatttttcttgatggtgctcctgatccccgagcccgaccggcagagaaccccgcaagacaaccagctggcctacgtggtaattggactactgttcatgatcctgacagtagccgccaacgagatgggactcctggaaacgaccaagaaggaccttggcatcgggcacgtggccgcggagaaccaccaacatgccacaatgctcgatgtcgatttgagacccgcctccgcatggacactctacgcagtggcgacgaccgtaatcacacccatgatgcgtcacaccattgagaacacgaccgccaacattagcctcaccgccatcgccaaccaggcagcgatactaatggggctggacaagggctggccaatctccaagatggacatcggggtcccgctgctagccctggggtgttacagtcaggtcaaccccctcactctcaccgcggcggtcctaatgctcgtggctcactacgctatcatcgggcccggcctgcaggctaaggctacacgggaagcgcagaagcgcaccgcggccgggatcatgaagaaccccacagtggacggcatcgtggccatcgacttagacccggttgtatacgacgccaagttcgagaagcagttgggccagatcatgttgcttattctgtgcacgagccagatcttactgatgcgcaccacgtgggccttgtgtgagtctatcaccctggcaacggggcctttaacaacgctctgggagggctcccccgggaaattctggaacaccacaatcgctgtgtcaatggccaacatcttcagaggcagctatcttgccggcgcagggctggcgttcagcctcatgaagtcactaggtgggggccggcggggtaccggagcacagggcgaaaccttgggagagaagtggaagcgccagctcaatcaactgagcaagagtgagttcaacacgtacaaacgctctggtatcatggaggtcgacaggagcgaggccaaggaagggctcaaaagaggcgaaacgactaagcacgctgtgtcccgcgggaccgctaagctacggtggttcgtggagcgcaatctggtgaagcctgagggcaaggttatagacttgggatgcgggcggggcggctggagctactactgtgccggcctgaagaaagtgacggaagtaaagggctacaccaaaggagggccgggacacgaggagcccatccctatggccacgtacggctggaaccttgtcaagctgcactccgggaaggacgtattcttcatgcccccagagaaatgcgacaccctgctctgcgatatcggggaaagctcccccaaccccaccatagaggagggtcgcaccctacgggtcctgaagatggtggagccctggctccgaggcaatcagttctgcatcaagatcctgaacccatacatgcccaacgtggtcgagacgctggaacaaatgcagcggaagcacggcgggatgctcgtacgtaaccctctgtctcggaactccacccacgagatgtactgggtctcctgcggcaccgggaacatcgtctccgcagtcaacatgacctcgcggatgttgctcaatcgtttcactatggcccaccgcaagccaacctacgagcgcgacgtggatctgggcgcgggcaccaggcatgtcgccgtggagccagaggtggctaatctggacatcatcgggcagcgcatcgagaatatcaagaacgagcacaagtccacctggcactatgatgaggacaatccctacaagacgtgggcgtaccacggtagctacgaggtcaagccgtccgggtcggcctcaagtatggtgaatggagtggtccgactgttaaccaaaccttgggacggtataccaatggtaacccagatcgcgatgaccgataccacccctttcgggcagcagcgcgtcttcaaggaaaaggtagacacgcggacaccgcgagccaaacggggaacaactcagatcatggaggtaaccgcaaagtggctgtgggggttcttatcccgcaacaagaagccgcggatctgtacccgcgaggagtttacgcgcaaggtgcgctcgaacgcagccatcggagcagtgttcgtggatgagaaccaatggaactccgccaaggaggccgttgaggacgagcggttctgggacctggtgcaccgcgaacgggagctgcacaagcagggaaagtgcgcaacttgcgtgtacaacatgatgggcaaacgcgaaaagaagctgggggagttcggcaaggcgaagggctcgcgggccatctggtacatgtggctgggggcacgctttttggaatttgaggccctcggattcatgaacgaggaccactggttttcaagagaaaacagtttgtccggcgtcgagggcgaagggctacacaaactgggctacattctgagggacatatccaaaatcccaggagggaacatgtacgccgacgacactgccggctgggacacccggatcaccgaagacgacctgcagaacgaggccaagattactgaaatcatggagcccgagcacgccctgcttgccaccagcatctttaagctcacgtaccaaaacaaggtggtgagggttcagcgccccgcgaagaacgggacggtgatggacgtgatatcacgccgcgaccagcgggggtcgggccaggttgggacgtacggtctcaacaccttcactaacatggaggtgcagctgattcgtcagatggaatcagaggggatcttcctgccatctgagctcgagactcccaacctggcggagcgggttctggactggctcgagaagcacggtgcggaacgccttaagcggatggcaatctctggtgacgactgcgtcgttaaacccattgatgaccgattcgcaaccgcgctcaccgcgctcaatgacatgggcaaggtgaggaaggacataccccagtgggagccaagcaaaggctggaacgactggcagcaagtccccttctgctctcaccatttccatcagctcatcatgaaggacggtcgcgagatcgtagtgccctgccggaaccaggacgaactggttggcagagcacgggtaagccaaggagcaggctggtccctccgcgagaccgcctgcttgggaaaatcctatgcccagatgtggcagttaatgtacttccaccggcgcgatctacggcttgcggctaacgctatatgctccgccgtacccgtcgattgggtgcctaccagccggacgacctggagcatccacgctcaccaccaatggatgaccactgaggatatgctgagtgtgtggaatcgggtctggattgaagagaatccttggatggaggataagacgcacgtgagctcctgggaagaggtgccataccttggaaagagggaggaccaatggtgtggcagcctgatagggctgaccgcacgcgctacatgggctactaacattcaggtggccatcaatcaggtgcggcgcctcatcggtaacgagaactacttggattacatgacttccatgaagcggttcaaaaatgagtctgaccccgagggggccctgtggtga

SEQ ID NO: 23900 - RNA, 9879 nt, synthetic construct
  misc_feature 1..9879: note = derived and/or modified CDS sequence (opt11) from DENV-1__GQ868533__SS-prME
  source 1..9879: mol_type = other RNA
agcgttacaatgctgttgatgctgctgccaaccgccctcgcattccacctgaccacccgaggtggggaaccgcacatgatcgtgtcaaaacaggagcgtgggaagagcctgctcttcaagacctccgccggggtcaacatgtgtacactcatcgccatggacctgggcgagctgtgtgaggacactatgacatataagtgcccccagataaccgaggccgagcctgacgacgtcgactgctggtgcaacgccaccgacacctgggtgacctacggtacgtgctcgcagaccggcgagcacagacgggacaagcgctccgtagctctggcgccccatgtgggcctgggtcttgagacgcggaccgaaacctggatgagctccgagggtgcttggaagcagattcagcgcgtggagacctgggccctccgacatcctggcttcacggttatcgccctgttcctagcccacgcgatagggacctccataacccagaaaggaataatcttcatactgctgatgctcgtgaccccatccatggccatgaggtgcgtcggcatcggcaatcgggacttcgtggaggggctgagcggagccacgtgggttgacgtcgtattagaacatgggagttgtgtcacaacaatggcgaagaacaagcccaccctcgacatagagttactcaagacagaagtcacaaatcccgcgatacttcgcaagctttgcattgaggccaagatctctaacacgaccacggactccaggtgcccgacccagggcgaggctacccttgttgaagagcaggatgccaacttcgtgtgccgccgcacttttgtagaccgcggctgggggaacgggtgcgggctcttcggcaaggggagcctattgacttgcgccaagttcaagtgcgtcactaagctagagggcaagatcgtgcagtacgagaacctgaaatactctgtcattgtgactgtccacacaggcgaccagcaccaggtcggaaacgagactaccgagcatggaaccatcgctaccatcacgccccaggcccctacgtctgagatccagctgacggattacggggcactcacgcttgattgctcaccacggaccggcctggactttaacgagatggtcctcctgacgatgaaggagaaatcctggctggttcacaagcaatggtttctcgacctgccgctgccctggacctccggggccagcaccagccaagagacgtggaaccgccaggacttgttggttaccttcaagacagcccacgccaaaaagcaggaggtggtcgttctggggtcccaagagggcgcgatgcataccgccctcaccggggccacagagatccagacctcgggcaccactacgattttcgctggtcacctgaagtgccgactgaagatggacaagctcacgttaaaaggcacctcctacgtgatgtgcaccgggagtttcaagctggagaaggaggtcgcggagacgcagcatggcaccgtgctggtgcaggttaagtacgaaggcacagatgccccctgtaagatccccttctctacacaggatgaaaaaggagtgacgcaaaacggccgcctcatcacggcaaatcccatagtgaccgacaaggagaagcccgtcaacatcgagaccgaaccgccttttggggaaagctacatcgtcgtgggcgccggagagaaggctctgaaattgtcctggtttaagaagggaagcagtatcggcaaaatgttcgaggccacggcccgcggggcccgccggatggccatcctcggcgatacggcctgggacttcgggagcatcggcggcgtcttcacctccgtcgggaagctggtgcaccaggtcttcggcaccgcttacggggtgctgttcagcggcgtgtcctggacaatgaagatcggtatcggcatcctcctaacctggctcggcctcaacagccggtccaccagcctttccatgacttgcatcgcggttgggatggtgacgctgtacctcggcgtgatggtccaggcagactcggggtgcgtcatcaactggaagggtcgagagctgaagtgcgggtccggcatcttcgtgaccaatgaggtacacacatggaccgaacagtacaagttccaggccgatagcccgaagaggctgtccgcggcgatcggcaaggcctgggaggaaggggtctgcgggatcagatcagccactcggctcgagaatatcatgtggaagcaaataagcaacgagctgaaccacatcctactcgagaatgacatgaagttcacggtagtcgtaggggacgccaatggtatcctggcgcaagggaagaaaatgatccgtccccaacccatggagcacaagtactcctggaaatcctggggtaaagccaaaataatcgaagcagacatccagaataccaccttcatcatcgacggcccggacacccccgagtgccctgacaaccagagagcatggaacatctgggaggtagaggactatgggttcggaatctttacgacgaacatctggctgaaactcagggactcctacactcagatgtgcgaccatcggctcatgagcgccgcgatcaaggattccaaggccgtccatgccgatatggggtattggatagagtctgagaagaacgagacctggaagcttgcccgcgcgagctttatcgaggtgaagacgtgcacctggcccaaaagccacaccctctggtccaatggcgtgctggaaagcgagatgatcatccccaagatatatggcggcccaataagccaacacaactaccggcccggctacttcactcaaactgccgggccctggcacttgggcaagcttgagttggacttcgacctatgtgaggggaccactgtggtggtggacgagcactgcggtaacagagggccaagtctccgcaccacgacagttacgggaaagatcatccacgagtggtgctgccgctcatgcacgctcccgcctcttcggttccgcggagaagacgggtgctggtatggcatggagatccggcccgtgaaagaaaaggaggagaacctcgtgcgcagcatggtctccgccgggagcggcgaggttgatagcttctctctgggaatcctgtgtgccagcattatgatcgaggaggtgatgcgaagtcgatggtcacggaagatgctcatgacggggaccttagccgtctttcttctcctggtgatgggccaacttacctggaacgacctcatccggctgtgcatcatggtgggggcgaacgcctccgaccgcatgggcatggggaccacctatctggccctcatggccaccttcaaaatgagaccgatgttcgctgttgggctgctgttccgccggctcacgagccgagaggtgctactgctcacaatcggcctgtctctagtagccagcgtcgagcttccgaactctttggaagagctcggggacggcctcgccatggggatcatgatgctgaagctgctcacagaatttcagccccaccaattatggaccacattactgtcactgacctttatcaaaacgaccctgtccctcgactacgcctggaaaaccactgccatggcgctgagcatcgtgtccctgtttcctctctgcctgagcacgacgtcccaaaagacgacctggctgccagtcctcctgggcagctttggctgcaagcccttgaccatgttcctcatcactgagaacaagatctgggggcggaagtcctggccactgaatgagggcatcatggcgatcgggattgtgagcatcctcctctccagcctgctgaagaacgacgtgccactcgcgggcccactcatcgccggcgggatgctgatcgcctgttacgtcattagcggctccagtgcagatctcagtctggagaaagcagccgaagtcagctgggaacaggaggccgagcacagtggtaccagccacaacatcttagttgaagtccaagacgacggcacaatgaagatcaaggatgaggagagggacgatactctcacgatcctgctgaaggctacgctccttgcggtgtccggggtgtaccccatgagtatccctgccacccttttcctctggtacttttggcagaagaagaagcaacggtccggagtcctatgggacacccccagcccgcccgaggttgagcgcgccgtacttgacgatgggatctaccggatcttgcaacgcggcctcctgggcaggtcgcaggtgggagtgggcgtctttcaggatggggtctttcacacgatgtggcacgtcacacgcggcgccgtgctgatgtatcaggggaagcggcttgagcccagctgggcatccgtcaagaaggacctgatctcttacggagggggatggagatttcagggctcctggaataccggggaggaggtccaggtaatcgcggtcgaacctggcaagaatccaaagaacgtacagaccacgcccggtacctttaagaccccagaaggcgaagtgggcgcaattgccctggacttcaagccgggaaccagcggtagtccgatcgtaaacagagagggtaaaatcgttggactctatggcaacggggtggtgaccactagtggcacctacgtgtccgcgatcgcccaagcgaaagcgagccaggaggggcctctccccgaaatcgaagatgaggtgttcaagaagcgcaacttaactatcatggacctccacccggggagcgggaagacgcggagatacctgcccgccatcgtacgcgaagcaatcaaaagaaagctccggacgttaatccttgcgcccacccgcgttgtggcctccgagatggccgaggccctgaaaggcatgcccatccggtatcagacgacggccgtaaagtctgagcacaccggccgggagatcgtagacctcatgtgtcacgcgaccttcaccatgcgactgctgtccccggtgcgggtacctaactataacatgatcattatggacgaggctcactttacggatcccgcgtcaatcgctgcccgagggtacatctctacgcgtgttggcatgggggaagcggcggccatattcatgacagctacgccgcccggcagcgtcgaggcgttcccgcagtccaacgctgtaatccaagacgaagagcgcgacatccctgagcggagctggaactccgggtacgattggatcacggacttccccggcaagaccgtgtggttcgtgccctctataaagagcgggaacgacattgccaattgtctccggaagaacgggaagcgtgtaatccaactaagccgcaaaacttttgacaccgagtatcagaagactaagaacaatgactgggactacgtggtgaccaccgacatctccgaaatgggagccaacttccgggccgatcgtgtaattgacccccgccgctgcctgaagcccgtgatcctcaaggacggacccgaacgggtgatcttggctggcccgatgcccgtaacagtggcaagcgccgcccagcgaagggggcggatcggccggaaccagaataaggagggggaccagtacgtgtacatgggccaaccgctaaataacgatgaggaccatgcccactggacggaggcgaagatgctactggacaacataaacacccccgagggaatcatccccgctctgttcgagccagaaagggaaaagtcggcggccattgacggggagtaccgccttcggggcgaggccaggaagaccttcgttgagctgatgcggagaggagacctacccgtatggttaagctacaaggtcgcatccgagggcttccaatacagtgaccgtaggtggtgtttcgacggtgagcgtaacaaccaggtgctagaggagaacatggacgtggagatctggaccaaggagggggagagaaagaagctgcggccccgctggctcgacgcccgtacctactccgacccgttagccctgcgcgagttcaaggagttcgcggccggtaggcgaagtgtgagcggtgacttaatccttgagatcggcaagctgccccagcacctcacatctcgtgctcagaacgcccttgacaatttagttatgctccacaacagcgagcaggggggcaaggcctaccgccacgccatggaagaactgcccgacaccattgagaccctgatgctcctagcgctgatcgccgtgctcaccggcggcgtcacgctcttcttcttgtccggcaagggactaggtaagactagcatcggcttactgtgcgtgactgcgtccagcgccctactgtggatggcctccgtagagccacactggattgcggcgagcatcatcctggagttctttttaatggtactgctgataccagagcccgaccgccagcgcacgccccaggacaaccagctggcttacgtagtaatcgggcttctgttcatgatcctcaccgtcgccgccaacgagatgggactcctggagaccacgaagaaggaccttgggatcggccacgtggctgcagagaaccaccagcacgccaccatgctcgatgtcgacttgaggcctgcttctgcctggacgctctacgcggtcgcaaccaccgtgatcacgcccatgatgcgccacacgatcgagaacaccaccgccaacatatccctgaccgctatagccaaccaggcggccatcctgatgggccttgacaagggctggccaatttccaagatggacatcggcgtgcccctgctagcgcttggttgctattctcaagtcaacccacttactttgaccgcggcggtcctaatgctggtggcccactacgccatcatcggtccggggctgcaggcaaaggcaactagggaagcgcaaaagcggactgcagccgggataatgaagaatcccacggtggatgggatcgtggccatagacctcgaccccgtggtctatgatgccaagttcgagaagcaactggggcagatcatgctgctcatcctgtgcacttcccaaattttactcatgcgcactacttgggcactgtgtgagtcgatcacgctcgctacagggccgctcaccactctgtgggaaggtagtccaggcaaattctggaacacgacaatcgcagtgtcgatggcgaacatattccgcggctcctacctggccggcgcgggcctcgccttcagcctgatgaagtccctcggtggaggacgccgggggactggggcccaaggcgagaccctcggagaaaagtggaagcgccagttaaaccagctgagcaaatcagaatttaatacgtacaaacggtccggtatcatggaggtggacaggtctgaggccaaggagggtctcaaacgtggggagaccaccaagcacgcggttagtcgcggcacagcgaaactcaggtggttcgtcgaaagaaatctggtaaagcccgagggaaaggtcatagacctggggtgtggacgcggcggttggagctactactgcgccgggctgaagaaagttaccgaggtgaaagggtacacaaagggcggtcctggccacgaggaacctatcccgatggcgacatatggatggaacctggcaaaactacactccggcaaggacgtattcttcatgcctcccgagaagtgcgacaccctcctatgcgatatcggggagagcagtccgaacccgacgatagaagagggccgcacgctgagagtgttgaagatggtggagccgtggttgcgggggaatcagttctgcatcaaaatcctgaacccatacatgccgagcgtagtggagaccctcgagcagatgcagcgaaaacacggcggcatgctggtccgcaacccgctatctcgaaacagcacccatgagatgtactgggtctcctgcggtaccggcaacatcgtgagcgcagtgaacatgacgtccaggatgctcctcaatcggtttaccatggcccatagaaagcccacctacgagcgcgacgtcgacctaggtgccggcacccggcacgtggccgtggaacccgaggttgcgaaccttgacatcataggccagcgaattgaaaacatcaagaacgagcacaagtcgacgtggcattacgacgaagataatccgtacaaaacctgggcatatcacgggtcctacgaggtcaagagcagtggcagcgcaagctcaatggtgaacggagtcgtgcggctgttaacgaagccctgggatgtcattcctatggtaactcaaatcgcaatgacggacaccaccccgttcggccagcaacgagtgttcaaggagaaggttgacacccggacgccgcgcgcaaagcgagggaccacccagatcatggaggtcacagctaagtggctctggggcttcctctcacgcaacaagaagccccggatctgcacgcgcgaggaattcactcggaaagtgagatcaaacgctgcaatcggtgccgtgtttgtggacgagaaccagtggaacagcgccaaggaggcggtcgaggacgagcggttctgggacctggtccatagggagcgggagctccataagcagggaaagtgcgctacctgcgtgtacaacatgatgggtaagcgcgagaaaaaattaggggagttcggaaaggcaaaggggtcccgggccatttggtacatgtggcttggcgcgagattccttgagttcgaggctctgggcttcatgaacgaggaccactggttcagtcgggagaactccctgtcaggggtggaaggcgaggggctccacaaactgggctacattctgcgggacatttctaaaatccccgggggcaacatgtacgcggacgacacggccggctgggacactcgtataaccgaggacgacctccagaacgaggccaagatcaccgagatcatggagccggagcatgccctgctggccacaagcatcttcaagttaacataccagaacaaggttgtgagggtccagcgccccgcaaaaaacgggacagtcatggacgtaatttcccggcgcgatcagagaggtagcggccaagtgggtacttacggactgaacaccttcaccaacatggaggtccagctcatccgccagatggagtccgaagggatcttccttcccagcgagctagaaacccccaacctggcggaaagggtactcgattggctggagaaacacggtgccgagaggcttaagcggatggccatttccggggacgattgcgtggttaagccgattgacgaccggttcgcgactgccctcactgccctgaatgacatgggcaaagtccggaaagacatcccacaatgggagccctcaaaggggtggaatgattggcagcaggtccccttctgctcccaccacttccaccagcttatcatgaaggacggccgcgagatagtcgttccatgcagaaaccaagatgagctggtgggccgcgctcgggtcagccaaggggcggggtggtccctgcgagagactgcgtgccttggcaagagctacgcccagatgtggcagcttatgtacttccaccggcgggaccttcggctggccgccaacgcgatctgcagcgcagtaccagtggactgggtccccacgtcccgcacaacctggtccatccacgcccaccaccagtggatgacgaccgaggacatgttgtcagtctggaacagagtgtggatcgaggagaatccctggatggaagacaagacgcacgtctccagttgggaggaagtgccgtatctgggcaaacgggaggaccagtggtgcggcagcctgataggcctcaccgcacgcgccacctgggcaacgaacatccaggtggccataaaccaggtgaggcgactgatcggcaacgagaactatctggattatatgacatccatgaaacgcttcaagaatgagtctgacccggaaggggccctctggtga

SEQ ID NO: 23901 - RNA, 9879 nt, synthetic construct
  misc_feature 1..9879: note = derived and/or modified CDS sequence (opt11) from DENV-1__GQ868534__SS-prME
  source 1..9879: mol_type = other RNA
agcgtcacgatgctgctcatgcttctgcccaccgcattggccttccacctaaccacccggggcggggaaccgcacatgattgtgagcaagcaagagcggggcaagtcactactgttcaagaccagtgccggagtgaacatgtgcaccctgatagctatggacttaggcgaactctgtgaagatacaatgacgtacaaatgtccccagatcaccgaggccgagcccgacgacgtggattgttggtgcaatgctaccgacacgtgggttacctacggtacttgtagccagaccggcgaacaccgccgggacaaacgctcagtggccctcgcgccccatgtcggcctgggtctagaaacacggaccgaaacgtggatgagctctgagggcgcctggaagcagattcagcgcgtcgagacctgggccctgcggcaccccgggttcaccgtaatcgctctgttcctcgcgcacgctatcggtacatcgatcacgcagaaagggataatctttatactcttgatgcttgtgaccccctccatggccatgcggtgcgtcggcatcgggaatcgggacttcgtggaagggctatcaggagccacgtgggtggacgtcgtacttgagcatgggtcgtgcgtgaccaccatggcgaagaacaagcccacactcgatatcgaactgctgaaaacagaggtaacaaacccagctatcctgcgaaagctgtgcatcgaggccaagatcagcaacaccactactgactcccgttgccccacgcaaggcgaggccaccctagtggaggagcaagacgccaactttgtgtgtcggcggaccttcgtagaccgcggctggggcaatggctgtggactcttcggcaaggggagccttctcacctgcgccaagtttaagtgcgtcaccaagcttgaaggcaagatagtccaatatgagaacctgaaatattcagtaatcgtgaccgtgcataccggcgaccaacaccaggtagggaacgagaccaccgaacacggcaccatcgcaacaatcacccctcaggcacccacgtcggagatacagctgaccgactatggtgccttgactctggactgttctcctagaactggtctggatttcaacgagatggtgctgctgacaatgaaggagaagtcctggctggttcacaagcagtggttcctagacctgccgcttccctggactagcggcgccagcaccagtcaggagacatggaaccggcaggaccttctagtgactttcaagactgctcacgcgaagaaacaggaggtagtcgtgctgggcagccaggagggcgccatgcacaccgccctcaccggggcgacggagatccagacctcaggaaccacaacgatattcgccgggcacctgaagtgtcgtctgaagatggataagttgacactgaagggcacctcctacgtgatgtgtaccggcagcttcaaactggagaaagaggttgcggagacccaacacggcaccgttttggtgcaggtcaagtacgaggggacggacgccccctgcaagatcccttttagtacccaggacgagaaaggggtcacgcaaaacggtcgtctcatcaccgcgaacccgatcgtgacggacaaagaaaagccggtcaatatagagaccgagccaccattcggggagagctacatagtggtgggcgccggcgagaaggctttaaagctgtcttggtttaagaaggggagctccatcggcaaaatgttcgaggctacggcccgcggggcccgaagaatggccatactcggcgacaccgcgtgggatttcggtagcatcggcggtgtattcacaagtgtgggaaagctggtgcaccaggtctttggcaccgcctacggtgttcttttcagcggtgtgtcctggacgatgaagatcgggataggcatcttgctcacatggctggggctcaattcccggtccactagcctgtctatgacctgcatcgccgtcggtatggtaacgctgtacctcggcgtcatggtccaggccgacagtgggtgtgtgatcaactggaagggcagagagctaaagtgtggttctggaatcttcgtgaccaacgaggtccacacctggacggagcagtacaaattccaagcggacagcccgaagagactttctgcagcaatcggcaaggcgtgggaggagggggtatgtggcattcgctccgccacccggctcgagaacatcatgtggaagcagatatctaatgagctcaaccacatcctgctcgagaatgacatgaagttcacggtggtcgtcggggacgcaaacggtatactggcccagggcaagaagatgatccgaccccaacctatggaacacaagtactcatggaaaagctgggggaaggccaaaatcatcggcgcagacatccagaacaccacatttataatcgacgggcccgatacccccgagtgccccgataaccaacgggcatggaatatctgggaggtagaagattacggcttcgggatcttcacgacaaatatctggttaaagctccgcgactcatacacccagatgtgcgaccatcggctgatgagcgcggcaataaaggactccaaggccgtccacgccgacatgggttactggatcgaatcggagaagaacgagacgtggaaactggcccgggcgtccttcattgaagtgaaaacgtgcacctggccaaagagccataccctctggtccaacggcgtactggagagcgagatgatcattcccaagatctacgggggtccgatctctcagcacaattacagacccgggtacttcacccagacggccggtccatggcacctggggaagttagagctggacttcgacctgtgtgagggcaccacggtcgtggtggacgagcactgcggaaaccgcgggccgagtctccgtaccacgactgtaaccggcaagataatccacgaatggtgctgccgctcctgcaccctcccgcctctgaggttccgcggggaggacggctgctggtacgggatggagatccggcccgtgaaagagaaggaagagaaccttgtgcgcagcatggtcagtgccggcagcggagaggtggactctttcagtctggggatcctgtgcgtgagcatcatgatcgaggaggtcatgagaagccgctggtcccggaagatgctaatgacgggcaccctggccgtgttcctactactggtgatgggtcagctgacctggaacgacttaatccgcctgtgtatcatggtgggcgccaacgcgtccgatcgtatggggatgggcaccacctacctggccctcatggccacctttaagatgcgaccgatgttcgctgtggggttgttattccgcaggttgaccagccgcgaggtgctactgttaacgataggcctgtcacttgtcgccagcgtggagttaccgaactcgctggaggaactgggcgacggcttagccatgggcattatgatgctgaagctactcacggagtttcagccacaccaactgtggacgacgctgctaagcctgaccttcatcaagacgacgctgagcctcgactatgcctggaaaaccaccgcaatggccctgagcatagtctcactgttcccactctgcctgagtacgaccagtcaaaagaccacctggctacccgtgctccttggctcattcgggtgcaagccactcacgatgttcttaataacggaaaacaagatatggggccgcaagtcctggcctttaaacgaggggatcatggcgattggcatcgtgagcattctgctctcctcacttctgaaaaacgatgtccccctcgccgggccgctgatcgccggcggcatgctgatcgcctgctacgtgatcagcgggagttctgccgacctctcccttgaaaaggcggcggaggtgagctgggagcaggaggccgagcacagcggcacatcgcacaatatcttggttgaggtgcaagacgacgggaccatgaagatcaaggacgaagaacgggatgacacgttgacgatccttctcaaggccaccctgctggccgtgtccggcgtctatccaatgtcaatcccagccaccctcttcgtgtggtacttctggcagaaaaagaagcagcgatccggggttctctgggatactccctcgccgcctgaggtggagagagccgtgcttgacgatggcatctatcgcatccttcagcggggcttgctagggcggtcccaggtaggcgtcggggtattccaggacggtgtattccacacgatgtggcacgtcacgcgcggggccgtcctaatgtaccagggcaagcgtctggagcccagctgggcctccgtcaaaaaggatctcataagctatggcgggggttggcgttttcaggggtcctggaacacgggagaggaagtccaggttatcgcggtggagccgggaaaaaacccgaagaacgtccagacgacgccgggcacctttaagaccccggaaggcgaagtaggcgcgatcgccttggacttcaagccgggcaccagcggcagtccaattgtgaacagggagggtaagatagtcggactgtacggtaacggagtagtgacaaccagcgggacctatgtctccgccatcgcccaggcaaaggcatctcaggagggacctctccccgaaatcgaggacgaggtgttcaagaaacgcaacctgaccatcatggacctgcaccctgggtcaggcaaaacgcggcgttatctccctgcgatcgtgcgggaggcaataaagagaaaactgcggaccttaatattagcacctacccgcgtcgtcgcgtccgagatggccgaggcgctgaagggcatgcccatccgataccagaccacggctgttaaatccgagcacactggtcgggagatcgtagacctgatgtgccacgccaccttcaccatgcgtctcctgagcccggtacgagtgcccaactacaacatgatcatcatggacgaggcccactttacggatccagccagcatcgctgcccgcggctacatctccacccgggtcggaatgggtgaggctgctgcgatcttcatgaccgccacgccccctgggagcgtagaggccttcccacaaagtaacgcggtgatccaggacgaggagcgcgacatccccgagcgaagctggaactccgggtacgactggattactgacttccccgggaagaccgtgtggtttgtccccagtatcaagtccgggaacgatatagcgaactgcctgcgcaagaacggcaagcgggttattcagctcagccgcaagacctttgacaccgaataccaaaagacgaagaacaatgactgggactacgtggttaccaccgacatctctgagatgggggccaatttccgcgccgaccgcgtgatcgacccccggcgctgcctgaagccagttatcctcaaggacggacccgagcgcgtgatcctcgccggtccgatgcccgtgactgtcgcgagcgctgcccagcgaagagggcgcattggccggaatcagaacaaagaaggggatcagtatgtgtacatgggccagcctctgaacaacgacgaggaccacgcacattggacggaggccaagatgttactcgacaacatcaacacacccgaggggattatcccggcgctgttcgagccagagagagaaaagaacgccgcgatcgatggagaatatcgattacgtggcgaggctcgcaagaccttcgtcgaactcatgcgtcgcggcgatctgcccgtgtggctatcatacaaggtcgccagcgagggattccagtacagtgaccggcgatggtgtttcgacggggagcggaacaaccaggtcctcgaggaaaacatggatgtggagatctggaccaaagagggcgagcgcaagaagctgcggccccgctggctcgacgctcggacgtactccgacccactcgccttaagagagtttaaagagtttgcggccgggcgccgttccgtgtctggcgacctaattttagagatcggcaaactgccccagcatctcactctgcgggctcaaaacgccttagataacctagtcatgctccacaacagtgagcagggtgggaaagcctaccgccacgccatggaagagctgccggacaccatcgagacactgatgctcttggccttaatcgcggtgttgaccgggggcgttacgctctttttcttgtcggggaagggtctcggcaaaacctcaatcggtctgctgtgtgtgacggcctccagcgccctcctgtggatggcctctgttgagccccactggatcgcggcgagtattattctcgagttcttcttgatggtgctgctgattccggagccagaccggcaacgcactccccaggataaccagttggcctacgtcgtgatcggcctactgttcatgatccttacggtggccgccaacgagatgggactgctggagactaccaagaaggacctgggcatcgggcatgttgccgccgagaaccaccagcacgctaccatgctcgatgtggacttaagaccggcctctgcctggacgctgtacgcagtggcgaccaccgttatcacccccatgatgcgccacacgatcgagaatacaactgccaatattagcctaacggccatcgcgaaccaggccgcgatcctgatgggcctggataagggctggcctatcagtaagatggacatcggggtgccactgcttgctctaggctgctacagccaggtaaacccactgacactgaccgccgccgtcctcatgctggttgcgcattacgcgatcatcgggcccggtctgcaggctaaggccacaagggaggcccagaagcgcaccgcggcaggaattatgaagaaccccacggtggacggcatagtcgcaattgatctcgaccccgtggtatacgacgcaaagttcgagaagcagctaggccaaattatgctgctcatcttgtgcacatcacagattctgttgatgcgaaccacatgggccctgtgcgaatccatcaccctggccacggggccactaaccacactttgggagggaagccccgggaagttctggaacactaccattgccgtcagtatggctaacattttccggggatcctacctggccggcgccgggctcgcgttcagcctcatgaagtccctgggtggtggcaggcgggggaccggcgcccagggagaaacactcggggagaagtggaagcgacagctgaaccagctcagcaagtccgagttcaacacgtacaagcggagtggcattatggaggtcgaccgctcggaggccaaggaggggctcaagcggggcgaaactaccaaacacgccgtgtcgcgcgggaccgctaagttacggtggtttgttgagcgcaatctggtgaaacccgagggcaaggtgatcgacctgggctgcggtcggggcgggtggagctattattgcgccgggctcaagaaagtgaccgaggtgaaggggtacacaaagggcggaccagggcacgaggaaccgatccccatggcaacctacggttggaaccttgtgaagttacactccggtaaggacgttttcttcatccctcccgagaagtgtgacaccctactgtgcgacatcggcgagagctccccgaatccgacgatcgaagaggggcgtacgctacgggtccttaagatggtagagccctggcttcgcggtaaccaattctgcatcaagatcttgaacccctatatgccatctgtcgtggaggcgctcgagcaaatgcagaggaagcacggagggatgcttgtcagaaacccattatcgcggaactcgacccatgaaatgtactgggtctcctgtggaaccggtaacatcgtgagcgccgtgaatatgacctctagaatgctactgaaccgtttcacgatggcacaccgcaagcccacgtacgaacgcgacgtagatctcggtgccggcacccggcacgtggctgtggagcccgaagtcgccaatttagatattatcgggcagcgcatcgagaacataaagaatgagcacaaatctacctggcactacgacgaggataacccatacaagacgtgggcgtaccatggttcctacgaggtcaagcccagcgggtccgcaagctccatggtgaacggcgtcgtgcgtctgctgacaaagccatgggacgtcatccccatggtgacccagattgccatgaccgacacgacccctttcgggcaacaacgcgtgttcaaggagaaagtcgacacacgaaccccccgagccaagagaggcacgacccagataatggaggtgactgccaaatggctctggggctttctgagccgcaataagaagccccggatctgcacccgcgaggaattcacccggaaggtcaggtcaaacgccgcgatcggggccgtattcgtagacgagaaccagtggaacagcgccaaggaggccgtggaggacgaacggttctgggacttagtgcaccgcgagcgggagttgcataagcaagggaagtgcgcgacatgcgtgtacaatatgatggggaaacgtgagaagaaactgggcgagttcgggaaggccaagggtagcagggccatctggtacatgtggctgggcgcccgtttcctagagttcgaggccctggggttcatgaacgaggatcactggttttcccgggagaacagcctttccggtgtggaaggggagggtctccacaagctggggtatatcctgagggacattagcaagataccgggaggcaacatgtacgcggatgacaccgccggctgggacacccgaatcacggaggatgatttacagaatgaggccaagatcaccgagataatggaacccgagcacgcactgctagccacctccatattcaagttgacgtaccagaataaggtcgtgcgggtccagcgccccgccaagaacggcacggtcatggacgtaatatcccggcgtgaccagcgggggagtggccaagtgggaacttacggtctcaataccttcaccaacatggaagtccaactgattcgccagatggaaagtgaaggcatatttctaccctctgaactggagacgccgaacctggcagagcgggccttggactggttagaaaagcacggggccgaaagacttaagcggatggccatctccggcgacgattgcgttgtcaagcccatcgacgatcgcttcgcgactgccctgaccgccctgaacgacatggggaaggtcagaaaggacatcccccagtgggaaccctccaaggggtggaacgactggcagcaggtcccgttctgcagccaccacttccaccagctgatcatgaaggatggccgcgagatagtggtcccctgtcggaaccaggacgagctcgtggggcgcgcccgggtgtcccaaggggccgggtggagcttgcgcgagaccgcttgcctgggcaaatcctatgcacagatgtggcaactcatgtacttccaccgtcgcgacctgcgcttagccgcaaatgcgatctgcagcgccgtcccagtggactgggtgcccaccagtagaacgacctggagcatccacgcacaccaccagtggatgaccacagaggacatgctcagcgtctggaaccgggtatggattgaagagaacccctggatggaggataagacgcatgtatcaagctgggaggaggtcccctatctaggcaaacgcgaggaccaatggtgtgggtctctgatcggacttacagccagagccacctgggcaaccaacattcaagtggccataaaccaggttcggcgcctgatcggtaacgagaactatctggattacatgacgtccatgaagcggttcaaaaatgagtccgatcccgagggagcgctctggtga

SEQ ID NO: 23902 - RNA, 9879 nt, synthetic construct
  misc_feature 1..9879: note = derived and/or modified CDS sequence (opt11) from DENV-1__GQ868535__SS-prME
  source 1..9879: mol_type = other RNA
agcgtcacgatgctgctcatgttgctgcccacggcccttgccttccatctgacaacccggggcggggagcctcatatgatagtctccaagcaagaacgaggcaagagccttttattcaagacaagcgcgggggtgaatatgtgcaccctgatcgcgatggacctgggtgaactttgcgaggacaccatgacctacaagtgtcctcagatcaccgaggccgagcccgacgacgtggactgctggtgtaacgccaccgacacctgggtcacctacgggacctgcagccagacgggcgagcacagacgggacaagcgctcagtggcactggcgccccacgtgggactggggctcgaaacccggactgagacctggatgagctccgagggcgcctggaaacagatccagcgcgtggaaacgtgggccctgcgacatcccgggttcacggtgattgctctgtttctcgcgcacgcgatcggcaccagcattacccagaaggggataatcttcattctgctgatgctcgtgacgccaagcatggctatgcgatgcgtgggcatcggcaaccgagacttcgtcgaggggctgagcggcgccacgtgggtggacgtcgtgctagaacatggttcctgtgtcaccaccatggccaagaacaagcccaccctcgacatcgaactgcttaagacggaggtagcgaatcccgctatcttacgcaaactttgcatcgaggctaagatcagcaacaccaccaccgactcgcgatgccctacgcagggcgaggccactctggtggaggaacaggacgccaacttcgtctgcagacggacgttcgtggacaggggctgggggaacggctgtggccttttcggcaaggggtcactactgacctgtgcgaagttcaagtgcgtgacgaagttggagggaaagatcgtgcagtacgagaacctgaagtactccgtcatcgtgaccgtgcacacgggcgaccagcaccaggtcggtaacgagaccacagagcatggaaccatcgccaccatcacgcctcaggcccccaccagcgagatccagctgacggactacggtgccttgaccctggactgtagcccacggacgggtctcgacttcaatgagatggtgctcttaaccatgaaggagaagtcctggctggtgcacaagcagtggttcctcgacttgccgttaccctggacgtccggggccagtacctcccaggagacctggaaccgccaggatctcctggtcaccttcaagactgcgcatgctaagaagcaggaggtagtcgtgctgggatcacaggagggcgcaatgcacaccgccctcaccggggcgaccgagatccagacgagcggtaccaccacaatctttgcagggcacctgaagtgccggctgaagatggacaaactcacgctgaaaggcacctcctacgtgatgtgcactgggagcttcaagctggagaaagaggttgccgagacccagcacggcacggtcctggtgcaagtcaagtacgaaggaaccgatgcaccctgcaagatacccttctccactcaggacgaaaagggtgtgactcagaacggccgcctcatcacggcaaaccccatcgtgacggacaaggagaagcccgtcaacatcgagaccgagcctcctttcggggagagctacatcgtggtgggcgcgggcgagaaagctcttaaactgtcctggtttaagaaggggtcctccattggtaagatgttcgaggcaaccgcccgcggggcgagacggatggcgatactgggcgacacggcatgggacttcgggagcatcggtggcgtctttacatccgtgggaaagttggtgcaccaggtcttcggtacggcttacggggttctattcagcggcgtctcatggaccatgaagatcggcattggaatactcctgacgtggctggggctcaacagccgctccaccagcctgtcgatgacttgtatcgccgtcgggatggtgacactgtatctcggcgtgatggtccaggccgactcggggtgcgtaatcaactggaaaggacgcgagctaaagtgcgggtccggcatctttgtgacgaatgaggtccatacctggaccgagcagtacaagtttcaagcggatagcccgaaaaggctgagtgcagccataggcaaggcctgggaggagggggtgtgtggcatccgctccgctacccggttggaaaacatcatgtggaagcaaatcagtaacgagttaaaccacatattgcttgagaatgacatgaagttcaccgtggtcgtgggggacgcgaacggtatcctggcccagggaaagaagatgatcagaccccaacctatggagcacaaatactcgtggaagtcctggggaaaagccaagatcatcggagcggatatccagaacacgacattcatcatcgatggacccgacacgcctgaatgccctgacaaccagcgggcgtggaacatttgggaggtggaggactacggattcgggatcttcaccaccaatatctggctgaagctgcgcgactcctacacccaaatgtgcgaccaccggcttatgagcgccgcgatcaaggactccaaggccgtccacgcggacatgggttactggatcgagtcggagaagaacgagacttggaagctagcgcgggcctccttcatcgaggtgaagacctgcacttggcccaagagccacaccctctggtccaacggcgtattagagtcggagatgatcatccccaagatctacggtgggcctataagtcagcacaattaccggcccggctacttcacccagaccgccggcccctggcacctagggaagctcgaactggacttcgacctgtgcgaaggcacgaccgtcgtggtcgacgagcactgcggcaatcgcgggccgagtcttaggacgaccacggtcaccggcaagatcatacacgagtggtgctgtcgatcctgcacgctgccgccgctgcggtttcgcggggaggacgggtgctggtacgggatggagatccggcccgtgaaggagaaggaggagaacctagttcggagcatggtgtccgccggcagcggcgaggtggacagcttctccttaggtatcctatgcgctagtatcatgattgaggaggtgatgcggtcccgctggagccggaagatgctcatgacgggcacgctggcggtgtttctgctcctgatcatggggcagttgacttggaacgacctgatccgcctgtgcatcatggtgggcgccaacgcctccgatcgcatgggaatgggcacaacctatctcgcattgatggcaacgttcaaaatgcggcccatgtttgcagtgggactgctttttcgccgactcacatctagggaggtactgttactcaccatcgggctctccctcgtggccagcgtggagctcccaaactcgttggaagagctgggcgatgggcttgccatgggcatcatgatgctgaagcttctaaccgaatttcaaccccaccagttgtggactaccctgttaagtctgacctttatcaagactacgctgtccctagactacgcctggaagaccacagcgatggcactgagcatcgtctccctattccccctctgcctgtcaaccacgtcccagaagactacctggctgccggttcttctgggttcattcgggtgcaaacccctgaccatgttcttgatcaccgaaaataagatctggggcaggaagtcctggcccctgaacgaggggatcatggcaatcggcatagtgtccatcctgctctctagcctactgaagaacgacgtgcctctcgctggccccctgatcgccggaggaatgttgatcgcttgctatgtaataagcgggtccagtgccgacctctccctggaaaaagccgccgaggtaagctgggagcaggaggccgaacactccggcacgagccacaacattttggttgaggtgcaggacgacgggaccatgaagatcaaggacgaagagcgcgatgacaccctcaccattcttctgaaggcgacgttgctggccgtcagtggtgtgtaccccatgagcatacccgccaccctgttcgtatggtacttctggcagaaaaagaagcaacggtctggggtcctctgggacacccccagcccgcccgaggtggaacgcgccgtgctggacgacggcatctaccggatacttcagcgcggcctgctcgggcggtcccaggtcggcgtgggggtgttccaggatggtgtttttcacaccatgtggcatgtgacgcgaggggccgtgctgatgtaccagggtaagcggctggagcccagctgggcatccgtcaagaaggaccttatcagctacggcggggggtggcgtttccagggatcttggaacatgggcgaagaggtgcaagtgatcgctgtcgagcccgggaaaaacccgaagaacgtgcagaccacacccggcaccttcaagacgccggagggtgaggtgggcgccatcgccctggacttcaagcctggtacctcaggaagtcccatcgtcaaccgagaagggaagatcgttggtctgtacgggaacggcgttgtgaccacctcggggacgtacgtgtccgccatcgcccaggccaaggcaagccaggaaggaccactccccgaaatcgaggacgaggtgttcaagaagcgaaacctgactatcatggatctgcacccggggagcggcaagactcggcgctatttgcccgccatagtccgggaggcaattaagcgcaagctgaggaccctaatcctcgctcccacgcgcgtggtggcctcagagatggccgaggccctgaagggcatgccaatccgctaccagaccaccgcggtcaagtcggagcacaccgggcgggagatagtcgatctgatgtgccacgctacttttaccatgcgcctcctgtctccggtgcgggtcccgaactacaatatgatcatcatggacgaggcccacttcaccgacccggccagcatagccgcgcgtggctacatatccacccgggtgggtatgggcgaggcggccgcaatcttcatgacagcaacgccgcccgggagcgtagaggcgtttccccagtccaacgccgtaatccaggatgaggagcgcgacatccccgagcggagctggaactccggctacgactggatcaccgacttccccggaaagactgtgtggttcgtgcccagcataaaatccggaaacgacatcgccaactgccttcgcaagaacgggaagcgggtcatacagttgagccgcaagacgttcgataccgagtaccagaagaccaagaataatgactgggactacgtggtgacaacggacatctccgaaatgggggccaacttcagagcggaccgcgtcattgacccccgccgctgcctgaagcccgtgatcctgaaagatggccccgagcgggtcattctcgcggggccgatgccagtgaccgtggccagcgccgcccagcgccggggccgcattggtcggaaccagaataaggagggtgaccagtacgtgtacatgggccagccactgaacaacgacgaggaccacgcgcactggacagaagccaaaatgctgctcgacaacataaacaccccggaggggataatccctgccctgttcgagcccgagcgcgagaaatctgccgcaattgatggcgagtatcgtctgcgcggggaagcgcgcaagacgttcgtcgagctcatgcggcgcggcgacctgccagtatggctatcctacaaggtcgctagcgagggcttccagtacagtgaccggcgctggtgcttcgacggggagaggaataaccaggtgctagaagaaaacatggacgtcgagatctggaccaaggaaggcgagcgcaagaagctgcggccccgctggctggacgcccggacttactccgatccgttggccctgcgcgagttcaaggagttcgccgcggggcgtcgaagcgtaagcggcgacctgatcctcgagatcggcaagctgccacagcacctgaccctgcgggctcagaacgccctggataacctagtgatgctccacaactccgaacagggagggaaggcctaccgacacgcgatggaagagctaccagatacaatagagacgctaatgctcctcgccctgattgccgttctcaccggaggtgtaaccctgttcttcctgagcgggaaaggcctcggcaagacctctatcgggctgttgtgcgtgacggccagctccgctctcctgtggatggcgagcgttgagccccactggatcgccgcctccatcatactggagtttttcctcatggtcctgttgattccagagcccgaccggcagagaacgccccaggacaaccagcttgcctatgtagttattggcctgctgttcatgattttaaccgtcgccgcgaacgagatggggctgctcgagaccactaagaaagatctcggcatcggacacgtagccgccgaaaatcaccagcacgccactatgctggatgtggatctgagaccagccagcgcgtggacactgtacgccgtcgccaccacggtgattactccaatgatgaggcacaccatcgagaacaccacggccaacatctctctgaccgctatcgcgaaccaagccgccatcctgatgggtctcgacaaagggtggcccatcagcaagatggacatcggagttcccctgctggccctcggttgctactctcaggttaacccgctgaccttgaccgccgccgttctcatgctggtggcccactacgcaattataggccccgggctgcaggccaaagcgacgcgggaggcccaaaaacgcaccgccgccgggatcatgaaaaatcccaccgtcgacggcatcgtagccatcgacctcgatcccgtggtctacgacgctaagttcgagaagcaactgggccagattatgctgctcatcctgtgcaccagccagatactgctaatgaggacgacctgggccctgtgcgagagtatcactttggcgaccgggcctctcacgactctgtgggaaggcagccccgggaagttctggaataccaccatagcagtgtccatggccaacatcttccggggcagctacctggcgggcgccgggctcgccttttccctgatgaagtccctgggagggggccgacgggggacaggcgcacagggtgagaccctcggagagaagtggaagagacagctgaatcagctgtccaagagcgagttcaacacctacaagcggagcggcatcatggaggtggaccgctccgaggcgaaagaggggttgaaacggggcgaaacgaccaagcatgcagtgagccgcgggacggctaagctgaggtggttcgtggagcgcaacctcgtgaagcccgagggcaaggtcatcgacttgggctgcgggcgtggtgggtggtcatactactgcgccggactaaagaaggtgaccgaggttaaggggtacaccaagggtggccccgggcacgaagagccgatccccatggccacctacgggtggaaccttgtcaagctgcacagcgggaaagacgtcttcttcatgccgcctgagaagtgcgatacgctcctgtgcgacatcggcgagtccagcccgaaccctaccatcgaggaggggcgtaccctgcgggtgcttaagatggttgagccatggctgcgcggcaaccagttttgcatcaagatcctgaacccttacatgcctagcgtggtggagaccttggagcaaatgcagcgtaaacacggtgggatgctggtccgcaatccactgagccggaactccacgcacgagatgtactgggtgagctgcggcacgggcaatatcgtgtccgcggtcaacatgactagccgaatgctcctgaaccgatttaccatggcccaccgcaagcctacgttcgagcgcgacgtggacctgggcgccggcacccggcacgtggctgttgagcccgaggtggccaacctcgacatcattgggcagaggatcgagaacataaaaaatgagcacaagtccacctggcactatgacgaggacaacccatacaagacatgggcttaccacggcagctacgaagtgaagccctccgggagcgcttcgagcatggtcaacggcgttgtgcggctgctgacgaaaccctgggatgtcattcccatggtgacccagatcgccatgactgacaccactccgttcgggcagcagcgagtcttcaaggagaaggtcgatacccggacgccgcgggctaagcggggcacaacgcagatcatggaggttacggctaagtggctctggggattcctgagccgcaacaagaaaccccggatctgcactcgcgaggagttcacgcgaaaggttcgctcaaacgcggccatcggggccgtattcgtagacgagaaccagtggaatagcgccaaggaggcggtcgaggatgagcggttctgggacctggtgcaccgcgaacgagagctccacaaacagggcaaatgcgccacgtgcgtgtacaacatgatggggaagcgcgaaaaaaagctgggcgagttcggcaaggccaagggctcccgggcaatctggtatatgtggctgggcgcccgcttcctcgagttcgaggcgcttggcttcatgaacgaggaccattggttctcccgcgagaactccctgagcggcgttgagggggagggcttgcacaaactggggtatatcctgagggacatctccaagatcccaggcggcaacatgtacgccgatgacaccgccggttgggatacccgaatcaccgaggacgacctccagaacgaggccaagatcacagacataatggagcctgaacacgcgttattagcgaccagcatcttcaagctcacgtaccagaacaaggtggtgagggtccagcgccccgccaagaacggcacggttatggacgtgatctcccggcgcgaccagcggggcagcggccaggtcggaacatacggattaaacacttttaccaacatggaggtgcagctgattcgccaaatggagtccgagggcatcttccttccctccgagctggaaactcctaacctggccgagcgggtgctcgactggctcgagaagcatggggccgagcgcttaaagcggatggccatctccggtgacgactgcgtcgtgaagcccatcgatgaccgcttcgcgaccgccctcacggccttgaacgacatggggaaggttcggaaggacataccccagtgggagcccagtaagggctggaacgattggcagcaagtcccgttttgctctcaccacttccaccagctgatcatgaaggatggccgcgagatagtcgtgccttgcaggaaccaagacgaactcgtggggcgcgctcgggtcagtcagggcgccgggtggtccctacgcgagacagcttgcctggggaagtcgtatgcccagatgtggcagctcatgtacttccaccggcgcgatctgcggctggccgccaacgcaatatgctccgccgtgcctgtcgactgggtgcctacctcacgcacgacgtggagtatccacgcccaccatcagtggatgaccacggaggacatgctcagcgtgtggaaccgggtctggatcgaggagaacccgtggatggaggataaaacgcacgtgagttcctgggaggaggtgccctacctggggaagcgcgaggaccagtggtgcggtagccttatcggcctcacagcccgggctacctgggcaacgaacatccaggtcgcaattaatcaggtccggcgcctgatcgggaacgagaactacctggactacatgacctcaatgaagcggttcaagaacgaaagcgaccctgagggtgccctctggtga

SEQ ID NO: 23903 - RNA, 9879 nt, synthetic construct
  misc_feature 1..9879: note = derived and/or modified CDS sequence (opt11) from DENV-1__KJ189306__SS-prME
  source 1..9879: mol_type = other RNA
agcgtaaccatgctgctaatgcttttaccaaccgcgctagcgtttcacctcacgacaaggggaggcgagccacacatgatagtgtcaaaacaagaacgtggtaaatcgctcctattcaaaaccagcgccggagttaacatgtgcaccctaatagccatggacttaggcgagttatgcgaggatacaatgacgtataaatgtccacaaattactgaggctgaaccagatgatgtagactgctggtgcaacgctacagacacatgggtaacctacgggacgtgctcgcaaactggcgagcataggcgcgacaaacggtcagtggccttagcgcctcacgtaggcttaggcctagaaacccgcacggagacttggatgtcatctgagggcgcatggaaacaaattcaacgggtcgaaacgtgggctctccgccacccaggatttactgtgatagcgttgttcctagcccacgccatcggaacctccatcacacaaaaagggatcatattcatactgcttatgcttgtgaccccgtcaatggccatgcgatgcgttggaatcgggaaccgtgacttcgtggaaggcttaagcggagccacctgggtagacgtcgtcctggaacatggctcatgtgtaacaactatggccaaaaacaaacccactctagatatagaactccttaaaacagaagtgacaaacccagcaatattacggaaactctgcattgaagcgaaaataagcaacacaaccacggactcccgatgtccaacacaaggcgaagccactctcgtagaagaacaagacgcgaacttcgtttgccgccgaacattcgtagatcggggctggggcaacggatgcggattgttcggcaagggatccttgctaacctgtgcaaagtttaaatgcgtgaccaagctggaaggcaagatagtccaatatgagaaccttaagtactccgtgatcgtcacggtgcacaccggcgaccaacaccaagtaggaaatgaaacaacagaacacggcacaatagccacgataactccccaggcacccacctccgaaatccaactgaccgattacggagcgctgactctcgattgcagtcctcgcacgggtttggatttcaacgagatggtcttgcttacaatgaaagaaaaatcgtggctagtacacaaacaatggtttctagacctacctctaccgtggaccagtggtgcatcaacatctcaggaaacgtggaaccgacaagatctcctagtgacattcaaaaccgcacacgcgaagaaacaggaagtggttgttctcgggagccaagagggggccatgcataccgccctcacgggcgcgacggaaatacagacatcgggaacaaccacgattttcgcgggtcatctaaaatgcagactcaaaatggacaagctaaccctcaaaggcacatcatacgtcatgtgcacgggccctttcaagctcgagaaagaagtagcggaaactcagcacggcactgtcctggtccaggtaaagtatgaaggaacggacgcgccctgcaagataccgttcctcacacaggacgagaaaggcgtaacgcaaaacgggcgattaattacggcgaaccccatcgtcaccgacaaggaaaagccagtaaatatcgagactgagccaccattcggcgagagctatattgtcgtcggggcaggagagaaagccctaaaactctcatggttcaaaaagggaagtagcataggaaaaatgttcgaggcaacagcaagaggggcccggcggatggctatcttgggcgacaccgcgtgggatttcggaagcataggtggggtctttacaagtgtcggcaagttggtacaccaagtattcggaactgcatacggagtactcttctcaggcgtaagctggaccatgaaaataggaattggaatcctgctgacatggctaggcctgaacagccgtagcactagccttagcatgacatgcatagctgtagggatggtaactctctatctcggtgtcatggtccaggcggacagcgggtgtgtgataaactggaaaggaagagagctcaaatgcggatcgggtatattcgtaacaaatgaggtccacacgtggaccgaacagtataaattccaagccgacagcccgaagcgcctgagtgccgcaatcggcaaagcctgggaagaaggtgtatgcggcatacgatccgctacgaggttagagaacataatgtggaaacaaatatcaaatgagctcaaccatatcttacttgaaaacgatatgaagttcacggtagtcgtcggggatgccaacggaatcctagctcaaggcaagaaaatgatacgcccacagccaatggagcataagtacagctggaagtcatggggcaaagccaaaattattggcgcagacatacaaaacaccacattcataatcgacgggcctgacactccagaatgcccggacaaccaacgtgcttggaatatatgggaggtagaagactacggcttcggaatcttcaccacgaacatctggctcaagctacgggactcatacacccaaatgtgcgaccacagactaatgtctgcggcaataaaagactcaaaggcagtacacgccgacatgggatactggatagaatcagagaaaaacgagacgtggaagctcgctagagcgtccttcatcgaggtgaaaacatgtacgtggccgaaaagccatacgctgtggtcaaatggcgtactcgagtccgagatgatcataccaaaaatttacggtggaccgatcagccagcataattaccggcctgggtatttcacgcaaacagccggaccgtggcacctaggcaaactagaattagatttcgacttgtgcgaaggcacgacggtagtagtagacgaacattgcggcaatagaggccctagcctccgtaccactaccgtaaccggtaagataatacatgagtggtgttgcaggagttgcaccctacccccactaaggttcaggggagaagacgggtgctggtacggcatggaaattcgaccggtaaaagaaaaagaggaaaatctcgtccgctcaatggtgagtgcgggcagtggagaggtagactcattttccctcgggatattatgtgtatcaatcatgatcgaagaagtgatgagaagcagatggtcgcgaaagatgttgatgaccggaactctggcggtgttcctacttttagtgatgggacaactcacatggaacgaccttattcgactgtgcataatggttggagcgaacgcgtccgatcgcatggggatgggcacaacctacctcgcgctgatggcaaccttcaagatgcgccccatgttcgctgtaggactcctcttcaggcgcctcacgagccgagaggtcctgcttctaacaatcggcctcagcctagtagcctcagtcgaactccccaactcgctagaagaacttggggacggcctcgccatgggcataatgatgttgaaactcctgacagagttccaaccgcatcagctatggactacactactgtccctgactttcataaagacaacattgtcattggactatgcatggaaaaccacagccatggctctaagcatagtatccctattcccactatgcctctccaccacatctcagaaaacgacttggctcccagtactgctgggcagctttggatgcaaacccctaactatgtttcttataactgaaaacaagatatggggccgtaaatcgtggcctttgaatgagggcatcatggcgattggaatagtcagtatacttctcagtagcctactgaagaacgacgttccactggccggcccactcatagccgggggcatgctcatcgcatgttacgtgatatcgggatccagtgcggacctatcattagaaagggcggccgaagtctcgtgggaacaagaagcagaacactcgggaactagccacaatatcctagtggaagtgcaagatgatggcaccatgaagatcaaagatgaagaacgagacgatacgctaaccatcctcctaaaagccacgctactagcggtgtcgggcgtatacccgatgtccatccctgccacactcttcgtatggtacttttggcagaagaagaaacaacgatcaggagtactctgggacaccccgtcaccaccagaggtcgaaagagccgtcctggacgatggcatctaccgaatacttcagaggggcctcctcggtagaagccaggtcggcgtaggcgtcttccaagacggagtctttcataccatgtggcatgtgacaagaggagctgtgttaatgtaccaagggaaaaggttagaaccttcttgggcttcggtcaagaaagacctaatatcatacggtggcggatggcgttttcagggctcatggaataccggggaagaagtccaagttatcgcggtagagcccgggaagaaccctaaaaacgttcaaacgacgccgggcacatttaaaacgcctgagggcgaagttggagcgatcgctctcgactttaaaccaggcacctcaggatcccccatcgtaaaccgcgagggaaaaatcgtgggactttacggaaacggcgttgtaacaacgagcggtacgtacgtaagcgcaatagcccaggcaaaggcttcgcaggaagggcccttgccagagatagaagatgaggtattcaagaagagaaacctaaccatcatggacttacaccccgggagcggaaaaacacgacggtacttgcctgcaatagtgcgggaggcaatcaaaagaaaacttcgcactctaattctcgcaccgacgcgggtagtcgcatccgagatggcagaagctcttaaggggatgccaatccgataccaaacaaccgcagtaaaatcagaacacacaggccgagaaatagttgacctgatgtgccacgcgactttcaccatgaggctgctgtcaccggttagagtcccgaattacaacatgatcattatggacgaagcccacttcacggacccggccagcatagcggcgcgggggtacatttccaccagagtgggaatgggagaggcagcagcgatcttcatgacggccacacccccgggctccgtcgaagcattcccacagtccaacgccgtgattcaagacgaagagagagacatccctgagcgaagctggaacagcggatacgattggataactgatttccccggtaagacagtgtggtttgtgccctcgataaaatcgggaaacgacattgccaactgcctgcggaaaaatggcaaaagagtcatacagctctccagaaaaacatttgacaccgagtaccagaagaccaaaaacaacgattgggattacgtagtgacgactgatatcagcgaaatgggtgcaaacttcagagcggatcgagtaatagacccacgccgatgtctaaagcccgtcatactgaaagacggcccagaaagggtaatcctagcgggacctatgcctgtcacagttgcgagcgccgctcagcggaggggccgcatcggacgaaatcagaacaaggaaggagaccaatatgtatacatggggcaaccactaaacaacgacgaagaccacgctcactggacagaggccaaaatgttactcgacaatatcaatacgccagaaggaattataccagcactgttcgagccagagcgggaaaaatcagcagcaattgatggtgaataccgcctacgaggggaagcaaggaaaactttcgtagaactaatgcgacggggagacctaccagtctggctttcctacaaggtagcaagcgaaggattccaatattcagacagacgctggtgctttgacggggaacggaacaaccaggtcttagaagagaacatggacgttgagatatggaccaaagaaggcgaaaggaagaaattacggcctagatggctggacgcgaggacctactctgaccccttggctttgagggaatttaaggagttcgccgcgggacgccgaagcgtatccggcgacctcatactggagataggcaaactaccccagcacctcaccctacgagcccaaaacgctttagacaacctggtgatgctacataactccgagcaaggaggcaaagcgtacagacacgcaatggaagaactgccggacacgatcgaaaccttaatgctcctcgcactaatcgccgtgcttacagggggagtcacactgttctttctctccggtaaaggcctcgggaaaacatcaatcggtttgctctgcgtaaccgccagcagcgcactattatggatggcaagcgtcgagccccactggatagcggcaagcatcattctagagtttttcctaatggtactactcatccctgagccagatcggcagcgaaccccacaagataaccaacttgcgtacgtagttataggtctactgttcatgatcttaacagtggcggcgaacgagatgggactcctagagacaacgaagaaagacctcggcataggtcacgttgcagctgaaaatcaccaacatgcaacaatgctcgatgtcgatctacgccccgccagcgcatggactctatacgctgttgccacaacggttatcacaccaatgatgagacatacaattgagaacaccaccgcaaacatctcactgaccgcaatagccaaccaggcggcgatcctaatgggcctcgacaagggctggccgatatccaaaatggatataggagtacccctcctcgccctcggctgttacagccaagtaaatcctctgacactgaccgcggccgttctaatgctagttgcacactacgcgatcattggaccaggactccaagccaaggcaacccgggaggcgcaaaagcgcaccgctgccggcataatgaagaacccaacggtagacggcatcgtcgcaatcgatctcgacccagtagtgtacgacgccaagttcgaaaaacaattggggcaaataatgttgcttattttgtgtacatcccagatcctcctaatgcgaaccacctgggccctatgcgaatccatcaccttagccaccggacccctaacaacgctatgggagggctcacccggaaaattttggaacacaaccatcgcagtatccatggccaacatcttccgaggctcatacctggccggagccggactagcgtttagcctgatgaagagtttgggaggcggacgcaggggtaccggagctcaaggagaaacactgggagagaagtggaaaaggcagctaaatcaactcagcaaaagcgagtttcatatatataaacgctcgggcataatggaagtagaccgctccgaagcgaaagaagggcttaagcgaggagaaactacgaaacacgcagtctcacgcggcacggcaaaactgagatggttcgtcgaaaggaatctcgtaaagcccgaaggcaaagttatagaccttggatgcggcagagggggctggagctattactgcgcagggctcaaaaaggtcaccgaagtcaaggggtacacaaagggcggccctggacacgaagaacccatacccatggcaacatacggttggaacctcgtcaaactccacagtggaaaggacgtgttcttcatgccgccggaaaagtgtgacaccctactatgcgacataggggaaagctccccgaacccaaccatagaagaaggacgtacgctacgagtgttaaaaatggtagaaccatggcttcgtgggaatcagttctgcattaaaatactaaacccgtacatgccgtcagtagtagagacgcttgaacaaatgcagcggaaacacggagggatgctcgttcggaatcctctctctcgaaacagcacgcatgaaatgtattgggtatcttgcggaactggaaatatagtaagcgccgtcaacatgacaagtcggatgttgctaaaccgattcaccatggcccaccggaagcctacctatgagagagacgtcgacctaggggccggcaccaggcacgtggcagttgaaccggaagtggcaaaccttgacatcataggccaaaggatagaaaatatcaaaaatgaacacaagagtacttggcactacgacgaggacaatccgtataagacgtgggcctatcatggctcatacgaggtcaaaccaagtggaagcgcaagctccatggtgaatggagtagtaaggttgctgactaaaccttgggacgtgatacccatggtgacccaaatagccatgacagatacaacaccctttggacagcagagagtctttaaggaaaaagtggacacccgcacaccccgagcaaagagggggacaacgcagatcatggaagttacggcaaagtggttatggggcttcttgagcagaaacaagaaaccacggatctgcacacgggaggagtttatcaggaaagtgcgcagcaacgcagccatcggcgcggtgttcgttgacgaaaaccagtggaactcagcaaaagaggcggtcgaggacgagagattttgggacctagtccaccgcgaacgagaattacacaagcaaggcaaatgcgcgacgtgtgtctacaacatgatgggcaaaagagagaagaaactgggggagttcggcaaggcaaagggcagtagagcgatttggtatatgtggctcggcgcacggtttctcgagttcgaagccttgggattcatgaacgaggaccactggttctcacgggagaactcactatcgggcgtagaaggtgaaggtcttcataaactcggctatatccttcgcgacatcagcaaaataccgggtgggaacatgtacgcagatgacacggcaggctgggacacccgcataacggaagacgacctccaaaacgaggcaaaaataacagagattatggaacccgagcacgcactgttagcaacaagcatctttaaacttacctaccaaaacaaagtagtaagagtgcagcgcccagccaagaacggaacagtaatggacgtaatcagtcgacgggaccagcgggggtcaggtcaagtaggaacctacggcttaaacaccttcacgaacatggaggtacagctcatacggcaaatggagtccgaaggcatcttcctccccagcgaattagagacgcccaatctagcggagcgggtattggactggctagaaaaacatggagcggaacggctaaagcgcatggcaatatctggtgacgactgcgtcgtaaaaccgatagacgaccgttttgcaacagcactaaccgcgctgaatgatatgggcaaagtacgcaaagacataccccaatgggagccctcaaaaggttggaacgactggcaacaagtcccattctgctcccatcactttcaccagctcataatgaaggacggaagagagatagtcgtcccgtgccgcaaccaagacgagttggtgggacgagcacgagtcagccaaggggccggttggtccttgcgcgaaaccgcctgcctgggaaaatcctatgctcaaatgtggcaactcatgtacttccacagacgcgacctacgcctagcggccaacgctatctgctcggccgtaccggtcgactgggtaccgacctcgcgcaccacctggtcaatacacgcgcaccatcaatggatgacaacggaagacatgctgagcgtctggaatcgggtctggatcgaagagaacccatggatggaagacaagacccacgtatcaagttgggaagaagtaccatacctgggcaaacgggaagaccaatggtgcgggagcttgatcgggctaactgcaagagcaacatgggccacaaacatacaagtggcaatcaaccaagtccggcgactgataggcaacgaaaattatctcgactacatgacctcgatgaagcgattcaaaaacgaaagcgaccccgaaggagccctgtggtga

SEQ ID NO: 23904 - RNA, 9879 nt, synthetic construct
  misc_feature 1..9879: note = derived and/or modified CDS sequence (opt11) from DENV-1__KJ189307__SS-prME
  source 1..9879: mol_type = other RNA
agcgtgactatgctgcttatgttgctgcccactgctctggccttccacctgactacccgcggcggagagccgcatatgattgtatccaagcaggagcggggaaagagcctgcttttcaaaacctccgcgggggtgaacatgtgcaccctgatcgccatggacctgggtgagctctgcgaggacacgatgacctacaagtgcccccagataaccgaggccgagcccgatgacgtggattgctggtgcaacgccaccgacacatgggtcacgtatgggacgtgctcgcagactggcgagcaccgccgggacaaaagaagcgtggcccttgcgccccatgtgggcctgggcttagagacgcggaccgagacctggatgagctccgagggcgcctggaaacagattcagcgcgtcgagacctgggccctgcggcaccctgggttcacggttatagccttcttcctggcgcacgcaatcggaaccagcatcacgcagaaggggatcatctttatcttgctgatgctggtgaccccctctatggccatgcgctgcgtcggcatcggcaaccgggacttcgtggagggcctcagcggcgccacgtgggtcgacgtcgtgctggagcacgggtcctgcgtaacaaccatggccaagaacaagcccaccctggacatcgagctcctgaagacggaggtcaccaacccggcgatcctgcgcaagttatgcatcgaggctaaaatctccaataccaccacggactccaggtgcccgacacagggcgaggccaccctggttgaggagcaggacgccaatttcgtgtgccgccgtacattcgtcgaccgcggctggggcaacggttgcgggctgttcggcaagggctcactcctgacttgcgccaagttcaagtgcgtgacaaagcttgaaggcaaaatcgtgcagtacgagaaccttaaatactccgtcatagtcaccgtccataccggcgaccagcaccaggtcgggaacgagacgacagaacatggcaccatagcgaccatcacgccccaggcccccacgagcgaaatacagctgaccgactacggtgccctgacactcgactgttccccgcgaaccggcctggatttcaacgagatggtgctgctcacgatgaaggagaagagctggcttgtccacaagcagtggttcctggatctcccgctgccctggacctccggggcctctaccagccaggagacgtggaaccgccaagacctgctcgtaacgttcaagaccgcacacgcgaagaagcaggaggtggtcgtgctgggctcacaagagggcgcaatgcataccgctctaaccggggccacggagatacagaccagcggcaccaccacgatcttcgccggtcacctcaagtgcaggctgaagatggacaagcttacccttaagggcacctcctatgtgatgtgtaccgggagcttcaagttggagaaggaggtcgcggagacgcaacatggtacagtgctggtgcaggtcaagtacgagggcaccgacgccccctgcaagatccccttctccacccaggacgagaagggggtgacacagaacggccgcctgatcaccgccaacccgatcgtgaccgacaaagagaagcccgttaacattgaaaccgagcccccctttggggagtcttacattgtcgtgggagccggagagaaggctctcaagctgtcctggttcaaaaaggggagctccatcggcaagatgtttgaggccacggcccggggggcccgccgcatggcgatcctgggcgacaccgcgtgggacttcgggagcatcggcggggtcttcacctcggttggtaaactcgtgcaccaggtctttggcaccgcctacggggtgctgttcagcggcgtgagctggacgatgaagatcgggatcggcattctgctcacttggctgggcctgaattctcgctccaccagcctcagcatgacatgcattgccgtcgggatggtcacgctgtatctgggcgtgatggtccaggccgactccgggtgcgtgatcaactggaagggcagggagttgaagtgtgggtccggcatcttcgtgaccaacgaggtccacacttggaccgagcagtataagttccaggctgacagcccgaagcggttgtctgcggcgatcggcaaggcctgggaggagggggtgtgcggcatccgctccgctacacggctggagaacatcatgtggaagcagatcagcaacgagctcaaccacatcctgctggagaacgacatgaagttcacggtggtcgtgggggacgccaacggcattctcgcgcaggggaagaaaatgatccggccgcaacccatggagcacaagtactcctggaagagctggggcaaagccaaaatcatcggcgcggacatccaaaacaccaccttcatcatcgacgggcctgacactccggagtgccccgacaaccagagggcctggaacatttgggaggttgaggattacggctttggtatcttcacgaccaacatctggctgaagttgcgcgacagctacactcaaatgtgcgaccacagactcatgagcgcggccatcaaagactccaaggccgttcatgccgacatgggctactggatcgaatccgagaagaatgaaacctggaagttggcccgcgcgtctttcatcgaggtgaagacgtgcacgtggcccaaatcacacaccctgtggtccaatggtgtgcttgaaagcgagatgatcatccccaagatctacgggggcccgatctcccagcacaactaccggcccggttatttcacccagacagcaggcccctggcacctgggcaagctggagcttgactttgacctgtgtgagggcaccaccgtcgtggtggacgagcattgcggaaatcgcgggccgagcctgcggaccacgaccgtcaccggcaagataatccacgagtggtgctgccgctcctgcacgctcccccccctgcgattccgcggggaggacggctgctggtacgggatggagatccggcccgtgaaagagaaggaggaaaacctggtgcgaagcatggtatccgccggcagcggcgaggtcgacagcttctccctcgggatcctgtgcgtgagcatcatgatcgaggaggtcatgcggtcccgatggagccggaagatgctgatgacgggcaccctcgctgtgttcctgttattggtgatggggcagctgacctggaacgacctcatccgcctctgcattatggtaggcgccaatgcgtctgatcgcatggggatggggaccacgtacctggcgctgatggccactttcaagatgcggccgatgttcgccgtgggtctcctgttccgccgactgaccagccgcgaggtgctcctgctgacaattgggctctccctggtcgccagcgtggaactgcccaactccctcgaggagctgggcgacgggctggcgatgggcattatgatgctgaagctactgaccgagtttcagccccaccagctctggaccacccttctgagcctcaccttcatcaaaacgaccctgtccctggactacgcctggaaaaccactgctatggccctcagcatcgtctcccttttccccctgtgcctcagcaccacctcccagaagactacctggctgccggtgctgctaggtagcttcgggtgcaagccgttgaccatgttcctcatcacggagaataagatctggggcagaaagagttggcccttgaacgaggggatcatggccatcggaatagtgtcgatactgctgtccagcctcctgaagaatgatgttcccttagccgggccactcatcgcaggcggtatgctaatcgcctgctacgtgattagcggatccagcgctgacctgtcgctcgagaaggcggcagaggtcagctgggagcaggaggccgagcactccggaacgagccacaacatccccgtcgaggttcaagacgatgggaccatgaagataaaggacgaggagcgcgatgacaccctgacgatcctgctcaaggccaccttgctggccgtgtctggcgtctaccccatgtccattccggcgaccctctttgtgtggtacttttggcagaagaagaagcaacggagtggcgtgctgtgggacaccccgagcccccccgaggtcgaacgcgccgtgctcgatgacggcatctatcggatactccagcgcggactgctggggcgttcccaagtgggcgtcggggtgttccaggacggcgttttccatacgatgtggcacgtcacccgcggagccgtgctgatgtatcagggcaagcggctcgagccgagttgggcctccgtgaagaaggacctgataagctacggagggggctggcgcttccaggggtcctggaatactggagaggaggttcaggtcatcgccgtggaaccagggaaaaatcccaaaaatgtccagaccacccccggcacgttcaagacgcccgagggtgaggtgggggcaatcgccctggactttaagccgggcaccagcgggtcccccatcgtgaaccgggaaggcaagatcgtcggattatatgggaatggcgttgtcacgaccagcgggacgtacgtctccgccatcgcccaggccaaggcgagccaagagggtcctctgccggaaattgaggatgaggtgttcaagaagcgcaacctgaccatcatggacctccatcccggtagcggcaagacgcggcgctacctgcccgccatcgtccgggaggccattaagcgaaagctgcggactctcatccttgcgccgacccgcgtcgtggcgtccgaaatggccgaagccctgaagggcatgccgatccgctaccagactacggccgtaaagagcgagcataccggacgtgagatcgtcgacctcatgtgccacgcaaccttcaccatgcgcctgctgtcccccgtgcgggtgcccaactataacatgatcatcatggacgaagcgcacttcacggacccggccagcatcgccgcccgcggctacatctccactcgggtcggtatgggtgaggccgcggccattttcatgaccgccaccccgccaggaagcgtggaggcgtttccccagtcaaacgccgttattcaggatgaggagcgcgacatccccgagcggagctggaactccggctacgactggatcaccgattttccaggtaagaccgtctggttcgtgcctagcatcaagtccgggaatgacatcgctaactgcctccgcaagaacggcaagcgtgtgatccagctgagccgcaagactttcgacaccgagtaccagaagacgaagaataacgactgggactacgtcgtgaccaccgacatttcggagatgggggcaaacttccgggccgatcgcgtgatcgaccctcgtcgctgcctgaagcccgtaatcctcaaggacggaccggagcgggtgatactggccgggcctatgcccgtgaccgtcgctagcgccgcccagcgcaggggccgtatcggcaggaaccaaaacaaagagggggaccagtacgtgtacatgggccagcccctcaacaacgacgaggaccacgcccactggacggaggccaagatgctcctggataacatcaacaccccggaggggatcatacccgctttatttgagccagagcgcgagaagaacgccgccatagacggcgaataccgactccggggtgaggcccgcaagactttcgtcgagctgatgcggcgcggcgacctgcccgtgtggctctcctacaaggtggccagtgagggcttccagtactccgaccggcgatggtgcttcgacggagaaagaaacaaccaggttctggaagaaaatatggacgtagagatctggacaaaggagggcgagcgcaaaaagctgcggccgcgctggctcgacgcgaggacctatagcgatcctctggccttacgcgagttcaaggagttcgccgccgggcggcgcagcgtgagcggcgacctcatactggaaatcggtaagctgccccagcacctaacgctgcgcgcccagaacgcgctggacaacctcgtaatgctgcacaatagcgaacaagggggcaaggcttaccgccacgccatggaggagctgcccgataccatcgagaccctcatgctgctggccttaatcgcggtgctgaccggcggcgtgacactctttttcctctccggcaagggccttgggaagactagcatcgggctgctctgtgtcacagcgtccagcgcccttctttggatggcttccgtggagccgcactggatcgcggcgagcatcattctggagttcttcttgatggtactgctcatccccgagcctgaccggcagcgcaccccgcaggataaccagctggcgtacgtcgtgatcggccttctgttcatgatcctcacggtggccgctaacgagatgggtctgctcgagacgaccaagaaagacctgggcatcgggcacgtcgccgcggaaaaccaccagcacgccaccatgctggacgtggacctccggcccgccagcgcctggacgctgtatgcagtggcaaccaccgtaatcacccccatgatgcgccacacgatcgagaacaccactgccaacatcagtctgaccgccatagctaaccaagccgcgatactcatgggcctggacaagggctggcccatttccaagatggacataggggtgccgttgctcgcgttaggctgctatagccaggtgaatcccctaacgcttaccgccgccgtcctaatgctggtggcgcactacgccatcattgggcccggcctccaagctaaggccacccgagaggcccaaaagcgcaccgcggccggcatcatgaagaaccccaccgtggacggcatagtcgcgattgacctggatcccgtggtgtacgacgccaagttcgaaaagcagctgggccagatcatgctcttaatcttgtgcacttcccaaatcctcctgatgcgcaccacctgggcactgtgcgagtcgatcaccttggcgaccgggcccctgaccaccttgtgggagggttcccccgggaaattttggaacacgaccatcgccgttagcatggccaacatcttccggggatcctacctagccggcgcagggttagcgttcagcctgatgaagtccctcggagggggccgccgcgggaccggtgcgcagggcgagaccttaggggagaagtggaagcgccagctgaaccagctcagcaagtcagaattcaacacgtacaaaagaagcggcatcatggaggtcgaccgcagcgaggccaaggaaggtcttaaacggggcgagaccaccaagcacgcggtgtcacgcgggacggcaaagctgcggtggttcgtcgagcgtaacctcgtgaaaccagagggcaaggtgatcgacctgggctgcgggaggggcgggtggagctattactgcgccggtctgaagaaggttacggaggtgaaggggtatacgaagggcggaccggggcatgaggagcccatccccatggccacctacgggtggaatttggtgaagctacactccgggaaggacgtcttcttcatgcccccggaaaagtgcgataccctgctgtgtgacatcggcgagagctcccccaaccctaccattgaagaggggcgcacgctccgggtgctgaagatggtagagccctggctgcgcggcaaccagttctgcatcaagatcctcaatccctacatgcccagcgtcgtggagaccctggagcagatgcaacggaaacacggcgggatgctggtgcggaacccgctcagccgaaacagcacccacgagatgtactgggtcagctgcggcaccgggaacatcgtgagcgccgtgaacatgacgtcccgcatgctgctcaaccggttcaccatggcccatcggaagcccacatacgagcgcgatgtcgacctcggcgcgggcacccggcacgtcgccgtggagccagaggtcgccaacctggacattatcgggcagcgcatcgagaacatcaagaacgagcacaagagcacgtggcactacgacgaggacaacccctacaaaacctgggcctatcacggctcctacgaggtgaagcccagcgggtccgctagctccatggttaacggcgtagttaggctactcaccaagccatgggacgttatccccatggtgacacagattgctatgacggacaccacccccttcggccagcaaagggtgttcaaagaaaaggtcgacacccggacgccgcgcgcgaaacggggcaccactcagatcatggaggtgaccgccaaatggctgtggggattcctgagccgcaacaagaagccgcggatctgcacgcgggaggagttcacccgcaaggtgagatccaacgccgccatcggagcggtcttcgtagacgagaatcagtggaactcagccaaggaggccgtggaggacgagcggttctgggacctcgtccatcgggagcgggaactgcacaaacagggcaagtgcgccacttgcgtttataacatgatggggaagcgcgagaagaagctgggcgagttcgggaaggcgaagggcagccgggccatctggtacatgtggctcggcgcacgcttcctagaattcgaggcgctggggttcatgaacgaggaccactggttttctagagagaacagcctgagcggcgtggagggagagggcttacacaagctggggtatatcctcagagacatctcgaagattcccggcggcaacatgtacgccgacgacaccgcggggtgggacacgcggatcacggaagacgacttgcagaacgaggctaagatcaccgagattatggagcccgagcacgccttattagccacatccattttcaagctgacgtaccagaacaaggtcgtgcgcgtccagcgccccgccaagaacggcaccgtcatggacgtgatatcccggcgagaccagcgggggagtggacaagtgggtacctacggtctgaacaccttcacgaacatggaggtccagctgattcgccagatggaaagcgagggtatcttcttaccgtccgagctggagacccccaacctcgccgagcgggtgctggactggctggagaagcacggggccgaacgcctcaagcggatggccatcagcggcgacgactgcgtggtcaagcccatcgacgaccgcttcgccaccgctctgaccgcgctgaacgatatggggaaggtgagaaaggacataccgcaatgggagccctccaagggctggaatgactggcaacaggtgcccttctgcagccaccacttccaccaattaattatgaaggacggcagggagattgtcgtgccttgccggaaccaggatgagctggtgggccgagcccgggtctcccaaggtgccgggtggagcctgcgtgagacagcctgcctcggtaagtcctatgcccagatgtggcagctgatgtacttccaccgccgtgacctgcggctcgcggccaacgctatctgctcggccgtgcccgtcgactgggtcccgacgtccagaaccacatggagcatccacgcgcaccaccaatggatgaccacggaggacatgctgagcgtttggaacagagtgtggatagaggagaacccctggatggaggacaaaacccacgtctccagctgggaagaagtgccctacctggggaagagagaggaccagtggtgcggttccctcataggcctgaccgcccgcgccacgtgggctacgaatatccaggtggccatcaaccaggttagacgtcttatcggaaacgagaactatttagactacatgaccagcatgaagcggttcaaaaacgagtccgaccccgagggcgcgctttggtga

SEQ ID NO: 23905 - RNA, 9879 nt, synthetic construct
  misc_feature 1..9879: note = derived and/or modified CDS sequence (opt11) from DENV-1__KJ189318__SS-prME
  source 1..9879: mol_type = other RNA
tccgtgaccatgctcctcatgctgctccccaccgctctcgcgttccacttaaccaccagagggggcgaaccgcatatgatcgtgtccaagcaggagcgaggcaaaagcctcttgttcaagaccagcgctggggtgaatatgtgtaccttgatagccatggatctaggcgagctctgcgaagatacgatgacctacaagtgtccccagatcacggaggctgagcccgatgatgtggactgctggtgcaacgctacggacacgtgggtcacttatggtacctgtagccagaccggcgagcaccggcgggacaagcgcagcgtggcactggcgccccacgtgggcctgggtctggaaacccggacggaaacctggatgtcatccgagggcgcttggaagcagatacaacgcgtcgagacgtgggcattacgtcaccccggtttcactgtgatcgcgctgtttctcgcgcacgcgatcgggaccagcattacccaaaaggggatcatatttatcttgctgatgctcgtgacaccctcgatggctatgcgctgcgttgggattgggaaccgggatttcgtggaggggctgagcggggccacgtgggttgatgtcgtgctcgaacatgggtcctgcgtgacgaccatggccaagaacaagccgaccctggacattgaactgctcaagacggaagtcacaaatcccgcgatcctccgcaaactttgcatcgaggcgaaaatcagcaataccacaacggacagccgctgtcctacccagggcgaagccacgctggtggaagaacaggatgctaactttgtttgccggcgcacctttgtcgaccgcggttgggggaatgggtgcggccttttcggtaaggggagcctattaacgtgtgccaaattcaaatgcgtgacgaagctggagggcaagatcgttcaatatgaaaacctgaagtactccgtcatagtgacagtccacacaggcgatcaacaccaggtcgggaacgagacgactgagcacggcaccatcgcgacgataacaccccaggcacccacgagcgagatccaactgacggactacggggccttgaccctggactgcagcccccgtaccgggctggacttcaatgaaatggtgctcctgacgatgaaggagaagtcctggttggtgcacaagcagtggttcctagacctgccgctaccctggacgtccggggcgtcgaccagtcaggaaacctggaaccgccaggacctcttagtcacgttcaagacagcccacgctaagaagcaggaggtcgtcgtgctgggctctcaggagggggcgatgcataccgccctaacaggggctacagagatacagacgagcgggactaccacgatattcgccgggcacctgaagtgccggctaaagatggataaactgacattgaaggggacttcgtacgtgatgtgcaccggttctttcaagctagagaaggaggtcgcggagacgcaacatggcaccgtccttgtccaggtcaagtacgagggtacagatgccccgtgtaagatcccgttcagcactcaggacgagaagggggtgactcaaaacggtcggttaataacagccaacccgatcgtaaccgacaaggagaagcccgttaacatcgagaccgagccgcccttcggtgagagctacatcgtggtgggagccggcgagaaagccctgaaactgagctggttcaaaaagggatcttcaatcggcaaaatgtttgaggccacggcacgcggcgctcgcaggatggccatcctgggtgacaccgcgtgggattttggaagtataggcggcgtcttcacctccgttggcaaattggttcaccaggtttttgggaccgcttacggcgtgctgttctcaggtgtgagctggacgatgaagataggaatcgggatcctcctgacttggctgggattaaacagccgatccaccagcctgagtatgacttgcatagccgttgggatggtaacgctgtacctcggcgtcatggttcaagccgactcaggctgcgttatcaattggaagggcagagagttaaagtgcgggtccggcatcttcgtcacaaacgaggtccatacctggactgaacagtacaagttccaggcggattcacctaaacgcctgagcgcggctatcggcaaagcctgggaggagggtgtgtgcgggatccgctcagccaccagactcgagaacatcatgtggaagcagatttccaacgagctgaaccatattttactcgaaaacgacatgaaattcactgttgtcgtcggagacgccaacggcatcttggcccaagggaaaaagatgattcgcccgcagcccatggagcataagtattcttggaagtcgtggggcaaggccaagatcatcggcgccgatattcagaacaccaccttcatcatcgatggtccggacaccccggaatgccccgacaaccaacgggcctggaacatctgggaggttgaggactatggattcgggatatttacgaccaacatctggctcaagttacgcgacagttatacgcaaatgtgcgatcatcggttgatgtctgcggcaatcaaggactcaaaggcggtccacgccgatatgggctactggattgagagcgagaagaatgagacctggaaactggcaagagcctcttttatcgaggtaaaaacatgtacctggccaaagagccatactttatggtctaatggcgtgctggaaagcgagatgataatacccaagatatacggcggcccgatctctcagcataactatagacccggctactttacccagacagccgggccctggcaccttgggaagctggagctggacttcgacctgtgtgagggtaccaccgtcgttgttgatgagcattgcggcaaccgcgggccgagtctgaggaccacgaccgtcaccggcaagatcatccacgagtggtgttgccgctcctgcaccctgccgcccctacggttcagaggggaagacggttgctggtatggtatggagatacgtccggtgaaggagaaggaggagaacttggtacgctccatggtcagcgccggaagtggcgaggtagacagcttctcactcggaatcctgtgtgcctcaatcatgatcgaggaggtgatgcgatcccgctggtcgcggaagatgctgatgactggcactctggcggttttcttgctcctcatcatggggcagttgacctggaacgacctgatccgcctgtgtatcatggtgggcgcgaatgccagcgacaggatggggatgggtactacgtacttagcccttatggccaccttcaagatgcgtccgatgttcgcagtgggcctgctgtttcgccgcctcacaagccgggaggtcttattgttgaccatcgggctgagcctggtagcgtcagtcgagctccccaactcactggaggaactgggcgatggtctcgcaatgggcataatgatgctgaagctgctcacggagtttcagccccaccagctgtggacgaccctgctcagcctgacgttcataaaaaccaccctgtctctcgactacgcgtggaagaccacagcaatggcgcttagtatagtttcactgtttccgctctgcctgtcaacgacctcccaaaagactacgtggctgccggttctgctagggagcttcgggtgcaaacctctgaccatgttcctcattactgagaacaaaatctggggacgcaagtcatggcccctgaacgaagggatcatggcgatcggcatcgtctcgattctgctctcaagcctcctcaagaacgacgtgccgctcgccgggccgctcatagccggcggcatgctgatagcctgttacgtaatctccgggtcctccgcggacctcagccttgagaaaaccgccgaggtaagctgggagcaggaggccgagcattccggcaccagccacaatatattggtcgaggtgcaagatgacggcacaatgaagatcaaggacgaggaacgcgacgacacgctcaccatcctccttaaggcaacactcctagccgtctccggcgtgtaccccatgagcatccccgcgaccctcttcgtttggtacttctggcagaagaagaagcaacggtccggagtgttatgggacacgcccagtccacccgaggtggagagagcagtgctggacgatggcatataccggattctgcagcgcggcctgcttggacggagtcaggtcggcgtaggggtcttccaggacggagttttccacaccatgtggcacgtaacccgcggggctgttctaatgtaccaaggcaagcggcttgagcccagctgggcgtccgtaaagaaggacctcatctcttacggagggggctggaggttccaaggctcttggaacacgggtgaggaagtgcaggtcatcgctgtcgagcccgggaaaaaccccaagaacgttcagacgacgcccggaacgttcaagacccccgagggggaggttggggcgatcgcactagatttcaagcccggcacgtccggatctccgatcgtgaaccgcgagggcaagattgtgggcttatacggaaatggggtcgttacaactagcggaacgtatgtgtcggctatagcacaggccaaggcgtcccaggaaggacccctcccagagatcgaggacgaggttttcaagaaacgcaacctgacgatcatggacctgcacccggggtctggcaagacgcggcggtacctcccagctattgtccgagaggctatcaaacgaaagctgcgtactcttattctagctccgacccgcgtggttgcgtccgagatggccgaggctctaaaggggatgcccatacgttatcagacaaccgccgtcaaaagcgagcacacaggtcgagagatagtggacctcatgtgccacgccacgttcacgatgagactcctgtcccctgtccgggtacctaactacaacatgatcataatggacgaagcgcacttcacggaccccgcctctatcgccgcgcgaggctacatctcaacgcgggtaggaatgggggaggccgcggcaatcttcatgaccgccacgcccccggggagcgtggaggccttcccccagagcaacgcggtcatccaagacgaggagcgcgacatcccggaacggagctggaacagtggctacgactggatcaccgatttccccggcaagaccgtatggttcgtgccgagcatcaagagcgggaatgacatcgccaactgcctgcgcaagaacggcaagagggtcatccagctcagcaggaagacctttgacaccgagtatcagaagaccaagaacaacgactgggattacgtagtgaccaccgatatctccgagatgggtgcaaacttcagggccgatcgcgtcatagacccacggcgctgcctaaagcccgtgatcctgaaggatggccccgaacgggtcatcctcgctgggcctatgcccgtcaccgtcgcgagcgccgcccagcgtaggggtcgcatcggacggaatcaaaacaaagagggagatcagtatgtgtacatggggcagcccctgaataacgatgaggaccacgctcactggacagaagctaagatgctgctcgacaatatcaacactcccgaggggatcatcccagcactgtttgagcccgagcgtgaaaagtccgccgcaatcgacggggagtaccgcctgcgcggggaggctagaaagacttttgtagaactcatgagaaggggcgaccttccggtgtggctatcatataaagttgccagcgaggggttccaatacagcgaccggcgatggtgctttgacggagagaggaataaccaggtccttgaagagaacatggatgtggagatctggaccaaggagggcgagcgcaagaagctgcggccgcgatggttagacgcgcgcacttattccgaccccctcgccctgcgggaatttaaggagttcgccgccggccgtcgcagcgtcagcggagacttgatcctcgagattggcaaactgccccaacacctgaccttgcgtgcacagaatgcgctggacaaccttgtgatgctccacaattccgaacagggcgggaaggcatacagacacgccatggaggagcttcccgatacgattgagacgctcatgctcctagccctcatcgcagtactcaccggcggcgtcaccctgttctttctgagcggaaaggggctcggcaagacctccatcggtctgctgtgcgtgactgctagctctgccttgttgtggatggcaagcgtagagccccactggatcgccgcatcgatcatcctagagttcttcctaatggtactgctgatcccggagcccgaccggcagcgcacaccccaggacaaccagcttgcttatgtggttataggcctgctgttcatgatcctgaccgtagccgccaacgaaatggggcttctggagacgaccaagaaggacctcggcatcgggcatgtggcggccgaaaaccaccagcacgcgactatgctggacgtagatctgcgacccgccagcgcctggaccttgtatgcagtcgccactacggtgataacgcccatgatgcgccataccatcgagaacacgacagcgaacatcagcttgacggccatagccaaccaggcagctattctaatgggtctcgataaaggttggcccatctctaagatggatatcggggtgccccttctggccctcggctgctactcccaggtcaatccgttaaccctgacagccgccgtcctcatgctggtcgcgcactatgctatcataggccccggtttgcaggccaaggccacccgtgaagcccagaagcgcacggctgcagggatcatgaagaaccccaccgtcgacggcatcgtggccatcgacctcgacccagtggtgtacgatgcgaagtttgagaagcagttaggccaaataatgttgctcatcctgtgcaccagccagattctgctaatgcggaccacatgggcactgtgcgagtcaatcaccctagcgacgggacccctcacaacgctgtgggagggctcgcccgggaagttctggaataccactatcgccgtttctatggcaaacatcttccggggcagctatctcgcgggggccggccttgcgttctccctcatgaaaagcctgggcgggggcaggagaggaaccggtgcccagggcgagacgctcggggaaaagtggaagcgccaactgaaccagctgtccaagagcgagttcaacacttacaagcggagtggcatcatggaggttgaccgctcagaagccaaggaagggctcaagcggggcgagaccaccaaacacgctgtcagccgcggcaccgcgaaactgcggtggttcgtggagcgcaacttagtgaagccggaaggcaaagttatcgacctgggatgcgggagaggcgggtggtcctactactgtgccggcctcaaaaaggtaacggaggttaaggggtacactaagggcggccccggccacgaggaaccaatacccatggcgacctacgggtggaacctggtgaagctgcacagcgggaaagacgtcttcttcatgccaccagagaagtgcgacacgctgctttgcgacatcggggagtcaagcccgaaccccacaattgaggaagggaggacactgcgtgtgctcaagatggtcgagccctggctgcgcgggaaccaattctgcattaagatactgaatccgtatatgccttccgtggtggagactttggagcagatgcagaggaagcatggcgggatgttggtccgcaaccctctgtcaagaaactccacacacgagatgtattgggtcagctgcggcacgggaaatatcgtttctgccgtcaacatgaccagccgcatgctcttgaatcgattcacaatggcccaccgcaagcccacctttgaacgcgacgtcgacttgggggcgggcacccggcacgtggcagtagagcccgaggtggccaatctcgacatcataggccagcgcatagagaacattaagaatgagcataagtccacctggcactacgacgaggacaacccgtacaaaacatgggcttatcatggctcctatgaggtgaaaccctccgggagcgcgtccagtatggtgaacggagttgtacggctgctgaccaaaccctgggacgtcattcccatggtgacgcagatcgcgatgaccgataccaccccgtttggacaacagcgagtctttaaagagaaagtggacacgcggacgccacgagcaaagcggggcacaactcagatcatggaggttacggccaagtggctgtgggggttcctgtcccgcaataagaaaccgcggatctgtactcgcgaagagttcaccagaaaagtgcgctctaatgccgcaatcggggcggtcttcgtggacgagaaccagtggaacagcgccaaagaggcggtggaggatgagagattctgggacctggtgcaccgcgaacgagaactgcacaagcagggcaaatgcgcgacctgcgtctacaacatgatggggaaacgggagaagaagctgggcgagtttgggaaggcgaagggctcacgggcaatatggtacatgtggctgggcgccaggttcctcgagttcgaggcccttggattcatgaacgaggaccactggtttagtcgggagaactctttgagcggcgtggagggggagggactccataagctgggttacatcctgcgagatatctccaagatcccgggcggcaacatgtacgctgacgacacggccggatgggatacccggatcacggaggacgacctgcagaatgaggccaagatcaccgacatcatggagcccgaacacgcgctgctcgcaactagcatctttaagctcacctaccagaacaaggtagtgcgcgtccagagacctgccaaaaacggcaccgtgatggacgtgatctctagaagggatcagcgggggagcggccaagtcggcacttatgggctgaacacgtttaccaacatggaagtgcaattaatccgtcagatggaatccgaaggcatatttctcccctccgagctggagaccccgaacctggccgaaagggtgctcgattggctggagaagcacggggcggaaaggttaaagcgaatggccatctccggggacgactgcgtcgttaagcctatagacgaccgcttcgccacggccctcaccgctctgaacgacatggggaaagtaagaaaagacataccccagtgggagcccagcaagggctggaacgattggcagcaggtaccgttctgctcccaccacttccaccagctgatcatgaaagacggccgcgagatcgtggtgccctgccggaaccaggatgagcttgtcggcagagcccgagtcagccagggcgcagggtggtctctgcgcgagacggcatgcctgggaaagagctatgcacagatgtggcagcttatgtacttccatcggagagacctgcggctggccgcaaacgctatctgctccgcggtgcccgtcgactgggtgcccaccagcagaaccacgtggtctatccatgcgcatcatcagtggatgactactgaagatatgctatccgtatggaatcgcgtatggatcgaggagaatccgtggatggaagacaagactcacgttagctcgtgggaggaagtgccgtatctggggaaacgcgaagaccagtggtgcgggagccttatcggcctcacagccagggcgacatgggccaccaacatccaggtggccattaaccaggttcgccgcctgataggtaacgaaaattacttagactacatgacctcaatgaagcgatttaaaaacgagagcgacccagaaggagcgttgtggtga

SEQ ID NO: 23906 - RNA, 9879 nt, synthetic construct
  misc_feature 1..9879: note = derived and/or modified CDS sequence (opt11) from DENV-1__KJ189319__SS-prME
  source 1..9879: mol_type = other RNA
tcggtaaccatgctactgatgctactaccgacggcactagcttttcatcttaccaccaggggaggagaaccccacatgatagtatccaaacaagaaagagggaaatcgctactgttcaaaacatcggcgggagtaaacatgtgtactttaatagcgatggatctgggcgaactctgcgaagacactatgacctacaaatgcccgcaaattacggaggccgagcccgacgacgtagactgctggtgcaatgccacagacacatgggtcacctacggtacctgctcgcaaaccggcgagcacagacgcgacaaaagaagcgtagcgctagcaccccacgtgggacttggtctcgaaacgcggacagagacctggatgtcctcagagggagcctggaaacagatacagcgtgtcgaaacgtgggcactacgacatcccggctttacagtaattgctctattccttgcccatgcaataggtacatcgataacccaaaaaggcataatctttatactcttaatgctggtgaccccctcgatggccatgagatgtgtaggcataggaaaccgtgacttcgtcgaaggactatcaggagccacctgggtcgatgtagtcctggaacacggaagctgcgtaaccacgatggccaaaaataaaccaaccctagacattgagctactaaaaacagaagtaacgaacccagcgatactacgtaaactgtgcatagaggcaaaaataagcaacacgactacagattcccgctgcccaactcagggggaagccacgctagtcgaagaacaggatgcaaacttcgtatgtcgccggacatttgttgaccgcggatggggcaacggctgtggcttgttcgggaaaggcagcctcctgacttgcgcaaaattcaaatgcgtaaccaaattagagggtaaaattgtccaatacgaaaacctgaaatacagcgtaatcgtaactgtacacaccggagaccagcatcaagtcggtaatgaaacaacggagcatggcacgatagccaccataacaccacaggcccctacctccgaaatacagctcactgactacggcgcactcacactcgactgttcaccccgaacaggcttagacttcaacgaaatggtgctcctaaccatgaaggaaaagagctggctcgtgcacaaacaatggttcctggatctgccgctaccctggacgagcggcgcctcgacaagccaagagacatggaaccgccaggacctgttggtcacgttcaaaactgcccatgcaaagaaacaagaggtagtcgtgctaggctcccaagagggcgcgatgcataccgcactgaccggagccactgaaatacaaacttccggcacaacgaccatatttgcggggcacctaaaatgtcgactgaaaatggacaaactaacactaaagggcacaagctacgtgatgtgtacgggtagcttcaagctcgagaaagaagtagcagaaacgcaacacggaacagtcttagttcaggtaaaatacgagggaacagacgcaccttgcaagataccgttttcaacccaagacgagaaaggggtaactcagaacggacgtctaatcaccgctaacccgatagtaactgacaaggagaagcctgtaaacatagaaaccgagccgccgtttggcgaaagctacatagtcgtgggggccggggaaaaggccctgaaactgtcctggttcaagaagggcagcagtataggcaagatgtttgaggcaaccgcacgcggagccaggcgtatggcaatcctcggagacacagcatgggacttcggatcaattggcggagtgttcaccagtgtcggaaaactggtacaccaggtgttcggcaccgcatatggagtactattctccggcgtctcatggactatgaaaatcggaataggaatcctcctaacctggttgggactcaactcccgctccacatccctctcgatgacctgtatagccgtagggatggtaacactctacttaggggtcatggtgcaagctgatagcggttgcgtaataaattggaaaggacgagaactgaagtgtggatccggaatattcgtgaccaatgaagtacatacgtggacagaacagtacaaatttcaggcggactctcccaagagactaagcgccgcaatcgggaaggcgtgggaagaaggggtatgcgggatacgctccgccacccgcctagagaacattatgtggaagcagatctcaaatgaactaaatcacatactcctggaaaacgacatgaagttcacagtagtcgttggagacgctaacggaatacttgcgcagggaaagaaaatgatacgcccccagccaatggaacacaaatactcctggaagtcatgggggaaagctaaaataataggcgcagacattcaaaacaccacgttcatcatcgacggtcccgacacaccggaatgccccgacaaccagcgagcctggaacatatgggaagtagaggactacgggttcgggatattcaccaccaacatctggctgaagttacgagactcgtacacccagatgtgtgaccatcgcttgatgtcggccgcaatcaaagattccaaagcagttcatgcagacatgggctactggatcgaaagcgaaaagaacgagacgtggaaacttgccagggcctcctttatagaagtcaaaacttgcacatggccaaagagccacacgctatggtcgaacggagtactagagtcagagatgatcatccctaaaatctatgggggccccatatctcagcacaactaccgaccgggttatttcacccaaactgcaggcccttggcacctgggaaaactggaactcgacttcgacctttgtgaagggaccacagtggtagtagacgagcactgcggaaaccgcggcccatcccttcggacaacaacagtcacgggcaagataatccatgagtggtgctgccgctcatgcacactaccacccctcaggttcagaggggaagacgggtgctggtacggaatggaaatacggccagtcaaagaaaaagaggagaacctcgtacgctccatggtatcagcgggttcaggagaggttgactctttcagcctaggcatactctgcgcatcgatcatgatcgaggaggtcatgagatcgcgatggtcgaggaaaatgctcatgacgggaacattggcggtatttcttctgctaatcatgggtcagctaacatggaacgacctcatacgcttatgcatcatggtcggagcaaacgcttcggaccggatggggatggggacgacctatcttgcactaatggccacattcaagatgagacctatgttcgccgtggggctactgtttaggcgactaacaagccgagaagtcctcttgctcacaataggcctcagcctcgtcgcctcggtggaattaccaaacagtcttgaggaactcggcgacggactagcaatggggataatgatgctgaaactactgacggagttccaacctcaccaactatggaccacccttctttccttgactttcatcaaaacgacactgtccctcgactacgcatggaagaccaccgcgatggccctcagtatcgtctcactttttccactatgcctttcaactacttcccaaaagacaacatggttgcccgtcctactgggcagccttggttgtaaaccactcaccatgtttctaataaccgagaataagatatggggacggaaaagttggccgctaaacgaaggaataatggccattgggattgttagcatcctactatcgtccctactcaaaaacgacgtgccgttagcaggcccgctaatcgctgggggcatgctgatagcatgctacgttataagcggaagctccgcagacctaagcctggaaaaggccgccgaggtatcctgggaacaagaagccgagcattccggaactagccacaacatcctagtagaagtccaagacgatggtacaatgaaaataaaggacgaagaacgggacgacacgctaaccatactactaaaggccaccctcctagcggtgtcgggcgtgtacccgatgtcgattccggcaacgctgttcgtatggtatttttggcaaaagaagaaacaaaggtcaggggtgctctgggatacgccgagtccacccgaagtcgaacgcgcagttctggacgacggcatctatcgaatattgcaacgaggtctcctcggacggtcccaggtgggagttggcgtcttccaagatggagtattccacacaatgtggcatgtgactcggggcgctgtactaatgtaccaggggaaacgtctagaaccttcctgggctagcgtcaagaaagacctgatcagctatggaggagggtggcgattccaaggatcctggaacactggagaagaggtacaagtaattgcagtcgaacccggcaaaaaccctaaaaacgtacaaaccacaccaggaacgttcaaaacccccgagggcgaggtcggcgccatcgcacttgatttcaagccgggaacgagcggctcaccgatcgtcaatagggaggggaagattgtcggcctctacggcaacggagttgtcaccacctccggaacatacgtatcagctatagctcaagccaaagcctcacaggaagggccactgcctgaaatagaagacgaagttttcaagaaaaggaacctaacaatcatggacttacaccccggcagtggcaaaacgcgccgttacctgccagcgatcgtccgtgaagcgattaaacggaaactacgaacattgatactagcccccaccagggtagtagcctcggaaatggcggaggcgctaaagggtatgccaatacgataccagacaacagccgttaaatccgagcacaccggaagagaaatagtggacctaatgtgccacgcaactttcaccatgcgtttactttcgcccgttcgagtcccgaattacaacatgataataatggacgaggcacactttacagatccggcgtcaatagcagctaggggttatatcagcacccgggtgggcatgggggaggcggctgcgatcttcatgacagcaacaccacccgggagtgtagaagccttcccgcagagcaacgccgtaatccaggacgaagaacgggatattcccgaaagaagctggaatagcgggtacgattggataactgacttccccggcaagacggtgtggttcgtgccttctattaaatccggaaatgacatcgcaaattgcctgcggaagaacggcaaacgcgtgatccaactgtccagaaaaacattcgatacagagtatcagaaaaccaaaaacaatgattgggactacgtcgtaaccactgatatctccgaaatgggcgcgaacttcagggccgaccgggtgatcgacccacgacgatgcctgaaacccgtaatccttaaggatgggcctgagagagtgatcctcgccggccctatgccagtgacagtagctagcgccgcccagcggcgaggacgcatcggcagaaaccagaacaaggaaggagaccagtatgtatacatgggacagccgctaaacaacgacgaagatcacgcccactggacagaagccaaaatgctgctggacaacatcaacaccccggaagggatcataccggccctgttcgaacctgaaagggaaaaatcagcggctatcgatggggaatacagactaagaggcgaagcccgaaaaacgtttgtagaactaatgcggagaggcgacctaccagtgtggctgtcatacaaagtcgcgagcgaaggcttccagtactcagacagaaggtggtgttttgacggagaaaggaacaatcaggtactcgaggaaaacatggacgtcgaaatatggactaaggaaggcgagagaaagaaactccgaccacggtggctcgacgcgagaacttactcggatccgctagctctacgcgagttcaaggagttcgccgccggcagaaggtcggtgtctggggatttgattctagagatcggcaagctcccgcaacatctaacgttaagagcccaaaacgccctggacaaccttgtcatgttgcacaactctgaacaaggaggcaaagcctaccgccacgcaatggaagaacttccggacacaatcgagacgcttatgctcctcgccctcatagcggtactaacgggaggtgtaactctcttcttcctgagcgggaagggccttggaaaaacgtcaatcgggctactatgtgtgaccgcaagcagcgcgctactgtggatggcctcagtcgagccgcattggatcgcagccagcatcatattggagtttttcctcatggtacttctaatacctgaaccggaccggcagagaactccgcaagataaccaactagcatacgtagtgattggactcctcttcatgatactcacggtagcggccaatgaaatgggcctccttgaaacaacaaagaaggacttaggcataggccacgtggcagccgagaatcatcaacatgcgactatgctcgacgtagacctacgccctgcatcggcatggaccctgtacgccgtagcgacaacagtcataacccctatgatgaggcacacaatcgagaacacgacggccaacataagcctcacagcaatagcaaaccaagcggcgattcttatggggctggacaaggggtggccaatatccaaaatggacataggcgtaccgctgctcgcgttaggatgctactcgcaagttaatcccttaacacttaccgccgcggtactaatgcttgtcgcacattacgccataatcggacccgggctacaggccaaggcaacgagggaagcccagaaacgaacggctgctggtatcatgaagaaccccacggtcgacgggatcgtcgcaatagaccttgaccccgtcgtgtacgacgcaaaatttgaaaaacagttaggtcaaatcatgctgctaatactatgcacttcacagatactgctaatgcgcacaacatgggcactatgcgaatccattacgctagccacaggacccctcaccaccttgtgggagggtagccctgggaagttttggaacaccacaatcgccgtgagcatggcaaacatattccgagggtcatacctagcgggtgcgggcctcgcatttagcctgatgaaatccctcggaggagggcggagggggacgggcgcgcagggtgagacactgggcgaaaaatggaagagacagttaaaccaactcagcaaaagcgagtttaatacctataaaaggagcggcataatggaagtagaccgctcagaagcaaaagagggtctgaagcggggagaaactaccaaacatgcggtcagtagggggactgccaaactaaggtggttcgtagagcgcaacctggtcaaaccagaaggaaaagttatagacctaggatgcggacgcggagggtggtcgtactactgcgcgggcctcaagaaagtcacagaagtaaaagggtacactaaaggcgggcccggccacgaagaacccatacccatggcaacgtatggatggaacctggtaaagctccactcggggaaagacgtctttttcatgcctcctgagaagtgcgatacactcctctgcgacatcggagaatcgtcaccgaacccaacgatcgaggaagggcgcacactacgagtccttaaaatggtagagccgtggctccgagggaaccaattttgcataaaaatcctcaatccgtatatgcccagtgtggtagaaacgctagaacaaatgcaacgaaaacacggcggtatgctcgtacgaaaccctctctcgaggaacagcactcacgaaatgtattgggtgtcatgcggcaccgggaatatagtatcggcggtcaacatgacctcgcgtatgctgctcaaccggtttacgatggcccacagaaagccgacgttcgagagggacgtagacctgggtgcaggtacaagacacgtcgccgtagaacccgaggtggcaaacctagacatcataggtcaacggatcgaaaatatcaaaaatgagcacaaaagcacatggcactacgatgaagacaacccctacaaaacgtgggcgtatcatggaagctacgaggtaaagccgtcgggaagcgcatcatcgatggtaaacggagtcgttcgcctactcacgaaaccttgggacgtgatccccatggttacacagattgccatgaccgatacgaccccatttggacaacaacgcgtctttaaagaaaaagtagacacaaggacaccgcgtgcaaagcgggggacgacccaaatcatggaagtgacagcaaaatggctatggggatttctgtcacgcaacaagaagccccgaatctgcacccgggaggaatttacgcgcaaggtgagaagcaatgccgctataggagccgtattcgtagatgaaaaccaatggaactcagccaaagaggctgtagaggacgagagattctgggatctagtgcaccgtgagcgcgaattacacaaacagggtaaatgcgctacgtgcgtctataatatgatggggaagcgggaaaagaaattaggggagttcggcaaagcgaagggctcgagagctatctggtacatgtggctcggcgcacgcttcctcgagttcgaagctctcggcttcatgaatgaggaccattggttcagtagagaaaattcactgtcaggcgtagagggcgaagggctgcataagctcggctacatcctgcgggatatctccaagattccgggagggaacatgtacgccgacgacacagcggggtgggacacccgaataacagaggacgacctacaaaacgaagccaaaataacagacatcatggaaccggagcatgcactgctagctacgagcatttttaagctcacttaccagaataaggtcgtacgggtgcagagaccggctaaaaatggcaccgtaatggacgtcatctcaaggcgggatcaaagaggctcgggacaagtggggacatacggactaaatacttttacgaacatggaagtccaactaattagacagatggagtccgaaggaatcttcttaccatcagaattagaaacccctaatctggcagagagggtactcgactggcttgaaaaacacggggccgaaagactcaaacgaatggctatatccggagatgactgtgtcgtaaaaccaattgacgatagattcgctaccgcccttacagccttaaacgatatgggcaaagttcgaaaagacataccgcaatgggagccgtcgaagggctggaacgattggcaacaagtgcctttctgcagccaccactttcaccagctcataatgaaagacgggagggagatagtcgtgccgtgccgcaatcaagatgagctagtaggaagggcgcgggtctcacagggagcagggtggtctttgagagaaactgcgtgcctgggcaaaagctacgcacagatgtggcaacttatgtacttccaccggcgggatctacggcttgcagctaacgccatatgttcagcagtacctgtggattgggtaccaaccagccgaactacctggtcgatacacgcccaccaccaatggatgacaaccgaagacatgctttctgtgtggaatagagtctggattgaagaaaatccatggatggaagacaagacccacgtttcgagctgggaagaggtaccatatctgggaaaacgagaagaccagtggtgcggatcactcatcggactgactgcgcgcgccacctgggcgaccaacatccaggtagcgataaatcaggtcaggcgcctaataggaaacgaaaactacctagactacatgacatccatgaaacgattcaagaacgaatccgatcccgaaggggcgttatggtaa

SEQ ID NO: 23907 - RNA, 9879 nt, synthetic construct
  misc_feature 1..9879: note = derived and/or modified CDS sequence (opt11) from DENV-1__KJ189320__SS-prME
  source 1..9879: mol_type = other RNA
agcgtgaccatgctgttgatgctgctaccgaccgccctggcgttccacctgaccacgcggggcggggagccgcacatgatcgtgtctaagcaggagcgcggcaagagcctcctgttcaagaccagcgcaggggtgaacatgtgcactctgatcgccatggacctaggcgagctatgtgaggacacgatgacctacaagtgcccccagatcacagaggccgaaccggacgacgttgattgctggtgcaacgcaaccgatacctgggtcacatacggtacgtgcagccagacgggtgagcaccgacgggataagcgctccgtcgccctagcccctcacgtaggcctgggactcgagacgcggaccgagacttggatgagctccgagggggcctggaagcaaatccagcgcgtagagacctgggccctgcggcatcccggattcactgtgatcgccctgttcctcgcacacgccatcggcacctctattactcagaaggggatcatcttcattctactgatgctcgtgactccctccatggcaatgcgctgcgtgggaattggcaaccgggacttcgtggaggggctcagtggcgcgacgtgggtggatgtcgttctggagcacgggagctgcgtgactaccatggccaagaacaagcccacccttgacatcgagctgctgaagacggaggtcaccaatcccgcaatcctccgtaagctgtgcattgaagcaaagatcagcaacaccacgacggactcccgctgtccaacccagggcgaggctaccctggtggaggagcaggacgctaacttcgtttgtcgccgaaccttcgttgatcgaggctgggggaacgggtgcggcttatttgggaagggcagcctgctgacgtgcgccaagttcaagtgcgtgaccaagctcgagggcaagatcgtgcagtacgagaacctcaagtactccgtgattgtgaccgtgcatacaggcgaccagcaccaagtcggaaacgaaacaaccgagcacggtaccatagcgactatcacgccccaagcccccacgtccgagatccagctgaccgactacggagccctcacactggattgctctccacgtaccggcctggacttcaatgagatggtgctcctgacaatgaaggaaaagtcctggctcgtccacaagcagtggtttctcgatctaccactgccctggacttccggggcgtccacgagccaggagacctggaaccgccaggacctcctggtgacgttcaagacagctcatgcgaagaagcaagaggtggtagtgctaggttctcaggagggcgcaatgcacacagccctcaccggggccacggagattcagacgagcggcaccaccacgatttttgccgggcacttgaagtgccgtctgaagatggataagttaaccctgaagggcaccagttatgtgatgtgcacggggagtttcaaactggaaaaggaagtcgcggagacccagcacggcactgtgctagtgcaggtcaagtacgagggcaccgacgccccctgcaagatcccattttccacccaggatgagaagggggtgacgcagaatggtcgtctcatcactgccaacccgattgtgaccgacaaggagaagccagtcaatattgagacggaaccccctttcggggagagctacattgtggtaggcgccggcgaaaaggcgctcaagttgtcctggttcaagaaggggagctccatcggcaagatgtttgaggccacggcccgcggggcccgccggatggctatcctcggcgacaccgcttgggactttggcagcatcggaggcgtctttacctccgttgggaaactggtgcaccaagtcttcggaacggcctacggggtgctgtttagcggcgtgtcatggacgatgaaaatcggaattggcatcctccttacatggctgggtctcaactcacggagtaccagtctgtccatgacctgcatcgcagtcggaatggtcactctatatctcggcgtgatggtccaagccgatagcgggtgcgtgatcaattggaagggccgcgagctgaagtgcggatccggtatattcgtgaccaatgaggtgcacacttggaccgaacagtacaagtttcaagcagacagcccgaagcggctgagtgcggccatcggcaaggcctgggaggaaggagtgtgcggtatccgaagtgcaacccggctcgaaaacatcatgtggaaacagatcagcaatgagctgaaccacatcttgctcgagaatgacatgaagtttacggtggtggtgggggacgccaatggcatcttggcccaggggaagaagatgatccgcccacagcccatggagcacaagtattcatggaagtcctggggaaaggccaagatcatcggagcagatatccagaacacaacgttcatcatagatggacccgacaccccggaatgccccgacaaccagagggcgtggaacatctgggaggtggaggactacggcttcgggatcttcacgactaatatttggctgaagctgcgagattcctacacccagatgtgcgatcaccggctcatgagcgcggccatcaaggactccaaggcggtccatgccgatatgggctactggatcgagagcgagaagaacgagacatggaaactagcccgtgcgtcctttatcgaggttaagacgtgcacctggcccaagagccacacgctctggtccaacggcgtcctggagagcgagatgatcattcctaaaatctacgggggcccgatttcccagcataattaccggcccgggtacttcacccagaccgcgggaccatggcacctggggaagctcgagctggacttcgatctgtgcgaggggaccaccgtcgtagtagacgagcactgcggcaaccgcgggccatccctccggaccactaccgtcaccggaaagattatccatgagtggtgctgccgctcctgcaccctgcctcccctgcggtttcgcggagaagacggctgctggtacgggatggaaatccggccggtcaaggagaaggaagagaacctcgtgcgcagcatggtctccgctggttcgggcgaggtggacagcttctccctggggatcctgtgcgcatcaatcatgatcgaggaggtcatgagatcccggtggagccggaagatgctcatgacaggcaccttagctgtcttcttacttctgattatggggcagctgacctggaacgatctcatccgcctgtgcattatggtgggtgcgaacgcctccgaccgaatgggaatgggaaccacgtacttagccctcatggccaccttcaagatgcggcctatgttcgccgtaggactgctgttccgccggttaaccagcagagaggtcctccttctcacaattgggttgtccctagtggcgagcgtagagctccccaactccctggaggaactgggcgacgggctcgccatgggaatcatgatgctaaagctactcacggaatttcagccgcaccagctgtggaccacgctgctcagcctgaccttcataaagaccaccctgagtctcgactatgcctggaaaacaaccgccatggcgctgagcatcgtcagtctgttccctttgtgcctttcgacgacatctcaaaagaccacctggctaccggtcctgctgggaagcttcgggtgcaaacccctgaccatgttcttaatcacggagaataaaatatgggggcggaaatcctggccgcttaacgaggggattatggccatcggcatcgtcagcatcctgctctcaagcttactgaagaacgacgtgcccctcgcggggccgcttatagcgggtggcatgctgatcgcctgctacgtgattagcgggtccagcgctgacctctccctagagaaggccgcagaggtcagctgggagcaggaagcagagcacagtggaaccagccacaatatcttagtggaggtgcaggacgacggaaccatgaaaatcaaagacgaggagcgcgacgacaccctcacaatattactaaaggcgaccctcctggcggtctccggcgtctacccaatgagcatcccggccaccttgttcgtgtggtacttctggcagaaaaagaagcaacgatccggcgttctctgggatacccccagcccccccgaggtggaacgggccgtcttagatgacggcatctatagaatcctgcagagaggtctgttaggccggtcccaggtcggcgtgggggtgttccaggacggcgtcttccacacgatgtggcacgtgaccagaggtgccgtgctgatgtatcaggggaagcggctggagcccagctgggcctctgttaagaaagacctcatcagctacggcgggggttggcgcttccaggggagttggaacaccggcgaggaggtccaggtcatcgcggtggaacccgggaagaacccgaagaacgtgcagacaacgcccggcaccttcaagacacccgagggcgaggtgggagcgattgccctggacttcaagcccgggacaagcgggtccccgatcgtcaaccgtgagggtaagatagttggcctgtacgggaacggcgtggtcacgaccagcggaacctacgtgtcggccatcgcccaagctaaggcctcacaggagggccccctaccagagatcgaggacgaggtattcaaaaagcgcaacctgaccattatggacctccacccggggagtggcaagacacggcgctatttgcccgccatcgtccgcgaggccatcaagcgcaagctgcggacactcattcttgcgcccacccgggtggtcgcctccgaaatggcggaggctctcaagggcatgcccatccgctaccagactacagcggtcaagagcgagcatacgggacgagaaatcgtggacctgatgtgccacgccactttcacgatgcggctcctgtccccagtgcgggtccccaactacaacatgataatcatggacgaggcccactttactgaccccgctagcatagccgcccgtggttacattagtacgcgggtggggatgggagaggccgctgctatcttcatgacggctacgccgccagggagcgtggaggccttcccccagtccaacgcggtcatccaggatgaggagcgtgacatccccgagcggagctggaatagtggctacgactggatcacggacttcccaggcaaaacagtctggttcgtaccgagcatcaagtccgggaacgatatagctaactgcctgcgcaagaatggcaaacgggtcattcagctcagccgaaaaacatttgacacggaataccagaagacgaagaacaacgactgggactacgtggtgaccaccgacatatccgagatgggagccaattttcgggccgacagagtcatcgacccgcggcgctgtctgaaacccgttatcctgaaggacggccccgagcgtgttatcttagcgggtccgatgcccgtcaccgtcgctagcgcggcccagcgacggggccgcatcggccggaaccagaacaaagagggcgaccagtacgtgtacatgggccagccgctgaacaacgacgaagatcacgcccattggacagaggccaaaatgctgctcgacaacatcaatacgcctgagggtatcataccggccttattcgagcccgaacgcgagaagtccgccgccattgacggcgaataccgcctacggggcgaggcccgcaagaccttcgtcgagctcatgcggcgaggcgatttgcccgtgtggctgtcctacaaggtagcctccgagggctttcagtatagcgaccggaggtggtgtttcgacggggaacggaacaaccaggtgctcgaggagaacatggacgtagaaatctggacaaaagagggagagcggaagaagctccggccgcgctggctagacgcccggacctacagcgaccctctcgccctccgcgaattcaaggaattcgccgccggacggagaagcgtaagtggcgatctgatactcgagattggtaagctgccccagcacctgacgctccgtgcgcaaaacgccctcgacaacctggtaatgttacacaacagtgagcaaggcgggaaagcttaccgccacgccatggaggagctacctgacaccattgaaaccctgatgctactggcactgatcgcagtgctcactgggggggtcaccctttttttcctgagcggaaaaggcctcggcaagacctccatcgggttgttgtgcgtgaccgccagctccgccttactgtggatggctagcgtcgagccccactggatagccgcctccatcatcctcgagtttttcctcatggtcctgctgataccggagcccgaccggcagcgcacgccccaagataaccagctcgcctacgtcgtgataggactgctgtttatgatactcacggtcgctgccaatgagatgggactcctggagaccactaagaaggacctcggaatcggtcacgtcgctgcagagaatcatcaacacgccacaatgttggacgtggatcttcggccggccagcgcttggacgctctacgcggtcgcaactaccgtgataacgcccatgatgcgccatactatcgagaacacaaccgctaacatcagcctgacagccatcgccaaccaggcggcaatcttgatgggcctcgacaagggctggcctataagtaaaatggacatcggagtacccctgctggccctcgggtgctactcccaggtcaatccgctgacgctgaccgccgcggtactgatgttggtggcccactacgccatcatcgggcccgggctgcaggcaaaagcgaccagggaggcgcaaaagagaaccgccgcagggatcatgaagaaccccacagtcgatggcatcgtggccatcgacctcgatccggtggtctacgacgctaagtttgaaaagcagctggggcagatcatgctgctaatcctgtgcacgtctcagatcctcctcatgcgtactacgtgggcgttatgcgaatcgatcacactggcaaccgggcccctcacgacactttgggaaggcagcccagggaagttctggaacaccaccatcgccgtatcaatggccaacatattccgaggcagctatctggcgggcgcggggctcgccttctcgctgatgaagtccttgggtgggggccgcaggggaaccggcgcccagggcgagaccctcggtgagaagtggaagcgccaactgaaccagctgtcgaagagcgagttcaacacatacaaacgtagcggcatcaccgaggtggaccgcagtgaagccaaggaaggcctcaagcgaggcgagaccaccaagcacgcggtcagccgcggtactgccaagctgcggtggttcgtggaacggaacctggtgaagcccgagggcaaggtaatagacctaggctgcgggcggggtgggtggtcctactactgcgccggcttaaagaaggtgacggaggtgaaagggtataccaaagggggcccgggtcacgaggagccaatcccaatggccacctacggatggaaccttgttaagctgcactcagggaaagacgtgttcttcatgccgcccgagaaatgtgacaccttactgtgcgacatcggcgagtccagcccgaatccaacgattgaggagggccgcaccctgcgtgtcttaaagatggtcgagccatggctgcgaggcaaccagttctgtattaagatccttaatccctacatgccgtcagtcgtggagacattggaacaaatgcagcgcaagcatggaggaatgctggtccgcaacccccttagtcgtaactccacccatgagatgtattgggtgagctgtggcaccgggaatatcgtgagcgccgtcaatatgacctcgcgcatgctgctgaaccggttcacgatggcgcaccggaagcccacgtttgagcgcgacgtggacctgggcgccggtacgcggcacgtggccgtcgagcccgaggtagcaaatttagacatcatcggacaacgcatcgagaacatcaagaacgagcataaatccacatggcactatgacgaagacaatccatacaagacgtgggcctaccatggcagttacgaagtgaagccctccggtagtgcgtctagcatggtcaacggcgttgtgcggctgctgaccaagccctgggacgtcatccccatggtaacgcaaatagccatgaccgacactacgcctttcggccagcagcgcgtcttcaaggagaaggtggacacgcggacgccccgcgccaagcgggggaccacccagataatggaggtaaccgccaaatggctttggggtttcctttcacgcaacaagaagccccggatctgcactcgcgaggaattcacccggaaggtccgcagcaacgccgcgataggggccgtgttcgtagacgaaaatcaatggaactccgccaaggaggccgtggaggacgaacggttctgggacttagtgcatagagagcgggagttacataagcagggcaaatgtgcgacctgcgtatacaatatgatggggaagcgcgagaaaaagttgggagagttcgggaaggcaaagggctcccgggccatatggtacatgtggctgggcgccagattcctcgagttcgaagctctggggtttatgaacgaggaccactggtttagccgggaaaactccttaagcggtgtagagggggagggcctccacaagctggggtacatcctacgcgacataagcaagatccctggcgggaacatgtacgcggatgacacggcgggctgggacaccaggatcaccgaggacgacctccagaacgaggccaaaatcacagatatcatggagcccgagcacgcactgctggcgacctcgatattcaagttgacctaccagaataaggtggtgcgggtacagcgtccagcgaagaacggtacagtgatggacgtgatctctcggagggaccagcgggggagcggccaggtcggcacctacgggttgaatacttttacgaacatggaggtacaattaatccgccaaatggagtccgagggcatcttcctcccaagcgagctggagactccgaatctcgcagaaagagtgctcgactggctggagaagcatggggccgagcggctcaagcggatggccatctccggtgacgattgcgtggtgaaaccaattgatgaccggtttgccaccgcgctcaccgctctaaacgacatgggtaaggtccggaaggacatcccccagtgggagcccagtaagggctggaatgactggcagcaagtcccattctgctcccatcattttcaccaactgatcatgaaggacggcagggagattgtggtcccctgccggaaccaggatgagctcgttgggagggcccgggtctctcagggcgccgggtggagtctgagggagacggcctgcctgggtaagtcatacgcacagatgtggcagttaatgtacttccaccggcgcgacttacggctggccgccaacgcaatctgctccgcggtgcccgtcgattgggttcccaccagccgcaccacttggagcatacacgcccaccaccaatggatgacgacagaagacatgctctctgtgtggaacagagtctggatcgaggagaacccctggatggaggacaagacccacgtcagctcctgggaagaagtgccctacctcggcaagcgtgaggaccagtggtgcggaagcctgatcggccttaccgcccgcgcaacgtgggccaccaatatacaggtcgcgatcaaccaggtgcggaggctgattgggaatgagaactacctggactacatgactagtatgaaacggtttaagaacgaaagcgaccccgagggtgccctctggtga

SEQ ID NO: 23908 - RNA, 9879 nt, synthetic construct
  misc_feature 1..9879: note = derived and/or modified CDS sequence (opt11) from DENV-1__KJ189323__SS-prME
  source 1..9879: mol_type = other RNA
agcgtgacgatgctgctcatgttgctgcccaccgctctcgcattccacttgaccacccggggtggcgaaccccacatgatcgtgtccaagcaggagcggggcaaaagcctgctgttcaaaacttctgccggggtgaacatgtgcaccctgatcgcgatggacctgggcgaactctgcgaggacacgatgacctacaaatgcccgcagattaccgaggccgagcctgacgacgtggactgctggtgcaacgccaccgacacgtgggtcacgtatgggacctgttcacagacaggcgagcaccggcgggacaagcggtcggtggccctggctccacacgtagggctggggctcgagacgaggaccgagacttggatgagctctgagggcgcctggaagcagatacagcgagtcgagacgtgggccctgcgccaccccggtttcaccgtgatcgccctgttcctcgcgcacgccattgggacctccatcacccagaaagggatcatctttatcctgcttatgctcgtgaccccttcaatggccatgcggtgcgttgggatcgggaatcgggacttcgtggaggggctgtcaggcgccacctgggtggacgtcgtcctggagcacgggtcctgtgtgactactatggccaagaacaagcccaccctcgacatcgagctgctgaagacggaggtcaccaaccctgctatcctcaggaagctgtgcatcgaagccaagatcagcaacactacgacggacagtcggtgcccgacacagggcgaggccacgctggtagaggagcaggacgctaactttgtgtgcagacggacctttgtagaccgcggatgggggaatgggtgcggtctcttcggaaaggggagtttgctgacgtgcgccaaattcaagtgcgtgaccaagctcgagggcaagatcgtgcagtacgagaatctgaagtacagcgtcatcgtgacagttcacactggcgaccagcatcaagtcggtaacgagacgaccgagcatggtactatcgccacaatcacgccccaggccccaacgagcgagatccagctgaccgactatggggcccttaccctggactgcagcccacggacgggcctagacttcaacgagatggtgctcctgacaatgaaagagaagtcctggctggtacacaagcagtggttcctagacctgcccctgccctggacctccggggcctccaccagccaggagacctggaatcgccaagacctactggtgacgttcaaaactgcccacgcgaagaaacaggaggtggtcgtgctgggctcccaagagggcgcgatgcataccgcactcaccggcgccacggagatccagacctcgggcactaccaccattttcgccgggcatttgaagtgccggctcaagatggacaagttgacactgaagggtacctcctatgtaatgtgcaccggcccattcaagctggagaaggaggtcgctgagacgcagcatggcaccgtgctggtacaagtcaagtacgagggtactgatgccccttgtaagattccgttcagcacgcaggacgagaagggcgtcactcagaatgggcgtctcattaccgccaaccccattgtgaccgataaggagaagcccgtaaatatcgagaccgagcctccattcggggagagttacatcgtggtgggcgctggtgagaaggccctgaagctgtcgtggttcaagaaggggtcaagtataggcaagatgttcgaggccacagcccgcggggcaaggcggatggcgatcctcggcgacaccgcgtgggatttcggttccatcggtggcgtcttcacctcggtggggaagttggtgcaccaggttttcggcaccgcttacggagtgttgttctccggcgtgtcgtggacgatgaagatagggatcggcatcctcctgacctggctgggcctcaactcacgcagcacctccttaagcatgacctgcatcgccgtagggatggtgaccttatacttgggcgtgatggtccaggctgactccgggtgtgtgatcaactggaagggccgcgagctcaaatgcggtagcggcatcttcgtcactaacgaggtccacacctggaccgagcagtacaagtttcaggccgactcccccaaacggctgagcgcggccatcggcaaggcctgggaggagggggtttgcggcatccgctcggccactcggctcgagaacatcatgtggaaacaaatctccaacgagctgaaccatatcctgctcgagaacgacatgaagttcacggtggtcgtgggggacgccaacggtatcctggcgcaggggaaaaagatgatccgcccccaaccaatggagcacaaatactcatggaagtcctggggcaaggccaagatcatcggcgccgacatccagaatacaacctttatcatcgacgggccggacacacccgaatgccccgacaaccaacgggcctggaacatctgggaggtggaagactacggcttcgggattttcacgaccaacatttggctcaaactgcgcgactcgtacacccagatgtgcgatcaccggttgatgagtgcggccatcaaagatagcaaggccgtacacgccgacatgggctactggatcgagtccgaaaagaacgagacctggaaacttgcccgcgctagcttcatagaggtgaagacgtgcacctggcccaagtcgcacaccttgtggagtaatggcgtgctggagtccgagatgattatcccgaagatctacgggggcccaatcagccaacacaactaccggcccgggtacttcacacagaccgccggcccgtggcatttggggaaactcgagctggactttgacctgtgtgagggcaccaccgtagtagtggacgagcactgcggcaacagagggccctccctaaggaccacgacggtcaccggcaaaatcatccacgagtggtgctgccgcagctgcaccttgccgccccttcgattccgcggagaggacggatgctggtacgggatggagatccggccggtgaaggagaaagaagagaacctcgttcgcagcatggtcagcgccggctccggcgaggtcgacagtttcagcctggggatcctgtgcgtgtctattatgatcgaagaggtcatgagaagtagatggtcccggaagatgctaatgacgggcaccctagctgtgttcttactcttggtgatggggcagctgacctggaacgacctgatccgcttatgcatcatggttggagccaacgcaagcgaccgcatggggatgggcaccacgtacctggccctcatggcaacatttaagatgcggcccatgttcgccgtggggctgctgttccgcagactcacttcccgcgaagttctactgctaactatcggcctcagcctggtcgcctccgtagagttgcccaacagcctggaggagctgggcgacggcctcgccatgggcatcatgatgttaaagctgctcacggagttccagccacaccaactgtggaccacactgctctccctgactttcatcaagacgaccctgagcctcgactacgcttggaagaccactgcaatggccctgagtatcgtcagcttgttcccgctctgtctgagtacgacttcccagaagaccacctggctgcctgtgcttctgggctcattcggttgcaagcccctgaccatgttcttaatcacggaaaacaagatctggggccgcaagtcctggcccctgaacgaggggataatggcgatcggcatcgtgtccatccttctctcttctctgctgaagaatgacgtcccgcttgccgggcccctgatcgccggtggcatgctgatcgcctgttacgtgatctcagggtcctccgccgacttgtccttagaaaaggcggccgaggtgtcctgggagcaggaagccgagcacagcggcacgtcccacaatatcctagtcgaggtgcaggacgacgggaccatgaagatcaaggacgaagaacgggatgataccctcacgatcctgctgaaggccaccctcctggccgtgagcggcgtctaccccatgtccatccccgcgaccctgttcgtttggtatttctggcaaaagaagaagcagaggagcggggtgctctgggatacgccgagcccgcctgaggtagagcgcgccgtgctggacgacggcatatataggatcctccagaggggtctgctagggcggagccaggtgggcgtcggggttttccaaggcggggtcttccatacgatgtggcacgtcaccaggggcgccgtgctgatgtaccagggtaagcggctggagccctcttgggccagcgtgaagaaggatctaatctcctacggtggcgggtggcgcttccagggcagctggaacactggtgaggaggtccaggtgatcgcggtggagccgggcaaaaatcccaagaacgtccaaaccacgccgggcaccttcaagacccccgagggcgaggtaggagcgattgccttggatttcaagcccggtacctccggcagccccatagtgaacagggaaggcaaaatcgtagggctgtacggcaacggggtggtaacgacctccggcacctacgttagcgccatcgcccaggccaaggcgtcccaggaagggcccttgccggagattgaggacgaagtgttcaagaaacgcaacctaaccattatggacttgcaccccggctccgggaaaacgcggcgctacttacccgctatcgtgcgggaggccataaagcgcaagctacgaaccctgatcctggccccgacccgcgtcgtggctagcgagatggccgaggccctgaagggaatgccgatccgctatcagaccacggccgtgaagtccgagcatactggtcgagagatagtagacctgatgtgccacgcaaccttcaccatgcgcctgctaagcccggtgcgggtgcccaactacaatatgattatcatggacgaggcgcacttcacggacccggcatcaatcgccgcccgcggatacattagcacccgagtcggtatgggcgaggccgccgccatcttcatgaccgccaccccgccggggtctgtggaggccttccctcagagcaacgccgtgattcaggacgaagagagggacatccccgaacggtcctggaactctggctacgattggataacggactttcccgggaaaactgtatggtttgtaccctccatcaagagcggcaacgacatcgcgaactgcctgcgcaagaacgggaagcgggtgatccagctctcccgtaagaccttcgacaccgagtatcagaagacgaagaacaacgactgggactacgtcgtgaccactgacattagcgaaatgggcgcaaattttcgggccgaccgcgtgatcgacccccggagatgcctgaagcccgtcatattaaaggacggtcctgagcgggtgatcctcgctggccccatgccagtgaccgtggcaagtgcggcacaacgccgtggacgtatcgggcggaaccagaacaaagagggcgaccagtacgtgtatatggggcagccactgaacaacgatgaggaccacgcccactggactgaggctaagatgctacttgataacatcaatacaccggaggggatcattcccgcgttattcgagccagaacgcgaaaagtccgccgccatcgatggggaatatcggctaagaggggaagcccgcaagaccttcgtcgaactcatgcggcgcggcgacctgccagtttggctgtcatacaaggtggcaagcgaggggtttcagtactccgaccggaggtggtgctttgacggcgagcggaacaatcaggtactcgaggagaatatggacgtggaaatttggacaaaggagggggagcgcaagaagctgcgtccgcggtggcttgacgcgcggacatacagtgaccctctagcccttagggagttcaaagagttcgcagccggccggaggtcagtgagcggcgatctgatcctcgaaatcggaaagttaccccagcacctgaccctacgggcccaaaacgcgcttgataacctggtcatgctccacaacagcgagcagggcgggaaggcataccgccacgccatggaggaactgcccgacaccatcgagaccctgatgcttctggccctgatcgcggtgctcacaggcggcgtgacgctgttcttcctgtcgggcaagggcctcgggaagacgagtatcggcctgttgtgcgtcacggcctccagcgccctcttatggatggcctcagtggagccgcactggatcgccgcgagcatcatactggagttcttcctcatggtgctgttgatcccagagcccgaccggcagagaaccccgcaggacaatcaactggcctatgtcgtgatcgggctgctgtttatgatactcacggttgccgcgaacgagatgggcttgctggagacaactaagaaggacctagggatcggacatgtcgccgctgagaaccaccagcacgccacaatgctggacgtggatctgcgtcccgcctcagcctggacgctctacgccgtggccaccaccgtaatcacccccatgatgcgccacaccatcgagaatacgacggccaacataagcctgactgccattgctaatcaggctgccatcttaatgggcctcgataaagggtggcccatctcaaagatggatatcggcgtgccattactagccctcggctgctacagtcaggtgaaccccctgaccctgaccgccgccgtcttaatgctggtggcgcactatgcgatcatcggccctgggctgcaagccaaggcgacccgggaagcgcaaaagcgcaccgcggccggcataatgaagaaccccacggtggacggcatcgtcgccatcgacttagaccctgtggtgtacgacgccaagtttgagaagcagctgggtcagattatgctgctgatcctgtgcaccagtcagatcctgctcatgcgcacgacctgggcactgtgtgagagcataacgctggctactggccccctcactacgctgtgggaagggtcccccggcaagttctggaacacgaccatagccgtaagtatggcaaacatattccgaggctcctacctggccggggccggcctcgcgttcagcctgatgaagtccttgggaggagggcgccggggcacgggcgctcagggggagaccctcggcgagaaatggaaacgccagctgaaccagttgagcaagtccgagttcaatacatacaagcggagcggcatcatggaggtagaccgcagcgaggccaaggaaggcctcaagcgcggggagaccaccaagcacgccgtgtcccgcggcaccgcaaagctgcggtggtttgtcgaacgcaacctggtgaagcccgagggcaaggtgatcgacctggggtgcggccgcggtggctggagctattactgcgccgggttgaagaaggtcacagaggtgaagggctacacaaaaggagggcctggccacgaggagccaatccccatggcgacctacgggtggaatctggtgaagctgcactccgggaaggacgtcttcttcatgcccccagagaagtgcgacacactcctgtgcgacattggggaaagctcccccaatccaacgattgaggagggccgcacgctgcgtgtgctaaagatggtggaaccgtggctccgcggcaaccagttttgcataaagatcctgaacccgtatatgccctctgttgtggagacgctcgagcagatgcagcgcaagcacggagggatgctggtgcggaatcctctgtcccggaacagcacccatgagatgtattgggtctcctgcggtaccggaaacatagtaagtgccgtcaacatgacgtcccgaatgcttctgaaccgtttcactatggcccatagaaagcccacctatgagcgcgatgtcgaccttggcgcggggacacggcatgtagccgtggaaccggaggtggccaacttagacatcatcgggcagagaatagaaaacatcaagaacgaacacaaaagcacctggcactatgacgaggacaacccctacaagacctgggcataccacgggtcctacgaggtgcggccctcaggttccgcctcgtccatggtgaatggggtcgtgcgactgctaaccaagccctgggacgtcatcccgatggtgacccagatcgcgatgacggacacaaccccattcggccagcaacgtgtctttaaggagaaggtagatacgcgaactccccgagcgaagaggggaaccacccagatcatggaggtgaccgccaagtggctctgggggttcctaagcaggaacaagaagccgcgcatctgtacgcgggaggagttcacccgcaaggttcggtccaacgctgccatcggagcggtcttcgtggacgagaaccagtggaacagcgcgaaggaggcagtggaggatgagcgtttctgggacctggttcacagagagcgcgagctgcacaaacaggggaagtgcgcgacctgcgtgtacaacatgatgggaaagcgggagaagaaactaggggagttcggcaaggcgaaaggctcacgcgccatctggtacatgtggttgggtgctcggttcctcgagttcgaagccctgggcttcatgaacgaggaccattggttctcacgcgagaacagcctgagtggggtggagggggaggggctccacaagctgggctatatcctacgtgacatcagcaaaatcccaggcgggaacatgtatgccgacgacaccgcgggctgggatacgcgaatcaccgaggacgacctccagaacgaggccaagattaccgagataatggagccagagcacgccctgctggccacctccatcttcaagctcacgtaccaaaacaaggtcgtgcgggtccagcggcccgccaaaaacgggaccgtcatggacgtgatcagccggcgggaccagcgcggctccggccaagtgggcacctatggcctgaataccttcacgaacatggaggtccaactcatccgccagatggagagcgaggggattttcctcccgagtgagctggagacgccaaacctggcggaacgcgtgctcgattggctggaaaagcacggcgccgaacggctgaagcgcatggccatcagcggggacgactgcgtggtcaagcccatcgacgaccgcttcgcgaccgcattgaccgcgctgaacgacatgggcaaggtgcgcaaggacatcccacaatgggagccgtccaagggttggaatgactggcagcaggtccccttctgtagccaccacttccaccagctgatcatgaaggacgggcgggagatcgtcgtgccctgtcgcaaccaagacgagctagtgggccgggcacgtgtgtcccagggggcaggctggagcctgcgggagaccgcctgcctggggaagtcctacgcccagatgtggcaactcatgtacttccaccgacgggacctacgcctcgcggccaacgccatctgcagcgccgtaccggtggattgggtcccgacgtcccggactacatggagcatacacgcgcaccaccagtggatgacgacggaggacatgctcagcgtgtggaaccgagtgtggatcgaggagaacccctggatggaggacaagacacacgtgtcctcgtgggaggaggtaccctacttgggaaagagggaggaccagtggtgcgggtccttaatcgggcttaccgcccgggctacctgggccactaacatccaggtggcaatcaaccaagtccgccggttaattggcaacgagaactatctggactatatgacgagcatgaagcgcttcaaaaacgagtccgaccccgagggcgcgctctggtga

SEQ ID NO: 23909 - RNA, 9879 nt, synthetic construct
  misc_feature 1..9879: note = derived and/or modified CDS sequence (opt11) from DENV-1__KJ189324__SS-prME
  source 1..9879: mol_type = other RNA
agcgtaaccatgctgctcatgctgctgcccactgccctcgccttccacctgaccacccgcggaggggaaccccacatgatagtgagcaagcaggagcggggcaagtctcttctttttaagacgtcagcgggggtgaacatgtgcactttgatcgctatggacctgggggaactctgcgaggacaccatgacctacaagtgcccccaaatcacagaggccgagccggacgatgttgactgctggtgcaatgctaccgacacatgggtgacatacgggacttgcagccaaaccggggagcatcgaagggacaagcgcagtgtcgcgctggcgccacacgtcggcctcggcctcgagacgcggaccgaaacctggatgagctctgagggcgcctggaagcagattcagagggtcgagacctgggctctccgtcaccctgggtttactgtgatcgccctgttcctcgcacacgctattggcacatctatcacccagaagggcatcattttcatcctgctgatgctagtgaccccctcaatggccatgcgttgcgtcggcatcggcaaccgggacttcgttgaggggctgtcaggtgcaacttgggtggatgtcgtgctggagcacgggtcctgcgtgaccaccatggccaagaacaagcccaccctcgacatcgaactactgaagacggaggttacgaaccccgcgattctccgcaagctctgcatcgaggccaagatcagcaacacgaccacggactcccggtgtccgacccagggcgaggcgacactggttgaggaacaggatgccaacttcgtgtgccgccggacatttgtcgaccgcggctggggaaacggctgcggcttgtttggaaaggggagcctgctgacgtgcgccaagttcaagtgcgtgaccaaactcgagggaaaaatcgtgcagtacgagaacctgaagtattccgttatcgttaccgtgcatacgggcgaccagcaccaggtcgggaacgagacgacagagcacggaaccatcgcgaccatcaccccgcaggctcccacctcggaaatccagctgaccgactacggggctctcaccctggattgctcaccccgtactggtcttgacttcaatgaaatggtcctcctgacgatgaaagagaagtcctggctggtccacaagcagtggttcctcgacttgccactgccatggacctccggggccagcacctctcaggagacctggaatcggcaagacctactggttacgttcaagaccgcccacgcgaaaaagcaggaggtggtcgtgctgggctcccaggaaggcgccatgcacactgccctcactggggccacggagatccagacctccggcaccaccacgatctttgctgggcacctaaagtgcagattgaagatggataagttgactctgaagggcacctcctacgttatgtgcactgggagcttcaagctggagaaggaggtcgcggagacgcagcacggcaccgtgctggtgcaggtcaagtatgagggaacagacgccccgtgcaagatccccttttcaacccaggacgaaaagggtgtgacgcaaaacggcagactcattaccgcaaaccctatcgtgaccgacaaggaaaagcccgtcaacatcgaaaccgagccgcccttcggggagagttacatcgtggtgggcgccggcgagaaggcgctgaagctgtcttggttcaagaaaggtagttccatcgggaagatgttcgaagccacggcacgcggggcgcgccggatggccattctaggcgatacggcttgggacttcgggtcaataggcggggtctttacttccgtgggcaaactggtgcaccaggtatttggcaccgcttacggcgtgctgttcagcggcgtgtcctggacaatgaaaataggcatcggtatactcctaacctggctgggactcaacagccgctccacctcactgtccatgacttgcatagctgtcggcatggtgacgctgtacctcggcgtgatggtccaggccgatagcgggtgcgtgattaactggaagggccgcgagcttaaatgcgggagcggaatctttgtgaccaacgaagtccacacctggaccgaacagtacaaattccaggccgacagcccgaagcggttaagtgcggctataggcaaagcctgggaggaaggtgtgtgcggcatcagatccgccacccgacttgaaaacataatgtggaagcagatcagcaacgaactgaaccacatcctgctcgagaacgacatgaaattcacggtggtcgtgggggacgccaacggcatcttagcgcagggtaagaagatgatccgcccccagccgatggagcacaaatactcctggaagtcctggggcaaagctaagattattggcgcagacatccaaaacaccacattcatcatagatggccccgatacccctgagtgccccgataaccagcgggcctggaacatttgggaagtggaggactacggcttcgggatctttacgaccaatatctggctgaagttacgcgattcctacacccaaatgtgcgaccaccggctgatgagcgccgcaatcaaggactccaaggcggtccacgcggacatgggctactggatcgagagcgagaagaacgagacgtggaagctggcccgcgcgtccttcatcgaggtaaagacgtgcacatggccacgcagccataccctctggtccaacggcgtcctagaaagcgaaatgattatccccaagatctatgggggtccgatctcccagcataattaccgccccggctacttcacccagacggccggtccctggcacttaggaaagctcgaactggacttcgacctgtgcgagggcaccacagtagtggtggatgagcactgcgggaaccgggggccgtccctccgcacaacaacagtcaccggcaaaatcatccacgagtggtgttgccggtcctgcacactgccgcccctgcgcttccgcggggaagacggttgctggtacgggatggagatccgccccgtgaaggagaaggaggaaaatctcgttcggagcatggtctccgccggcagcggtgaggtcgacagcttctctttaggcatcttgtgcgcctctatcatgatcgaggaggtgatgcgctcacggtggagccgcaagatgctcatgacaggcaccctggccgtgtttctgctcctggtgatggggcaacttacctggaacgacctcatccgcctgtgcatcatggtgggcgcgaacgcctctgaccggatggggatgggcaccacgtacctggccctcatggccaccttcaagatgagaccgatgtttgccgtgggtctgctgttccggcgcttgacctcacgggaagtgctgctgctcaccatagggctctccctcgtggcgagcgtcgaactcccgaacagtctggaagaattgggcgacgggctcgccatgggcatcatgatgctgaaacttctcactgagtttcagccccaccagttatggaccaccctgttaagcctaaccttcatcaagacgaccctcagtctcgactacgcctggaagaccaccgccatggcgctgtctattgtatccctgttcccactctgcctgagcactacatcccagaagaccacctggttaccggtcctcctaggcagctttgggtgcaagcccctgacgatgttcctcatcacggagaacaagatctggggccgcaagtcctggcccctgaacgaagggattatggccatagggatagtgagtatcttgttatcctcgctgctgaagaacgacgtgccgctcgccggaccgctgatcgccggtggtatgctgattgcgtgctacgtcatcagtggatccagcgccgacctctcgctggagaaggcagccgaggtcagttgggagcaggaggccgagcacagtggcacatcgcacaacatcctggtggaagtccaggatgacgggaccatgaaaatcaaggacgaagaacgggacgacaccctcacaatcctgctgaaggccacccttctggccgtgtccggcgtgtaccccatgagcatcccggcaaccctgtttgtctggtacttctggcagaaaaagaagcagcgctccggggtgttgtgggacacccccagtcctcccgaggtggagagggcagtcctggatgacgggatataccgtatactccagcggggcctgctcggccgctcccaagtgggcgtgggggtcttccaggacggcgtgttccacacgatgtggcatgtgacacgcggggccgttctgatgtaccagggcaagcgcctggagcccagctgggcctccgtgaagaaggacctcatctcgtacggcggcggctggcggttccaagggtcctggaacactggcgaggaagttcaggttatcgccgtagagccggggaagaatccgaagaacgtgcagaccacacccgggaccttcaagacccccgaaggcgaagtcggggcaatcgccctggacttcaaacccggcacctccggatccccgatagtcaaccgcgaggggaagatcgtgggcctgtacgggaacggcgtcgtgacgacctcggggacctacgtgtccgccatcgcccaggcaaaggcaagccaggaaggtcccctccccgagatcgaggacgaggtcttcaaaaagcggaacctgaccatcatggacctgcacccaggatcgggcaagacacgccggtacctccccgccatcgtccgcgaagctatcaaacggaagctgcgcaccctaattctcgcgccaacccgcgtggtcgcctccgagatggcggaggccctgaagggaatgcccatccggtatcagaccacagccgttaagagcgagcataccgggcgcgagatcgtggatctgatgtgccacgcgaccttcacgatgcggctcctgtccccggtccgcgtgcctaactacaacatgatcatcatggacgaggcccactttacggaccctgccagcatcgccgcccggggctatatctccacacgcgtcggcatgggggaggcggccgccatatttatgacagcaacgccgcccgggagcgtggaggccttcccccaatccaacgcggtgatccaggacgaggaacgcgacatccccgagcgcagctggaactccggctacgattggatcacggacttccccggcaaaactgtgtggttcgtcccgagcatcaagtccgggaatgacatagccaattgcttacggaaaaatggaaagcgcgtgatccaactcagccggaaaaccttcgacaccgagtaccagaagacgaaaaataacgattgggactacgtggtcacaaccgacatctccgagatgggggccaactttagggccgaccgggttatcgacccccgccggtgcctgaagcccgtgatcctgaaggacggtccggagcgtgtcatactcgcggggccgatgcccgtgacagttgcgagcgcggcccaaagacgcggccggataggccgcaaccaaaacaaggagggggaccaatatgtttacatgggtcagcccttgaataacgacgaggaccatgcccactggactgaggcgaagatgctgctcgacaacatcaacacccccgagggtatcatcccggctctgttcgagcccgagcgtgagaaatccgccgccatcgacggggagtacaggctgcgcggggaggcgcggaagaccttcgtggagctcatgcggcggggcgatctacccgtctggctgagctacaaggtggcgtccgagggctttcaatacagcgatcgccggtggtgcttcgacggggagcgcaataaccaggtgttagaagagaacatggacgtcgagatatggaccaaggagggggaacgcaagaagctccgccctcggtggctggatgcgcgcacctattcagacccgctcgctctgcgggagttcaaagagttcgccgccgggcgtcggtctgtgagtggcgacctgatcctcgaaatcggcaagctgccccagcacctgacgctccgcgcgcagaacgccctggacaacctggtaatgctccacaactccgagcaaggcgggaaggcctaccggcatgccatggaggagttgccagataccatcgagaccctgatgctcctagcgctaatcgctgtcctcaccggaggggtgactctgttcttcctgtcgggaaaaggcctcggcaagacgtcaatcgggctgctgtgcgtgaccgcatcctccgcactcttatggatggccagtgtcgagccccattggatcgcggcctcaataatcttggagtttttcctcatggtgttgctgatcccggaaccggaccgccagcggacaccccaggacaaccagctcgcgtacgtggttatcggcctgctgttcatgatcctcaccgtggccgccaacgagatgggccttctcgagacgactaagaaggacttgggcatcggacacgtggctgcggagaatcaccaacacgccaccatgctggatgtcgacttgcgccctgccagcgcgtggacgctctacgcagtggccactaccgtgattacccccatgatgcggcacacgatcgaaaataccaccgccaacatttccttgaccgccattgctaaccaagcggcaatcctgatgggcctcgacaagggctggcccatctctaagatggacattggagtccccctactggccttaggctgctactcccaggtgaacccgctgacgctgaccgccgctgtgctcatgctggtcgcccactacgccatcatcggccccggactgcaggccaaagctacaagggaggcgcagaaaagaaccgccgccgggatcatgaagaaccccacggtggacggcatagtggccatcgacctcgaccccgtcgtgtacgacgccaagtttgaaaagcagctgggccaaatcatgctgctgatcctctgcacctcccagatcctactcatgcgtacaacctgggcattatgcgaaagtatcaccctggctaccgggccgctcaccactctgtgggagggcagtccggggaagttctggaacacgaccatcgctgtgtcaatggcgaacatcttccgcggctcttacctcgccggcgcggggctcgctttctccctgatgaaatccctagggggtggccggcgcgggaccggggctcagggggagaccctcggggaaaagtggaagaggcagctgaaccagctgtccaagtctgagttcaacacctacaagaggtcggggatcatggaggtagaccggtccgaggccaaggaggggttaaaacgcggcgagacaaccaagcacgctgtgagccggggtactgccaagctacgctggttcgtggagcggaacctggtaaaacccgagggaaaggttatagacctgggctgcggacgtggcgggtggtcctactactgcgccggcctcaagaaggtgaccgaggtcaagggctacacgaagggcggcccgggacacgaggagccgattcccatggccacctacggctggaacctggtgaaacttcacagcgggaaggacgtgttctttatgccgcccgagaagtgtgatacactcctgtgcgacatcggcgaatccagcccgaaccccactatcgaagaaggtcggacgctccgggtcctaaagatggtggagccatggctgcgggggaaccaattttgcattaaaatcctgaacccttatatgccctccgtggtcgagacattagagcagatgcagcgaaagcacggcggcatgctggtgcggaaccccctgagccgaaacagcacccacgagatgtactgggtgtcctgcggcacgggaaatatagtctccgccgtgaacatgaccagccgtatgctcctgaaccgcttcaccatggcgcacagaaagcccacttacgagcgagacgtggacctgggcgcgggtaccaggcacgtggccgttgagcccgaggtggccaacttggacataatcgggcagcgtatcgagaacatcaagaacgagcacaagtccacgtggcactatgacgaggataacccttacaagacctgggcgtaccacggctcttatgaagtcaagccctccggttctgcgtccagcatggtaaatggcgtcgtacgcctgctgacaaagccctgggacgttatccccatggtcacccagattgccatgactgataccaccccgtttgggcagcaacgggtgttcaaagaaaaggtggacacccgcacgccccgggccaagcgcggcactacacaaatcatggaggtcacggcaaagtggctttggggattcctgtcccggaacaagaagccacgcatttgcacgcgggaggagttcacccgaaaggtgcggagtaacgccgcgatcggcgccgtgttcgtcgacgagaaccaatggaactcagccaaagaggctgtggaggacgagcgattctgggacctggtgcaccgggagcgcgagcttcacaagcaaggcaaatgcgcaacctgcgtctacaacatgatggggaagcgagagaagaagctaggcgagttcgggaaggccaaggggtcccgcgccatttggtacatgtggctgggcgcccggtttttggagttcgaggccctgggattcatgaacgaagaccactggttctcaagagaaaattccctgagcggagtggagggggagggcctacacaagttagggtacatcctgcgggacatctccaagatcccagggggcaatatgtacgcggacgacaccgccgggtgggacacgcggataactgaggacgacttgcagaacgaggccaagataaccgagatcatggagcctgagcatgccctgctggccaccagcatcttcaagctaacgtaccagaacaaggtagtccgcgtgcagcgtcccgcgaaaaatggcaccgtgatggacgtcatcagccgcagggaccagcgggggagtggccaggtaggcacctacggactgaataccttcacgaacatggaggtgcagctgatccgacagatggagtccgaggagatcttcctcccaagcgagctagagacccctaacctggcggagcgcgtcctcgactggctggagaagcatggtgccgagagactgaagcgcatggcgatttccggggacgactgtgtggtgaagcccatcgacgaccggttcgctacagcgctcaccgccctaaacgatatgggcaaggtacggaaggacattccccagtgggagccctccaaagggtggaacgattggcagcaggtcccattctgctcgcaccatttccaccagctgattatgaaggacggtagagaaatcgtggttccatgccgaaaccaggacgagctcgtggggcgggctagggtgagccagggggccggctggtcccttcgggagaccgcctgcctgggaaagagctacgcgcagatgtggcagcttatgtatttccaccggcgggatctgcgcctggccgcgaacgccatctgctccgcggtccccgtggactgggtgcccacgagccgcacaacctggagcatccacgcccatcaccagtggatgacaacggaggacatgctctccgtctggaaccgcgtgtggatcgaagaaaacccctggatggaagacaagacacatgtgagcagctgggaggaggtcccctacctgggtaagcgagaagaccagtggtgcgggtcactgattggcctcaccgcccgagccacctgggccacgaacatccaggtagcgataaaccaggtgcgccgtctgatcggcaacgagaactacctggactacatgacctccatgaagcgcttcaagaacgaatctgatcccgagggggcactctggtga

SEQ ID NO: 23910 - RNA, 9879 nt, synthetic construct
  misc_feature 1..9879: note = derived and/or modified CDS sequence (opt11) from DENV-1__KJ189325__SS-prME
  source 1..9879: mol_type = other RNA
agcgtgaccatgttgctcatgctattgccaaccgccctagccttccacctgaccacgcggggcggcgaaccgcacatgattgttagcaagcaggagcggggcaagagcctcctgtttaaaacttcggcgggggtgaacatgtgtaccctgattgctatggacctgggcgagttgtgcgaggacaccatgacttacaaatgcccgcaaataactgaggccgagcccgatgacgtggactgttggtgcaacgctaccgacacctgggtgacctacggaacctgctcgcagaccggagagcaccgccgggacaagagatcagtagccctggcgccccatgtgggccttgggctcgaaacgcgtaccgagacctggatgagctccgagggcgcctggaaacaaatacagcgcgtcgagacctgggccctgcggcatcccggcttcacagtgattgccttgttccttgcgcatgccatcggcaccagcatcacccagaaggggaccatcttcatcctgctgatgcttgtgaccccctccatggccatgcgatgtgtcggcatcggcaacagggacttcgttgaggggctgtcaggagccacctgggtggacgtcgtgctggagcacgggtcctgcgtgacaactatggccaaaaacaagcccaccctcgacatcgagctgctgaagaccgaggttacgaatcccgcgatcctccgcaagctgtgcatcgaggccaaaataagcaacaccacgaccgactcacgatgcccgacccagggtgaggccaccctggtagaagaacaggatgccaacttcgtgtgccgccggacgttcgtcgaccgcggctgggggaacggctgcggactctttggcaaggggtcactgctgacttgcgccaagttcaagtgcgtgaccaagctcgagggcaagatcgtgcagtacgaaaacctgaagtatagcgtaatcgtgacagtccacaccggagaccagcaccaggtaggcaatgagaccacagaacacggcacgatagcgaccatcacgccccaggcgcccacctcagagatccagttaacagactatggagcgttgaccctggactgcagcccccggacgggactggactttaacgaaatggtgctcctgaccatgaaagagaagtcttggctggtccacaagcagtggtttttagacctgccgttgccctggacctccggggccagcaccagccaggagacgtggaaccgccaggacctgctggtcaccttcaagaccgcccacgcgaagaagcaggaggtggtcgtcctgggctcccaggagggtgccatgcacactgctctcacgggggccaccgagatccagacctcaggcaccacgaccatcttcgccgggcacctaaaatgccggctgaagatggacaagctcaccctgaagggcacctcctacgtgatgtgcacagggagcttcaagctggagaaggaggtcgcggaaacccagcacggcaccgtgctggtgcaggtcaaatacgaaggaactgacgccccctgcaagatccccttctccacgcaggacgagaagggggtgacacagaacggccgcctcataaccgccaaccctatcgttacggacaaggagaagcccgtcaacatcgagactgagccgccgttcggggagagttacatcgtggtgggcgcaggcgagaaggctctgaagctctcctggtttaagaaggggtcatccatcggcaagatgttcgaggccaccgcccgcggggcccgtcggatggcaatcctcggcgataccgcgtgggactttggtagcatcggcggcgtcttcaccagtgtgggaaaactggtgcaccaggtcttcggcactgcgtacggcgtactcttcagcggcgttagttggaccatgaagatcgggatcggcatactcctgacctggctggggctcaatagccgctccacgagtctgtccatgacgtgtatagccgtcgggatggtgaccttgtacctcggcgtcatggtgcaggccgattcgggatgcgtgatcaactggaagggccgtgaactgaagtgcgggtccgggatattcgtgaccaacgaggtccacacctggaccgagcagtacaagtttcaggccgatagccccaaacggttgagcgcggccatcggcaaggcctgggaggagggggtgtgcggcatccgctccgccacgcggctcgagaacatcatgtggaagcagatcagcaacgagctgaaccacatcctgctcgagaacgacatgaaattcaccgtggtcgtgggggatgccaacggcatcctggctcagggtaagaagatgatccgcccccagcccatggaacacaagtactcgtggaaatcatgggggaaagccaagatcatcggcgcagatatccaaaatactaccttcatcatcgacgggcccgatacgccggagtgccctgacaaccagcgggcctggaacatctgggaggttgaggattatggcttcgggatcttcaccaccaatatctggttgaaactccgcgattcctacacccagatgtgcgaccaccggttaatgtccgccgccatcaaggattctaaggctgtccatgccgacatgggatactggatcgagagcgagaagaacgagacgtggaagctggctcgcgcctccttcatcgaggtgaaaacttgtacctggcccaagagccacaccttgtggtcgaacggcgtgctagagagcgagatgatcattcccaagatctacggaggccctatcagtcagcacaactatagacccgggtactttacgcagaccgccgggccctggcatctggggaagctcgagctggacttcgacttgtgcgagggcaccaccgtcgtggtagacgagcactgcggcaaccgcgggccaagcctccgtacgacaaccgtcaccggtaagatcatacatgagtggtgctgccgctcctgtacgcttccgcccctgcgcttccgcggggaggatggctgctggtacggtatggaaatccggcccgtgaaagagaaagaagagaacctcgtgcgcagtatggtctcagccggcagcggcgaagtggatagcttctccctagggatcctgtgcgccagcatcatgatagaggaggtgatgcggtcccgatggtcgcggaagatgctcatgaccggcaccttggccgtgttcctgctacttgttatggggcagctgacatggaacgatctcataagactgtgcatcatggtgggcgcgaacgcctccgaccgcatggggatggggacgacctacctggcactcatggcaacattcaagatgcggccaatgtttgccgtcgggctgttgtttcgccgactgacgtcaagggaagtgctgctactaacaatcggtctgtcgctagtggcgtcggttgagctcccaaacagccttgaggaactgggcgacgggttagccatgggtatcatgatgctgaagctgctaaccgagttccagccacaccagctttggatcactctgctcagcctgaccttcatcaagactaccctgtccctcgactatgcctggaagaccacggcgatggccctgagtatcgtgtccctgttcccactctgcctcagcactacctcacagaagaccacctggctcccggttctcctgggcagcttcgggtgcaaaccgctgaccatgttcctcatcactgagaacaagatttggggccggaagtcctggcccctaaacgaaggtatcatggccattggcatcgtcagcatccttttatcgagcctcctgaagaatgacgtgcccctcgccgggccgctgatagccggcggcatgctgatcgcctgctatgtcatatcggggtccagcgccgacttgtccctggaaaaagccgcagaggtgagctgggagcaagaggccgaacattccggcacttctcacaacatcctggtggaggtgcaggatgacgggacgatgaagatcaaagatgaggagcgcgacgataccttgaccatcctgctgaaggccacccttctggcggtgtcgggggtgtaccccatgtcgatccccgccaccctgttcgtctggtacttctggcagaagaagaagcaacggtccggggtcctctgggacacacccagcccgccggaggtagagagggccgtcctggacgatgggatctaccggatcctgcagcgcggcctgctcgggcgatcccaggtgggggtgggggtcttccaggacggcgttttccacaccatgtggcatgtgacccgcggcgccgtcctgatgtaccagggcaagcgcctggagcccagctgggcctccgtcaaaaaggacctcatctcttacggcgggggctggcgcttccaggggtcttggaacacgggcgaagaggtgcaggtcatcgcagtagagcccggcaagaacccgaagaacgttcaaaccatgccaggcacgtttaaaacccccgagggcgaggtaggcgccatcgccctggactttaagcctggcacctccgggtcgccgatcgtgaaccgggagggcaagattgtgggcttatacgggaacggcgtcgtgaccacgagtgggacctacgtgtccgccatcgcccaggccaaggccagccaagaaggccccctccccgagatcgaggacgaggtcttcaaaaagaggaacttaaccatcatggacctacacccggggagcggcaagacgagaagatacctacccgctatggtgcgggaggccatcaagcgcaagttacggacgctgatcttagcgcccaccagggtggtcgcctccgagatggctgaggccctgaagggcatgcccattaggtaccagaccaccgccgtcaagagcgagcatacggggcgggagatcgtcgacctcatgtgccatgccaccttcaccatgagactcctgtccccggtcagagtgcccaactacaacatgattattatggatgaggcccacttcaccgaccccgccagcatcgccgcacgcggctacatatccacgcgggtggggatgggcgaggcggccgccatttttatgaccgccacgccgcctgggagcgtcgaggccttcccccagtccaacgcggtgattcaggacgaggaacgcgacatacccgaacgtagctggaacagcggctacgactggatcacagactttcccggcaagactgtgtggtttgtccccagcatcaagtccgggaacgacatcgccaattgtctgcgcaagaacgggaaaagggtgatccaactcagccgcaaaaccttcgacaccgagtaccagaaaaccaaaaacaacgactgggattacgtcgtaacaaccgacatctccgagatgggggccaacttccgggccgaccgcgtcatcgacccccggcgatgcttaaaaccggtgatcctgaaggacggcccggagagggtgattctcgcggggccgatgcccgtgaccgtggccagcgccgcccagcgtcggggtcggatcggaagaaatcagaataaggagggggaccagtatgtctacatgggccagcccctgaacaacgacgaggaccacgcccactggacggaggcgaaaatgcttctcgacaacatcaacacccccgaggggatcatcccagccctgttcgagcccgagcgggagaagtccgctgctatcgatggcgaataccgtctccgcggggaggcccgcaagaccttcgtagagctcatgcggcgcggcgacctgcctgtgtggctgagctacaaggtggcgtccgagggcttccagtacagcgaccggcgatggtgtttcgacggggagcggaacaaccaggtactcgaagaaaacatggacgtcgagatctggaccaaggagggggagaggaagaagttacgtccccgctggctggacgcccggacctatagcgaccccctcgccctgagagagttcaaggagttcgccgccgggagacgcagtgtgagcggcgacctaatcttggagataggcaaacttccccagcacctgaccctccgggcacagaacgccctggacaacctggtgatgttgcacaattccgagcagggcgggaaggcctaccgccacgccatggaggagttgccagacacgatcgagaccctaatgttactggcgttaatcgccgtcctcaccggcggggtgaccctgttctttctgagcgggaaaggcctgggaaagacttccatcgggctgctgtgcgtgactgccagctccgcccttctgtggatggccagcgtagagccccactggatcgcggcctccatcatccttgaattcttcctcatggtgctgctgattccggaacccgaccggcagcgcacaccgcaggacaaccagctcgcatatgtggtgatcggtctgctattcatgatccttacggtggccgctaacgaaatggggctcctggagacgaccaagaaggacctcggcatcggacacgtggcggctgagaatcaccagcacgccaccatgctggacgtcgacctgcggcctgccagcgcctggaccctctacgcggtggcaaccaccgtgataacccccatgatgcggcataccatcgagaacacgaccgccaacatctccctaacagccatcgcgaaccaagctgcgatcctgatggggctggacaagggctggcccatttctaagatggacatcggggtccccctgttggccctcggctgctactcccaggtaaatccactaaccctgacggctgcggtgctcatgctggtcgcgcattacgccataatcggtcccggcctgcaggcaaaagccacccgggaggcgcagaaacgcaccgccgcggggataatgaagaacccgaccgtcgatggcatcgtggcaatcgacctcgacccagtcgtgtatgacgccaaattcgaaaagcagctgggccagataatgctgttgatcctgtgcacgagccaaatcctgttgatgcgcaccacttgggcgctgtgcgaatccattaccctggccacgggtccactcactacgttatgggagggcagccccgggaaattctggaacacgacaatcgccgtgtccatggccaatatttttcgcggctcgtatctggccggcgcggggctcgccttttcgctgatgaagtccctgggcgggggacggagagggaccggcgcacagggcgaaaccctcggggagaagtggaaacgccagctgaaccagctgtccaagagtgagttcaatacatacaagcggagcggtatcatggaggtcgaccgttccgaggccaaggaggggctaaagaggggtgagaccactaagcacgcggtgagccgcgggacagccaagctgagatggttcgttgagcgcaacctggttaagcctgagggcaaggtgatcgacctgggctgcgggcggggcgggtggtcctactactgcgccggcctcaagaaggtgaccgaagtaaaggggtataccaagggcggccccgggcacgaagagcccatccccatggcaacgtatggatggaacctggtcaagctgcactctggcaaggacgttttctttatgccccccgagaaatgcgataccttactgtgtgacatcggcgaatcgagcccgaaccccaccatagaagaggggcgcacactgcgggtgctcaagatggtggagccctggctgagaggcaaccaattctgcatcaagatcctgaacccctacatgccgtctgtggtcgagactctcgagcagatgcagcggaagcacggcgggatgctggtccgcaaccccctgagccgtaactctactcatgagatgtactgggtgagctgcggcacgggaaacatcgtctccgctgtaaacatgaccagccgcatgctcctgaaccggttcacgatggcgcacaggaagcctacttacgaaagagatgtggatctgggcgcaggcacacggcacgtcgcggtggagcccgaagtggctaacctcgacatcatcggccagcgcatagagaacatcaagaacgagcacaaatccacgtggcattacgacgaggacaacccgtacaagacgtgggcctaccacggctcgtacgaggtcaaaccctcagggagcgcttcgagtatggtgaacggggtggtccggctgctgacgaagccctgggacgtgatccccatggttactcagatagcgatgactgacacgaccccgttcgggcagcagcgcgtgttcaaagagaaggtggacacccggacgccccgggcgaagcgtggcacgactcagatcatggaagtaaccgccaagtggctctggggcttcttgtcgcgaaacaagaagccccgaatctgcacccgggaggagttcacgcggaaggtgcgcagcaacgcagccatcggtgccgtgttcgtcgacgagaatcagtggaacagcgccaaagaagccgtggaggacgagagattttgggatctagtgcatcgcgagcgggagctccacaagcagggcaagtgcgcgacttgcgtctacaatatgatgggcaagcgcgagaagaagctgggagagtttggcaaggccaagggctctcgcgccatctggtatatgtggcttggcgcccgcttcctggaattcgaggcactggggttcatgaacgaggaccactggttcagccgggaaaactctctgagcggcgtagaaggggagggtctccacaagctggggtacatcctgcgcgacatctccaaaatccctggcggcaacatgtacgcggacgacaccgccgggtgggacaccaggatcacagaggacgaccttcaaaatgaggcaaagataacagagattatggaacccgagcacgcccttctagccaccagtatcttcaagctcacgtatcagaataaggtggtccgcgtgcagcgccccgccaaaaatggcaccgtaatggatgtcatctcccggagagaccagagggggtcaggccaggttggcacctatgggctgaatacgtttaccaacatggaggtacagctcatccggcagatggagtccgagggcatttttctcccctctgagctggagacgcctaacctggcggagcgggtcctcgactggctggagaaacacggggccgagcgcctgaagaggatggccatctccggtgatgactgcgtagtgaagccgatagacgatcgcttcgccaccgcgctcaccgccctaaacgatatgggtaaggtccggaaagatatcccccaatgggagcccagcaaaggctggaacgactggcaacaggtccctttttgctctcaccactttcaccaactcatcatgaaggacggccgcgaaatcgtcgtcccatgccgcaaccaggacgagctcgtgggacgggcccgtgtgagccagggcgccgggtggtccctgcgcgagaccgcctgccttggcaagagctacgcgcagatgtggcagctcatgtacttccaccggcgcgacctgcggctcgctgccaatgcgatttgctcggcggtgcccgtggactgggtacccacctcacgcaccacctggtcgatccacgcccatcaccagtggatgaccaccgaggacatgctgtccgtatggaaccgggtgtggatcgaggagaacccgtggatggaggacaagacgcatgtgagctcgtgggaggaggtcccctacctggggaagcgcgaagaccagtggtgcggcagcctgataggtctcaccgcccgcgccacctgggcaaccaacattcaagtcgcgataaaccaagtgcggcgcctgatcgggaatgagaactacttagactacatgacgtccatgaagcggttcaagaacgaatctgaccccgagggcgccctctggtga

SEQ ID NO: 23911 - RNA, 9879 nt, synthetic construct
  misc_feature 1..9879: note = derived and/or modified CDS sequence (opt11) from DENV-1__KJ189326__SS-prME
  source 1..9879: mol_type = other RNA
tctgtgaccatgctgctgatgttactgcccaccgccctggcattccacctaacgactcgcggcggcgaaccccacatgattgtgagcaagcaagaacggggcaagtcgctcctgttcaaaacctctgcaggggttaacatgtgcaccttaatcgctatggacctgggcgaattgtgcgaggatacaatgacctataagtgcccacagatcaccgaggccgagcctgatgacgtggactgctggtgcaacgccaccgatacgtgggttacctacgggacctgcagccagactggcgagcaccgccgggacaagcgatccgtagccctggcgccacacgtgggcctcgggcttgaaacgcggaccgagacctggatgtctagcgagggcgcctggaagcagattcagcgcgtcgagacctgggccctgcggcaccccgggttcacggtgatcgccctgttcctcgcgcatgcgatcggcacctcgatcactcagaaaggcaccatcttcatactgctcatgctcgtcacgccctccatggccatgcgctgcgtcggcatcggtaaccgggacttcgtggaggggctgagtggcgccacctgggtggacgtagtgctagagcacgggtcatgtgtgaccactatggcaaagaacaagcccactttagatatcgagctgcttaagactgaggtgaccaatcctgctattctccgcaagctgtgtatcgaggccaagatcagcaacaccacgaccgactcaagatgccctacccagggcgaggccaccctggtggaagaacaggacgcgaactttgtatgccgtcggacgttcgtggaccgcggctgggggaatggttgcggcctgttcggcaaagggagcctgttgacctgcgccaagttcaagtgcgtaaccaagctcgagggcaaaattgtacaatacgagaaccttaagtactcggtcatcgtgacggtgcacacgggagaccagcaccaagtcgggaacgagaccacagaacatggcaccatcgccaccatcactccccaggcgcccaccagcgaaatccaactgaccgactacggggcacttaccttggactgtagtccccggaccggcctggactttaacgagatggtgctacttaccatgaaggagaagtcctggctggtccacaaacaatggttcctcgacctgccgttaccctggacctccggggcgagcacctctcaggagacgtggaaccgccaggatctcctggtgaccttcaagaccgcccacgcgaagaaacaggaggtcgtcgtgctgggtagccaagagggcgctatgcataccgccttgacgggtgccacagagatccagacaagcggtaccacgactatcttcgccgggcacttaaagtgcaggctaaaaatggacaaactcactctaaagggcacgtcctacgttatgtgcactggcagcttcaagcttgagaaggaagtagcagagacccaacatggcacagtgctggtgcaggtcaaatatgagggcacagatgccccatgcaagattcccttctctacgcaggacgagaaaggggtgactcaaaacgggcggctcataaccgccaacccgattgttaccgataaggagaaaccggtcaacatcgagacggagccgccattcggtgagagctacatcgtcgtgggcgccggtgaaaaggcgttaaagctgtcgtggtttaagaaggggagctccattggcaagatgttcgaggccaccgcccgcggggcacgccggatggccatcctcggggacaccgcgtgggacttcgggagcatcggcggggtgttcacatccgtggggaagctggtgcaccaagtcttcggaacggcgtacggcgtgctgttttctggcgtgtcctggaccatgaagatcggcatcggcatcctactgacctggctgggcctaaatagccgctccacaagcctatccatgacgtgtatcgccgtcggcatggtgaccctgtacctcggcgtgatggtccaggcagacagcggctgcgtgataaactggaaagggagggaactaaagtgcgggagtggcatcttcgtgaccaatgaagtccacacatggacggagcagtacaagttccaggccgactccccgaagcgcctgagcgcggccatcggcaaagcttgggaggagggtgtctgcggcatacgctccgccacacggctcgagaacattatgtggaagcagatcagtaacgagctgaatcacatactgctcgagaacgacatgaagttcaccgtggtcgtgggggacgctaacggcatactggcgcaggggaagaagatgatccgcccgcagccgatggagcataagtactcatggaagtcttggggcaaggcgaagatcatcggtgccgacatccaaaacaccaccttcataatcgacgggcccgatacgccggagtgccccgacaaccagagggcctggaatatatgggaggtcgaggactacggcttcgggatctttaccacaaacatatggctgaagctccgcgactcgtacacccagatgtgcgaccaccggctgatgagcgcggcaatcaaggacagtaaggccgtccacgctgatatggggtactggatcgagagcgagaagaacgagacctggaagctggccagagcgtcctttatcgaagtgaagacttgtacctggcccaagagccacaccctatggtccaacggcgtgctcgagagcgaaatgatcatccccaagatatatgggggcccgatctcccagcacaactaccgacccggttacttcacgcagactgcaggtccatggcacttggggaagctcgagctggacttcgacctgtgcgagggcacgacagtcgttgtggacgagcactgcggcaaccgcgggcccagcctccggacaaccactgttaccggcaagataatccatgagtggtgctgccgctcctgtacgctgccgcccctgagattccgcggggaggatggttgctggtacggaatggagatccggcccgtaaaagagaaagaggagaacttagtgcgatcaatggtctcggctggcagcggcgaggtggacagcttctccctgggcatcttatgtgcgagcattatgatcgaggaggtgatgcggagccgctggagcaggaagatgctcatgactggaaccctggccgtcttcctgttgttggtgatggggcagctgacctggaacgacttaatccgcctgtgcataatggtcggcgcgaacgcctcagaccgcatggggatgggcacgacctacctggccttgatggccacattcaagatgcggccgatgttcgcagtcggcctgcttttccgcagactaacctcgagagaggtcctgctgttgacgatcgggctgagtctggtagcgagcgtcgagctcccgaactctttagaagagctgggcgacggcttagccatgggaatcatgatgctgaagctcctcaccgaattccagccacaccagctatggaccactctactctctctgacgttcataaagacaaccttatccttggactacgcctggaagaccaccgccatggcgctgagcatcgtgtccctgtttcccctctgcctgagtaccaccagccagaagacgacgtggctcccggtgctacttggctcctttggttgcaagcccttgacgatgttcctcatcaccgagaataagatatggggccgcaagtcctggcccttaaatgaggggatcatggccatcggcatcgtgtcgatcctgctctccagccttctgaagaacgacgtgcccctagccgggccactgattgccggcggcatgctgatcgcatgttacgtcataagcgggtcctctgcggacctttctcttgaaaaggccgccgaagtgagctgggagcaggaggctgagcactccggcacctctcacaacatcctggtggaggtccaggacgatgggaccatgaagataaaagatgaggaacgcgacgacaccctcacaatcttgctgaaggccaccctcctggcagtgtcaggcgtgtaccccatgagtatacccgctaccctgttcgtatggtacttctggcagaagaaaaagcaacggtcgggggtgctgtgggacacgcccagcccacccgaggtcgagagggccgttctggatgacggcatataccggatcctccaacgcggcctgctcgggcggtcacaagtgggggtaggggttttccaggacggcgtcttccacaccatgtggcatgttacccgcggtgccgtcctgatgtatcaaggcaagcgactggagcctagctgggcctccgtgaagaaggacctcatctcgtatggcggtgggtggaggttccaggggctatggaataccggggaagaagtgcaggtcatcgcggttgagccagggaagaacccgaagaacgtgcaaaccacccccgggaccttcaaaacccccgagggcgaggttggggccatcgccttagacttcaaacccgggacgtccggcagcccgatagtgaaccgggagggcaagatcgtgggactctacgggaatggagtcgtcaccacctccgggacctatgtaagcgccatcgcccaagcaaaggcatcccaggaggggcccctgccggagatcgaagacgaggtcttcaagaagcgcaatttaacgatcatggacctccatccggggtccggcaagacaaggcgctacctgcccgccatggtgcgggaggccatcaaacggaaactgcgtaccctcatccttgcaccgacccgcgtggttgccagcgagatggccgaggcgctgaagggcatgcccatccgctaccagacgaccgccgtgaagtccgaacacaccggccgggagatcgtggacttgatgtgtcacgcgaccttcacgatgcgcctgctgagcccggtccgggtaccgaactacaacatgatcatcatggacgaggcccactttacggaccccgcatcaatcgcagcccgaggctacataagcacccgggtgggcatgggcgaagctgcggcaatcttcatgactgcaacgcccccggggtccgtcgaggcgttcccccagagcaacgctgtgatccaggacgaggaaagggatatccccgagcggtcctggaatagcggctacgactggatcaccgacttcccgggaaaaaccgtgtggttcgttccgtccatcaagagcgggaacgacattgccaactgtctccgcaaaaacggcaagcgggttatacagctgtctcgtaagactttcgacacagaataccaaaagaccaagaacaacgattgggactacgtggtaaccacagacatcagcgaaatgggtgccaacttccgggccgaccgggtgatcgaccccagacgctgcctgaagcccgttatcctcaaggacggccccgagcgggtcatattggcggggcccatgcccgtgacggtcgcctccgcagcccagcgccggggccggatcggccggaaccagaataaggagggggaccaatatgtctacatgggccagcctctgaacaacgacgaggaccacgcccactggaccgaggcgaaaatgctcctggacaacattaataccccagagggcatcatcccggccctgttcgagcccgaacgcgagaagtccgccgccattgatggagaataccgcctccgcggagaggcccgaaagaccttcgtggagctgatgcggcgcggcgatctgccggtctggctatcctacaaagtggcgtcggagggcttccagtattccgatcggcgctggtgcttcgatggcgagcgcaacaaccaggtgctggaggagaacatggacgttgagatctggacgaaggagggcgagcgtaagaagctacgcccccgttggctggacgcccggacgtacagcgaccccctggccctgcgtgagttcaaagagttcgccgccgggcgaaggtccgtgagcggtgacctcatcctcgagatcggtaagcttccacagcacctcacgctgcgggcgcaaaatgccctggataatttagtgatgctgcacaacagcgagcagggaggcaaggcctaccgccacgctatggaggagctgccggacacgatcgagacattaatgcttcttgcgttgatcgccgtcctgaccggcggggtaaccctgtttttcctctccgggaaggggcttggcaaaacctcgattgggcttctatgcgtcaccgcatcaagcgccctactgtggatggcatccgtcgagccgcactggatcgcggcctccataatattggagttctttctgatggtccttctcatcccggagccagatcgacaacgcacgccccaggataaccaactggcttacgtggtcataggcctcctctttatgatactaaccgtggcagccaacgagatggggctgctcgagaccaccaaaaaggatctcggcatcgggcacgtagccgctgagaaccaccagcatgccacgatgctggacgtcgacctccgccccgcgtccgcctggaccctgtatgcggtggccacgaccgtgataacgcccatgatgcgacacacaatcgaaaacaccaccgcgaacatcagtctgacggccatagccaaccaagccgccatcctcatgggcctcgacaaaggctggcccatctccaagatggacatcggcgtccccctgttagccctgggatgttacagccaggtcaacccgctgaccctcacagctgccgtgctcatgttggtcgcccactacgccatcatcggacccggcctccaagccaaggctacccgggaggctcagaaacgcacggccgccgggatcatgaagaatcccacggtcgacggcatcgtggccattgacctggacccagtcgtgtacgacgccaaatttgaaaagcagttaggccaaataatgctcttaattctgtgtacctcccagatcctccttatgcgcaccacgtgggcgctgtgcgagtctatcacgctcgccaccgggccgctcaccacgctctgggaaggctcccccgggaaattttggaacaccactatcgccgtgagcatggccaacattttccgaggctcctatttagccggcgcggggctggccttttctctgatgaagagtttgggtgggggccgccgagggactggcgcgcaaggcgagacgctaggcgagaagtggaagcgccaactgaaccagctctccaaatccgaattcaacacctacaagcggtcaggaatcatggaagtggaccgcagcgaagccaaggaggggttaaaacggggcgagaccaccaagcacgcggtgtccagagggacggccaaactccggtggtttgtggagcgcaacctggtcaagcctgagggcaaagtgatcgacctcgggtgtgggcggggtgggtggtcttattactgcgccgggctgaaaaaggtaacggaggtcaaggggtacaccaagggtggcccagggcacgaagaaccgatccccatggccacctatggttggaacctggtcaagctccactccggcaaggacgtgttcttcatgccgcccgagaagtgtgacaccctgctgtgcgacatcggcgaaagcagtccaaaccccactatcgaggagggacgcaccctccgggtcttgaagatggtcgagccgtggctgcgcggcaaccagttctgcatcaagatcctcaacccatacatgcctagcgtggtggagaccctggagcagatgcagcggaagcacggtgggatgctggtccgcaaccccctatcccggaacagcacccacgagatgtactgggtgtcatgcggtactgggaacatagtgtcggccgtcaacatgacctcccgaatgctgctgaatcggttcaccatggcgcatcgcaagcccacctatgagcgcgacgtggacctcggcgccggcacgcgacacgttgccgtggaacccgaggtggccaatctagacatcatcgggcagcgtatagagaacatcaagaacgagcacaagagcacttggcattacgacgaagacaacccgtacaaaacctgggcttatcacggctcctacgaggtaaaacccagcgggtccgcaagctccatggtgaacggcgtggtccggcttctcacaaagccctgggatgtgatccctatggtcacccagatcgcgatgaccgacacgaccccgttcgggcaacagcgtgtgttcaaggaaaaagtagacacgcggacgccgcgggctaagcggggcaccacccagatcatggaggtcacagcaaagtggctatggggcttcctctcgcgaaacaagaaaccccgaatttgcactcgcgaggagttcacccggaaagtgcgcagtaacgcggcgatcggggccgtgttcgtcgacgagaaccagtggaacagcgcaaaggaggccgtggaggacgagcggttttgggacttagtgcaccgcgagcgggaactgcacaaacagggcaagtgcgcgacttgtgtctacaacatgatggggaaacgggagaagaagctgggcgagtttgggaaggccaagggctcccgagctatctggtacatgtggctcggggcccgcttcctggagttcgaggccctgggattcatgaatgaggaccactggttctcccgggagaacagcctctccggggtggaaggggagggcctccacaagctggggtacatcttacgtgatatctcaaaaatcccgggcggcaatatgtatgcggacgatacggccgggtgggatacgcggatcaccgaggacgacctgcagaacgaagctaagatcaccgagatcatggagcccgaacatgccctgctcgccacgagtattttcaagctgacctaccaaaataaggtggtccgcgtgcagagaccggcgaaaaacggcacggttatggacgtaattagtaggcgtgatcagcggggatccggacaggtgggcacctacgggctcaatacgtttaccaatatggaggtgcagctgatacgccaaatggaaagcgagggcatctttctaccttccgaactggagacaccgaacctggccgagcgcgtcctggactggctggagaagcatggggccgagcgcctcaaacggatggctatttccggcgacgactgcgtggtgaaacccatcgacgaccgcttcgccacagcgcttacggctctgaacgacatgggtaaggtccggaaggacataccacaatgggagccctccaaaggatggaacgattggcagcaggttccgttttgcagccaccacttccaccaactcatcatgaaggacggccgagagattgtggtcccctgcaggaaccaggacgagcttgtggggcgtgccagggtgtcccagggggccgggtggtctctccgagagacggcctgcttaggcaaatcctatgcgcagatgtggcaactcatgtacttccacagacgcgacctgcggctcgctgccaacgccatctgtagcgcagtccccgtggattgggtccccacttccagaaccacgtggtccatccacgcccaccaccagtggatgacgaccgaggatatgctgagcgtttggaaccgggtatggatcgaggagaacccgtggatggaggacaaaacacacgtgtcatcgtgggaggaggtcccgtacctcgggaagcgcgaggatcagtggtgcggatctctcattggtctgaccgcgcgcgcgacgtgggcgaccaacatccaggtggcgatcaatcaagtgcggcgcctgatagggaacgaaaactacctcgactacatgaccagcatgaagagatttaagaacgaatccgaccccgagggcgccctgtggtga

SEQ ID NO: 23912 - RNA, 9879 nt, synthetic construct
  misc_feature 1..9879: note = derived and/or modified CDS sequence (opt11) from DENV-1__KJ189327__SS-prME
  source 1..9879: mol_type = other RNA
agcgtgacgatgctactcatgttactgcccaccgcccttgccttccacctgaccacccggggcggggagccccatatgatcgtgtcaaagcaggagcgggggaagtcactgctgttcaagaccagcgcgggagtgaacatgtgcacactgatcgccatggatttgggagagctctgcgaggacacgatgacctataagtgtccccaaatcaccgaagccgaacccgacgatgtggactgctggtgtaatgccaccgatacctgggtcacctacgggacttgctcccagaccggcgagcatcgtcgggaaaagcgctccgtggccctagccccacatgtggggctgggcctagagacgcgcaccgagacctggatgagctccgagggcgcctggaagcagattcagcgtgtcgagacctgggcgctgcggcaccccgggttcacggtgatcgcgcttttcctcgcgcatgctatcggcaccagcataacccaaaaagggattatttttatcctgctgatgctcgttactccctccatggccatgaggtgcgtcggcatcggcaaccgagacttcgtggagggcctgagcggcgcgacgtgggtggacgtcgtgctggagcacgggtcatgcgtaaccaccatggccaaaaacaagcccactctcgacatcgagctcctgaagacggaggttaccaaccccgctatcctccgcaagctgtgcattgaggccaagatttctaacaccacgaccgactcccgctgccctacccagggcgaagccaccctggtggaggagcaggacgcaaacttcgtctgcaggcggaccttcgtcgaccgaggttgggggaacgggtgcggcctcttcggcaaagggagcctgctgacgtgcgccaagtttaagtgcgtgaccaagctcgagggcaagatcgtgcagtacgaaaacctcaagtactcggtcatagtgaccgtgcacaccggcgaccagcaccaggtaggcaatgagacgaccgagcacggcaccatcgcaaccatcacaccccaggcccccacgtcggagatccagctcacagactacggggccctcaccctggactgcagcccccggaccggcctggattttaatgagatggtgctcctgacgatgaaggagaagtcctggttagtccacaagcagtggttcttggatctgccgctgccgtggacatccggagccagcacgtctcaagagacgtggaaccgacaagacctcctggtgactttcaagaccgcccacgcgaagaagcaggaagtcgtcgttctgggctcacaagagggggccatgcacacagccctcaccggggccacggagattcagacgagcggcaccaccacaattttcgcgggccacctgaaatgccgtctgaaaatggacaagctcacgctgaagggcacctcctacgtgatgtgtaccgggtctttcaagttagagaaggaggtcgcggagacgcagcacggcactgtactggtgcaggtcaaatacgagggcacggacgccccctgcaagatacccttcagcacccaggacgagaagggagtgacgcagaacgggcgcctcatcacagccaacccgatcgtgaccgacaaggagaagcccgtgaacatcgaaaccgagccgcctttcggggaatcatacatcgtggtcggcgcgggcgagaaggctttaaagctgtcctggttcaagaaggggagcagcatcgggaagatgttcgaggccacggccagaggggcccgccggatggccatcctcggggatacggcctgggacttcgggagcatcggcggcgtcttcacctccgtggggaagttagtccatcaggtcttcggaacggcctacggcgttctgtttagcggcgtgtcctggacgatgaagatcgggatcggaatcctcctgacctggctgggtctaaattcacgctcgacaagcctgtctatgacttgcatcgccgtcgggatggtcacgctgtacctcggcgttatggtgcaggcggactcagggtgtgtgatcaactggaagggccgcgaactgaagtgcgggtcgggcatcttcgtaaccaacgaggtccacacttggaccgagcagtacaagttccaagcagactccccgaaacggctgtcggcggcaatcggcaaggcgtgggaggagggggtgtgcggcatccgctccgccacccggttggagaacatcatgtggaagcagatcagcaacgaactcaaccacatcctcctagagaacgacatgaagtttacggtagtggtgggcgatgcgaacggcatcctggcgcaagggaagaagatgatccgcccccagccgatggagcacaagtacagctggaagtcatggggcaaggccaagatcatcggcgccgacacacagaacaccacttttataatcgacgggcccgatacgccggagtgcccggacaaccaacgggcttggaacatttgggaagttgaggactatggcttcgggatcttcaccaccaacatatggctcaagctccgcgattcctacacccagatgtgtgatcaccggttgatgagcgcggccatcaaggactccaaggccgtgcatgccgatatgggctactggatcgaaagcgagaagaacgaaacgtggaagctggcccgcgcatccttcatagaagtgaagacttgcacctggcccaagagtcacaccctctggtccaacggtgtgctggagtcagagatgatcatccccaagatctacggtggcccgatttcccagcacaactaccgcccggggtacttcacgcagaccgccgggccctggcatttgggtaagctcgagctggacttcgacctgtgcgaaggcaccacagtcgtggtggatgaacactgtgggaatcgcgggccgagcctccggacgaccacagtcaccggcaagatcatccatgagtggtgctgtcgttcctgcactttaccgccgctgcgtttccgcggagaagacggttgctggtacggtatggaaatccgaccggtgaaagagaaggaggagaacctcgtacgctccatggtttcagctggctctggcgaggtagactcgttctccctggggatcctgtgcgccagcatcatgatcgaggaagtgatgcggtcccgctggagccgaaaaatgttgatgaccggcaccctggccgtcttccttctcctgatcatggggcagctgacctggaacgacctcatcaggctgtgcataatggtgggtgcaaatgcctctgacaggatggggatgggcacgacctacctggccttgatggcaacctttaagatgcggccgatgttcgccgtgggcctgttgttccgacgactcacctctcgcgaggtcctcctgctgacgatcgggttatccctggtggccagcgtggagctccccaactccttggaggagctgggcgacgggctcgccatgggcataatgatgctgaagctgttaaccgaatttcaaccccaccaactctggaccaccctgctcagcctgacgtttatcaagaccacgctatcccttgattatgcttggaaaaccactgccatggcgctctcgatcgtctcgctgttccccctctgtctgagcaccacctcccagaagaccacctggctgccggtgctcctgggcagcttcgggtgcaagcccttaacgatgttcctcattaccgaaaacaaaatctggggcagaaagagctggcccctgaatgaggggatcatggccatcggaatcgtcagcatcctgctgtcttctctgttaaagaatgacgtgcccttagccggcccgctgatcgccggcggcatgctgatcgcctgctacgtgattagcgggtccagcgcggacttatccctggagaaggccgccgaggtcagctgggagcaggaggccgaacactctggcacatcccacaacatcctggtagaggtgcaggacgacggcaccatgaagatcaaggacgaggaacgcgatgatacgctcaccatcctgctgaaggcaacgctcctggccgtctccggcgtgtatcccatgagcatccccgccaccctgttcgtgtggtatttctggcagaagaagaagcagcggtccggggttctttgggatactcccagtccacccgaggtggagcgcgccgtcttagacgacggcatatatcggatactgcagaggggcctgctcgggcgttcccaggtcggcgtgggcgtgttccaggacggcgtcttccacaccatgtggcacgtgacgcgcggcgccgtgctgatgtaccagggcaagaggctggagcccagttgggccagcgtcaagaaagacttgattagctacggcggaggctggcgcttccaggggtcctggaacaccggcgaggaggtccaggtcatcgcggttgagcccgggaagaaccccaaaaatgtccagacgacccccgggactttcaaaacccccgaaggcgaggtgggtgcgatcgccttggatttcaagcccggcacaagcgggtccccgatcgtcaaccgggaggggaaaatcgtaggactgtatgggaacggcgtggtcaccaccagcggaacctacgtgtccgccattgcccaggctaaagcaagccaggaagggccgcttccggagatcgaggacgaggtcttcaagaagcgaaatctgacgatcatggatctgcacccgggcagcggcaagacccggcgctacttgcccgcgatcgtccgggaggccataaagcgcaagctgcggaccctgatcctcgcgcccacaagagtggtcgcctccgagatggccgaggccctgaaggggatgcccatccgctaccaaacgaccgccgtcaagtcagagcacaccggacgcgagatagtagacttgatgtgtcacgccacatttacgatgcgcctcctgagtccggtgcgagtccccaactacaacatgatcatcatggacgaggcccacttcaccgacccggctagtatcgccgcccgcggctacatctccacccgagtaggaatgggggaggcggccgctatcttcatgaccgcgacgcctccgggcagcgtagaggccttcccccagtccaacgcagtcattcaggacgaggaacgcgatatccccgagcggtcttggaactccggctatgactggatcaccgacttccccggaaagactgtgtggttcgtgccgagcatcaagtccggcaacgacatcgccaactgcctccgtaagaatggcaagcgtgttatccagctcagccgtaagaccttcgatacggagtaccagaagaccaagaacaacgattgggactacgttgtgactaccgacatatccgagatgggagcgaacttccgggccgaccgcgtcatcgaccccagacgctgcctcaagcccgtgatcctgaaggacggccccgagcgggttatcctcgcgggtccgatgccggtcacggttgccagcgccgcccaacgccggggccgcatcggccggaaccaaaataaagagggggaccagtacgtctacatgggccagccgttaaacaatgacgaagaccacgctcactggaccgaggcgaagatgctactcgacaacatcaacacgcccgagggcataatcccggccttgttcgagcccgagcgcgagaagtccgccgccatcgacggcgaataccgcctgagaggggaggcccgaaagacctttgtcgagctcatgcggcgcggtgacctgcccgtttggctcagctacaaggtggcctccgagggtttccaatacagcgaccgacgctggtgcttcgacggtgagcgcaacaaccaagtgttagaagagaacatggacgttgaaatctggaccaaggagggagaacggaagaagctacggccccgctggctcgacgcccgcacgtacagtgacccgttggccctgcgtgagttcaaggaatttgccgccgggcggcgcagcgtcagcggagacctaatcctcgaaatcggcaagctgccccagcatctgacactccgggctcagaatgctcttgataacctggtgatgctccacaactccgagcagggcgggaaggcctaccgccatgccatggaggagctgcccgacactatcgagaccctaatgttgctggcattaatcgccgttctcaccggtggtgtcaccctgttcttccttagcgggaaggggctcgggaaaacgagcatcgggctgctgtgcgtgacagcgagctccgccctcctgtggatggcaagcgtggaacctcactggatcgcggcgtcaatcattctggagttctttctcatggtcctcttaatcccggaacccgaccgtcagcgcacgccccaggataaccagctcgcctacgtggttatcgggctgctgttcatgatcctcacagtcgccgccaatgagatggggttgctagagacaaccaagaaggatttaggcatcgggcatgtggcggcagagaatcaccagcacgccacaatgttagacgtggacctgaggcccgccagcgcctggaccctctacgcggtcgccacaactgtcatcactcccatgatgaggcacaccattgagaacaccaccgcgaacatttccctgaccgccatcgccaaccaggcggccatcctgatgggcctcgataagggctggcctataagcaaaatggacatcggggtgcccctgctggcccttgggtgttattcccaggtcaacccgctgaccctgaccgccgcggtgctgatgttggtggcacactatgccatcattgggccaggccttcaggccaaggctacccgggaagctcagaaacgcacggccgccgggatcatgaaaaaccctaccgtggacggcatcgtggccatcgatctggaccccgtggtctatgacgccaagttcgagaaacagctgggccagatcatgctcctcatcctgtgcaccagccagatcttgctcatgaggaccacatgggctctttgcgagtcaatcaccctggccaccgggcctctaaccacgctttgggaaggcagccccggcaagttctggaacacaaccatcgccgtgtccatggcgaatatcttccggggcagctacctggccggcgcgggactcgccttctccctgatgaagtcgctgggtgggggccgccggggcaccggggcacagggcgagacgctaggggagaaatggaagagacagctgaatcaactgtccaaaagcgagttcaacacctacaagcgttccggcattatggaggttgaccgctccgaggccaaagagggcctcaagcggggagagaccaccaaacacgcggtcagcagggggaccgctaagctgcggtggttcgtggagcgaaatcttgtgaagcccgagggcaaggtcatagacttaggctgcgggcggggcggatggtcgtactattgcgccggcctcaagaaggtgacggaagtgaagggatacaccaaaggcggccctgggcacgaggagccaatccccatggccacctacggttggaatctcgtgaaactgcacagcgggaaggacgtgtttttcatgccgccagagaagtgcgacacccttctgtgcgacataggcgagtcctcaccgaaccctactatcgaggaggggaggacactgcgggtgctcaagatggtagagccctggctgcgggggaatcagttttgtatcaagatcctgaacccctacatgccgagtgtggtcgagacactcgagcagatgcagcggaagcacggcgggatgctggtccgcaacccactcagccggaacagtacccacgaaatgtactgggtgagctgtggcacgggcaacatcgtgtctgcggtcaatatgaccagccgcatgctgctgaatcgattcaccatggcacaccgcaagcccaccttcgagcgcgatgttgacttaggcgccggcacgcggcacgtggccgttgagcctgaagtggccaacctcgatatcataggccagcggatcgaaaacattaagaatgaacacaagtccacctggcactacgatgaggacaacccgtacaaaacctgggcctaccacggctcctacgaggtgaagccctccgggagcgcgtccagcatggtcaacggagtggtgcggttgctgaccaagccctgggacgtcatcccgatggtgacgcagatcgcgatgaccgacaccacgccgttcgggcagcagagagtcttcaaggagaaggtagacacacggacgccacgggccaagcggggcaccacgcaaatcatggaagtgacggctaagtggctctggggcttcctgtcccgcaataaaaagccacggatctgcactcgggaggagttcacccggaaggttcgaagcaatgccgcgatcggcgccgtgttcgtggacgagaaccagtggaatagcgccaaggaggctgtcgaagacgagagattttgggacctggtgcaccgagagcgggagctccataagcaggggaagtgcgcgacctgcgtgtataacatgatggggaagcgcgaaaagaaactgggcgagtttggaaaggctaagggctcccgagccatatggtacatgtggctgggcgctcgcttcttggagtttgaagccctggggttcatgaatgaggaccattggttcagccgggaaaattccctgtcgggcgtggagggtgagggcctccataagttgggctatatcctgagagacatctccaagatccccggcggcaacatgtacgcggacgatacggccggttgggatacccggatcactgaagacgacctgcagaacgaggccaaaatcacggatatcatggagccagagcacgcccttctggccactagcatcttcaagctcacctaccagaacaaagtggtgagagtccaacggcccgcaaagaacggcaccgttatggatgtgatctcccggcgcgaccaacgggggtcgggtcaggtcggcacctacgggttgaacacgtttacaaacatggaggttcagcttattcgccagatggagtccgagggcatattccttcctagcgaattggaaaccccgaacctggccgagcgggtgctcgattggctggaaaagcacggggccgagcgtctcaagcggatggccatctccggcgacgactgcgtcgtcaagccaatcgacgacagattcgccaccgcgctaactgcattaaacgacatggggaaggtccggaaggacattccccagtgggagcctagcaaaggctggaacgactggcagcaggtcccgttttgctcgcaccacttccaccagctgattatgaaggacgggcgcgagatcgtagtaccctgccggaatcaggacgagctagtcgggcgcgcgcgagtgtcgcaaggcgccgggtggtccctgcgcgagacggcatgcctgggcaagagctatgcgcagatgtggcagctcatgtacttccatcggcgcgacctgagactggccgccaacgccatctgctcggccgtgcccgtcgattgggtccccaccagccgcactacgtggagcatacacgcccatcatcaatggatgacgaccgaggacatgctctccgtctggaaccgggtctggattgaggagaacccgtggatggaggataagacccatgtgagttcgtgggaggaagtgccctacctggggaagagagaagaccaatggtgcggcagcctgatcggcctcacggcccgagccacgtgggccaccaacatccaggtcgcgataaaccaggtgcggcgcctgatagggaacgagaattacctggactacatgacttccatgaagcggttcaagaacgaaagcgaccccgagggcgccctgtggtga

SEQ ID NO: 23913 - RNA, 9879 nt, synthetic construct
  misc_feature 1..9879: note = derived and/or modified CDS sequence (opt11) from DENV-1__KJ189328__SS-prME
  source 1..9879: mol_type = other RNA
agtgtgacaatgctgctcatgctactgcccaccgccctcgcctttcacttgaccacccggggcggggaaccccatatgatcgtcagcaagcaagagcggggcaagagcctactgttcaagaccagcgccggcgtgaatatgtgcaccctgatagccatggacttaggcgagctttgcgaagacaccatgacctacaagtgtccgcagatcaccgaggctgagcccgacgacgttgactgctggtgcaacgccaccgacacctgggtgacttacgggacctgcagccagaccggagagcaccggcgggagaagcgctccgtggcattagcgccccacgtgggcctggggctcgagacgcggaccgagacctggatgagcagcgaaggggcctggaagcagatccagcgcgttgagacctgggcgctgcggcaccccgggttcaccgtgatagccctcttcctagcgcacgccattggaacaagcatcacccaaaaggggatcatctttatcctgctaatgctcgtgaccccctcaatggccatgcgatgcgtgggcattggtaacagggatttcgtggagggcctgagcggcgccacgtgggtggacgtcgtactggagcacgggtcctgcgttaccaccatggcgaagaacaagcccaccctagacatcgagttgctgaaaacggaggttaccaacccagcgatcctccgtaagctctgcatcgaggccaagatcagcaataccaccacggactcccggtgcccgacccagggcgaggccacgctggtagaggagcaggacgccaatttcgtgtgcaggcggaccttcgtcgatcgcggttgggggaacggctgcggtttattcggcaagggtagccttttgacgtgcgccaaatttaagtgcgtgaccaagctcgagggcaaaatcgtgcagtacgagaacttgaagtactccgtaatcgtgaccgtgcacactggcgaccaacaccaggtcgggaacgagacgactgagcacggaaccatagccacaatcacgccacaggccccgacgagtgaaatacagctgaccgactacggggccctcactctggattgcagccctcgtaccggcctggactttaatgagatggtcctcctgactatgaaggagaaatcttggcttgtccacaagcaatggttcctcgacctgccacttccctggacttctggggccagcaccagccaggagacctggaaccgccaggacctcctcgtgacgtttaagaccgcccacgcaaagaaacaggaggtggtcgtactgggctctcaggagggcgccatgcacaccgccttgacgggggcaacggagatacaaaccagcgggaccacaacgatcttcgccgggcacctgaaatgccggttgaaaatggacaagctcaccctgaagggcacctcgtacgtgatgtgcaccgggagcttcaagttggagaaagaggtcgcggagacgcaacacggcaccgtgttggtgcaggtcaagtacgagggcaccgacgcgccctgcaagatccccttttccacccaggacgagaaaggtgtgacgcaaaacggccgactcatcaccgccaatccgattgtaaccgacaaggagaaaccagtgaacatcgagacagagccgcccttcggtgagagctatatcgtggtaggcgccggcgagaaggcccttaagctgagctggttcaagaagggcagctccatcggcaagatgtttgaggccacggcccgcggggccagacgcatggccatccttggggacaccgcgtgggacttcgggagcataggcggcgtcttcacgagcgtgggaaagctggtgcaccaggtcttcggtacggcatacggggttctgttctcgggcgtgtcctggacaatgaagatcggaattggcatcctcctaacctggctcggcctcaacagccgctcgaccagcctgtccatgacatgcatcgcggtggggatggtgacactgtacctcggcgtgatggtccaggccgactcagggtgcgtgataaactggaaagggcgcgagctgaaatgcggctccggaatcttcgtgaccaacgaggtccacacctggaccgagcaatacaagtttcaggcggatagcccgaagcggctgtccgcggccattggtaaggcgtgggaggagggcgtgtgcggtattcgctccgccacgcggctagagaatataatgtggaagcagatatccaacgagctcaatcacatactgctcgagaacgatatgaagttcacggtggtcgtgggcgatgcaaacggcatcctggcgcaggggaagaagatgatccgcccgcagcccatggagcacaagtactcctggaagtcatggggaaaggccaagattataggcgccgacatccagaacaccactttcatcatcgacgggcccgacaccccggagtgccccgacaaccagcgagcctggaacatctgggaggtagaagactacggtttcggtatcttcacgacaaacatctggctaaagctccgcgactcctacacccagatgtgcgaccatcggctgatgtctgcggccatcaaggactccaaggccgtccacgccgacatggggtactggatcgagagcgaaaagaacgagacctggaagctggcccgcgccagcttcatagaagtgaagacgtgcacctggcccaagagccacacactttggtccaacggtgtgctggagtccgagatgatcatccccaagatctacgggggcccgatcagtcagcacaattatcggcctgggtacttcacccagacggccggcccatggcacctggggaagttggagcttgatttcgacctgtgcgagggcaccaccgtcgttgtcgacgagcactgcggcaatagaggaccgagcctacggacaacaacggttacgggcaagatcatccacgagtggtgctgccgctcttgcacccttccgccgttacggttccgcggcgaggacggctgctggtacggcatggagatccggcccgtgaaggagaaggaggagaacctcgtacgcagcatggtttccgccggcagcggggaggttgattctttctcccttgggatcctgtgcgtcagcattatgatcgaggaggtcatgcgttcgcgctggtcccggaagatgctcatgaccggcactttagcagtgttcctactcctgatcatgggtcaactgacatggaaggatctcatcaggctgtgcatcatggtgggcgctaacgcatccgataggatgggcatgggcaccacctatctggccttaatggccaccttcaagatgcggccaatgtttgccgtcgggctgttgttccgccggctcacctcccgcgaggtgctgctgctcaccatcggactgtcactggtggccagcgtggaactgcccaactccctggaggagctgggagacgggctcgctatgggcataatgatgctgaagctgctcacggagttccaccctcaccagctgtggacaaccctgctcagcctgaccttcataaagacgacactgtctctcgattatgcctggaagacgacggccatggccctgagcatcgtgtccctcttcccactctgcttatctactacctcccagaagaccacctggctgccggtcctcctaggaagttttggttgcaagcccctgaccatgttcctcatcactgagaacaagatttggggccggaagtcctggcccctgaacgaggggatcatggcgatcgggatcgtgagcatcctgctatcctcgctactgaagaacgacgtgcctcttgccgggccgctgatcgccggcggaatgttaattgcctgctacgtcatcagcgggtccagcgccgacctctcactagagaaggcggccgaggtgagctgggaacaggaggccgaacactccgggaccagccacaacatcctggtcgaggtccaggacgacgggacaatgaagatcaaggacgaagagcgcgacgataccctcaccatcttgctaaaagccacgcttctggcggtgtccggtgtgtaccctatgagcataccagcgaccctgttcgtttggtacttctggcagaagaaaaagcaacggtcgggagtgctgtgggacacccccagcccgcccgaggtggagagagccgtcctagacgatggcatctaccggatcctgcagcgcggcctgctcgggcgtagccaagtaggcgtgggggtattccaggacggcgtgttccacacgatgtggcacgttacgcgcggggccgtcctgatgtaccagggcaagcggctggagccgagctgggcctccgtgaagaaggacctcattagctacggcgggggctggcgcttccaggggagctggaacaccggcgaggaggtgcaggttatcgccgtggagccagggaaaaatcccaagaacgtgcagaccacgcctggaaccttcaaaacgcccgaaggggaggtcggggcgatcgccctcgactttaagcccgggacttctggttcgcctatcgttaaccgggagggaaaaatagtgggtctttacggaaacggcgtagtcacgacctccggaacctatgtgtccgccatcgcgcaggcaaaggcgagccaggagggccccttaccagagatcgaggacgaggtcttcaagaagcgcaatctgaccataatggatctgcaccccgggtctggcaagacacggcgctacctccccgccatcgtgcgcgaggccatcaaacgcaagttacggaccctgatcctcgcccctacccgcgttgtcgcgtccgagatggcagaagccctgaaggggatgcccatccgctaccagaccacggccgtcaagagcgaacacacagggcgggagatcgtggacttgatgtgccacgccaccttcacgatgcgcctcctgtccccggtgagagttcctaactataatatgattatcatggacgaggcgcacttcacggaccccgcctccatcgccgcccgcggctacatctccacacgggtggggatgggcgaggccgctgctatatttatgaccgccacgcccccggggagcgtcgaagccttcccccagtccaacgccgtgatccaggacgaggagcgagacatccctgagcggagctggaactccggctatgactggatcacagacttccccggtaagacagtatggttcgttcccagcatcaagtccgggaatgacatcgcgaattgcctccgcaagaacggcaagcgggtgatccagctcagccgaaagacctttgacactgaataccaaaaaacgaagaacaatgactgggactacgtggtcacaaccgacatatccgagatgggtgcaaacttcagggcggatcgggttatcgacccccggaggtgcctgaagccggtgattcttaaggacggacccgagcgggtaatcctagccgggccaatgcccgtgaccgtggcctctgcggcccagcgccggggccggatcgggcggaaccagaacaaagagggggaccaatacgtctacatgggccaacccttgaataacgacgaggaccacgcgcactggacggaggccaaaatgctcctcgacaacatcaacaccccggaggggataatacccgcgctgtttgagccagagcgcgaaaagagcgccgcgatcgacggcgaatatcgccttcgcggtgaagcccgcaaaacctttgtggaactcatgcggcgcggcgatctgcccgtctggctgagctacaaggtggcgtccgagggcttccagtactcggaccggcgctggtgctttgacggggagcggaacaaccaggttctcgaggagaacatggacgtcgagatatggaccaaggaaggcgagcgcaagaagctgcgcccacgctggctggatgcccggacctactcggacccgcttgccctgcgagaattcaaggagttcgccgccgggcgacggagcgtatctggcgacctaatcctcgaaatcggtaagctgccacagcatctgacgctccgggcccagaacgccctagacaacctggtgatgctccacaactccgaacagggcgggaaagcgtaccgccacgccatcgaggagctccctgacaccatcgagaccttgatgctcctggccctgatcgcggttctcaccgggggcgttacgctgttttttctgagtggtaaaggactcggcaagacctccattgggctgttgtgcgttaccgcaagctccgctctcctgtggatggcgagcgtcgagccccattggatagccgcgtccataatcctggagttcttcctcatggtgctgctgatcccggaacccgaccggcagcgcacgccccaggacaaccaactcgcatacgtggtgatcggtctgctcttcatgatcctcacagtggcggctaacgagatggggctgctggagaccaccaagaaggacctcggcatcgggcatgtggcagcggagaatcatcagcacgccacaatgctggacgtcgacctgcggccggccagcgcctggacactctacgctgtggccacgaccgtcataacccctatgatgcgtcacacgatcgagaacactactgccaatatctcgctgacggccatagccaaccaggccgccatcctgatgggcctcgacaagggctggcctattagcaaaatggatatcggcgtccccttgcttgccctcggctgctactcccaggtgaacccgttgaccttaaccgccgccgttctcatgcttgtcgcgcattacgccattatcgggcccggcctgcaggcaaaagctaccagagaggcccagaagcggaccgcggctggaatcatgaagaatcccaccgtggacggcatcgtggccatcgacctcgacccagtcgtgtacgacgccaagttcgagaagcagctgggtcagataatgctgctcatcttatgcacgagccagatcctgctcatgaggaccacctgggccctctgtgagtccatcacgctggcgaccgggcctctcactaccctctgggaaggcagccccgggaagttttggaacacgaccatcgccgtgtctatggccaacatctttcggggcagctatcttgcgggggccgggctcgcgtttagcctgatgaagtccctgggcgggggccgccgggggaccggcgcccagggcgagaccctcggggagaagtggaagcgccagctgaaccagctgtccaagagcgagttcaacacctacaagcggagcggcataatggaagtcgatcgcagcgaggccaaggaaggtctcaagcggggcgagaccaccaagcatgccgtgtcacgcggcaccgcgaagcttcggtggtttgtggaaagaaacctggtcaaacccgagggcaaagtcatcgacctgggttgcgggcggggaggatggtcctactactgcgccggcctcaagaaggtgaccgaggtcaaggggtacacgaagggcgggccagggcacgaggaaccaatccctatggccacctacggctggaacctcgtgaagctgcacagcgggaaggatgtttttttcatgccgcccgagaaatgtgacacactcctgtgcgacatcggcgaatcaagcccgaaccccacgatcgaggagggccgcacgctgcgggtcctcaagatggtggagccctggctgcgcggcaaccagttctgcatcaaaatcctgaacccctacatgccgtccgtcgtcgagaccctcgagcagatgcagcggaagcacggcggtatgctggtgcgtaatcccctgagtcggaactccacacacgaaatgtattgggtgagctgcggcacgggtaacatcgtcagtgccgtgaacatgacgagccgcatgctccttaaccggttcaccatggcacacagaaagcccacctatgagcgcgacgtggacctcggggcggggacccggcatgtcgccgtggagcccgaggtggccaacctcgacatcatcgggcagcgcattgagaatatcaagaacgagcacaaatccacgtggcactacgacgaggacaacccgtacaaaacttgggcctaccacggtagctacgaagtcaagccgagtggaagcgcctccagcatggtgaacggcgtagtcaggctgctgaccaagccctgggacgtgatccccatggtcacccagatcgcgatgacggacaccaccccgtttgggcagcagcgcgtgttcaaggagaaggtggacacccggaccccccgcgccaaacggggaaccacccagatcatggaggtcacagccaagtggctctggggtttcctgtcgcgcaataaaaagccccggatctgcacgagggaggagttcacccggaaggtgcgtagcaacgccgcaatcggcgccgtattcgttgacgagaaccagtggaacagcgccaaagaggccgtggaggacgaacggttttgggacttggttcaccgcgaacgagagctccacaagcagggcaagtgcgcgacctgcgtatacaacatgatggggaagcgcgagaagaaactgggcgagtttgggaaggcgaaggggtcgcgggccatatggtacatgtggttaggcgcccgcttcctcgagtttgaggccctggggttcatgaacgaggaccactggttcagccgggaaaactcgctgtctggcgtggagggggagggcctgcacaaactagggtacatactgcgcgacatctccaaaatcccgggcggcaacatgtacgccgatgacacagcgggttgggacacgcggatcaccgaagacgacctccagaacgaggccaagattaccgatatcatggaacccgagcatgcactgctcgccaccagcatcttcaagctcacgtaccagaacaaggtggttcgcgtgcagcgtcccgccaagaacggcaccgtgatggacgtgatcagtcggcgcgaccagcgggggagcggccaggtgggcacttacgggctgaacactttcacgaacatggaagtgcagcttatccgccagatggagtctgagggcatcttcctccccagcgagctggagacgccgaacctggctgagcgggtcctggactggctggagaagcatggcgcagagcgccttaagcggatggcaatctcaggcgacgactgtgttgttaaacccatcgacgaccgcttcgccaccgccctcacagcgctgaacgacatggggaaggtgcggaaggacatcccacagtgggagcccagcaaggggtggaatgattggcagcaggtcccgttctgctcccatcactttcaccagctgatcatgaaggacggccgcgagatcgtggtcccgtgtcggaaccaagacgagctagtggggagagctcgggtgagccagggcgccgggtggtccctcaaggagaccgcgtgcttaggcaagtcgtacgctcagatgtggcagctcatgtacttccaccgccgggacctccgcctggcggccaacgccatctgctccgctgtccccgttgactgggtgcccacgtcccggaccacctggtccatccacgcgcaccaccagtggatgaccacggaagatatgctctctgtctggaaccgcgtgtggatcgaggagaacccgtggatggaggacaagacccacgtgagtagttgggaggaggtcccctacctagggaagcgggaggaccagtggtgcggaagcctgatcggcctcaccgccagagccacctgggccaccaacatccaggtggccatcaaccaggtgcgccggctgatagggaacgaaaattatctggactatatgacatccatgaagcgctttaaaaacgagagtgatcctgagggcgcgctctggtag

SEQ ID NO: 23914 - RNA, 9879 nt, synthetic construct
  misc_feature 1..9879: note = derived and/or modified CDS sequence (opt11) from DENV-1__KJ189329__SS-prME
  source 1..9879: mol_type = other RNA
tcggtgacaatgctgctgatgctgcttcccaccgccctggcgtttcacctgaccacccggggcggggagccccacatgatcgtgagcaagcaagagaggggcaagtctctcttatttaagacctccgctggagtgaacatgtgcaccttaattgccatggacctgggcgagttgtgtgaggacacaatgacctacaagtgcccacagatcacagaagccgagcccgacgacgtcgactgctggtgcaacgctaccgacgcctgggtcacctacgggacctgttcgcagaccggagaacaccggcgggacaagcgttctgtggcactagcccctcacgtgggactgggactggagacgcggacggaaacctggatgagctccgaaggcgcctggaaacaaatacagcgggtagagacttgggccctgcggcatcccgggttcaccgttattgctttcttcctggcccacgccatagggaccagcatcacccagaaggggatcatcttcatcctgttaatgctggtaaccccctcgatggccatgcgctgcgtcggcatagggaaccgggacttcgtggaagggctaagcggcgccacttgggtggacgttgtactagaacacggatcctgcgtgacgaccatggcgaagaacaaacccactttagatatcgagctcttgaaaaccgaggtcacgaaccccgcgatccttcgcaaactctgcatcgaggccaagattagcaacaccaccaccgacagccggtgccctactcagggcgaggccaccctggtggaggagcaggacgcgaacttcgtgtgccgccgcaccttcgtcgatagaggctgggggaatggctgcggtcttttcgggaaggggagcctcttgacatgcgcgaagtttaagtgcgtgacgaagttggagggaaaaatcgtccagtacgaaaacctaaagtactccgtaatagtcaccgtgcacaccggcgaccagcaccaggtcggcaacgagaccactgagcacggaacaatcgccacaatcacgccccaagcccccaccagtgagatccaacttacggactacggggccctgaccctcgactgctccccccggaccggccttgacttcaacgagatggtgctgctcaccatgaaggaaaagtcctggctggtccacaagcaatggttcctggacctcccgttgccttggacgtccggggccagcacctcccaggagacctggaaccgccaggacctgctcgttacctttaagacggcccacgcaaaaaagcaggaggttgtcgtgctgggctctcaggagggagcaatgcataccgccctgaccggggccaccgagatacagaccagtggcaccaccaccatcttcgctgggcacctcaagtgtcggctgaagatggataagttgaccctcaagggcacctcgtacgtgatgtgcacgggaagcttcaagttagaaaaagaggtcgccgagacacagcatggcacggtgctggtgcaggtaaagtacgagggcactgacgccccctgcaaaatccccttctctacccaggacgagaagggagtgacccagaacggccgcttaatcacagccaacccaatagtgaccgacaaggagaagcccgtcaatatcgagactgagccgcccttcggggaaagctacatcgtggtgggagcgggcgaaaaggccctcaagctttcctggttcaagaaggggagctccatcgggaagatgtttgaggccacagcccgcggggcccgccgcatggctattctgggtgacaccgcctgggacttcggcagcatcggcggcgtcttcacctccgtggggaagctcgtgcaccaggtattcggcaccgcttacggggtactgttctcaggtgtgtcctggaccatgaagataggcatcggcatactgctcacgtggctgggtctcaactcaaggtccacgagcctctcgatgacctgcatcgccgtcgggatggtgacactgtacctgggcgtgatggtgcaggctgactcggggtgtgtgataaattggaaggggcgcgagctcaagtgcggatccggcatattcgtaacgaatgaggtccacacatggacggagcagtacaaattccaggcggacagcccgaaacgtctgtctgccgccatcggcaaggcctgggaggagggggtgtgtggcattcgctccgcgacccggctggagaacatcatgtggaagcagattagcaacgagctcaaccacatcctgttggagaacgacatgaaattcaccgtcgtcgttggagacgcgaacgggattctcgcacaggggaagaaaatgatccgcccccaacccatggaacacaagtactcctggaagtcttggggcaaggccaagatcatcggcgccgacatccagaatacaacgttcatcatagacggacccgacaccccggagtgccccgacaaccagcgggcctggaacatatgggaggtcgaggactatggcttcgggatcttcaccacgaacatctggttgaaactgcgcgactcctacacacagatgtgcgaccaccggctcatgagcgctgcaatcaaggactcgaaagccgtccacgccgatatggggtattggatcgaaagcgagaaaaacgagacatggaagctggctcgcgcctcctttatcgaagtgaagacctgcacgtggccaaagtcccataccctgtggtccaatggcgtgctagagagcgagatgatcataccgaagatttacgggggcccgatctcccaacacaactacaggagcgggtatttcacccagaccgccggcccttggcacctggggaaacttgagctcgacttcgacctatgcgaggggacgaccgtagttgtagacgaacattgcggaaaccgcgggccctcccttcgaactaccacggtcactggcaagatcatccacgagtggtgttgtcgcagctgcaccctcccacccctccggttccgcggggaagacggctgctggtacgggatggagatacggcctgttaaggagaaggaggagaacctggtacgctccatggtctcggccggcagcggcgaggtggactccttcagcctcgggatcctctgcgcctccatcatgatcgaggaagttatgagaagccgctggtcccggaagatgctcatgacgggaacgctggctgtcttcctgctgctcgtgatgggtcaattgacctggaacgacctgatccgcctctgcattatggtgggcgccaacgccagcgaccgcatggggatgggcaccacctacctggcactgatggccacgttcaagatgcggcccatgttcgcggtcggcctgctgttccgtagactaaccagcagggaagtgctactgctgactatcgggctcagcctggtagcgtccgtcgagctgccaaatagtctcgaagagctgggagatggactagccatgggcattatgatgctcaagcttctgaccgaatttcagccacaccagctctggacgacccttctgtccctcactttcatcaagaccacgctaagcttggactacgcctggaaaaccactgcgatggccctctccatcgtgagcttgtttcccctgtgcctctccaccacgagccaaaagaccacctggctgcccgttctactcggctccttcggttgcaagccgctaactatgttccttatcacggagaacaaaatctgggggcgcaagagctggcccctcaatgaagggatcatggctatcggcatcgtgtccattctgctgagcagcctcctcaagaacgacgtgccattggccggtcctttaatcgccggagggatgcttatcgcttgttacgttatatccgggagctccgccgacctcagcctagagaaggccgccgaggtgtcctgggagcaggaggccgagcactcgggcacgtcccacaacatcctggtggaggtccaagacgacgggaccatgaaaatcaaggacgaggagcgcgatgacactctaaccatcctcctgaaggctacgctgcttgccgtgagcggggtgtacccgatgtctatacccgccaccctgttcgtctggtacttctggcagaagaagaagcaacggtcgggggtgctgtgggacacgcccagcccgcccgaggtcgagcgcgcagtcctcgatgacggcatctaccggatcctacaacgcggcctgctggggcggagccaggtgggcgtgggggtgttccaagacggcgtattccacacaatgtggcacgtgacgcgcggggccgtccttatgtaccagggtaagcggctggagccttcctgggcgtccgtcaagaaggacctgatctcctacggcggcggctggcgcttccaagggtcgtggaacaccggggaggaggtgcaagtcattgccgttgaacccgggaagaaccccaagaacgtgcagaccacccccggcaccttcaagacccccgagggcgaggtcggggccatcgccctcgactttaagcctggaaccagtgggtcacccattgtgaatagagaggggaagatcgtcggcctctatgggaatggcgtcgtgaccacgtccggtacctacgtcagcgccatcgcgcaggccaaagccagtcaggagggcccgctgcccgaaatcgaggacgaagtctttaagaagcgaaacctcaccatcatggacctgcaccccgggtccggcaagacccggcgctacctgccggccatcgtgcgggaagcgatcaagcgaaagttgcggacgctaatcctggcccctacccgagtggtcgcctctgaaatggcggaggccctcaaggggatgcctatccgctaccagaccaccgcggtgaagagcgagcacacggggagggaaattgtggacctgatgtgtcacgccacctttactatgcggcttctcagccctgtccgggtgccaaactacaacatgattatcatggacgaggcccacttcaccgaccccgcctccattgctgcacgcggctacattagcacgcgggtggggatgggcgaagccgccgctatcttcatgacagcaacgccgcccgggtccgtcgaggccttcccgcagtccaacgctgtgatccaggacgaggagcgggacatacccgagcgctcctggaatagcggctacgactggatcaccgactttcctgggaagacggtatggttcgtaccgtccatcaagagcgggaacgacatcgctaattgcctgcgcaagaacggcaagcgggttatccagctgtcccgcaagaccttcgacaccgagtaccagaagaccaagaacaacgactgggattacgtggtcaccacggacattagcgagatgggtgccaacttccgggcggatcgcgtgatcgacccgcggcgctgcctcaagcccgttatcctgaaggatggtcccgagcgggtcatcctggcggggccaatgccggtgaccgtggcctccgccgctcagcgccggggtcgaatcggccggaaccaaaacaaagagggtgaccagtacgtctacatgggccagccgctgaacaatgacgaggaccacgcccactggactgaggccaagatgctcctggacaacataaacacgcccgaggggatcatcccagcattattcgagccggagcgcgagaagagcgccgcaatcgacggagagtacagactgagaggtgaggcgcgtaagaccttcgtggagctcatgaggcgcggagacctccctgtttggctatcctacaaggtggccagcgaggggttccagtactccgaccggcgctggtgcttcgacggggagcggaacaatcaggtgctggaagagaacatggacgtcgagatctggacgaaggagggcgagcgcaagaagctccgccccaggtggctagacgcccgcacctacagcgaccccctcgccctaagggagtttaaggagtttgccgcggggcggcgcagcgtgtccggtgacttgatcctggagatcggcaagctccctcagcacctgaccagccgggcccagaacgcccttgacaacctcgtgatgctgcacaatagcgagcagggcgggaaagcttaccgccacgcgatggaggagttgcccgacacgattgagaccctcatgctgctggccctgatcgccgtccttaccggaggtgtgaccctgtttttcctctccgggaagggcctgggtaagacgtccatcgggctgctctgcgtgaccgccagctccgccctgctgtggatggcgtccgttgagccccactggatcgccgcatccatcatcctcgagttcttcctgatggtgctgcttattcccgagccggataggcagcggacgcctcaggataaccagcttgcatacgtggtcatcgggttgctgttcatgatcctgaccgtggccgcgaacgagatggggctgctcgagacgaccaagaaggacctgggcatcggacacgtggcggccgagaaccaccagcacgcaaccatgctagacgtcgacctccgccctgccagcgcgtggaccctgtatgccgtggccactaccgtgatcaccccgatgatgcgccacaccattgaaaatacgactgcgaacatatccctgaccgccatcgcgaatcaggccgcaatcctcatgggccttgacaagggctggcccatcagcaagatggacatcggggtccccctgctcgccctgggctgctattcccaggttaaccccctaaccctcacagcggccgtgctgatgctggtggcgcactatgccatcatcgggccgggactacaagcgaaggcgacccgagaggcccaaaagcgcaccgccgccgggatcatgaagaatcccacggtggatggcattgtggccattgacctggacccggtcgtatacgacgcgaaattcgagaagcagctgggccagatcatgctcctgatcctgtgcacaagccagattctcctgatgcgcaccacctgggccttatgcgagtccataaccctcgcaacaggaccgctcaccaccctatgggagggtagcccgggcaagttctggaacaccacgatcgccgtgtccatggcgaacatcttccgaggtagctatttagcaggcgccgggcttgccttttccctgatgaaatcactcggcgggggccgccggggcacaggagcccagggcgagaccctgggggagaagtggaagcgccagttgaaccagctcagtaagtcagagtttaacacctacaagcgtagcggcatcatggaggttgaccgctcggaggcgaaagagggcctaaaacggggcgaaacgaccaaacacgccgtgagtcgcgggaccgctaagctgcggtggtttgtggagcgcaacctcgttaagcccgagggcaaggtgatcgatctgggctgcggccggggcggatggagttattactgcgcgggcctgaaaaaggtgaccgaggtcaaggggtacaccaagggcggcccaggccacgaggagcccatcccgatggccacgtacggctggaacctcgtgaagctccactccggcaaggacgttttcttcatgccgccagagaagtgcgacaccctgctgtgtgacataggcgagtccagccccaacccgaccatcgaggaggggcggacattgcgggtcctgaagatggtggagccgtggctgcgcggaaaccagttctgcataaagatcctcaatccctacatgcccagtgtggtcgagacgctggagcaaatgcagcggaagcacggcgggatgctggtgcgcaatccgctcagccggaactccacccacgagatgtactgggtgagctgcggaaccgggaatatcgtctccgcggtgaacatgacaagtcgcatgttactgaatcggttcacaatggcccaccgaaaaccaacctacgagcgcgacgtggacctcggcgccggcacccggcacgtcgccgtggagcccgaggtggccaacctggatatcatcgggcagcgcatagaaaatataaagaacgagcacaagtccacctggcactacgacgaggataatccctaccgaacgtgggcttatcatggcagctacgaggtcaaaccgtccgggagtgcctcttcaatggtgaacggggtggtccgtcttctcactaagccgtgggacgtgattcccatggtcacccagatcgccatgaccgacacaactcccttcggccagcagcgggtgttcaaagaaaaggtggacacaagaaccccgcgggcaaagcgcggcacgacccagataatggaggtgaccgccaaatggctctggggcttcctaagccggaacaaaaagcctcgcatatgcacccgggaggaatttactagaaaggtgcgctccaacgcggccataggggccgtgttcgtcgacgagaaccaatggaactccgcgaaggaagcggtagaggatgagcgcttctgggatctcgtccaccgggagcgcgagctgcacaaacagggcaagtgcgctacttgcgtgtacaatatgatggggaagcgagagaagaagctgggcgaattcggtaaggccaaaggatcccgcgccatctggtacatgtggcttggagctcgttttctagagttcgaagcgctcgggtttatgaacgaggaccactggttcagccgcgagaactccctctctggcgtggaaggagagggactgcacaagctcgggtatatcctccgggacatttccaaaataccaggagggaacatgtacgccgacgacaccgccgggtgggacaccagaattacggaagacgaccttcagaacgaggccaagattaccgagatcatggagccggagcacgccctgctcgctacctctatattcaagctgacataccagaacaaggttgtccgcgtgcagcggcctgccaagaacggcactgtgatggacgtcatatcccgccgggaccagcgcgggagcggccaggtggggacctacgggctgaacactttcaccaacatggaagtgcagcttatccggcagatggagtccgagggcatattcctgcccagcgagctggaaacgccgaaccttgcagagcgcgtcctggactggctggaaaaacacggggccgagcggctaaagcgcatggcgatctccggcgacgactgtgtggtgaagccgatcgacgaccggttcgcgacggcgctgacagccctgaacgacatgggcaaggtccgcaaggacatcccccagtgggagcccagcaagggctggaacgactggcagcaggtacccttctgcagtcaccacttccaccagctaatcatgaaagatgggcgggagatagtggttccgtgcaggaaccaggacgagctggtgggtcgggcccgcgtgagccagggagctgggtggtccctgcgggagaccgcttgcctaggcaagtcgtacgctcaaatgtggcaactgatgtacttccaccgccgggatctccgcctcgccgccaacgcgatatgttcagccgtccccgtcgactgggtccccacctcccggacgacctggagcatccatgcgcaccaccaatggatgaccaccgaggacatgctgagtgtctggaaccgcgtctggatcgaggagaatccctggatggaggacaagacgcacgtaagcagctgggaggaagtcccatatctggggaagcgcgaggaccagtggtgtggcagcctcattggactgaccgcccgggccacctgggcgaccaacatccaggtcgccatcaaccaggtgcggcggctaatcgggaacgagaattacctagactatatgacgtccatgaagcgcttcaagaacgagagcgaccccgaaggcgccttatggtga

SEQ ID NO: 23915 - RNA, 9879 nt, synthetic construct
  misc_feature 1..9879: note = derived and/or modified CDS sequence (opt11) from DENV-1__KJ189331__SS-prME
  source 1..9879: mol_type = other RNA
agcgtgacaatgctgttgatgctgctgcccaccgccctggcctttcacctgaccacccggggaggggagccccacatgatagtgagcaagcaggagcggggcaaaagcctcctgtttaagaccagcgcgggcgtgaacatgtgtaccctgattgcgatggacctgggtgagctctgcgaggacaccatgacctacaagtgcccccagattaccgaggccgagccggacgacgtggattgctggtgcaacgccaccgacacctgggtaacatacgggacctgcagccagactggcgagcaccggcgcgacaaaagatccgtggctctggcgccccacgtgggcctggggctcgagacacggaccgagacctggatgagctccgagggggcctggaagcagatccagcgcgtcgagacttgggcgttacggcaccccgggttcacggtgatcgccctattcctggcgcacgccatcggaaccagcatcacccaaaaggggatcattttcatcctgctgatgcttgtaaccccctccatggctatgcgctgcgtcggcatcggcaaccgggacttcgtggaggggctgagcggcgccacgtgggtggatgtcgtgctggagcacgggtcctgcgtgaccactatggccaagaacaagcccaccctagacatagagctgctgaagacggaggtcaccaaccccgcaatccttcgcaagctttgcatcgaggccaagatcagcaacacgacaacggactcccggtgcccgacccagggcgaggccactctggtggaagagcaggacgccaatttcgtgtgccgtcggaccttcgtcgaccgcggctgggggaacggctgcggcctcttcggaaaggggagcctgttaacgtgcgctaagttcaagtgcgtgacgaagctcgagggcaagatcgtgcagtacgagaatctgaagtactccgtcatcgtgacagtgcataccggcgatcagcaccaggtcgggaatgagacgaccgagcacggaaccatcgcgaccatcacgccccaagcccccacgtctgaaatacaactgaccgactatggcgccctcaccctggactgcagcccccggaccggcctggatttcaacgagatggtgctcctgacgatgaaggaaaagtcctggctggttcacaagcagtggttcctcgacttaccgctgccctggacgtctggggccagcaccagccaggagacctggaaccgccaggacttgcttgtaacgttcaagaccgcccacgcaaagaaacaggaggtggtcgtgctgggctcccaggagggggccatgcacaccgccttaaccggggccacggagatccagaccagcggcactaccacgatcttcgccgggcacctcaaatgccgtctgaaaatggacaagctcaccctgaaaggcacctcctacgtgatgtgcaccgggagcttcaagctggagaaggaggtggcggagacgcaacacggaaccgtgctggtccaggtcaaatacgagggaaccgatgccccctgcaagatccccttctccacccaggacgagaagggtgtgacgcagaacggccgcctcatcaccgctaacccaatcgtgaccgacaaggagaagccagtcaatatcgaaaccgagccgcccttcggggagagctacatcgtggtaggggccggcgagaaggcgctgaagctgtcctggttcaagaaggggagctccatcggcaagatgttcgaggcgacggcccgcggggcccgccggatggcgatcctcggcgacaccgcgtgggacttcgggagcatcggcggcgtcttcacttccgtcgggaagctcgtgcaccaggtcttcggaacagcctacggggtgctgttcagcggagtgtcttggacgatgaagatagggatcggaattttgctgacctggctaggcctaaacagcaggtccacaagcctgtccatgacctgtatcgccgtcggcatggtgacgctgtacctcggcgtgatggtgcaggccgacagcgggtgcgtgatcaactggaagggccgcgagctgaagtgcgggagcggcatcttcgtgaccaacgaggttcatacctggaccgagcagtacaagttccaggcggacagccccaagcggctgagcgcggccatcggcaaggcctgggaagagggggtgtgcggcatacgctccgcaacccggctcgagaacatcatgtggaagcaaataagtaacgagctgaatcacatcctgctcgaaaacgacatgaagttcacggtcgtcgtgggcgacgccaacggcatactggcccagggcaagaagatgatccgcccgcagcccatggagcacaagtacagctggaagtcctggggcaaggccaagatcatcggtgccgacatacagaataccaccttcatcatcgacgggcccgatacaccggagtgtcccgacaaccagcgggcctggaacatctgggaggtggaggactacggcttcggtatcttcactaccaacatctggctgaagctccgcgactcgtacacccagatgtgcgaccatcggctgatgagcgcggccatcaaggactccaaggccgtccacgccgacatgggctactggatcgaaagcgagaagaacgaaacctggaagctggcccgcgcgtccttcatagaggtgaaaacgtgcacctggcccaaaagccacaccctctggtccaacggcgtactggagagcgagatgatcatccccaagatctacgggggcccgatctcacagcacaactaccggcccgggtacttcactcaaacggccgggccatggcacctggggaagttggagctggacttcgacctgtgcgagggcaccaccgtcgtggtggacgagcactgtggcaaccgcgggccgagcctccggaccacgaccgtcaccggcaagatcatccacgagtggtgctgccgctcctgtaccctgccccccctgcggtttcgcggggaggacggctgctggtacgggatggagatccggcccgtaaaggagaaggaagagaacctcgtccgcagcatggtctccgccgggagcggcgaggtggactcattctccctgggtatcctatgcgccagcataatgatcgaggaagtaatgcggtctcgctggagccggaagatgctcatgatcggcacgctggccgtcttccttctcttaatcatggggcagctgacctggaacgacctcatccgcctgtgcatcatggtgggcgcgaacgcctccgaccgcatggggatgggcactacctacctggccctcatggccacgttcaagatgcggcctatgttcgccgtggggctgctgttccgccggctcaccagccgcgaagtcctgctgctcaccatcgggctctcactggtggcgagcgtggagctccccaactcactggaggagctgggcgacgggctcgccatgggcataatgatgctgaagctgctaaccgagttccagccccaccaactgtggacgactctgctcagcctgaccttcatcaagactacgctgtccctcgactacgcctggaagaccaccgccatggccctgtcaatcgtttccctgttccctctctgcctgagcaccacgtcccagaagaccacctggctgccggtgctactcggcagtttcgggtgcaagcccctgaccatgttcctcatcaccgagaacaagatctgggggcggaagtcctggcccctgaacgaggggatcatggccatcggaatcgtcagcatcctcctatccagcctgctgaagaatgacgtccccttagccgggcctctgatcgctggtggcatgctgattgcctgctacgtgatcagcgggtccagcgcggacctttccttagagaagaccgccgaggtaagctgggagcaggaggccgagcactccggcaccagtcacaacatcctggtggaggtgcaagacgacgggacaatgaagatcaaggacgaggagcgtgatgacacactcacgattttactgaaggccaccctcctggccgtcagcggcgtttaccccatgagcatccccgcgaccctgttcgtgtggtacttctggcagaagaaaaagcagcggtcgggggtcctctgggacacccccagcccgcccgaggtggagagagccgtgctggacgacggcatctaccggatcttgcagcgcggcttactcgggcggtcccaagtcggcgtgggggtgttccaggatggcgttttccacacgatgtggcacgtgacccgcggggccgtactgatgtaccagggcaagcggctggagccgagctgggcctccgttaagaaagacctgatcagctatggcgggggctggcgcttccaaggatcctggaacaccggcgaggaggtccaagtgatcgccgtcgaacccgggaagaatccgaagaacgtgcaaaccacgcccggcaccttcaagacccccgagggcgaggtgggggcgatcgccctggatttcaagcctggcaccagcgggtccccgatcgtcaaccgggaggggaagatcgtgggcctgtacgggaacggcgtggtcactaccagcggcacctacgtgtccgcaatcgcccaggccaaggcgtcacaggagggcccgctccctgagatcgaggacgaagtgtttaagaagcgcaacctcaccatcatggatctacacccggggagcggcaagacacggcgctacctcccggcgatcgtccgggaggccatcaagcgcaagctgcggaccctgatcctcgccccgaccagggtagtggcgtccgagatggccgaggccctgaagggaatgcccatccgctaccagaccacggccgtcaagtcggagcacaccgggcgggagatcgtggacctcatgtgccacgctaccttcacaatgcgtctattatccccggtgcgggtccccaactacaacatgatcatcatggacgaggcacacttcacggatcccgccagcattgccgcccgcggctacatctccacccgggtggggatgggcgaggccgcggccatcttcatgaccgctacgccgcccggcagcgtcgaggccttcccccagtccaacgccgtcatccaggacgaggagcgcgacatccccgaacgcagctggaactcaggatacgactggatcacggacttccccggcaagaccgtgtggttcgtgccgagcatcaagtccgggaacgacatcgcgaactgcctccgcaagaacggcaagcgggtcatccagctaagccgcaaaaccttcgacacggagtatcagaagacgaagaacaacgactgggactacgtggtgaccacagacatctccgagatgggggctaacttccgggccgaccgcgtaatcgatccccggcgctgcctgaagcccgtgatactgaaggatggccccgagcgggtgatcctcgctggcccgatgccagtcaccgtggcgagcgcagcacagcgccggggccgcatcggccggaaccagaacaaggagggcgatcagtacgtgtacatgggccagcccctgaacaacgacgaggaccacgcccactggacggaggccaagatgctacttgacaacatcaacaccccagagggaatcataccggcgctgttcgagcccgagcgcgagaaaagcgcggccatcgacggcgagtaccggctgcgcggggaggcccgcaagaccttcgtggagttgatgaggcgcggcgacctgcccgtgtggcttagctacaaggtcgcgagtgagggcttccagtacagcgacaggcgctggtgcttcgatggggagcggaacaaccaggtgctcgaggagaacatggacgtggagatctggaccaaggagggcgagcgcaaaaagctgcggccccggtggctggacgcgcgaacctactctgacccgctcgccctgagggagttcaaggagttcgccgccgggcgacgtagcgtctctggcgacttgatcctcgagatcggcaagctacctcagcacctgacgctccgggcccagaacgcgctggacaacctggccatgctccacaactccgagcagggagggaaggcctaccgccacgccatggaggaactgcccgacactatcgagaccctgatgctcctggctctgatcgccgtgttaaccgggggcgtgacactgttcttcctgtcggggaagggcctcgggaagacctccatcgggttattatgcgtcaccgccagctccgccctcctgtggatggcctcagtggagccacactggatcgctgcgtccattatactggagttcttcctcatggtcctcctgatcccggagccggaccggcagcggacgccccaagacaaccagctcgcctacgtcgtgatcggattgctgtttatgatcctcacggttgccgccaacgagatggggctgctggagaccactaagaaggacctcggcatcgggcacgtcgcggccgagaaccaccagcatgctaccatgttagacgtggacctgcggccagccagcgcctggacgctctatgcggtggcgactaccgtcattacccccatgatgcgccacacgatcgagaacaccactgccaacatctccctgaccgccatcgccaaccaggccgctatcctgatgggcctcgacaagggttggcccatttcgaagatggacatcggggtgcccctgctcgccctcggctgctactcccaggtgaacccgctgacgctgaccgccgcagtcctcatgctggtagcccactatgccatcatcgggcccggcctgcaggccaaggccacccgggaggcgcagaagcgcacagcggccgggatcatgaagaaccccacggttgacggcatcgtcgccatcgacctcgaccccgtggtgtacgacgccaagttcgagaagcaactgggccagattatgcttctcatcctgtgcactagccagatcctgctcatgaggacgacctgggcgttatgcgagtccatcacgctggcgacagggccgctcaccaccctgtgggagggcagccccgggaagttctggaacacgaccatcgccgtctccatggccaatatattccggggcagctacctggccggcgcggggctcgccttctctctgatgaagtcgctgggcgggggccgccggggcaccggcgcccagggtgagacactcggggagaagtggaagcgccagctgaaccagctgtcgaagtccgagttcaacacgtacaagcggagcggcatcatggaagtggaccgctccgaggccaaggaagggctcaagcggggcgagaccaccaagcacgctgtgagccgcgggaccgccaagctgcggtggttcgtcgagcgcaacctcgtgaagcccgaggggaaggtgatcgacctgggttgtgggcggggcgggtggtcctattactgcgccggcctcaagaaggtcacagaggtgaaggggtacaccaaagggggccccggccacgaggaaccgatcccaatggcaacatacggctggaatctggtgaagctgcacagcgggaaggacgtcttcttcatgccgccggagaagtgcgacaccctgctgtgcgacatcggcgagtccagcccgaacccgactatcgaggaggggcgcacgctgcgggtgctcaagatggtggagccctggctccgcggcaatcagttctgcatcaaaattctgaacccctacatgccatctgtcgtggagacccttgaacaaatgcaacggaagcatggcgggatgctggtgcgcaaccccctgagccggaactccacccacgagatgtactgggtcagctgcggaacaggcaacatcgtgtccgccgtgaacatgacgtcgaggatgctcctgaatcggttcaccatggcgcaccgaaaacccaccttcgagcgagatgtcgacctgggcgcaggtacccggcacgtggctgtggagcccgaggtcgccaacttagacatcattgggcagcgcatcgagaatatcaagaacgaacataagagcacgtggcactacgacgaggacaacccgtataagacctgggcataccacggctcgtacgaggtgaagccgtccgggagcgcatccagcatggtcaacggcgtcgtgcggctgttgaccaagccctgggacgtgatccccatggtcacccaaatcgccatgacggacactaccccgttcgggcagcagcgcgtgttcaaagagaaggtcgacacccggacgccgcgcgcaaagcgggggacaacacagatcatggaggtgaccgccaaatggctctggggcttcctatcccgcaacaagaagccccggatctgcacacgcgaggagtttacccggaaggtgcgcagcaacgccgctataggggccgtctttgtggacgagaaccagtggaacagtgccaaggaggccgtggaggacgagcggttctgggatctggtccaccgcgagcgggagctccacaagcagggcaagtgcgcgacctgcgtgtacaacatgatggggaagcgcgagaagaagctgggcgagttcgggaaggccaagggctcccgcgccatctggtacatgtggttaggcgcccgcttcctcgagttcgaggccctagggttcatgaacgaggaccactggtttagccgagaaaactccctgagcggggtggagggggagggtctccacaaactgggatacatactgcgcgacatctccaaaattccgggcggcaacatgtacgcggacgacaccgctgggtgggacacgcgcatcaccgaagacgacctccaaaatgaggctaagatcaccgacattatggagcccgagcacgccctgctggccacgagtatcttcaagctcacgtaccagaacaaggtcgtgcgcgtgcagaggcccgcgaaaaacggcaccgtcatggacgtgatctcccgtcgcgaccagcgggggagcggtcaggtgggcacatacgggttgaacaccttcacgaacatggaggtacagctgatacgccagatggagtccgagggcatcttcctcccctctgagttagagaccccaaacctggccgagcgggtgctcgactggctggagaagcacggggccgagcgcttaaagcggatggccatatccggtgacgactgcgtggtcaaacccatcgacgaccgcttcgccactgcgctaacagccctgaacgacatggggaaggtgcggaaggacatcccacagtgggagcctagcaagggctggaatgactggcagcaggtcccgttctgctcccaccacttccaccagctgatcatgaaggacggccgcgagattgtcgtgccctgccggaaccaggacgagctcgtcgggcgcgcccgtgtcagccagggcgccgggtggtccctgcgcgagaccgcatgcctgggcaagagctatgcgcagatgtggcagctcatgtacttccaccggcgcgacctgagactggctgccaacgccatctgctccgcggtgcccgtggactgggtccccacgagccgcacgacctggagcatccacgcccaccatcagtggatgacgacggaagacatgctcagtgtgtggaaccgggtgtggatcgaggagaacccgtggatggaggacaagacccacgtcagctcctgggaggaagtgccgtacctggggaagcgcgaggatcagtggtgcggctcgctgatcggcctcactgcccgcgccacctgggccacgaacatacaggtggctatcaatcaggtccggcgcctgatcgggaatgagaactacctggactatatgacgagcatgaagcggttcaagaacgagagcgaccccgagggcgccctctggtaa

SEQ ID NO: 23916 - RNA, 9879 nt, synthetic construct
  misc_feature 1..9879: note = derived and/or modified CDS sequence (opt11) from DENV-1__KJ189332__SS-prME
  source 1..9879: mol_type = other RNA
agcgtgaccatgctgctaatgctactgcctaccgccctcgcattccacctgactacccggggcggggagccccacatgatagtgtcgaagcaggaacggggcaaaagcctcttattcaaaacctcggcgggggttaatatgtgtacgctgatcgccatggacttaggggagctctgcgaagacaccatgacctacaaatgcccacagattactgaggccgagcccgacgacgtagactgctggtgcaacgccaccgacacctgggtgacctacgggacctgctcccagaccggcgagcaccgcagagacaagcgctccgtggccttggcgccccacgtgggcctggggctcgagacgcggaccgagacctggatgtcgagtgagggcgcctggaagcagatccagcgcgtcgagacctgggccctgcggcaccccgggttcacggtcatcgccctgtttctcgcgcatgctatcggcaccagcattacccagaaggggaccatcttcatcctgctgatgctagtgacgccctccatggctatgcgctgcgtcggcattggcaaccgggacttcgtggagggtctgtcgggcgccacctgggtggacgtagtgctggaacacggatcatgcgtgacgaccatggccaagaacaagcccacgctcgacatcgagctgctgaaaaccgaagtcaccaaccccgcgatcctccgcaagttgtgtatcgaagcgaagatcagcaacaccacgaccgactctaggtgcccaacccagggcgaggccaccttggtggaggagcaggacgcaaactttgtgtgccgtcggacgttcgtcgacagaggctggggtaacggctgcggcctcttcggcaaggggagcctgctgacctgcgccaagtttaagtgcgtgaccaagttagagggcaagatcgtccagtacgagaacttaaagtacagcgtcatcgttaccgtgcacacaggcgaccagcaccaagtcggaaacgagacgaccgagcacggcaccatcgcgactatcacgccgcaggcccccaccagcgagatccagctcaccgactacggggccctcacgctggactgtagcccccggacggggctggacttcaacgaaatggtgctcctgaccatgaaggagaagtcctggctggtccacaagcagtggtttctcgacctgccgctgccctggacctccggggccagcaccagccaggagacgtggaacagacaggaccttctggtgacctttaagaccgcccacgcgaagaagcaggaggtggttgtgctgggttcccaggagggtgccatgcacaccgccctcacgggggccactgagatccagaccagcggcacaacaacgatcttcgccgggcaccttaagtgccggttgaagatggacaagctcacgctgaagggcacctcatacgtgatgtgcacggggtcattcaagctggaaaaagaggtggcggagacccaacacggcaccgtgctggtgcaagtaaagtacgagggcacagacgccccctgcaagatccccttctccacgcaagacgagaagggggtgacacagaacggccggttgatcaccgcgaacccgatcgtgaccgacaaggagaagcccgtcaacatagaaacggagccgccgttcggggagagctacatcgtggtaggggccggcgagaaggccctgaagctgtcatggttcaagaagggtagctcaatcgggaaaatgttcgaagccaccgcccgcggggcccgccggatggcaatcctcggcgacacagcctgggacttcgggagcatcggcggcgtcttcacctccgtgggcaagctggtacaccaggtcttcggcacggcctacggggtattattcagcggcgtgtcctggaccatgaaaatcgggatcgggatcctcctcacatggttgggcctcaacagccgctccacctcgttatcaatgacgtgcatcgccgtagggatggtgactctgtacctcggcgtgatggtacaagccgactctgggtgcgtgatcaactggaaaggccgagagctgaagtgcggctccgggatctttgttaccaacgaagtccacacctggacggagcagtacaagtttcaggccgatagccccaagaggctatcagcggccatcggcaaagcatgggaggagggggtgtgcggcattcgctccgccacgcggctagagaacatcatgtggaagcagatctctaacgagctgaaccacatcctgctagaaaacgacatgaagtttaccgttgtcgtaggggacgccaacggcatcctggcgcaggggaaaaagatgatccgcccccagcccatggagcacaagtactcctggaagtcctggggcaaggctaagatcatcggcgccgacatccagaacactaccttcatcatcgatggccccgatacgccggagtgccccgacaaccagcgagcctggaacatctgggaggttgaggactacggcttcgggattttcaccaccaacatctggctgaagttacgtgactcctacacccagatgtgcgatcaccggttaatgagcgctgccattaaggattccaaggccgtccacgcagacatgggctactggatcgagtccgagaagaacgagacgtggaagctggcccgcgcttccttcatcgaggtgaagacgtgcacctggcccaagagccacaccctctggtccaacggcgtgctggagagcgagatgatcatacccaagatctacggcggcccaatcagtcagcacaactaccgtcccgggtacttcacgcagaccgccggcccgtggcatctgggtaagctagagctggacttcgacctgtgcgagggcacgaccgtcgtggtggacgagcactgcggtaaccgcgggccgagcctccggacgaccaccgtcaccggcaagataatccacgagtggtgttgcaggagctgcaccctcccgcccctgcggttccgcggggaggacggatgctggtacgggatggagatccggcctgtgaaggagaaggaggagaatctcgtgcgtagcatggtgtccgcaggcagcggcgaggtggattcgttctccctggggatcctgtgcgctagcatcatgatcgaggaggtgatgcggtctcgctggagccggaaaatgctcatgaccggcaccctagcagttttcctgctcctgatcatggggcagctgacctggaacgacctcatccgcttatgcatcatggtgggcgccaacgcctctgaccgcatggggatgggcacgacctatctggccctcatggccaccttcaagatgcggccgatgttcgccgtggggctgctgttccgccgcctcaccagccgcgaggtactgctgctcacgatcgggctgtctctggtcgcatccgtggaactccccaactccctggaggagcttggcgacggactagccatgggaatcatgatgctgaagctgctcaccgaattccagccccatcagctgtggaccactctgctcagcctgacgttcatcaagaccacgctgtccctagactatgcttggaaaacgacggccatggcgctgagcatcgtctccctattccccctctgcctgagcaccacctcccagaaaaccacctggttacccgtgctcctgggcagcttcggctgcaagcccctgacgatgttcctcatcaccgagaacaagatctggggccgtaaatcctggcccctgaatgagggtataatggccatcggcattgtcagcatcttactctccagccttttgaagaacgacgtgcccttagccggcccgctgatcgccggcggcatgctgatcgcttgttatgtgatcagtggctccagcgcggatctctccctggagaagacagctgaggtgtcatgggagcaagaggccgagcactccggcacaagccacaacatcctggtggaagtgcaggacgacgggaccatgaagattaaggacgaggagcgcgacgacaccctcaccatcctgctcaaggccaccctcctggccgtgtccggcgtgtaccccatgtccatcccggcgacactgttcgtctggtacttttggcagaaaaagaaacagcggagcggggtcctctgggacacacccagtccgcccgaagtagaacgcgccgtgctggacgacggcatctaccggatactgcagcgcggactgctcgggcggtcgcaggtcggcgtgggggtgttccaggacggcgtcttccataccatgtggcacgtgacacgaggggccgtgctaatgtaccagggtaagcggctggagccctcctgggcctccgtcaaaaaggacctcatcagctacggcgggggctggaggttccagggaagttggaacacgggcgaggaggttcaggtgatcgccgtcgagccaggaaagaacccgaagaacgtgcagactacccccggcaccttcaaaacgcctgaaggcgaggtgggtgcgattgccctggacttcaagcccggcaccagcgggtccccgatagtcaacagagagggcaagatcgtgggcctgtacgggaacggcgtcgttaccaccagcgggacttacgtttccgccatcgcccaagccaaggcaagccaggaaggaccccttcccgaaatcgaagacgaggtcttcaagaagcgcaacctgaccatcatggacttacacccggggtcgggcaaaacccggcgctacctccccgccatcgtcagggaagcgattaagcgcaaacttcggaccctgatcctcgcccccacgcgcgtggtggcgtccgagatggcagaagccctgaagggcatgcccatccgctaccaaaccaccgccgtcaagagcgagcacaccggtcgggagatcgtggatttgatgtgtcatgccacgttcaccatgcgtctcctgtccccggtgcgggtccccaactacaatatgatcatcatggatgaagcgcattttactgaccccgccagcatcgccgcccgcggctacatctccacccgggtggggatgggcgaggccgcggccatctttatgacggcgacaccgcccgggtctgtggaagccttcccacagtctaatgccgtcatccaggacgaggaaagagacatccccgaacggagttggaactccggctacgactggatcaccgacttccccggcaaaaccgtttggttcgtgcccagcatcaagtccggaaacgacatcgcgaactgcttacgcaagaacggcaagcgggtcatccagctcagccgcaagacgtttgacacggagtaccagaagaccaagaacaacgactgggactacgtggtgaccacggacatcagcgagatgggggcgaacttcagagcagaccgcgtgatcgacccccggcgctgcctcaaacccgtgatcttgaaggatggtcccgagagggtgatactcgcagggccgatgccagtcaccgtggcgagcgccgcccagcgccggggccgcatcggccggaaccagaacaaagagggagaccaatacgtgtacatgggccaacccttaaataatgacgaggaccacgcacattggaccgaggcaaagatgctgttggacaacattaacacccccgaggggatcatcccggcattgtttgagcccgagcgcgagaaatccgccgcaatcgacggcgagtaccgcttacgaggggaggcccgcaagaccttcgtcgaactgatgcggaggggcgaccttccagtttggctgagctacaaagtcgcctcagaggggttccagtacagcgaccggcgctggtgcttcgacggggagcgaaacaaccaggtactagaggaaaacatggacgtggaaatctggacgaaggagggcgagcgcaagaaactccggccccgctggctggacgcgaggacctattccgacccgctcgccctgagagaattcaaggaatttgcagctgggcggcgctcagtcagcggcgacctgattctcgagatcggaaagctgcctcagcacctgaccctgcgggcccagaacgcgctcgataacctggccatgttacataactctgaacagggagggaaagcgtaccgccacgccatggaggaattgcccgacaccatcgagacattgatgctcctggcgctgatagccgtgctcaccgggggcgtgaccctgttcttcctgagcgggaagggcctcgggaagacgtccatcgggctactgtgcgtcacagccagctccgccctcctgtggatggcctccgtggaaccccactggatcgcggcctccatcatcttagagttcttcttgatggtgcttctgatacccgaacccgaccgacaacgcacgccccaagataaccaactcgcctacgtcgtgatcggcctgctgttcatgatactcacagtggcggccaacgagatgggcctgctggagaccaccaagaaggacctcggaatcgggcacgtcgcggccgagaatcaccagcacgccacgatgcttgacgtggacctgcggccggcctccgcctggaccctctacgccgtggcgacaacagtcataacccccatgatgaggcacaccattgagaacaccacggccaacatttcgttaacggccatcgccaaccaggcggccatcctgatgggcctcgacaagggctggcccatcagcaaaatggatatcggtgtgccactgctggccttgggctgctattcccaggtgaatccgctgaccctgaccgccgcggtgctcatgcttgtcgcccactacgccatcatcgggcccggcctgcaggccaaggccacgcgggaggcgcagaagcgcaccgccgccgggatcatgaaaaaccccaccgtcgacggtatagtcgctatcgacctggatcccgtggtgtacgacgccaaattcgagaagcagctgggccagatcatgctgctcatcttatgcacctcacaaatcctattaatgcgcactacctgggcgctgtgcgagtcgatcaccctggctaccgggcctctcacgaccctgtgggagggcagcccgggtaaattctggaacaccaccatcgctgtctccatggccaacatcttccgcggtagttacctggccggcgcgggactcgccttttccttgatgaagtctctgggaggcggccgccgggggacgggcgcccagggcgaaaccttgggggagaagtggaagcgccaactcaatcagctgtccaaaagcgagttcaacacctataaaagaagcgggatcatggaggtggaccgctccgaggctaaggaggggctcaagaggggcgagaccaccaagcacgcggtgagccgcggtacggccaagttacggtggttcgtcgagcgcaacctggtgaagcccgaaggcaaggtgatcgatttgggttgtgggcggggagggtggagttactactgcgccggccttaagaaagtcaccgaggtgaaggggtataccaaaggcggcccagggcacgaggagccgatccccatggccacctacggctggaacctggtcaagttacacagcgggaaggacgtattcttcatgccgcccgaaaaatgcgatacactcttatgcgacatcggagagagtagcccgaaccccaccatcgaggaggggcgcactctgcgggtactcaagatggtggagccctggctgcgcggcaaccagttctgcatcaagattctgaacccctacatgccgtccgtcgtggaaaccctcgagcagatgcagcggaagcacggcgggatgttggtgcgcaaccccttaagccggaacagtacgcacgagatgtactgggtcagctgcggcacgggcaacatagtgtccgccgtgaacatgaccagccgcatgctcctgaaccggttcacgatggcgcaccgaaagcccactttcgagcgcgacgtcgacctgggcgccggcacccgtcacgtggcggtggagcccgaagtcgcaaacctcgatatcatcggccagcgcatcgagaacattaagaacgagcacaagtccacctggcactacgacgaggacaacccgtacaagacctgggcctaccacggcagctacgaggtgaagccgtcgggcagcgcgtctagcatggtcaacggcgtggtgcggctgctgacgaagccgtgggacgttatcccgatggttacccagatcgccatgaccgacaccacaccgttcggccagcagagggtgttcaaggagaaagtcgacacccggacgccccgggccaagcggggaaccacgcagatcatggaggtgaccgccaagtggctctggggcttcctgtcacgcaacaagaaaccccggatctgcacccgcgaagaattcacccggaaagtgagatccaacgccgcgatcggcgccgtcttcgtggatgaaaaccagtggaacagcgccaaggaggcggtggaagacgagcggttttgggacctggtgcaccgcgaacgggagctccacaagcagggtaagtgtgcgacatgcgtgtataatatgatggggaagcgtgagaagaagctgggagagttcgggaaggccaaggggtctcgggcaatttggtacatgtggctgggcgcccgcttcctcgagttcgaagcccttgggttcatgaacgaagaccactggttcagccgggagaactccctgtctggcgtggagggggagggcctccataaactggggtacattctgcgagacatctccaagatcccgggtggcaacatgtacgcggacgacaccgctgggtgggacacccggatcactgaggatgacctccagaacgaagcgaagataacggacatcatggagcccgaacacgccttactggccaccagcatattcaagttgacctaccagaataaggtcgtgcgcgtgcagcggcccgcgaagaacgggaccgtcatggatgtgatctccaggcgagaccagcgggggagcggccaggtgggtacgtacgggttaaacacctttaccaacatggaagtccagcttatacgccagatggagtccgaaggcatcttcctcccgtcagagttagagaccccgaacctggccgagcgggtccttgactggttagagaaacacggtgccgaacgcctgaaacggatggccatctccggcgacgactgcgtggtcaaacctatcgacgaccgcttcgccacagctctcacagccctgaacgatatgggcaaggtgcggaaggacatcccccagtgggagcccagcaaaggatggaatgattggcagcaagtgccgttctgctcccaccacttccatcagctcatcatgaaggacggccgcgagatcgttgtgccctgccgtaaccaggacgagctcgtggggcgtgcccgggtcagccagggcgccgggtggtcccttcgcgagaccgcctgtctgggcaagagttatgcgcagatgtggcagctcatgtacttccaccgccgcgacctgcggctggccgccaacgcgatttgctccgcggtgcccgtggactgggtccccaccagccgcacgacctggagcatccacgcccaccatcagtggatgaccacggaggacatgctctccgtatggaatcgggtgtggatcgaagagaacccctggatggaagacaagacccacgtgagctcctgggaggaggtgccgtacctggggaagcgcgaggaccagtggtgcggcagcctgatcggcctcacggcacgcgcgacctgggccaccaacatccaggtggcgatcaaccaggtgcggcgcctgatcgggaacgagaattatctggactacatgacctccatgaagcggttcaagaatgaaagcgaccccgagggcgccctctggtaa

SEQ ID NO: 23917 - RNA, 9879 nt, synthetic construct
  misc_feature 1..9879: note = derived and/or modified CDS sequence (opt11) from DENV-1__KJ189334__SS-prME
  source 1..9879: mol_type = other RNA
agcgtgaccatgttgctcatgcttctgccaaccgccctggcgttccacctgaccacccggggcggggagccgcacatgatcgtgagtaaacaggagagagggaagagcctgctattcaaggtgtccgcaggggtgaacatgtgcacgctgatcgcgatggatctgggcgagttgtgcgaggacaccatgacctacaagtgtccccagatcaccgaggccgagccagacgacgttgattgctggtgcaacgccacagacacctgggtgacctacgggacctgctctcaaaccggtgagcacagacgggacaagcgctcggtggccctggcgccccacgtcgggctggggctcgaaacgcgcaccgagacatggatgagctccgagggggcatggaagcagatccaacgcgtggagacctgggccctgcggcatcccgggttcaccgtgattgccttctttctagctcacgccatcggcacgtcgataacccagaaaggtattatctttatcctcctgatgctggtcaccccctccatggccatgagatgcgtgggaatcgggaaccgcgactttgtggaggggctcagtggcgctacctgggtcgacgtggtgctggagcacggatcctgcgtcacgactatggccaagaacaagcccaccctggacatcgaactcctgaagacagaggtgacgaatccggcgatcctgcgcaagctctgcatcgaggccaagataagcaataccaccaccgattcccggtgcccaacgcaaggcgaggcaactctggtggaggagcaggacgcaaactttgtgtgccgccgcaccttcgtcgaccgcggatgggggaacggctgcgggctgtttggcaagggcagcctgcttacgtgcgccaaattcaagtgcgtcacgaagctggaaggaaagatcgttcagtacgagaacctcaagtattccgttatcgtgacggtccacaccggcgaccagcaccaggtggggaacgaaaccacagagcatggcaccatcgcgaccatcacaccgcaggcccctaccagcgagatccaactgaccgattacggggccctcactctcgactgctcaccccggaccggcctggacttcaacgagatggtcctactcaccatgaaggagaagtcctggttggtgcataagcagtggttcctagatctcccgctgccttggacgtccggggcaagcacctctcaggagacctggaaccgccaggatctcttagtgaccttcaagacggcccacgcgaagaaacaggaggttgtggtgctggggtcccaagaaggcgcaatgcacaccgccctgaccggggcaaccgagatccagacgagcggaaccaccaccatcttcgccggacacctcaagtgccggctgaaaatggacaaattaacactcaagggcacatcctacgtcatgtgcaccgggagcttcaagctggagaaagaggtagcggagactcagcacggcacggtcctggtccaggtgaagtacgagggaaccgacgccccctgcaagatccccttctcgactcaggacgaaaagggggtgacccagaacggtcgcttaatcacagccaacccgatcgtcaccgacaaggagaagccagtaaacatcgagactgaaccgcccttcggggagagctacattgtcgtcggcgctggcgagaaggcccttaagctgtcctggttcaagaaggggagctccatcggcaagatgtttgaggccaccgcccgcggggccagacgcatggctatcctaggcgacacggcgtgggactttggtagcatcggcggggtcttcacctccgttgggaagctcgtccaccaggtgttcggcaccgcctacggggtattgtttagcggcgtctcctggaccatgaagatcgggatcggaatccttctcacctggctaggccttaatagccgttccaccagcctctccatgacctgcatcgccgtggggatggtgactctatacctgggcgtcatggtgcaggccgacagcggctgcgtaatcaactggaaaggccgcgagcttaagtgcgggtcgggcatattcgtcaccaacgaagtgcacacctggaccgagcagtacaagtttcaggctgactcacctaaaaggcttagcgcagccataggcaaggcctgggaggagggggtgtgcggcatccgctcagcaacccggctggagaacattatgtggaagcaaattagcaacgagctcaaccatatcctcctagaaaacgacatgaaattcaccgtcgttgtgggggacgccaacgggatcctcgcgcagggaaagaagatgatacggcctcagcccatggagcacaaatacagttggaagtcctggggcaaggccaagatcattggggccgacatccaaaacacgaccttcatcatcgatgggcccgacacacccgaatgtcccgacaaccaacgggcttggaacatatgggaggtcgaggactatggtttcgggatcttcaccacgaatatctggctgaagctgcgcgactcctacacccagatgtgcgaccaccgattaatgagcgcggccatcaaggactccaaagccgtccacgccgacatgggctactggatcgaaagcgagaagaacgaaacctggaaactggcccgcgcatccttcatcgaggtgaagacatgcacgtggcccaagagccacaccctgtggtccaacggcgtattagagagcgaaatgatcatacctaaaatatacggtggcccgatctcccagcacaattaccggcccgggtacttcacccagaccgccggaccgtggcacctgggcaagctggagctcgacttcgacctttgcgaaggcacgacagtggtggtcgacgagcactgtggcaaccgcgggccgtcgctgcggacaactacggtgaccgggaagatcatccatgagtggtgttgccgctcctgcaccctgccacccctccggttccggggtgaagatggctgttggtacgggatggagatccgccccgtgaaggaaaaggaagagaatctggtccgcagcatggtgtcagccggcagcggtgaggtcgacagcttctccctcgggatcttgtgtgtcagcatcatgatcgaggaggtaatgcggagtcgctggagccggaagatgctgatgaccggcacgctcgccgtgttcctgctcctcgtcatgggccaacttacgtggaacgacctgatccgcctctgcatcatggtaggcgccaacgcatccgatcgtatgggcatgggcaccacctacttagcgctgatggcaactttcaagatgcgcccgatgttcgccgtggggcttctcttccgccggctcaccagtcgcgaggtccttttactaaccatcgggctctccttagtggccagcgtcgagttacccaactccctcgaggaactgggggacgggctcgcgatggggatcatgatgctcaagctgctgaccgaattccagccccaccagctatggacaaccctactcagcttgaccttcatcaagacaacgctgtccctggactacgcctggaagaccaccgccatggctttaagcatcgtaagtctattccccctatgcctcagcacaacgtcccaaaagaccacctggctgccggtgctgctcggcagcttcggatgtaagccactgaccatgtttctgatcactgaaaacaagatctggggccggaagtcctggcccctcaacgagggtatcatggcgatcggcatcgtgagcatattgctgagttcgctcctgaagaacgacgtgcccctggccggtccgttgatcgccggcggaatgctgatagcctgctatgtaatcagcgggtcgagtgctgatctttccctcgagaaggcggccgaggtcagctgggagcaggaggccgagcactccggcacgagccacaacattcttgtagaggtgcaggacgatggaaccatgaaaattaaggatgaggagcgcgacgacaccctgaccatcctattaaaggccacgctccttgccgtctccggcgtctaccccatgagcatccccgcgaccctgttcgtgtggtacttctggcaaaagaagaagcagcgaagcggggtcctgtgggacacccccagcccacctgaagtggagcgcgcggtgctcgacgatggcatttatcggattcttcagcgcggcctcctagggcgctctcaggtcggcgtcggtgtgttccaagatggcgtcttccacactatgtggcatgtgacgcgcggagccgtcctcatgtaccagggcaagcggctggaacccagctgggcctccgtcaagaaggacctgatcagctacggcgggggctggcgcttccagggatcctggaacaccggggaagaggtccaggtgatcgctgttgagcctgggaagaacccgaagaacgtgcagaccacccccggcacgttcaagacccccgagggcgaggtgggggcgatcgcccttgatttcaaaccaggcacctctggatccccgatcgttaaccgggagggaaagatcgtgggcctgtacgggaatggcgtcgtcaccacgagcggtacctacgtgagcgccattgcccaggcaaaggcgagccaagagggccccctgcccgagatcgaagacgaggtattcaagaagcgcaacttgaccatcatggacctgcacccggggagcggcaagacccggcgctacctgcccgccatcgtccgggaggcaatcaagcgcaagctccggacgctgatcctggcccccactcgcgtagttgcctctgagatggctgaggccctcaagggcatgcctatccggtaccagaccaccgccgtaaagagcgagcatacggggcgtgagattgtggacctgatgtgccacgctacctttaccatgcgcctgctcagcccggtacgggtccccaactacaatatgatcatcatggacgaggcgcacttcaccgatcccgcctcaatcgcggcccgaggctacatctccactcgggtcggtatgggggaagccgccgccatcttcatgaccgccacgcctcctggctcggtggaggccttcccacaatccaatgccgtcatccaggacgaggagagggatatcccagagcggagctggaactccggatacgactggatcactgatttccccggtaagacggtatggttcgtgcccagcataaagtccggaaacgatatcgcgaactgcttacgcaagaacggcaagagagtaatacagctgtcacgaaaaactttcgacacggagtaccagaagaccaaaaacaacgattgggactacgtggtgacgaccgatatttccgagatgggggccaatttccgggccgaccgcgttatcgatccccggcgttgcttgaagcccgtaatcctgaaggatggtcccgagcgggtgattctggccgggccaatgcccgtcacggtcgcgagcgccgcccagcgccggggcagaataggccggaaccagaataaggagggggaccagtacgtctatatggggcagccgctgaacaacgacgaagaccacgcgcactggaccgaggccaagatgctgcttgataatatcaacacccccgagggcatcataccggccttgttcgagcccgagcgcgaaaagaacgccgccatcgacggcgagtaccgcctacgcggggaagcccgcaagacctttgtggagctgatgcgccgcggtgaccttcctgtatggctgtcctataaggtcgcaagcgagggtttccagtacagcgaccgtaggtggtgtttcgacggagaacgcaacaatcaggtgctggaagagaacatggacgttgagatctggaccaaggagggggagcgtaagaagctccggcctcgctggttagacgcgcggacctatagcgacccacttgccctcagggagttcaaggaattcgccgctgggcggcgctccgtctctggcgacctgatcctggagatcggcaagctcccccagcacctgaccctgagagcccagaacgcgctcgacaacctggtcatgctgcacaatagcgagcagggggggaaggcctatcgccatgccatggaggagctgccagacacgatcgaaactctgatgctgctcgctctgatcgccgtgctgaccgggggcgtcacgctcttcttcctgtccgggaaaggcctaggcaaaacgtcaatcggactcctatgtgtgaccgcctccagcgctctactttggatggcctccgtcgagcctcactggattgccgccagtattatcctggaattctttctgatggtgctcctgatcccggagcccgaccgacagcgcactccacaagataaccagttagcctacgtggtgataggcctcctgttcatgatcctgactgtcgcagccaatgagatggggctactggagacgacaaagaaggacctcggcatagggcatgtggccgccgagaaccaccagcacgccaccatgctggacgtggatctgcggccagcctccgcgtggacgctgtacgcggtcgcgacgaccgtaatcacacctatgatgcgtcatacgatcgagaacaccaccgccaacatcagcttaaccgcgatcgccaaccaggctgcgatcctgatggggctggacaagggctggcccatctctaagatggatatcggggttccgctcctggccctgggctgctattcacaagtcaaccctttgaccctgacggccgccgttctgatgctcgtggcgcactacgctatcatagggccaggcctgcaggccaaggccacccgggaggcacagaaacgcaccgcggccgggatcatgaagaaccccaccgtcgacggtatcgtggccatcgacctggaccccgtggtgtacgacgccaagttcgagaaacagctcggccagatcatgctgctcatcctatgcacttcgcagatcctgctgatgcgcacgacctgggccctctgtgagtctattaccctggcaactgggccgctgacaaccctctgggaggggtcccctggtaagttctggaacaccacgatcgccgtgtcaatggccaacatattccggggctcatacctcgccggtgccggtctggcattcagcctcatgaagtccttgggcgggggccgccgggggaccggtgcccagggcgaaaccctgggtgaaaagtggaagcgtcagctgaaccagctctcaaagtcggagtttaacacctataagcggagcgggataatggaggtggacagaagcgaagccaaagaggggctgaagcgaggcgagacgaccaagcacgccgtctcccgcgggacagccaagctgcggtggttcgttgagcgaaacttagtgaaacccgagggcaaggtaatcgatctgggctgcgggcggggagggtggagctactactgcgcaggcctgaaaaaagtgactgaggtgaaaggctataccaagggaggccccgggcacgaggagccgattcccatggccacgtacggctggaacctcgttaagctgcacagtgggaaggacgtgttcttcatcccgcccgagaagtgcgacaccctgctctgcgacattggagagtcctctccgaaccccacaatagaggaggggagaaccctgagggtactgaaaatggtcgaaccgtggctccgcgggaaccagttctgcatcaaaattttaaatccttatatgcccagcgtggtggaggccctggagcagatgcagcggaagcacggcgggatgctcgtccgcaacccattatcccggaacagtacgcacgagatgtactgggtgtcctgcggcaccgggaatatcgtgagcgccgtcaacatgacctcccgcatgctactcaatcggtttaccatggcgcaccgcaagccgacatacgagcgtgacgtcgacctgggcgccggcacacgccacgtggccgttgagccagaggtggccaacctggacatcatcgggcagcgcatcgaaaacatcaagaacgagcacaagtcgacatggcattacgacgaggacaacccctataaaacctgggcctatcacgggtcctacgaggtgaaaccctcgggctccgcgagctccatggtcaacggcgtggtccgactcttaacgaagccctgggatgtcatcccgatggtaacccagatcgccatgaccgacacgacgccgttcgggcagcaacgcgtcttcaaggagaaggtggacacgcggacgccccgggcgaagcggggcaccacgcagattatggaggtgactgcaaagtggctgtgggggttcctgtcgaggaacaaaaagccccggatctgcacacgtgaggaattcacccggaaggtcaggtccaacgccgcgataggggccgtgttcgttgacgaaaatcagtggaacagcgccaaggaggccgtcgaggacgagcggttctgggatctggtgcatcgcgagcgggagcttcacaagcagggcaagtgcgccacgtgtgtgtacaatatgatggggaagcgtgagaagaagctcggtgagttcgggaaggctaagggtagtcgggccatctggtacatgtggcttggcgcgcgattcctggagttcgaagccctcgggttcatgaacgaggatcattggttctcccgggagaactccctgagcggggtcgagggggagggcctgcataagctcgggtacatcctccgcgacatctctaagatcccgggagggaatatgtacgcggacgacaccgccgggtgggatacccggattaccgaggatgacttgcagaacgaagccaagatcacagaaatcatggaacccgaacacgccctcctggccacctccatcttcaagctgacctaccagaacaaggtggtgcgcgtccagaggcccgcgaagaacggcaccgtgatggacgtgatcagccggcgcgaccagcggggctccggacaggtgggcacctacggtctcaacacattcaccaacatggaggttcagcttatccgccagatggagtcggagggcatcttcctgccatcggagctcgagaccccgaacctcgccgagcgcgtactggactggctcgagaagcacggggcggagcgcctgaaacgcatggccatcagtggcgacgactgcgtcgtaaagccaatcgacgacaggttcgccaccgccctgaccgccctcaacgacatggggaaagtgaggaaagacatcccccaatgggagccttccaagggttggaacgactggcagcaggtacctttctgctcgcaccacttccatcaactgataatgaaagatggccgagagatcgtggtgccctgtcggaaccaggacgagctggttgggcgcgctcgggtgtcccagggagccgggtggtcgcttcgcgagaccgcctgcctgggcaagtcctacgcgcaaatgtggcaactgatgtacttccatcggcgggatctgcggctggccgccaacgccatctgcagcgcggtgcccgtagactgggtgcctaccagccggaccacgtggagcatacatgcgcaccaccaatggatgacgaccgaagatatgctgtccgtgtggaaccgagtctggatcgaggaaaatccgtggatggaggataagacgcacgtgtccagctgggaggaggtgccttaccttgggaagcgcgaggaccaatggtgtgggtccctgattggtctgacggcccgcgccacctgggcgaccaacatccaggtcgcaatcaaccaggtgcggaggctcatcgggaacgagaactatctggattacatgaccagtatgaagcggttcaagaatgagtccgatcccgagggcgccctatggtaa

SEQ ID NO: 23918 - RNA, 9879 nt, synthetic construct
  misc_feature 1..9879: note = derived and/or modified CDS sequence (opt11) from DENV-1__KJ189335__SS-prME
  source 1..9879: mol_type = other RNA
tctgttaccatgttacttatgctgttgcccaccgcgctcgctttccacctgaccaccaggggcggggagcctcacatgatcgtgtccaagcaggagcggggcaagagcctcctctttaagacctccgcgggtgtgaatatgtgcacgctgattgccatggatctgggcgagctatgcgaggacaccatgacttacaaatgcccccaaattaccgaagcggagccagatgatgtggactgctggtgcaacgccacggacacctgggtgacgtatgggacctgtagccagactggagagcaccggcgggacaagcgctctgtggccctggcaccccacgttggattgggactcgagacgcggaccgagacctggatgagctccgagggcgcttggaagcagatccaacgtgtcgagacctgggcccttcggcaccccgggttcacggttatcgccttcttccttgcgcatgctatcgggacatctatcacccagaaggggattatattcatcctcctgatgctggtgaccccctcgatggccatgcgctgcgtcggcatcgggaaccgggactttgtagaaggactcagcggcgcaacgtgggtcgacgtcgttctcgagcacgggagctgcgtgactaccatggccaaaaataagcccaccctggacatcgagctcctgaagacggaggtcaccaaccctgcgatcctgcgtaagctatgcatagaggctaagataagcaataccactacggactcccgctgtcctactcaaggggaggccaccctggtggaggagcaagacgccaattttgtgtgccgccggacctttgtggatcgcggctgggggaacggctgtgggctattcggcaaggggagcctgctgacgtgcgccaagttcaagtgcgtgaccaaactagagggcaagatagtgcagtacgagaacctaaagtactccgttatcgtaaccgtgcacacgggtgaccagcatcaggtagggaacgagactaccgagcacggaaccatcgcgaccattacgccgcaagcccccacgtcggagattcagttaaccgactacggggcactaaccctcgactgcagcccgcggacaggcctggatttcaacgagatggtgcttctcaccatgaaggaaaagagctggctggtacataagcagtggtttttggatctccccctcccctggacctccggcgccagcaccagccaggagacctggaaccgacaagacctcctggtcacgttcaagaccgctcacgccaaaaagcaagaggttgtcgtactgggctctcaggagggtgccatgcacaccgccctgaccggggccacagaaatccagaccagcggcactaccactatcttcgccgggcacctcaagtgccggcttaagatggacaaacttaccttgaaggggacctcctacgtgatgtgtaccgggagctttaaactggagaaagaggtagcagagacgcagcacggcaccgtgctggttcaggtcaagtacgagggcaccgatgccccttgcaaaatccctttctccacccaggacgaaaagggggtgacccagaacggcaggctgatcaccgccaacccgattgtgacagataaagagaaacccgtaaacatcgaaacggagccacccttcggggagagctatatcgtggtgggagcgggtgaaaaggctctcaagctgtcctggttcaagaaggggagctccatcggcaaaatgttcgaggctactgcgagaggggcgcgccgcatggccatcctgggcgataccgcgtgggacttcgggtcgataggcggcgtcttcacaagtgttgggaagctcgtccaccaagtgttcggcaccgcctacggtgtgctgttttctggagtgtcctggacaatgaagatcgggatagggatcctgctcacctggctaggcctcaacagccgctccaccagcttatccatgacctgcatcgccgtcgggatggtgacgctctatttaggcgtgatggtccaggccgactccgggtgtgtgatcaactggaagggccgcgagctcaagtgtggaagcgggatcttcgtgaccaatgaagtccacacttggactgaacagtataagtttcaggctgatagcccgaagcggctaagcgcggccatcggcaaggcctgggaagagggggtgtgcgggatacgttccgccactcggctcgagaacatcatgtggaagcagatatccaacgaactcaaccacatcctgttagagaacgacatgaagtttacggtggtcgtgggggacgccaacggcatcctggcgcaggggaagaaaatgatccgtccccaacccatggaacacaagtattcctggaagtcctggggaaaggctaagatcataggggcggacatccagaacaccaccttcattatcgacggtcctgacactccggagtgcccggataaccaacgggcctggaacatctgggaggtcgaggattacgggttcggaatctttacgaccaacatatggctgaagctgcgagactcttatacccagatgtgcgatcatcgtctcatgtccgcagccatcaaggactccaaggccgtccatgccgacatgggctactggatcgaaagcgagaagaacgagacctggaagctagcccgcgcgtcctttatcgaggtgaagacctgcacctggcctaagagccacaccctgtggtccaacggggtgttagagtcggagatgattatccccaagatctatggaggcccgatatcccagcacaactaccgtccagggtatttcacccaaacggccggcccgtggcaccttgggaagctggagctagacttcgacttatgcgagggcacgaccgtcgtggtggacgaacactgcggcaaccgcgggccgagccttcggaccacgaccgtcaccggcaagatcatccacgagtggtgctgtcgatcttgcaccctaccgccccttcggtttcgcggggaggacgggtgctggtacgggatggagatccggcccgtgaaggagaaggaggagaacctggtgcgcagcatggtttctgcgggttccggcgaggtggactcgttctccctaggcatcctatgtgtgagcatcatgatcgaagaggtcatgcggtcccgctggagcagaaagatgctgatgacgggaacccttgccgtgtttcttctgcttgtgatggggcagctgacatggaacgacctgatccgcctatgcatcatggttggagccaacgcatccgaccgcatgggcatgggtaccacgtacctggcactgatggccacctttaagatgcggccgatgttcgccgtgggtctcttattccgccggctgacctcccgcgaggtgctcctccttaccatcgggctgtccctggtcgcctccgtagaactgccaaattccctggaggaattaggcgacgggttggcaatgggcatcatgatgctcaaacttctgacggagttccagccgcaccaactctggaccacactgctgagcctcacgttcatcaaaacgaccctttccctggactacgcctggaagaccactgctatggccctaagcatcgtctccctgttccccctgtgcctgtctacaacctcgcagaaaaccacctggctgccggtgctgctcggcagcttcggctgcaagcccctcaccatgtttttaatcacggagaacaagatctggggccgaaagtcctggcccctcaatgagggcatcatggcgattgggatagtaagcattctcctgtccagcctcctgaagaacgacgtgccgttggcggggcctttgatcgcaggcggcatgcttatcgcctgttacgtgatctctgggagttctgccgaccttagtctcgagaaggcggctgaggtaagctgggagcaggaagcagagcacagcggcacaagccataatatcctggtcgaggtgcaggacgacggcaccatgaagatcaaggacgaggagcgcgacgataccctgacgatactgttgaaggccaccctgctcgccgtcagtggcgtctaccccatgagcatccccgccaccctgttcgtatggtacttttggcagaagaagaagcagcgttcaggtgtcctgtgggacacccccagcccaccggaagtcgagcgcgccgtgctcgacgacggcatctatcggattctgcagcgcggcctgcttgggcggtcgcaggttggcgttggggtattccaggacggtgtattccacacgatgtggcatgtcacccgtggggccgtactcatgtatcagggaaaacggcttgagccgtcctgggcatcggtgaagaaggacctgatatcatacggcgggggatggcgcttccagggctcatggaacaccggggaggaggtccaggtgatcgccgtcgagccagggaaaaacccgaagaacgtccagaccactcccggtacattcaagactccggagggggaggtgggagcgatcgccctggactttaagccaggaactagcggttcccccattgtgaaccgggagggcaagatcgtcggcctgtacgggaacggcgtagtgaccacgagcgggacctatgtctccgcaatagcacaggccaaggcaagccaggagggccccttacccgagatcgaggacgaggtgttcaagaagcgaaacctcactatcatggatctgcatccgggtagcggaaaaacgcggcggtacctgcccgccatcgtgcgtgaggcaatcaagaggaagctccggaccctgatcttagcccccactcgagtagtagcttccgaaatggccgaggccctcaagggtatgcctatccgctaccagaccaccgcagtcaagagcgaacacacaggtcgggagatcgtcgatctgatgtgccacgctactttcaccatgcgcctactctctccggtgcgtgtgcccaactacaacatgatcatcatggatgaggcgcacttcacagaccccgccagcattgccgctcgcggctacatctcaacacgggtcgggatgggcgaagcggcggccatcttcatgacggctaccccgcccgggtccgtggaggccttcccccagtccaacgccgtgatccaggacgaggagcgcgatatacctgagcggtcttggaactccggctacgactggatcacggacttccccggtaagaccgtctggttcgtgcccagcatcaagagcggtaatgacatcgcgaactgtctgcgcaagaacggaaagagagtaatccagttgagtcgaaagacattcgacaccgagtaccaaaagaccaagaataacgattgggactacgtagtgacgacagacatcagtgaaatgggggccaactttagagcggaccgcgtaatcgaccccagaaggtgtctcaagccggtcatcctgaaggacggccccgagcgtgttattctggctggtccgatgcccgttaccgttgcgagcgcagcccagcgccggggtcgcatcgggcgcaatcaaaacaaggagggggaccagtatgtctacatgggccagcccctgaacaacgacgaggaccatgcccactggacggaggcgaagatgctgctggacaacatcaacaccccggagggtatcatccccgccctattcgagcccgaacgcgagaagaatgccgccatagatggcgagtatcgactgcgcggtgaggcccggaagaccttcgtcgagcttatgcgccgcggcgacctccccgtatggctgtcctataaagtggcctcagagggcttccagtactccgaccggcgctggtgcttcgacggtgagcggaacaaccaggtcctggaggaaaatatggatgtggagatctggaccaaggaaggggagagaaagaaattacggccccggtggctcgacgcgcggacctacagcgatccgctggcactgcgcgagttcaaagagttcgccgctggacggaggtccgtgtcaggcgaccttatcctagagatcggcaagctccctcagcatttaacgctgcgggcccagaacgcactcgacaacctggtcatgctgcacaatagcgagcaaggcgggaaagcgtatagacacgctatggaggagttgcccgacacgatagagaccctgatgctgctcgccctaatagcggtgctgaccggaggggttactctcttcttcttaagtgggaaaggtctgggcaaaactagcatcgggctcctgtgcgtgacagcctccagcgcgctactctggatggcctccgttgaaccccactggatcgccgcgagcattatcctggagttcttcctgatggtgctcctgatcccggaacccgatcggcaacgcacgccccaggataaccagctggcctacgtggtgatcggtttactgttcatgatcctcacggtcgctgccaacgagatgggtcttctagaaaccaccaagaaggacttaggtatcgggcatgttgcggcggagaaccaccaacatgctaccatgctcgacgttgacctgaggccggccagcgcttggacgctgtacgctgtggcaaccaccgtcatcacccccatgatgcggcacacgattgagaacaccaccgccaacatcagcctcaccgctatcgctaaccaggccgcgatcttaatgggcctggacaagggctggcccatctccaagatggacatcggagtacccctcctggcgctgggctgctactcccaggttaacccgctcacgctgaccgccgcggtcttaatgctcgtggcgcactacgcaatcataggccccgggctgcaggctaaggcgacccgggaggcccagaagaggaccgcagccgggataatgaagaaccccaccgtagacggcattgtcgccatcgacctggatcccgtcgtatacgacgcgaagtttgagaaacaactcggccagatcatgctgttgattctgtgcacatcccagatcctgctgatgcgcacaacctgggccttatgcgaaagcataactctggctaccggtccgctgaccaccctctgggagggttcccctgggaaattctggaacacaaccatcgccgtctcaatggccaacatcttccggggctcctatctggccggagccgggctggcgttcagcctcatgaaatccctgggtggagggcgtcgagggaccggcgcacagggcgaaaccctaggtgagaagtggaagcgacagctcaatcagctgagcaagagtgagttcaacacatacaagcggagcggaatcatggaggttgaccgcagcgaggccaaagaagggctgaagaggggcgagaccaccaaacacgccgtctccaggggcaccgcgaagctgaggtggttcgtggagcgcaacctggtgaaaccggaaggtaaggtgatcgatctgggctgcggaaggggagggtggagctattactgtgctggcctgaagaaggtcaccgaggtgaagggttataccaagggagggcccggacatgaggagccgatccctatggctacctacggatggaacttagtaaagctgcattccggtaaggatgtcttcttcataccgcccgagaaatgcgacacattactctgcgacatcggcgaatcctccccgaaccccacgatcgaggaggggagaacgctgagagtactgaagatggtggagccctggctccgcggcaaccagttctgcattaaaatcctgaacccatacatgccttcagtagtggaggccctcgagcagatgcaacggaagcatggcgggatgctggtgcgcaatcccttgtcacggaacagcacccatgagatgtactgggtctcctgcggcaccggtaacatcgtgagcgcggtgaacatgaccagtcgcatgctgctcaataggttcacgatggcgcaccggaagcccacctatgagcgcgacgttgacctgggcgccggcacacggcacgtggctgtggaacctgaggtagccaatttggacatcatagggcagagaatcgagaacatcaagaatgaacacaaaagcacctggcactacgacgaggacaacccgtacaagacctgggcctatcacggctcctacgaggtgaaaccgagcgggtcggcgagcagcatggtgaacggtgtcgtgcggctccttaccaagccttgggatgtcatccccatggttacccaaatagccatgaccgacacgacaccgtttgggcagcagcgcgtgttcaaggagaaagtcgacacccggacaccccgggctaagagaggcactacccaaatcatggaggtgacggcgaaatggctgtggggctttctttctcgcaacaagaaaccccggatctgcacccgcgaggagttcacgcggaaggtgagatccaacgccgcgatcggggctgtcttcgtggacgagaaccagtggaatagcgccaaggaggccgtggaggatgagcgattttgggacctggtccatcgcgagcgggagctgcataagcaggggaagtgcgcgacctgcgtgtataacatgatgggcaagcgcgagaagaagctcggcgagttcgggaaggcgaaaggcagccgggccatatggtatatgtggctgggcgcccgtttcttggagttcgaggccctcgggtttatgaatgaggaccactggttctcccgggagaacagcttatccggcgtggagggtgaaggcctccacaagctcgggtacatcctgcgagacatctcaaagatccccgggggcaacatgtatgccgacgacacggccgggtgggacacccggatcacagaggacgacctgcagaacgaggccaagatcaccgagataatggaacccgaacacgccctcctggccacctctatctttaagctgacctatcagaacaaggtggtgcgcgttcaacgccccgcgaagaatggaacggtcatggacgtcattagccgacgcgaccagcgggggtccggccaggtgggtacctacgggctcaacaccttcactaacatggaggtccaactgatccgccaaatggaaagcgagggcatcttcctaccctctgagcttgaaacgccgaacctggctgagcgtgtactggactggctggagaaacacggtgccgagcggctgaaaaggatggccatcagcggcgacgactgtgtggtcaagcccattgacgaccgcttcgccacagctctcacggccttaaacgacatgggtaaggtgcggaaggacatcccccagtgggagcccagcaaggggtggaacgactggcagcaggttccgttctgtagccaccacttccatcagttaatcatgaaggacggacgcgaaatcgtcgtgccctgccgtaaccaggacgagctggtggggcgtgctcgagtctcccagggcgccgggtggagcctccgcgaaaccgcatgcttagggaaatcctatgcccagatgtggcaactgatgtacttccaccgaagggacctccgcctagcggccaacgccatctgcagcgctgtccccgtggactgggttcccacatcccgtactacctggagcatccatgcccaccatcaatggatgaccaccgaggacatgctgagcgtgtggaacagagtgtggatcgaggaaaacccctggatggaagacaagacgcacgtctccagctgggaggaagtgccctatttggggaaacgagaggaccagtggtgcgggagcttgatcggcctaaccgcccgcgccacatgggctaccaacatccaggtcgcaatcaatcaagtcaggcgtctcatcgggaacgagaactacctggactacatgacgtcgatgaagcggttcaagaatgaaagcgaccccgaaggtgccctatggtga

SEQ ID NO: 23919 - RNA, 9879 nt, synthetic construct
  misc_feature 1..9879: note = derived and/or modified CDS sequence (opt11) from DENV-1__KJ189336__SS-prME
  source 1..9879: mol_type = other RNA
agcgtgaccatgctgctcatgctgctgcccaccgccctcgccttccatttgaccacccgaggcggggagccgcatatgatcgtaagcaaacaagagcggggcaagagcctcctgttcaagaccagtgcgggggttaacatgtgcacgttgatcgccatggacctcggcgagttgtgcgaggacaccatgacctacaagtgcccccaaatcaccgaagccgagcctgacgacgtggactgctggtgcaacgccactgacacctgggtgacatacggcacgtgcagccagaccggcgaacatcgacgggataagcgctccgttgccctggccccccacgtgggcctgggattagagacccgaaccgagacctggatgagctccgagggagcctggaaacagatccagagagtcgagacctgggccttacgacacccggggtttacggtgatcgcgctgttccttgcgcacgccataggcacaagcataacccagaaggggatcatcttcatcctactgatgctcgtgactccctccatggccatgcgttgcgtcggcatcggcaaccgcgattttgttgaagggctgagcggcgcaacgtgggtggacgtcgtacttgagcacgggtcctgtgtgaccaccatggccaagaataagcccaccctggatatcgagctgctgaagacggaagttaccaatcccgcgatcctccgcaagctgtgcatcgaggccaaaatcagcaacaccaccactgactcccggtgccctactcaaggggaggcaacactggtcgaggagcaggacgcaaacttcgtctgtcgcagaactttcgtcgatagaggctggggcaacggctgtggcctcttcggcaaggggagcttgctgacgtgcgccaagttcaagtgcgtgaccaagttggagggcaagatcgtgcagtatgagaacctgaaatactccgtcatcgtgaccgtgcacaccggcgaccagcatcaagttggaaatgagacgaccgagcacggcaccatcgcgacaatcacgccacaagcccccacgagcgagatccaactgaccgattacggggcccttaccctggattgttcgccacggaccggcctggatttcaacgagatggtgctcctgactatgaaggagaagtcgtggttagtccacaagcagtggttcctcgaccttccgctgccctggacctccggggccagtaccagccaggagacctggaatcgccaggacctcctcgtgacgtttaagaccgcgcatgcgaaaaagcaggaggtggtcgtgctgggctcccaggagggcgccatgcacaccgcactcactggggccacggagatccaaaccagtggcaccaccacaatcttcgccgggcacctgaagtgccggctaaaaatggacaagcttacccttaagggcactagttacgtgatgtgcaccggttcgttcaagctggagaaggaggtcgcggagacgcagcacggcaccgttctcgttcaggtgaagtacgaggggaccgacgcaccctgcaagatcccattctccacccaggacgagaagggtgtgactcagaacggccggctcatcaccgcgaacccgatcgtgaccgataaggagaagccggtcaatatcgaaaccgagccgccgtttggggagagctacatcgtggtgggcgccggcgagaaagcacttaagctctcctggttcaaaaaagggagctccatcggcaagatgttcgaggccacggccaggggggctcgccggatggccatcctcggcgacaccgcgtgggatttcgggtcgataggcggtgtcttcacctccgtgggcaagctggtacaccaggtcttcggcaccgcgtacggtgtgctgttcagcggcgtgtcgtggacgatgaagatcgggatcggcatcctcttaacctggctcggcctcaacagccgctccaccagcctgtccatgacctgcatcgcggtcgggatcgtgacgttatatctgggcgtaatggtccaggccgatagcggatgtgtgatcaactggaaaggccgcgagctaaaatgcggttccggcatattcgttaccaacgaggttcacacctggaccgagcagtacaaattccaggccgacagcccgaagcggctaagcgcggccatcggcaaggcctgggaggagggggtgtgcggcataagatccgccacccgcctcgagaatatcatgtggaaacagatttccaacgagctgaaccacatcctgttagagaacgacatgaagttcacggtggtcgtgggtgatgccaacggcatcctggcgcaggggaagaagatgatccgcccccagccaatggagcacaagtattcctggaagtcctggggcaaagcaaagatcattggcgccgacatccagaacacgaccttcatcatcgacggaccagataccccggagtgccccgacaatcaacgggcctggaacatctgggaggtggaggactatggcttcgggatcttcacgaccaacatctggctgaagctccgcgattcctacacccagatgtgcgatcaccggctcatgagcgctgcgattaaggactccaaagcagtccatgcagacatgggctactggatcgagagcgagaagaacgagacctggaagctggcccgcgcgtccttcatcgaagtgaagacgtgcacctggcccaagtcacacactctctggtccaacggcgttctggagtcagagatgatcatcccgaagatctacggcggcccgatttcccagcacaactaccggccggggtatttcacacagacggcagggccctggcacctggggaagctcgagctggacttcgatttatgcgagggcaccaccgtcgtggtggacgagcactgcggcaaccgcgggccgagcctccggaccacgaccgtgaccggcaagatcatccacgaatggtgctgtcgctcctgcacactgccgcccctgcggttccgcggggaggacggctgctggtacgggatggagatccggcccgttaaggagaaggaggagaacctcgtacggtccatggtctcagccggcagcggcgaggttgacagcttttccttagggatcttgtgcgtgagcatcatgatcgaggaggtgatgcggtccaggtggagtcggaagatgctcatgacgggtacgctggccgtgttcctgctcctagtgatgggccagttgacctggaacgacctcatccgtctgtgcatcatggtcggagccaacgcctccgaccgcatggggatgggcaccacgtacctggccttaatggccaccttcaagatgcggcctatgttcgccgtggggctgctgtttcgccggctcacctcacgagaagttttgctccttaccatcggactgtccttagtggcgagcgtggaactccccaactccctggaggaactgggagacgggttagcgatgggcatcatgatgttaaagctgctcacggagttccagccccaccaactgtggaccacgctactatctctgaccttcatcaagacgaccctgagtctagactatgcatggaagaccaccgccatggccctgtcaatcgtctcccttttccccctctgcctaagcacgacatcccagaagaccacgtggctgccggtgctcctgggctctttcggatgcaagccactgactatgttcctcataacagagaacaagatatggggccgaaagtcctggcccttaaacgagggcattatggcgatagggatcgtgagcatcctgttatccagcctgctgaagaatgacgtccccttagccggcccgctgatcgccggcggcatgctgattgcctgctacgtgatctcagggagtagcgccgacctatccctggagaaggcggccgaggtgagctgggaacaggaagccgagcactcgggaacctcgcacaacatactcgtagaagttcaggatgacggaacaatgaagatcaaggatgaagagcgcgacgacaccttgacgatcctgctgaaggccaccctcctggccgtttccggcgtctaccccatgagcattcccgcgacgctgttcgtgtggtacttctggcagaagaagaagcagaggtccggggtgttatgggatacgcccagcccccctgaggtcgaacgtgccgtgttagacgacggcatctaccgcatcctccaaaggggcctgctcgggcggtcccaagtgggcgtcggggttttccaggacggcgtcttccacactatgtggcacgtcacccggggcgccgtactgatgtatcagggaaagaggttagagcccagctgggccagcgtgaaaaaggacttgatcagctacggcgggggctggcgcttccagggatcgtggaacaccggcgaggaggtccaggtgatcgctgtggaacccgggaaaaacccgaagaacgtacaaacaacgccaggcaccttcaagacccccgaaggggaggtgggggcgatagccctggacttcaagcccggcaccagcgggtctccgatcgtgaaccgggagggtaagatcgtcggactgtacgggaacggcgtggtgacgaccagcggtacctacgtctccgcaatcgcacaggccaaggcaagccaagagggccccctcccagagattgaagacgaggtattcaagaagcgcaacctgaccatcatggacctacacccagggagcggcaaaacgcggcgctaccttcccgccatcgtgcgggaagccatcaagcgcaagttgcggacacttatcctcgcacccacccgcgtcgtcgcgtccgagatggccgaagcccttaagggcatgcccatccgctaccagacaacggccgtcaagtcagagcacaccgggcgggagatcgtcgacctgatgtgccatgccaccttcaccatgcgcctcttgtccccggtacgagtgcccaactacaatatgataatcatggacgaagcccactttacggaccccgccagcatcgccgcccgcgggtacatcagcaccagggtgggaatgggcgaggccgcggccatcttcatgacggccacgccgcctgggtcagtagaagccttcccccagtccaacgccgtgatccaggacgaggagcgcgacatccctgagcgtagctggaactccggctacgattggattacggatttcccgggcaagaccgtatggtttgtgcccagcatcaagtcggggaatgatatcgcgaactgcctacgcaaaaatgggaagcgggtaatccagctgagccggaagaccttcgacacagagtaccagaagacaaagaacaacgactgggattatgtggttaccactgatatatccgaaatgggggccaattttagggccgaccgcgtgatcgatccccggcgctgcctgaagcctgtcatcctgaaggacggccccgaacgggtgatcttagccggcccgatgccagtaacggtcgcaagcgccgcccagcgccggggacgcataggccggaaccagaacaaggagggggaccagtacgtgtacatgggccagcccttgaacaacgacgaggatcacgcgcactggacggaggccaagatgctgctcgacaacatcaataccccagaagggatcatcccggccctgtttgaacccgaacgcgagaagtccgcagctatcgacggcgagtaccgcttacgtggggaagcccggaagaccttcgttgagctaatgcggcgcggtgacctgcccgtgtggttgagctataaggtagcctccgagggtttccagtatagcgaccggcgttggtgcttcgacggggagaggaacaatcaggtgctcgaggagaacatggacgtggagatttggacgaaggaaggcgagcgcaagaagttgcggccacgctggctggacgcgcgcacatactccgacccgctcgccctgcgcgagttcaaggagtttgccgctgggcgacgtagcgtgtctggcgacctgatcctcgagatcggcaagctgccccaacacctgacactccgggcccagaacgcgctggacaacctggtcatgctccacaattccgagcagggcggtaaggcctaccggcacgccatggaagagctccccgatactatagagacactgatgctcctggccctgatcgccgtgctcacggggggcgtgaccctgttcttcctgagcgggaagggcctcggcaaaacctccatcgggctgctgtgcgttaccgccagctccgcgctcttatggatggccagcgtagagccccactggattgccgcgtccataatcctggagttcttcttaatggtcctcctgatcccggagcccgacaggcaacgcactccccaggacaaccagctagcctacgtcgtgatcggcctcctgttcatgatcctcactgtcgctgccaatgagatggggctcctggagactaccaagaaggacctcggaatcgggcacgtcgccgcagaaaaccaccaacacgccacaatgctggacgtggacttacgaccggccagcgcctggacgctctacgcggtggcgacgaccgtcatcaccccaatgatgaggcacacgatagagaacaccaccgccaatatctcattaactgctatcgccaaccaggccgctatcttgatgggcctggacaagggctggccgattagcaagatggacatcggggtgcctcttctggccctcggctgttacagccaggtgaaccctctgacgctgaccgccgccgtcctcatgctggtggcgcactacgctattatcgggcccggtctgcaagccaaggccacccgagaggcacagaagcgcacggcggccgggataatgaagaaccccacggtagatggaatcgtggccatcgacctggacccagttgtgtacgatgctaaattcgaaaagcaattaggccagattatgctcctgatcttgtgcaccagtcagatcctgttaatgaggactacctgggcactgtgcgagtccattacactggcgactgggccgctaaccactctgtgggagggcagccctgggaaattttggaacacgacaatcgccgtctccatggccaacatctttcggggcagctacctggccggcgccgggcttgctttctccctgatgaagtccctgggaggcggccgccggggcactggcgcccagggcgagaccttaggagagaagtggaagcgccagctgaaccaactgtccaagagcgagttcaacacgtacaaacggagcgggataatggaagttgaccgcagtgaggccaaggaggggctcaaaagaggcgagacaaccaagcacgccgtgtcacgcgggactgcgaagttgcggtggttcgttgagcggaacctggtgaagcccgaaggcaaggtgatcgacctcggctgcgggcggggcgggtggagttactactgcgcgggcctcaagaaggtcaccgaggtgaaggggtatacgaagggcggccccggacacgaagagccgatccccatggccacctacggctggaacctggtgaagctgcacagcgggaaagacgtcttcttcatgccgccagagaagtgcgacaccctcctctgtgacattggcgagtcctcgccgaaccccacgattgaagagggtcgcactctgagggttttgaagatggtggagccttggctgcgtggcaatcagttctgcatcaagatcctgaacccctacatgccgtccgtcgtcgaggccctcgagcagatgcagcggaaacacggcggcatgttggtcagaaaccccttaagccggaactccacccacgagatgtactgggttagctgcggcactggaaatatcgtatccgccgtgaatatgacgagccgcatgctcctcaatagatttacgatggcgcatcgcaagcccacttatgagcgagacgtcgacctgggcgccggtacccggcacgtagccgtggagcccgaagtcgccaacctcgacataatcggtcaacgcatcgagaacatcaagaacgaacacaagtctacctggcattacgacgaggataacccgtacaagacgtgggcgtaccacggcagctacgaggtgaagccctcgggtagcgcatccagcatggtgaacggcgttgtgcgtctattaaccaaaccctgggacgtgatccccatggtaacccagatcgccatgacggacacgaccccgttcgggcagcaaagggtgttcaaggagaaggtggacaccagaacgccccgggccaaacgaggcacgacccaaatcatggaggtgacggctaaatggctctggggctttctgtcccggaacaaaaagcccaggatctgcacacgcgaggagttcacgcgaaaggtgcgcagcaacgcggcgatcggggctgtgttcgtggacgagaaccagtggaatagcgccaaggaggcggtggaagatgaacgcttctgggacctggtccaccgagagcgggagctccacaagcagggaaaatgcgcgacctgtgtatataacatgatggggaagcgagagaagaagcttggcgagttcgggaaggccaagggctcccgggcaatctggtacatgtggctgggcgcccgcttcctcgagttcgaggccctaggattcatgaacgaggaccactggttcagccgggagaattccctgtcgggggtagaaggggagggattacacaagttggggtacatcttgcgcgacatctccaagatccctggaggcaacatgtatgcggacgacacagccgggtgggatacgcgtatcacggaggacgacctccagaatgaagccaagataaccgagataatggagccggagcacgccctgctggcaaccagcatcttcaagctcacctatcagaacaaggtcgtacgcgtgcagcgccccgcgaaaaatggcacagtcatggacgtcatctcccgtagggaccaacggggttccggccaggtgggcacctacggcctgaacacctttacgaacatggaggtccagctcattaggcagatggagtccgaggggatcttcctccccagcgaacttgaaacaccgaacctagccgagcgtgtgctagactggcttgagaaacacggggccgaacgcctgaagcggatggccatttccggcgacgattgcgtggtcaagccaatcgacgaccggtttgccaccgcgctcaccgccctaaacgatatggggaaggtgcggaaggacataccccagtgggagcccagcaagggctggaatgattggcagcaggtcccgttctgctcccaccactttcatcagctgatcatgaaggacgggcgagagattgttgtgccatgtcggaaccaggacgagctcgtggggcgcgcacgggtctctcagggcgccgggtggtccctgcgggagaccgcttgcctgggcaagagctacgcgcagatgtggcagctcatgtactttcaccggcgcgacttgcggctagccgccaacgcaatctgctccgccgtgccagtggactgggttccaaccagccgaacgacctggagcatccacgcccaccaccagtggatgactaccgaggatatgctctctgtatggaatcgggtgtggatcgaagagaacccgtggatggaggacaagacgcacgtcagctcctgggaggaggtgccttatctcggcaagcgcgaggatcaatggtgcggcagcctgataggcctcaccgctagagccacctgggcgaccaacatccaggtggcgattaaccaggtccggagactgatcgggaacgagaactacctggactacatgacgtccatgaagaggttcaagaacgagagcgaccccgagggcgccctgtggtga

SEQ ID NO: 23920 - RNA, 9879 nt, synthetic construct
  misc_feature 1..9879: note = derived and/or modified CDS sequence (opt11) from DENV-1__KJ189337__SS-prME
  source 1..9879: mol_type = other RNA
agcgtgaccatgctcttaatgctcttacccacggctctcgccttccacctgacaacccgcggcggagagccccacatgatcgtgagcaagcaagagcgcggcaagagccttctgttcaagacgagcgctggggtgaacatgtgcacacttatcgccatggacctgggcgaattatgcgaagacactatgacctacaagtgcccccagatcaccgaggccgagcccgacgacgtggactgttggtgcaatgccaccgacacctgggtgacctacgggacctgcagtcagaccggagagcaccgcagagataagcgctctgtggccctggccccccacgtgggcctggggctcgagacccggaccgagacctggatgagctccgagggcgcatggaaacaaatccagcgcgtcgaaacctgggcattacggcaccctgggtttacggtcatcgccttattcctggctcacgccatcggcaccagcatcacccagaaggggatcatctttatcctgctgatgctcgttaccccgagcatggccatgcgctgcgtcggcatcggcaaccgcgacttcgtagagggcctgagcggcgccacctgggtggatgtcgtgctggagcatgggtcttgcgtgaccaccatggccaagaataagcccaccttggacatcgagcttctaaagacggaggtcaccaacccagcgatcctccgcaagttatgcatcgaggcgaagatcagcaacaccaccacggactccagatgcccgacacagggcgaggctactctggtcgaggagcaggacgccaactttgtgtgccgcaggacctttgtggatcgcggctggggcaacggctgcggcctcttcggcaagggatctctgctaacgtgcgccaaattcaaatgcgtgaccaagctcgagggtaagatcgtacagtacgagaatctgaagtactccgtcatcgttaccgtgcatactggcgaccagcaccaagtcggtaacgagacgaccgagcacggcaccatcgcgaccatcacgccccaagcccccacgagcgagatccagctgaccgattacggcgccctaaccctggactgcagcccccggacggggctggacttcaacgagatggtgctcctgacgatgaaagagaaatcctggctggttcacaagcagtggttcctcgacctgccgctgccctggacgtccggggcaagcaccagccaggagatctggaatcgccaggacctcctcgtgaccttcaaaacggcccacgcgaagaagcaggaggtggtcgtgttgggctcccaggagggcgccatgcacacagccttgacgggggccaccgagatccagacgagcggcaccacgaccatctttgccgggcacctcaagtgccggctgaagatggacaagctcacgctgaagggcacctcatacgtgatgtgcaccgggagcttcaagctggagaaagaagtcgcggaaacccagcatggcactgtgctggtccaggtaaagtacgagggcaccgacgcgccctgtaagatccccttttccacccaggacgaaaaaggtgtgacccagaacggcaggctaatcacggccaacccgatcgtgaccgacaaggagaaacctgtcaacatcgagaccgagccgccctttggcgagagctacatcgtggtgggcgcaggggaaaaggcgctgaagctaagctggttcaaaaagggaagctcgatcggcaagatgttcgaggccacggcccgcggtgctcgccggatggccattctgggcgacacggcgtgggatttcggcagcataggtggcgtcttcacctccgtggggaagctggtgcaccaggtctttggcaccgcctacggggtgctattcagtggcgtgtcttggactatgaagatcgggataggcatccttctaacgtggctgggtcttaactcacgttccaccagcttgtccatgacctgtatcgcagtcgggatggtgactctgtacctcggcgtgatggtgcaggcagacagcggctgtgtgatcaactggaagggccgcgagctaaagtgcgggtccggcatctttgtgacaaacgaggttcatacctggactgagcagtacaagttccaggccgactcaccgaagcgtctctcagcggccatcggaaaggcctgggaggaaggggtgtgcggcatccgctccgcgacccggctcgagaacatcatgtggaagcagatctccaacgaactgaaccacatcctgctcgagaacgatatgaaattcaccgtggtcgtcggggacgccaacggcatcctggcgcaaggtaagaagatgatccgcccacagcccatggaacataagtactcctggaagtcctggggcaaagccaagatcatcggcgccgacatccagaacacgaccttcatcattgacgggcccgacaccccggagtgtcccgacaaccagagggcctggaacatctgggaggtagaggactacggcttcgggatcttcaccacaaatatctggctaaagctccgcgactcctatacccaaatgtgcgaccaccggctgatgtcggcggcaatcaaggattccaaggccgtgcacgccgacatgggctactggatcgagagcgagaaaaacgagacgtggaagctggcccgcgcgtccttcatcgaagtgaagacctgcacgtggcccaagagccacaccctctggtccaacggcgtgctggaaagcgagatgatcatccccaaaatatatgggggcccaatctcccagcacaactaccggcccgggtatttcacccagacggccgggccctggcacctggggaagctcgagctggacttcgacttgtgcgagggcacgactgtcgtagtggatgagcactgtggcaaccgcggtccgagcctccggactacaacggtcaccggcaaaatcatccatgagtggtgctgccgctcctgcaccctcccgcccctgcggttccgcggagaggacggctgctggtacgggatggagatccgccccgtgaaggaaaaagaggaaaacctcgttagatcgatggtgtcagccggcagcggcgaggtggacagcttctccctggggatcctctgtgccagcatcatgatcgaggaagtgatgcggagccgctggagcagaaagatgctcatgaccggcacgcttgcggtcttcctgctcctgataatggggcaactgacctggaacgatctcatccgcctgtgcatcatggtgggcgcgaacgcctccgaccgcatggggatgggtaccacctacctggccctcatggccacgttcaaaatgcgaccgatgttcgccgtggggctgctgttcagacgacttaccagcagggaggtcctgttactaacgatcgggctgagcctggtggccagtgtggagctccccaactccctggaggagctgggagatgggctggccatgggcataatgatgctgaagctgctaaccgagttccaaccccaccagttgtggacgaccctgctcagcctgaccttcataaaaaccacgctgtccttagactacgcatggaagactactgccatggcgctctctatcgtgtcacttttcccactctgcctcagcacaacgtcccaaaagacaacctggcttccggtcctcctgggcagcttcgggtgtaaacccctgaccatgttcctcatcaccgagaacaagatatggggtaggaagagttggccgctgaacgaggggatcatggccatcggtatcgtcagcatcctgctctccagcctgctgaagaacgacgtgcctctcgccggtccgctcatcgccggcggcatgctgatcgcatgctacgtgatatctgggtcctctgccgacttgtccctggaaaaggccgccgaagtaagctgggaacaggaggccgagcactccggaacgagccacaacatcctggtggaggtccaggacgacgggacgatgaagatcaaggacgaggagcgagatgacaccttgacaatcctgttaaaggccacgctcctagccgtctctggcgtctaccccatgtcgatccccgccacccttttcgtctggtacttctggcagaagcgaaagcagcgctccggggtcttgtgggacacgcccagcccgcccgaggtggaacgggcagttctggacgacggaatctaccgaatactgcagcggggcctgctcgggcgctcccaggttggcgtgggagtgttccaggacggggtcttccataccatgtggcacgtgacgcgcggggccgtgctgatgtatcagggcaagcgcctggagcccagctgggcttctgtcaagaaggacctcatcagctatggcggtggttggcggtttcaagggtcctggaacaccggtgaggaggtccaggttattgcggtcgagcccgggaagaacccgaaaaacgttcagaccaccccgggcacgttcaagaccccggagggagaggtgggggctatcgccctggacttcaagcccggcacaagcggctcccccatagtcaaccgcgagggaaaaattgtgggcctgtacgggaacggtgtggtaaccacgagcggtacttacgtaagcgccatcgcccaggcgaaggcgagccaggagggccccctccccgagattgaagacgaagtgttcaagaagcggaacttaaccatcatggacctgcacccggggagcggcaagacccggcggtacttgcccgccatcgtgcgggaggccatcaagcgtaagctgcgcacgctaattttagcgcccacacgcgtggtggcctccgagatggcggaagccttgaagggtatgcccatcagataccaaacaacagccgtcaagagcgagcacacggggcgcgaaatcgtggacctgatgtgccacgctaccttcaccatgcggctcctgtccccggtgagagtccccaactataacatgatcatcatggacgaggcccacttcaccgaccctgcaagcatcgccgctcgcggctacatctccacgcgcgtggggatgggcgaggcggccgccatcttcatgaccgccacgccgcccgggagcgtggaagccttcccccaatccaacgcggtaatccaagacgaggaacgggacatcccggagcgcagctggaacagtggctacgactggattaccgacttccccggcaagacagtctggtttgtgccgtcgatcaagtccggaaacgacatcgctaactgcctgcgtaagaacggaaagcgcgtcatccagctcagccggaagacctttgacaccgagtaccagaagaccaagaacaacgactgggactacgtggtgacgaccgacatctccgagatgggggccaacttccgcgccgatcgggtcattgacccccgccggtgcctcaagcccgtgattctgaaagacgggcccgagcgcgtgattctagcgggtccaatgcccgtcacagtggccagtgccgcacagcggcgcggccggatcggccgtaaccagaacaaagaaggagatcagtacgtatacatgggccagccactcaacaatgatgaggaccatgcccactggaccgaggctaagatgctgctggacaacatcaatacgcccgagggtatcattccggcactgttcgagccagagcgcgagaaatccgccgctatcgacggcgagtaccggctgcgaggggaggcccggaagaccttcgtcgagctaatgcgccgtggcgacctgcccgtgtggctgagctacaaggtggcgagtgaaggattccagtacagcgacagacggtggtgcttcgacggggagcgcaataaccaggtgctcgaggaaaacatggacgtggagatctggaccaaggagggcgagcgcaagaagttgcggccccggtggctggatgcccgcacgtactccgacccgctcgccctgcgggagttcaaggagttcgctgccgggagacggtctgtcagtggcgacctgatcctcgagatcggcaagctgccccagcacctgaccctccgcgcgcagaacgccctggacaatctggtgatgttacacaactccgagcagggcgggaaggcctaccggcatgccatggaggagctccccgacacgatcgaaacgctgatgctcctggcattaatcgccgtgctcaccgggggcgtcaccctgttcttccttagcgggaagggcctcggcaaaacatccatcggcctgttgtgcgtgaccgccagcagtgccctactgtggatggcctcggtggagcctcactggatcgcggcttccattatcctggagtttttcctcatggtcttgctgatcccggagcccgataggcaaagaacgccccaggacaaccagcttgcgtacgtggtgatcggcctgctgttcatgatcctcaccgtcgccgccaacgagatggggctcctggagacgaccaagaaggatctcgggatagggcatgtggccgccgagaaccatcagcacgccaccatgctggacgtggacctgcgcccggccagcgcctggaccctctacgccgtcgccaccacggtgataaccccgatgatgcggcacacaatcgagaacacgaccgccaacatctccttgaccgccatcgccaaccaggcggcgatcctgatgggcctagacaagggctggcccatcagcaagatggacatcggggtgcccctgctggccctcggctgctactcccaggtcaacccgctgaccctgacggcagcggtgctcatgctggtggctcactacgccatcattggaccgggcctgcaggccaaggccacccgcgaagcgcaaaagcgcaccgccgccgggatcatgaagaatcccaccgtcgacggcatcgtggccatcgaccttgaccccgtagtctacgacgccaagttcgagaagcagctgggccagatcatgctgctgatactgtgtacgtcacaaatcctgctcatgcggaccacctgggcgctgtgcgagtcgatcacgctggccactgggccgctcacgaccttatgggagggcagccccggaaagttctggaacactacgatcgccgtgtccatggccaacatcttccgtgggagctacctggccggagcagggctcgccttctccctgatgaagtccctaggcggcggcagacgcgggaccggcgcccagggcgaaacgctcggggagaaatggaagagacagctaaaccagctatccaagagcgagttcaacacctacaaacgcagcggcatcatggaagtggaccggtccgaggccaaggagggactcaaacggggcgaaacgaccaagcacgccgtcagccgggggaccgctaagctgcgctggtttgtggagcgaaacctggtgaagcccgagggcaaggtgatcgacctaggctgcgggcggggagggtggtcctactactgcgctggcctcaaaaaggtgaccgaagttaaggggtacaccaagggcggccccgggcatgaggagccgatccccatggccacgtacggatggaacctggtcaagctgcacagcgggaaggacgtgttttttatgccgccggagaaatgcgataccttactgtgcgatatcggcgagtccagcccgaaccccaccatcgaagaggggaggaccctgcgcgtactcaagatggtcgaaccctggctacgcggcaaccagttctgcataaagatactgaacccctatatgccgtcagtggtggagaccctcgagcagatgcagcgaaagcacgggggcatgcttgtcagaaaccccctgagcaggaactcaacccacgaaatgtattgggtgagctgcggcaccgggaacatagtgtccgccgtcaacatgaccagcaggatgctcctgaaccgcttcacgatggcgcaccgcaaacctacattcgagcgggatgtggacctgggcgcaggaacccgccacgtggccgtcgagcccgaggtggccaatttagatatcattgggcagcggatcgagaacgtaaagaacgagcacaagtctacctggcactacgacgaggataacccgtacaagacctgggcctaccacggcagctacgaggtcaaaccctccgggagcgcgtctagcatggtgaatggcgttgttcgcctgctgaccaagccatgggatgtgatacccatggtcactcagatcgccatgaccgacacgaccccgttcgggcagcagcgggtgttcaaagagaaggtggatacccgcacgccccgggcaaagcggggcacaactcagatcatggaggtcacagcaaagtggctctggggcttcctgtcccggaacaagaagccacgcatctgcacccgggaggaattcacgcgcaaggtccggagcaacgccgcgatcggtgccgtgttcgtcgacgaaaaccagtggaacagcgccaaggaggcagtcgaggacgagcgcttctgggacctggtgcaccgggaacgcgaactccacaaacagggtaagtgcgcgacctgcgtctacaacatgatggggaagagagagaagaagctgggagagttcgggaaggccaagggcagtcgcgccatttggtacatgtggctgggcgcccggttcctcgagtttgaggccctggggttcatgaacgaggaccactggttcagccgcgagaactccctgagcggcgtggagggggagggcctccacaagctggggtacatcctgcgggacatctccaaaatacccggtggcaacatgtacgctgacgacaccgccgggtgggacacacgaattacagaggatgacttacagaacgaggccaagatcaccgacatcatggagcccgagcacgcactgttggccacctcaatcttcaagctcacgtatcaaaacaaggtggtccgcgtgcaaaggcccgcgaaaaacgggacggtgatggacgtgatctcccgccgggatcagcgggggtcaggccaggtaggcacctacgggctgaacacgttcaccaacatggaggtacagcttatccggcagatggagtccgagggaatcttccttcccagcgagctggagacgccaaacctggccgaacgcgtcctcgactggctggagaagcacggggccgagcggctgaagcgtatggccatctccggcgatgattgcgtggtgaaacccatcgacgaccggtttgcaaccgcgctcacagccctgaacgatatgggaaaggtccgcaaagacatcccacagtgggaacccagcaaggggtggaacgactggcagcaagtcccgttctgttcccaccacttccaccagctgataatgaaggacggccgggagatcgtggttccctgccgtaaccaagatgaattggtggggcgtgccagagtgagccagggcgccggctggtccctgcgagagaccgcctgcctgggcaagagctatgcgcaaatgtggcagctcatgtacttccaccgccgggatctgcgcctggccgccaacgccatctgttccgcggttcccgtggactgggtgcccacgagccggacgacctggagcatccacgcccaccatcaatggatgaccaccgaggacatgctctccgtctggaaccgcgtgtggatcgaagagaacccgtggatggaggacaagacgcacgtgagcagttgggaggaggtcccctatctggggaagcgcgaggaccagtggtgcggcagcctgatcggcttgaccgctcgggccacctgggccaccaatatccaggtggcgatcaaccaggtccgccggttgattgggaacgagaactacctggactacatgacatccatgaagcgcttcaagaacgagagcgatcccgagggcgccctctggtga

SEQ ID NO: 23921 - RNA, 9879 nt, synthetic construct
  misc_feature 1..9879: note = derived and/or modified CDS sequence (opt11) from DENV-1__KJ189340__SS-prME
  source 1..9879: mol_type = other RNA
tcggtgaccatgctgctcatgctgctgcccaccgcactagccttccacctcacaaccagaggcggtgagccccacatgatagtgtctaagcaggagcggggcaagagcctgctcttcaagacgtctgcgggagtgaacatgtgcaccctgatcgccatggacctgggcgagctctgcgaggacaccatgacttacaagtgtccccagatcaccgaagccgagcccgacgacgtggactgctggtgcaacgccaccgacacctgggtcacctacgggacctgcagccagaccggcgagcatcggcgggacaagcgctccgtggccctggcgccccacgtgggcttggggctagagacgcggaccgagacctggatgagctccgagggagcatggaagcagatacaacgagtcgaaacctgggccctccggcaccccgggttcacggtgatcgccttattcctcgcgcacgccatcggaacgagcatcactcagaaggggatcatcttcatcctgctgatgctagttactccatccatggcgatgcggtgtgtcggcattggcaatcgggattttgtggaggggctcagcggcgctacgtgggttgacgttgtgctggagcacgggtcctgcgtgaccaccatggccaagaataagcccacactcgacatcgagttgctaaagacggaggttaccaaccccgcgatccttcgcaagctctgcatcgaagccaagatcagcaataccaccacggactcccggtgccctacccaaggagaggcaaccctggtcgaggagcaagacgccaacttcgtgtgccgccggacatttgtcgaccgcggctgggggaacgggtgcggcctcttcggcaaggggagcctgctgacttgcgctaagttcaagtgcgtgaccaagctcgagggcaagatcgtgcagtatgagaacctcaagtattccgtcatagtgaccgtgcacaccggcgaccagcaccaagtcgggaatgagactaccgaacacggcaccattgcaaccatcacgccccaggcgcccacgagcgagatccagctgaccgattacggagcactcacccttgactgtagcccccggacgggattagacttcaacgagatggtgctcctgaccatgaaggagaagagctggctggtccacaagcagtggtttctcgacctgccgctgccatggacctctggtgccagcacctctcaagagacttggaaccggcaggacctcctggtgaccttcaagaccgcccacgcgaaaaagcaggaggtggtcgtgctggggtcgcaggaaggcgccatgcacacagccctgaccggggccacggagatccaaacctccggcaccaccacgatcttcgccgggcacctgaagtgccgactgaagatggataagctgacccttaagggcacctcctacgtgatgtgtactgggagcttcaagctggagaaggaggtcgcggagacgcagcacggcaccgtgctggtgcaggttaaatacgaaggcaccgacgccccttgcaagatacccttttccacacaggatgaaaagggcgtgacgcaaaacggccgcctcatcaccgctaatcctattgtgaccgataaggagaagcccgtcaacatcgaaaccgagccccctttcggggaaagctatatcgttgtcggtgcgggcgagaaagcgctgaagctgtcctggtttaagaaggggagcagcatcggcaagatgtttgaagccacggcccgcggggcccgccggatggccatccttggggacaccgcgtgggacttcgggagcattggaggcgtgttcacaagcgtgggcaagctggtgcatcaggtctttggtaccgcgtatggggtgctattcagtggcgtgtcctggacgatgaaaatcgggatcggcatcctcctgacatggctgggcctcaacagccgatccaccagcctgtccatgacctgcattgccgtaggcatggtgacactgtacctcggcgtaatggtccaggccgacagtgggtgcgtgatcaactggaagggtcgcgaactgaagtgtggctctggcatattcgtgaccaacgaagtccacacctggaccgagcagtacaagtttcaggccgacagcccgaagcggctcagcgcagccatcggcaaggcatgggaggagggggtctgcggcataagatccgccactcggctcgagaatatcatgtggaaacagataagcaatgagctgaaccacatcctgctcgaaaacgacatgaagttcacggtggtcgtaggggacgccaacggcatcctagcgcaggggaagaaaatgatccgtccccagcccatggaacacaagtactcgtggaaatcctggggcaaggccaagattatcggtgcagacatccaaaacaccactttcatcatcgatgggcccgatacacctgaatgccccgacaaccagagggcctggaacatctgggaagtggaggactacggcttcgggatcttcaccacaaacatctggctgaagctccgcgattcctacacgcagatgtgcgatcacaggctgatgtcggcggccatcaaggattccaaagccgtccacgcggacatgggctactggatcgagtctgagaagaacgagacctggaagctggcgcgtgcgtcctttatagaggtgaagacgtgcacctggcccaagagccacaccttatggtccaacggcgtgctggaaagcgagatgatcatccccaagatttacgggggcccgatctcccagcataactatcggccagggtacttcacgcagacggccggtccatggcatctggggaagctcgagctggatttcgacctatgcgagggcactacagtcgtggtggacgagcactgcggaaaccgcgggccgagcctcaggaccacgaccgtaaccggcaagattatccatgagtggtgctgccgcagttgcaccttaccgcccctgcggttcaggggggaggacggctgctggtacggtatggagatccggcccgtgaaggagaaggaggagaatctcgtgcgctctatggtttctgccggcagcggtgaggtggacagcttctccctggggatcctgtgtgtgtcaataatgatcgaggaggttatgcggtcccgctggagccggaagatgctcatgacgggcactctagccgtgttcctgctcctggtgatgggtcaattaacctggaatgacctcatccgcctgtgtatcatggtcggagccaacgcgtcagaccgtatgggaatggggaccacgtacctcgccttaatggccacctttaagatgcggccaatgttcgctgtgggtctgttgttccgcaggttaacttcacgcgaagtgctcctgctcaccatcgggctgtcgttagtcgccagtgtggaattacccaactccctggaggagctgggcgacggactcgccatgggcatcatgatgctgaagttactcacggagtttcagccccaccagctgtggacaaccctgctgagcctgacatttatcaagacgaccctctcccttgactacgcctggaagacaacggccatggccctgtctatcgtgtccctgttccccttatgcctgagcacgacctcccagaagaccacctggctgccggttctcttaggcagcttcgggtgcaagcccctgaccatgttccttatcacggagaataagatttgggggcggaagtcctggcccttgaacgaggggatcatggcgatcggcatcgtgagcattctgctctccagcttgctgaagaacgacgtccccctcgccggcccgcttatcgcaggaggcatgctgatcgcctgctacgtgatttctgggtccagcgccgacctctccctggagaaagcagccgaagtgtcgtgggaacaggaggccgagcattccggcaccagccataatatcctggttgaggtccaggacgacgggaccatgaagatcaaggacgaggagcgcgatgacaccctcaccatcctcctgaaggccaccctccttgccgtgtccggcgtctaccccatgagcatcccagcgaccctgttcgtatggtacttctggcagaaaaagaagcagcgatcgggggttttgtgggataccccgagtccacctgaggtcgagcgcgctgtgcttgacgatggcatctaccggatcctgcaacgcggtctgctcgggcggtcccaggtaggcgtcggggtcttccaggatggcgtgtttcatacgatgtggcatgtcacccgcggggcggtgctgatgtaccaggggaagcggcttgagccaagctgggccagtgtgaagaaggacttgatcagctacggcggagggtggcgctttcaaggatcatggaacaccggcgaggaggtccaggtgatagccgtggaaccagggaagaaccctaagaacgtacagaccacgcccggcaccttcaagacacctgagggcgaggtgggggcgatcgccctagattttaagcccggcacctccgggtccccgatcgtcaaccgggagggaaagatcgtcggcctgtatggaaacggcgtggtaacgacagggggcacctacgtctcggccatagcccaggccaaagcctcccaagaggggccgcttcccgaaatagaggatgaggtgttcaagaaacgcaacctgaccataatggacctgcacccgggtagcggcaagacgcggcgctacctccccgccatcgtgcgggaagccatcaagcgaaagcttcggacactgatcttagcccccaccagagtcgtggcgagcgagatggccgaggccctgaaagggatgcccatccgctaccagaccacggcggtgaagtccgagcacaccggcagagagatcgtcgacctcatgtgccacgcaaccttcaccatgcgcttactgtcgccagtccgggtgcccaactacaacatgatcatcatggacgaagcgcacttcacggacccggcgtccatcgcggcccgcgggtacataagcacccgtgtcggcatgggggaggccgcggccatattcatgaccgccacgcctccgggcagtgtggaggccttcccccagagcaacgccgtgatccaggacgaggagcgcgacatacccgagagaagctggaacagcggctatgactggatcaccgattttcccggtaaaaccgtatggttcgtgccctccataaagtctggcaacgacatcgcgaactgcctgcgcaagaatggcaagcgggtgatccagctcagccgcaagaccttcgacaccgagtaccagaagacgaaaaataacgactgggactacgtcgtgaccactgacatcagcgagatgggcgccaacttcagggctgaccgcgtgatcgacccccggcgctgccttaagcccgtcatcctaaaggacgggcccgagcgtgtgatcctcgccggtccgatgccagtcacggtggcctccgccgctcaaagacgggggcggattgggcggaatcagaacaaggagggcgaccagtacgtgtacatggggcagcccctgaacaacgacgaagaccacgcccattggacggaggccaagatgctgctagataacataaacacgcctgagggtattatcccggcgctgttcgaacctgagcgcgagaagtccgccgcaatcgacggagagtatcgcctgcggggcgaggcccgcaagaccttcgtcgagctaatgcgccgcggcgacctgcccgtgtggctgtcgtataaagtggccagcgaaggctttcagtactccgatcggcgatggtgcttcgatggggagcgaaacaaccaggtcctagaggagaatatggacgtggagatctggaccaaggaaggtgagcgcaagaagctgcggccccgttggctggatgcgagaacatacagcgacccgctcgcccttcgcgagttcaaggagttcgctgccggccggaggtccgtgagcggagacctgattctggagatcgggaagctgcctcagcacctgacattacgggcccagaacgcgctggacaacctggtcatgctccacaacagcgagcagggcgggaaggcctaccgccacgccatggaagaactccccgacaccatcgagaccttaatgttgctggccctgatcgcggtcttaactggcggggtgacgctgttcttcttgtccggcaagggcctcgggaagacctcaatcggccttctctgcgtcaccgcctccagcgcactcctgtggatggcctccgtcgaaccccactggattgccgctagcattatcttggagttttttctcatggtgctgctgatcccggagcccgaccggcagcgcacgccccaggacaatcagcttgcctacgtcgtcatcgggctgctgttcatgatcctcacggtggccgcgaacgaaatgggtctgctggagaccaccaagaaggatctcgggatcgggcacgtagccgccgagaaccatcagcacgctaccatgttggacgtggacctacggccagcctccgcctggacactttacgcggttgcaaccacggtcatcacccccatgatgagacatacaatcgagaataccactgcaaacatcagcttaactgccatcgccaatcaggccgctatcctgatgggcctcgacaaggggtggcccatctccaaaatggatataggtgtgcccctgctggcactcgggtgttacagccaggtgaacccgctgacgctgaccgctgccgtcctcatgctggtggctcactacgccatcattggacccgggctgcaggccaaggccacgcgggaggctcagaaaagaaccgcggccgggattatgaagaatcccacagtggacggcatcgtcgctattgatctcgatccagtggtgtacgacgccaagttcgaaaagcagctggggcagatcatgctgctcatactgtgcacctctcagattctgctcatgagaactacctgggccttgtgtgaaagcataacgctagcgaccggtcctctcacgacactatgggaagggtcccccgggaagttctggaacacgaccatcgccgtaagcatggccaacatcttccgggggtcctacctggccggagccggcctagcgttcagcctcatgaagtccctcgggggcggacgccgagggaccggagcccaaggggagacccttggagagaagtggaagcgccagttgaaccagttaagcaagagtgagtttaacacgtacaaacggagcgggatcatggaagtggaccgcagcgaagcgaaggagggcctcaagcgcggcgagaccaccaagcacgctgtttcccgcggaacagctaagttgcggtggttcgtcgagcgtaacctggtgaagcccgaaggtaaggtgatcgatctggggtgcggacgcgggggctggagctactactgcgctgggctaaaaaaggttaccgaagtcaagggctacacgaagggcggacccggccacgaggagccaatccccatggcaacctacggctggaacctggtgaagctgcattccgggaaggatgtctttttcatgccccccgagaagtgcgacacgctcctgtgcgacatcggtgagagttcacctaaccctacaattgaggagggcaggacgctgcgtgtgctaaagatggtggagccctggctgagaggaaaccagttctgcattaagatcctgaacccctacatgccgagcgtcgtggaagcgctcgagcagatgcaacggaaacacgggggcatgctggtgcgcaaccccctgtcccggaactctacccacgagatgtactgggtctcctgtggcacgggcaacatcgtgagcgctgtgaacatgaccagccgcatgctgctgaaccggttcacgatggcgcaccgcaagccgacgtacgagcgcgacgtagacctgggtgccggtacgcggcacgtggccgtggaacccgaagtcgccaacctggacatcatcggccaacgcatcgagaacatcaagaacgagcacaagtcgacctggcactacgacgaagataacccgtacaagacatgggcttaccacgggtcctacgaagtaaagcccagcggtagcgcgtcgtccatggtgaacggggtcgtgcggctgttgaccaagccatgggacgtcatccccatggtgacccagattgctatgaccgacaccaccccgtttggccagcaacgcgtgttcaaggagaaggtcgatacccggacccccaaggctaaacggggcacgacccagatcatggaggtgacggccaagtggctctgggggttcctgagtcgcaacaagaagccgcgcatctgcacccgggaggagtttacgcgcaaggttcgcagcaacgccgcgatcggcgccgtcttcgtggacgaaaaccagtggaacagcgccaaggaggccgtggaggacgaacgcttctgggatctggtccaccgggaacgcgagctccacaagcaggggaagtgcgctacctgcgtgtataacatgatgggcaagagggaaaagaaactcggtgagttcggcaaggccaagggcagccgcgcaatatggtacatgtggttgggagcccggttcttagagttcgaggccctcggcttcatgaacgaggaccactggttttcccgcgagaacagcctgagcggggtggagggggaagggctacacaagctgggctacatcctgcgggatatcagcaagatcccgggcggtaacatgtatgcggacgacaccgccggctgggacacaaggatcacggaggatgacctccagaacgaggccaaaatcaccgagatcatggagcctgagcacgcgttgctggccacctctatcttcaagctcacctatcaaaacaaagtagtgcgggtgcaacgccccgccaagaacggcaccgtcatggatgtgatcagccgccgggaccagcggggctccggccaggtggggacttatgggctgaacacgttcaccaacatggaggtccagctgatcagacagatggaaagcgagggaatcttcttgccctccgaactcgagacgccaaacctcgccgagcgcgtcctcgattggctggaaaagcacggcgctgaacggctgaagcgaatggccattagcggagacgactgtgtggtcaagcccatcgacgaccggtttgccaccgcgctcaccgctctgaacgatatgggcaaagtgcgcaaggacatcccccaatgggagccctccaagggctggaacgactggcagcaggtcccgttctgtagccatcacttccaccagttgatcatgaaggacgggcgcgaaatcgtagtgccgtgtcgcaaccaggatgagctcgttggccgggcccgcgtcagtcagggggccgggtggagcctgcgggagaccgcctgcctggggaagtcctatgcacagatgtggcagctcatgtatttccacagacgggacctgcgcttggccgcaaacgccatctgcagcgcggtgcccgtagactgggtccccacatcccgaacgacctggagcatccacgcccaccaccagtggatgaccaccgaggacatgctaagcgtgtggaaccgcgtgtggatagaggagaatccgtggatggaggacaagactcacgtctcaagctgggaggaggtaccctatttgggtaagcgggaagaccagtggtgcggatcactgatcggactcaccgcccgcgccacctgggcaaccaacatccaggtggcaatcaaccaggtcaggcggctgatcggaaacgagaactatctggactacatgacgagcatgaagagattcaagaacgaatccgaccccgagggggccctctggtga

SEQ ID NO: 23922 - RNA, 9879 nt, synthetic construct
  misc_feature 1..9879: note = derived and/or modified CDS sequence (opt11) from DENV-1__KJ189341__SS-prME
  source 1..9879: mol_type = other RNA
tccgtaaccatgctactaatgctgctacccacggccctagctttccacctcactactcgcggaggggaaccccacatgatcgtatcgaaacaggaacgaggaaaaagcctcctcttcaaaacgagcgcaggcgtgaacatgtgcaccctaatagctatggacctcggtgaactgtgtgaagataccatgacatacaaatgcccgcaaatcacagaagcggaacctgacgatgtagattgctggtgtaacgccacagacacatgggtgacctacggcacgtgttcgcaaacaggagggcaccgcagagaaaaacgaagtgtagcccttgcgccccacgtaggcctcgggctggaaacacggacagagacgtggatgtcgtcagagggggcgtggaaacaaatacaacgggttgagacctgggccctaaggcaccccggtttcacagtaatagccttatttctagctcacgcaatcgggactagcatcactcagaaaggtatcatttttatactactaatgctcgtcacaccaagtatggccatgaggtgcgtaggaataggcaaccgtgacttcgtcgagggcttatccggagcaacgtgggtagatgtcgtgctcgaacacggatcatgcgtaacaacaatggctaaaaacaaaccaacgctcgacatagagctactaaaaacagaagtgacaaacccagcagtcctaagaaaactttgtatagaagccaaaataagcaatacaactaccgattcacgctgtccaacccagggagaggccactctggtcgaagaacaggacgcaaacttcgtatgccgtcggacattcgtcgatagaggctggggcaacggttgcggcctgttcggcaagggatcgctgctcacttgtgcgaaattcaagtgcgtcaccaaactagaagggaaaattgtgcagtacgaaaacctaaaatacagcgtcatagtaacagtacacaccggggaccaacaccaggtaggtaacgagacaaccgagcacgggacaatagccaccatcacgccacaagcacctacgtcagagatccaactcacggattatggggcattgactctggactgctctccacgcacagggctagacttcaatgagatggttctcctcacaatgaaggaaaaatcatggctcgtccacaagcaatggttcctggaccttccgctgccatggaccagtggagcaagtacgtcccaagagacatggaaccgacaagatctcctagtaactttcaaaactgcgcatgcgaagaagcaggaggtagtcgtcctcgggtcacaagagggcgcaatgcacaccgccctcacaggcgcaaccgagatccaaaccagcggaacaaccacaatctttgctggacacctaaaatgtcgcttgaaaatggacaaattgactctaaagggaacatcgtatgtaatgtgtacaggccctttcaagttagagaaggaagtcgcagaaacgcagcatgggactgtccttgtccaagtgaaatacgaaggaaccgacgcaccatgtaaaatacccttctcgacacaggacgagaagggcgtcacccaaaatggccgactcataacggccaacccgatagttactgacaaagagaagccggtgaacattgagacggaaccacctttcggggaaagctacatcgtagtgggagcgggcgaaaaagcattaaagctctcttggttcaagaaaggatcgtcgattggtaaaatgttcgaagccaccgccagaggagccagacggatggcaatactcggcgacaccgcatgggacttcggtagcataggcggcgtattcacgagcgtgggaaaactggtccatcaggtatttgggacggcttacggtgtcctattcagtggtgtgagctggaccatgaagattggcatcgggatactgctcacatggctcgggcttaactcacggtcgacttctctgagcatgacgtgcatagtcgtaggcatcgtcacgttatatctcggagtaatggtccaggccgactctgggtgcgtgattaattggaaaggacgagagttgaaatgtggctcggggatattcgtgaccaacgaagtacacacctggactgaacaatacaagttccaggcagatagccccaagcggctcagtgcggccataggtaaggcttgggaagaaggagtctgcggaatccgaagcgcaacccggctagaaaatataatgtggaaacaaatctcaaacgaactcaaccacatattactagaaaacgacatgaaattcaccgttgtcgttggagacgcgaacggaatactcgcacaaggcaagaaaatgatcagaccacaaccgatggaacacaagtactcctggaagtcctgggggaaagcaaagataatcggtgcagacacccagaacaccacgttcatcatagatggccccgacactcctgagtgccccgacaaccaacgcgcgtggaacatatgggaggtagaagattatgggttcggcatcttcaccacgaacatatggctcaaattacgagatagctatacccagatgtgcgaccaccggttgatgtcagcagcaattaaagacagtaaggcggtgcacgccgacatgggttattggattgagtcggagaaaaacgagacatggaagctcgcccgcgcctcattcatcgaggtaaaaacatgcacatggccaaaatcccataccctctggtcgaacggtgtgctggagtccgagatgataatccccaaaatatacggaggccccatttcgcaacacaactaccgacccggctacttcacccagactgccggaccatggcacctgggcaaactcgaactggatttcgacctctgtgaaggtaccacagttgtagtagacgaacattgtggcaaccgaggtccatccctaaggacaacgaccgtgacaggaaaaatcattcacgaatggtgttgtagaagctgcaccctaccgccccttcgattccgaggggaggatggctgctggtatggtatggagatacgacctgtgaaggagaaagaagaaaacctagtccgaagcatggtaagcgcaggttctggagaggtagacagcttttccctaggaatcctatgtgcaagtattatgatagaggaggtaatgagaagcagatggtcgaggaagatgctaatgaccggcacactcgccgtctttctcttactcatcatggggcagctaacctggaaagatctcattcggctgtgtatcatggtgggtgctaacgcaagtgacaggatgggaatgggcacgacctacctggcactaatggcgacattcaagatgcgacccatgttcgccgtagggctcctatttagaagactcacaagcagagaggtgctactactgacaatcggtctatccttggtcgcgtcagtagaactacccaattccctagaagaattgggagacggactcgcaatgggaataatgatgttaaagctcctcacagagtttcagccacatcaactttggacaacactgctcagtctcacgttcataaaaacaacgctaagtctcgactatgcctggaagacaacagcaatggctttatccatagtatcactgttcccgctatgcctgagcacgacaagccagaaaacaacatggttaccagtgctgctggggagtttcggatgcaagccatcaacaatgtttctcataacagaaaacaaaatatggggacgaaagagctggccactaaacgaaggcatcatggcaatcgggatcgtgtcaatactcctcagcagcctcctcaaaaacgatgtgccactagccggcccattgatcgcaggcggtatgctaatcgcatgttatgtcatatccgggagttccgcagatctatcactggaaaaagcagccgaggtctcgtgggaacaggaggccgaacacagcgggacctcgcacaatatactggtcgaagtacaagacgacggaacaatgaaaataaaagacgaggagcgggacgacaccctcaccatactgctcaaagccacactcctcgccgtaagcggggtatatccaatgtcaatccctgcaactctcttcgtttggtacttctggcagaagaaaaagcagcgctcaggggtcctatgggatactccaagcccaccggaagtcgaaagagccgtattagacgacggaatttaccgaatactgcagcgggggttactaggccgaagccaggtcggcgtaggagtttttcaagacggcgtctttcacaccatgtggcacgtcactcggggagcggtgctaatgtatcagggaaagcgcctcgaaccgagttgggcgagtgtcaagaaagacttgataagttacggcggcggatggcggttccaaggctcttggaataccggggaagaagtgcaagtaatagcagtagagcccggcaaaaaccccaaaaatgtgcaaacaaccccgggtaccttcaagaccccggagggcgaggttggggcaatcgcgctcgacttcaagccaggcacgtcgggctcgcccatagtcaaccgagaagggaagattgtgggcctctacgggaacggtgtggtaacaacaagcggcacgtacgtgtcagccatagcccaagccaaggccagccaggaggggcctttgcccgagatcgaggatgaagtattcaaaaagagaaacctcaccattatggatttgcacccaggcagtggcaagacaagacgatatctgcccgcgatagtacgtgaagctatcaaacgaaagctccgtacactaatcttagcgcccacccgggtcgttgcctcagaaatggctgaggccctgaaagggatgccgattagataccagacaacagcagtaaaatcagaacacacagggcgcgagatcgtagacttaatgtgccacgccacttttaccatgagactactgagcccggtgcgcgttccaaattacaacatgattatcatggacgaagcccattttactgacccagcaagcatagccgcaagaggatacatcagcactagagtggggatgggggaagcggcggccatcttcatgacagcaacgccacccggcagcgtcgaagcatttccgcaaagcaacgccgtaattcaagacgaggaaagagacattccggagcggtcttggaacagcggttacgactggataaccgacttccccgggaaaacggtctggttcgtgccctccataaagtcaggtaacgacatagcaaattgcctaaggaagaatggaaaaagagtcatacaattatctagaaagaccttcgatacagaatatcagaagaccaaaaacaatgattgggattacgtcgtaacgactgacatatcagaaatgggcgcgaacttccgggcagaccgcgtaatagatccaagaaggtgcctgaagcccgtaatactcaaggacgggccggaacgggtcatactagccgggccgatgccggtgaccgtagcgtccgcggcacagaggcgaggccgaatcgggcgaaaccaaaacaaagaaggtgaccaatacgtctacatggggcaaccgctcaacaacgacgaagaccatgcccattggacggaagcgaagatgctgctagacaatataaacacgcccgaagggatcataccagccttattcgagcccgaacgagagaaaagcgcagcaatcgacggcgaatatcggctcaggggagaagcgcgaaaaaccttcgtagaactaatgcggcgcggcgatctgccagtatggctcagctacaaagtcgcatcggagggtatacaatacagtgaccggcgttggtgcttcgacggagaacgtaataaccaggtattagaagaaaacatggacgtcgaaatatggacaaaagagggggagaggaagaaactccggccgcgatggctggatgcacgtacatacagcgacccactcgcgctgagggagtttaaagagttcgccgcagggcggcgatcagtgtcaggcgatctaatcctcgagatcggaaaactgccacagcacctcacgctcagggcgcaaaatgcactagataatctagtaatgctacataactctgaacaagggggcaaagcataccggcacgcgatggaagaattgccggacaccattgaaacccttatgctccttgctttaatcgctgttctaacgggaggggtaaccctatttttcttgagcggcaagggcctgggtaagacaagtataggactgttatgcgtaacggcgtccagtgccctcctctggatggcgtcagtcgagctgcactggattgccgcgagcataatcctcgagttctttcttatggtccttttgatcccagaacccgacaggcaaaggaccccacaagataaccaactcgcgtacgtggtgataggcttactgttcatgatactgacggttgccgcaaacgaaatggggcttctagaaaccaccaagaaagatctcggcataggacatgtcgccgccgaaaaccaccaacatgcgacgatgttagacgtggatttgcgtccggcgagcgcatggaccctttacgcagtcgccacaaccgttattacccccatgatgcgccacaccatcgagaacactacggcaaacatctcacttacagcaatcgctaaccaggccgctatactgatgggcctggataaaggctggccaataagtaaaatggatatcggagtaccgttactcgcactagggtgttactcacaagtcaatccgttaacgctcaccgcagccgtacttatgttagtcgcacattacgccataatcggccccgggcttcaagcaaaagcaaccagagaagcccaaaagaggacggctgctggaataatgaaaaaccccacagtagacggaatagtcgccatagatctggatccggtcgtgtacgacgcaaaatttgaaaaacaactagggcagataatgctcctcatactctgcacgtcacaaatattgctcatgaggacaacatgggctctatgcgaaagcataaccctcgccaccggaccgctgacgaccctatgggaaggctctccaggaaaattttggaacacaacgatagctgtaagcatggcaaacatattcagggggtcatacctagccggggcgggattagcattcagcctcatgaagtcactaggcggagggcgacgggggacaggcgcccaaggggaaacgctcggcgagaagtggaagagacagctcaaccaactgagtaagagtgagttcaacatatacaagcggtcaggcataatggaagtagatcgctccgaagccaaagagggcctcaaacgaggagaaaccacgaaacacgccgtctcgcgtggtacagctaaactccgctggttcgtagagagaaatttagtcaaaccggaaggaaaagtcatagacctaggttgcggcagaggcggatggagctactactgcgccgggcttaagaaggtaacagaggttaaagggtacactaaagggggcccaggacacgaagaacccatcccgatggcgacctacggctggaatctggttaaactccatagcgggaaggatgtcttctttatgcccccagaaaaatgcgacacactcctatgcgatatcggggagtccagtcccaacccaacgatcgaagaaggaaggacattaagagtgctaaaaatggtcgaaccttggctgcgaggcaaccaattttgcatcaaaatactaaatccgtatatgcccagcgtcgtggagacgctcgaacaaatgcaacgaaaacatgggggcatgctggtacgtaatccactaagccgcaacagcacacacgaaatgtattgggtctcgtgcggtaccggtaatatagtttcggcagtaaatatgacttcaaggatgttattaaatcgatttacgatggcccatagaaaaccaacgtacgaacgcgacgtcgacctaggagcagggacgaggcatgtagccgtggaaccggaggtagccaacctcgacatcattggacagagaatcgagaatatcaaaaacgaacacaagagcacatggcactatgacgaggacaacccatacaagacatgggcgtaccatggaagctacgaagtaaaacccagcgggagcgcctcgtcaatggtgaacggagtagtgagactccttacaaagccgtgggacgtaatccctatggtaacacaaatcgcaatgaccgacactacgccgttcggacagcagcgagtgttcaaagagaaggtcgatacccggaccccacgagctaaaagagggacgacacaaataatggaggtaactgccaagtggttatggggtttcctgagccggaacaaaaagccaaggatctgcaccagagaggagttcacccgcaaggtccgttcaaacgcagcaatcggagcggtattcgtcgacgaaaatcaatggaacagcgcaaaagaagcggtcgaggacgaacgcttctgggacctagtacacagagaacgagagctacataaacagggcaaatgcgctacatgcgtatacaatatgatgggaaaacgggaaaagaagctgggcgaatttggcaaggctaaaggttcaagggcaatatggtatatgtggctgggagcgcgctttctggagtttgaggcactaggattcatgaatgaagatcactggttctcgcgcgagaacagccttagcggcgtagagggagagggcctccacaagctgggctatatactaagagatataagtaagatcccgggaggaaacatgtacgctgacgacacggcgggctgggacactaggatcaccgaggacgacttacagaacgaagcgaaaattaccgacataatggaacctgaacatgcgttgctagccacctcgatctttaaattaacgtatcagaacaaagtggttagggtccagcgcccagcgaaaaacgggacagtgatggatgtaataagccgacgggatcagcgaggctccggccaagtaggaacctacggcctaaacactttcaccaatatggaagtgcagctgatacgacagatggaaagtgaaggcatcttcctgccttccgaactggagactccaaatctagccgagcgtgtcctagactggctcgagaagcacggcgccgagagacttaagaggatggcgatatcaggggacgattgcgtcgtaaaaccaatagatgaccgattcgcaaccgctctaacggcactaaacgacatgggtaaagtcagaaaagacataccacagtgggagccaagcaaaggctggaacgactggcaacaagtacccttctgctctcaccacttccatcaactcatcatgaaagacggacgcgaaatcgtggttccatgtcgcaaccaagatgagctagtaggtcgcgccagagtgtcacaaggggccgggtggtccttaagggaaacagcctgcctcgggaaaagctacgctcagatgtggcaattaatgtacttccacaggcgtgacctcagactggcggccaacgcgatctgtagcgcggtgccagtggactgggtaccgacatccagaacaacctggagcatacatgcccaccaccaatggatgaccaccgaagacatgcttagcgtgtggaatagagtatggattgaggagaacccttggatggaggacaagacacatgtaagcagctgggaggaagtaccctatctggggaagagagaggaccaatggtgcggaagtctcataggactaactgcccgagctacttgggcgacaaatatacaagtcgcaataaatcaggtaagaagactcattgggaacgagaattacctagactacatgacttccatgaaacggttcaaaaacgaatcagatcccgagggggcactctggtaa

SEQ ID NO: 23923 - RNA, 9879 nt, synthetic construct
  misc_feature 1..9879: note = derived and/or modified CDS sequence (opt11) from DENV-1__KJ189343__SS-prME
  source 1..9879: mol_type = other RNA
agcgtgaccatgctcttaatgttgctccccaccgccctggcctttcacttaacgacccggggtggggaaccccacatgatcgtgagtaagcaggagcggggcaagagcttactctttaagactagcgcgggggtcaacatgtgcacactgatcgcaatggacctgggggagttatgcgaggacacgatgacctacaagtgtccccagatcaccgaagccgagcccgacgacgtggactgctggtgcaacgccactgacacgtgggtcacctatggaacctgcagccagacgggcgagcaccgccgggataagcgcagtgtggccctggcgccccacgtgggcctggggctcgagacacggaccgagacctggatgagctctgagggggcgtggaaacagatacagagggtcgagacctgggctctgcggcaccccgggtttactgtgactgccttattcctcgcgcacgcgatcggcaccagcattacccagaaagggatcatcttcatcctgttgatgttggtgacgccctccatggcaatgaggtgcgtcggcatcggcaaccgggatttcgtggaggggctgagcggcgcaacttgggtagatgtcgtcctggagcacgggagctgcgtgaccaccatggctaagaacaagcccacgctggatatcgagctgctgaaaaccgaggtcaccaaccccgcgatcctccgaaaactttgcatcgaagctaagatcagcaacaccacgaccgactcccggtgccccacccaaggggaggccaccttagtcgaagaacaagacgccaacttcgtctgcaggcggacgttcgtcgaccgtggctgggggaacggctgtggcctcttcggcaaagggagcctcctgacctgcgccaagttcaagtgcgtgaccaaactcgagggcaagatcgttcagtatgaaaacctaaaatacagcgtgatagtaaccgtgcacacaggcgaccaacaccaggtcgggaacgagaccaccgagcacgggaccatcgcgaccatcactccccaggcccccaccagcgagatacagctgacggactacggggccctcacgctggactgctcgccccggacaggcctggacttcaacgagatggtcctcctgaccatgaaagagaagtcctggctggtccacaagcagtggttcttggatttaccgctgccctggacctccggagccagcactagccaagagacgtggaacagacaggacttacttgttaccttcaaaactgcccatgcgaaaaagcaggaggtggtcgtgctgggaagccaggagggggccatgcacacggcactcacgggggccaccgagatacagacctccggcacaacaacgatcttcgccgggcacctgaagtgccggctgaagatggataagctcaccctgaagggcacctcctacgtgatgtgtacgggcagcttcaagctggagaaggaggtcgcagagacccagcacggcaccgtgcttgtacaggtcaagtatgagggcaccgacgccccctgcaaaattcccttctcaacgcaagacgagaagggagtcacacagaacggccgcctcatcacagccaacccgatcgtcactgacaaggagaagcccgtcaacattgagacggagccgcccttcggggagagctacatcgtcgtgggcgctggcgaaaaggccctgaagctgtcctggttcaagaaggggagcagcatcggcaagatgttcgaggccaccgcccgtggggcccgcagaatggccatcctcggcgacaccgcgtgggatttcgggagcattgggggtgtctttacctccgtgggcaagctggttcaccaggtcttcggcacggcctacggggtgctgttcagcggagtgtcctggacaatgaagatcgggatcggcatcttactgacgtggctgggactaaacagcaggtccaccagcctgtcgatgacgtgcattgctgtcgggatggtgaccctgtacctcggcgtgatggtgcaggccgattcagggtgcgtcgtgaattggaaagggcgcgagctgaagtgcgggtccggcattttcgtcaccaatgaagtgcacacctggaccgagcagtacaagttccaagccgacagcccgaaacggctgtcggcggccatcggcaaggcgtgggaggagggagtgtgcggcatccgcagtgctactcgactcgaaaatatcatgtggaagcaaatcagcaatgaactgaatcacattctgttggagaacgatatgaagttcaccgtcgtggtgggggacgccaacggcatcctggcgcaggggaagaagatgatccgcccccagccaatggagcacaagtacagctggaagtcctggggcaaggccaagattatcggcgctgacatccagaacaccaccttcatcatcgacgggcccgacacgccggaatgccccgacaatcagcgggcctggaacatctgggaggtggaggattatggcttcgggatattcactacaaatatctggctgaagctccgcgactcctacacccagatgtgtgaccaccggctgatgtctgcggccataaaggactccaaagccgtgcacgcggacatgggctactggatcgagtcggaaaagaacgagacgtggaaactggcccgcgcgtccttcatagaagtaaagacctgtacctggccaaagtcacacacgctctggtccaacggcgtgctggagagcgagatgatcatccccaagatctacggagggcctatctcgcaacacaactaccggcccgggtacttcacacagaccgccgggccctggcacctgggcaagttagaactggacttcgatttgtgcgaaggcaccacggtcgtggtcgacgagcactgtggcaaccgcgggcccagcctgcgaacgaccactgttacggggaagatcatccacgagtggtgctgccgctcctgcacgctgcctcccctccggttccgcggggaggatggctgctggtacggcatggagatccggcccgtgaaggagaaagaggagaacctcgtccgctcaatggtgtccgccggcagcggcgaggtagactccttctccctggggatcctgtgtgccagcatcatgattgaagaagtcatgcggtcaagatggagtagaaagatgctcatgataggcaccctggcagtgttcctactcctgatcatggggcagctgacctggaatgacctcatccgcttgtgcatcatggtgggagctaacgcctccgaccgaatggggatgggtaccacgtacctggcactcatggcgacctttaaaatgcggccgatgttcgccgtcggcctactcttccgtcggctcaccagtcgcgaggtgctgcttttaacgataggtttatccctggtggcgtccgtcgagttacccaactccttagaggagctaggcgacgggctggccatggggataatgatgctaaaactgctaacggagttccaaccccatcagctgtggaccaccctgctcagtctgaccttcatcaagacgaccctgtccctcgattatgcatggaagactaccgccatggcgttatctatagtgtccctcttccccttatgcttaagcacgacttcccagaaaaccacctggctgcccgtattacttgggagctttgggtgcaagccgctgacgatgttcctcatcacggaaaacaagatctgggggcggaagtcctggccactgaacgaggggatcatggccatcggaattgtcagtatcctgctctcctccttgctgaagaatgacgtccctctcgccgggccgctgatagccggcggtatgctgattgcatgctacgtcatcagcgggtccagcgcggatctctccttggagaagaccgccgaggtgagctgggagcaagaggccgagcactccggcaccagccacaatatcctagtggaggtccaggatgacgggaccatgaagatcaaggatgaggaacgtgacgacacgctcaccatcctgctgaaagccaccctgctggccgtctccggcgtctaccccatgagcatcccggcgaccctgttcgtctggtacttttggcagaagaagaagcagcggagcggggtattatgggacacgcccagcccgcccgaggtggagcgcgccgtactggatgacggcatttaccgtatactgcagcgcggtcttcttgggcggagccaagtgggcgtgggggtcttccaggatggcgtgttccacaccatgtggcacgtgactagaggagccgtccttatgtaccagggcaagcggctggagccctcctgggcctccgtgaaaaaggatctcatcagctacggcggagggtggcgcttccaggggtcctggaacaccggagaggaggtgcaggttatcgcagtggagcccgggaaaaacccgaaaaacgtgcagacgacccccggcaccttcaagaccccagagggcgaggtcggggcgatcgctctggattttaagcccggcacgtccgggagcccaatcgtaaaccgggagggcaaaatagtgggcctgtacgggaacggcgtcgtgaccacctcggggacctacgtctccgccattgcacaggccaaggcatcacaggagggccccttgcctgagatcgaggacgaggttttcaagaaacgcaacctgacgatcatggacctgcacccggggagcggcaagacccggcgctacctaccagccatagtgcgggaagccatcaaacgcaagctgcggaccctgatcttggcgcccacgagagtggttgcgtccgagatggcagaggcgctgaagggcatgcctatccgctatcaaacgaccgccgtcaagagcgagcacaccgggcgggagattgttgacctgatgtgccacgcaaccttcacgatgagactcctgtcgccggtccgggtccctaactacaacatgattatcatggacgaggcgcatttcacggaccccgcctctatcgccgcccgcggctacatctccacccgggtggggatgggcgaggccgcggctatcttcatgacggccacacccccagggagcgtcgaggccttcccacagtccaacgccgttatccaggacgaggagcgcgacatccccgagcggagctggaatagcgggtacgactggatcaccgacttccctgggaagacagtgtggttcgtcccctcgatcaagagtggaaatgacatcgcgaactgcttacgcaaaaatggcaagcgggtgatccagctctcacgcaagaccttcgacacggagtaccagaagaccaagaacaacgattgggattatgtggtcaccactgacatctcggagatgggtgccaactttcgggcagatagggtgatcgacccccggcgctgcctgaagcccgtgatcttaaaggacggtcctgaacgggtcatcctcgccgggcctatgccagtcacggtggcgtctgccgcccagcgcaggggccgcataggacggaatcagaataaggaaggggaccagtacgtctatatgggtcagcccctgaataacgatgaggatcacgcccactggacggaagccaaaatgttactggacaacatcaacacccccgaggggatcatcccggcgctgttcgagccagagcgcgagaagtccgccgccatagacggggaataccgcctccgcggggaggcacgcaagaccttcgtggagttgatgcggcgcggggacctgccggtctggctgagctacaaagtggcctccgagggcttccaatacagtgaccggcgctggtgcttcgatggggaacgcaacaaccaggtgctcgaggagaacatggacgtggaaatctggacaaaggaaggcgagcgcaagaagctgcggcctcgctggctggatgcacggacctactccgacccgctcgccctgcgcgagttcaaagagtttgccgccgggcggagaagcgtgagtggcgatctaatcctcgagattggcaagctgccccagcacctgacccttcgggcccagaacgctctggacaacctggccatgctccataacagtgagcagggcgggaaggcctaccgccacgccatggaggagctgcccgacacaatagagacccttatgctccttgcgctgatcgcagtgctcacaggcggggtcaccctgttcttcttgagcgggaaggggctcggcaagacctccatagggctgctctgtgtgacagccagcagcgccctcctctggatggccagcgtcgagccccactggatcgcggcttccattatcttggagttcttcctgatggtcctgctgatcccggagcctgaccggcaacgcaccccacaggacaaccagctcgcatacgtggtgatcggactgctgttcatgatcctaacggttgctgccaacgagatgggactgctggaaacaactaagaaagacctcggcataggtcacgtggcggctgagaaccatcagcacgccacgatgctggatgtggatctacggccggccagcgcctggacactgtacgcagtcgccaccactgtgattacgcccatgatgcgccacacaatcgagaacaccaccgccaacatcagtttaacggctatcgcaaaccaggccgccatcttaatgggcctcgacaagggatggcccattagcaaaatggacatcggggtcccccttctggccttaggctgctactcccaggtgaacccgctgaccctgactgccgcggtgttgatgttggtggcgcactacgccattattgggcccggattgcaagccaaggccacccgtgaggcgcaaaagcgcacggcggccgggatcatgaagaaccccaccgtcgatggcatcgtggctatagatctcgaccccgtggtctacgacgctaagttcgaaaagcagctggggcagataatgctgctaatcttatgcaccagccagatcttgctcatgcgcaccacctgggcactgtgcgagagcatcacccttgccaccgggccgctcaccactctgtgggagggcagccccgggaagttctggaacaccaccatcgccgtttccatggcgaatatcttcaggggctcttacctggccggcgcggggctcgcgttctctttgatgaagtcacttggcggtggccgcagagggaccggggcccagggcgagacgctaggggaaaagtggaagcgccagctgaaccaactgtcgaaaagcgagttcaacacctataagagatcggggatcatggaagtagaccgctccgaggccaaggaggggctcaagcggggcgagactaccaaacacgcggtcagcagagggaccgccaaactaagatggttcgtggagcgcaacctggtgaaacccgaaggcaaggtcatcgacttgggctgcgggaggggcggctggtcctattactgcgccggcctcaagaaggtaacggaagtcaaggggtacaccaagggcggccccggccacgaggagccgatacccatggccacttacggctggaatctggtcaagctgcatagcgggaaggacgtgtttttcatgccacctgagaagtgcgacaccctcctgtgcgatataggcgagtccagcccgaaccccacgatagaggaggggcgcacgctgcgggtacttaaaatggtcgaaccatggctgcgcgggaaccagttctgcatcaagatattaaacccctacatgcccagcgttgtagagaccctcgagcagatgcagcggaaacacggcgggatgctggttcgcaaccccctaagccggaactcaacacacgaaatgtattgggtatcttgcggcacaggaaacatcgtctccgccgtcaacatgacgtctcgcatgctcttaaatcgattcaccatggcccaccgcaaacccacctttgagagggacgtggaccttggcgccggcacgcggcacgtcgccgtcgagcccgaggtggccaacctcgacatcatcgggcaaagaatcgagaacataaagaacgagcataagtctacgtggcactatgatgaggacaatccgtacaaaacctgggcctaccacggctcatacgaggtgaagccttccggaagcgcatccagcatggtcaacggcgtggtgcggctgctgaccaagccctgggatgtcatccctatggtgacacaaattgccatgaccgacactacccccttcgggcagcagagagtcttcaaagaaaaggtagatacgagaacaccccgcgcgaagagggggacaacccagatcatggaagtgactgccaaatggctctggggcttcctgtctcggaacaagaagccccggatctgcacccgcgaggagttcacccggaaagtccgctcaaacgccgccatcggcgcggtgtttgtcgacgagaaccaatggaacagcgccaaagaggctgtcgaggacgagagattttgggacttggtgcaccgcgagcgggagctccacaagcagggcaagtgcgcgacctgcgtgtataatatgatggggaagagggaaaagaagctgggagagttcgggaaggccaagggctcccgggccatctggtacatgtggctgggtgcccgcttcctcgagttcgaggccctggggtttatgaacgaggaccactggtttagtcgtgagaactccctgagcggcgtggagggggaaggtctccacaagctggggtatatcctgcgcgatatctccaagattccgggcggaaacatgtacgccgacgacacggccggttgggacacccggatcaccgaggacgacctccagaacgaggccaagatcacggatatcatggagcccgagcacgccctgctggccacgagcattttcaagttaacctatcagaacaaggtcgtccgcgtccagcgccccgctaagaacggcaccgtgatggatgtgatctcccggcgcgatcagcgaggcagcggccaggtcggcacctacggactgaacacgttcaccaacatggaggtgcaactgatccgccagatggagtccgaaggaatcttccttccatctgagctggagaccccgaacctggccgaacgggtgctcgactggctggaaaagcacggggccgagaggctgaagcgtatggccatctccggcgatgactgcgtggtcaagcccatcgacgaccgcttcgccaccgcgctcaccgccttaaacgatatggggaaggtgcggaaggacatcccacagtgggagccaagcaagggctggaacgactggcagcaggtcccgttctgctcgcaccacttccaccagctaattatgaaggacggccgggaaattgtggtgccctgtagaaatcaggatgaacttgtcgggcgcgcccgagtgagccagggagcggggtggagtctgcgcgagaccgcctgcctgggtaagagctacgcgcaaatgtggcagctcatgtatttccaccggagagacctgcgactggccgccaacgccatctgctcggcggtgcccgttgactgggtgcccacaagcaggacaacctggagtattcacgcccaccaccaatggatgacaaccgaggatatgctctctgtgtggaatcgggtctggatcgaggagaacccctggatggaggacaagacccacgtgagcagttgggaggaagttccctacctggggaagcgcgaggaccagtggtgcggcagcctgatcggcttaacggcgcgcgccacctgggcgactaatatccaggtcgcgatcaaccaggtgcgacgcctgatcgggaatgagaactacctggactacatgaccagcatgaagcggttcaagaacgaaagtgatcccgagggtgccctctggtga

SEQ ID NO: 23924 - RNA, 9879 nt, synthetic construct
  misc_feature 1..9879: note = derived and/or modified CDS sequence (opt11) from DENV-1__KJ189344__SS-prME
  source 1..9879: mol_type = other RNA
agcgtgacgatgctgctcatgctgctgcccaccgccctcgcctttcacctgactacccggggcggggaaccccacatgatcgtgagcaagcaagaacgcggcaagagcctcctgttcaagacgagcgcgggggtaaacatgtgcaccttaatagctatggacctgggcgaactctgcgaggacacaatgacgtacaagtgcccccagatcacggaggccgaaccggacgacgttgactgctggtgcaatgccaccgacacctgggtaacttatgggacttgcagccagacaggcgagcaccggcgggacaaacgctcggtggccctggccccgcacgtggggctggggttagagacgagaaccgaaacctggatgagctccgagggcgcatggaagcagattcaacgtgtcgagacctgggccctacggcatcccggcttcacggtgaccgccctgttcttagcgcacgctatcggcacgagcatcacccagaagggcatcatctttatccttctgatgctcgtgacgccctctatggctatgcgctgcgtcgggataggcaaccgcgacttcgtggaggggctgagcggcgcaacatgggtggacgtcgtgctggagcacgggtcctgtgtgaccaccatggccaagaacaagcccactctcgacatcgagcttttaaagaccgaggtcaccaatccggcgatactgcgcaagctgtgtatcgaggccaagatcagcaacaccacgaccgacagtcggtgcccaacccagggcgaggccacgctggtggaggagcaggacgcgaatttcgtgtgtcgccggacgttcgtcgaccgcggctgggggaacggatgcggtctctttggcaaagggagcctgctgacctgcgccaagtttaaatgcgtgaccaaactcgagggcaagatcgtgcagtacgagaacctgaagtactccgtcatcgtgaccgtgcacacaggcgaccagcaccaggtcgggaacgagaccaccgagcacggcaccatcgccacgatcacaccccaggctcccaccagcgagatccagctgaccgactacggggccctcactctggactgcagcccccggactggcctggactttaacgaaatggtattgctgaccatgaaggagaaatcctggctggtgcacaagcagtggttcctcgacctgcctctgccctggacctccggggccagcaccagccaggagacgtggaaccggcaggacctcctggtgacttttaagaccgcgcacgcgaaaaagcaggaggtggtcgtgctgggctcccaggagggggcaatgcacaccgccttaacgggtgccaccgagatccaaacctccggtaccacgactatttttgccgggcacctgaagtgccggctgaagatggacaagctcaccctgaaaggtacctcctacgtgatgtgcacggggagcttcaagttggagaaggaggtcgcagagacccagcacggaaccgtactggtgcaggtcaaatacgagggcacggacgccccctgtaaaatccccttttccacgcaggacgagaagggggtgacccagaacggccgcctcatcaccgcaaacccgatcgtgaccgataaggagaagccagtcaatatcgagacagaaccgcccttcggggagagctacattgttgtgggcgcgggcgagaaggccctgaagctgtcttggttcaagaaagggagctccatcggcaagatgtttgaggccaccgcccgcggggcccgccggatggccatcctcggcgacaccgcttgggacttcggtagcatcggaggcgtcttcacctccgtgggcaaattggtgcatcaggtcttcggcacggcctacggggtactgttctctggggtgtcctggaccatgaagatcgggataggcatattactgacctggctgggcctcaactcgcggtccacgagcctgagcatgacgtgcatcgccgtcggaatggtgactctgtacctaggcgtaatggtccaggcagacagtggctgtgtggttaactggaaaggccgcgagctgaagtgcgggtccggcatattcgtaaccaacgaggtgcacacctggaccgagcagtacaagttccaggccgatagcccgaagcggctcagtgcggccatcggcaaggcctgggaggagggggtgtgcggcattcgctccgcgacgcgactcgaaaatataatgtggaagcagatcagcaacgagctgaaccacattctgctagagaacgatatgaagtttaccgtcgtggttggggacgccaatggcatcttagcgcaggggaagaagatgatccgcccgcaaccaatggagcacaagtactcctggaagtcctggggcaaggccaaaattatcggcgccgacatccagaacaccacattcatcatcgacgggcccgatacgccggagtgccccgacaatcagcgtgcatggaacatctgggaggtcgaagactacgggttcgggatcttcaccaccaatatctggttaaagctccgagactcctacacccagatgtgcgatcaccggctgatgagcgcggccatcaaggactctaaggccgtccacgccgacatgggttactggatcgagagcgaaaagaatgagacgtggaagctcgcccgagcgtccttcatcgaagtgaagacctgcacctggcctaagagccacaccctctggtccaacggcgtcctggaatccgagatgatcatccccaagatatacggcggcccgatatcccaacacaactaccggcccgggtacttcacgcagaccgccggaccatggcacctggggaagctcgaattggacttcgacctgtgcgagggcactaccgtggtggtcgatgagcattgcggcaaccgcggtccatcgctccggactaccaccgtgacaggcaagattatccacgaatggtgttgccgctcctgcacgctgccgcctctgcggttccgcggagaagacggctgctggtacgggatggagatcaggcccgtaaaggaaaaagaggagaacttggtgcgcagcatggtgtccgctggctctggcgaggtggatagcttcagcctggggatcctgtgcgtttcgatcatgattgaggaggtgatgcgctcccgctggagccggaagatgctcatgaccggcacgctggccgtgttccttcttcttgtaatggggcagctgacatggaacgacctcatacgtctgtgcatcatggttggtgctaacgcgtccgaccggatggggatgggcacgacgtacctggccctcatggccaccttcaagatgcgcccgatgttcgccgtgggcctgctgttccgccggttaacctcacgtgaggtactgctgttaacgattgggctttccttggtggcttccgtcgagctgccaaactccttagaggagctgggcgacggtctcgcgatgggcatcatgatgctgaagctgctcactgagttccagccccaccagctgtggaccactctgctaagcctgacgttcataaagactacgttgtccctcgactacgcttggaagacgactgcgatggcgctgtccatcgtgtccctgttccccctctgcctgtcaaccacctcccagaagaccacctggctgccggtgctactgggcagctttgggtgcaagcccctgacgatgttcctcatcaccgagaacaagatctggggccggaagtcctggcccctgaacgaggggatcatggcgatcggcattgtaagcattctgctctccagtctattgaagaacgatgtgcccctcgccgggccgctgatcgccggcggcatgctgatcgcctgctacgtgatcagcggctccagcgccgatctctccctggaaaaggcggccgaggttagctgggaacaggaggctgaacactccggcaccagccacaacatcctggtggaggtgcaggacgacgggaccatgaagatcaaggacgaggaacgcgacgacacgctcacaatcctgctgaaggccaccctcttggcggtctccggcgtgtaccccatgagcatcccggcgactctgttcgtgtggtacttctggcaaaagaaaaagcagagatcgggggtcctctgggacacgcccagcccgcccgaagtcgagcgcgccgttctggatgacggcatctaccggatcctgcaacgcggcctgctagggcggtcccaagtaggtgtgggggtgttccaggacggggtcttccacacgatgtggcacgtgacacgcggggccgtgctgatgtaccagggcaagcggttggagccaagctgggcctccgtcaaaaaggatctcatcagctacggcgggggctggcgcttccagggttcctggaacacaggcgaggaggtccaggtgatagccgttgagcccgggaaaaacccgaagaacgtgcagacgacccccggcaccttcaaaacccccgagggcgaggtgggggcgatcgccctggacttcaagcccggcacgtcgggcagtccgatcgtcaaccgggaggggaaaatcgtgggcctgtacgggaacggtgtggtcaccactagcgggacctacgtgtccgccatcgcccaggccaaggcgtcgcaagagggccccctccccgagatcgaggacgaagtgttcaagaagcgcaacttgacaattatggacctgcacccggggtccggaaagacccggcgctacctccccgccatagtccgcgaggccatcaagcgcaagttgcggacattgatcctcgcccccacccgcgtagtggcgagcgagatggccgaggccctgaagggcatgccgattcggtaccagacgaccgcagtcaagagcgagcacaccgggcgggaaatcgtagatttgatgtgccacgctactttcacgatgcgactcctgtccccggtgcgggtccccaactacaatatgataataatggacgaggcgcacttcaccgaccccgcaagcatcgccgcccgcggctatatctcgacccgggtggggatgggcgaggccgcggccatctttatgaccgctacgcctccggggagcgtggaagcgtttccccagtccaacgccgtgatccaggacgaggaacgcgacatccccgaacggagctggaactccggctacgactggataacggacttccccggtaagaccgtttggttcgttccgagcatcaagtccgggaacgacatcgcgaactgcctgcgcaagaacggcaagagagtcatccaactcagccggaaaacgttcgacactgagtatcagaagaccaagaacaacgactgggactacgtggttaccaccgacatctccgagatgggggcgaacttcagagccgaccgcgtcatcgacccacggcgctgcctgaagcccgtgatcctcaaggacgggccggagcgggtgatcctcgccgggcctatgcctgtcaccgtggctagtgccgcgcagagacggggccgcatcgggcggaaccagaataaggagggggaccagtacgtctacatgggccagcccctgaacaacgacgaggaccacgcccattggaccgaggccaagatgctcctcgacaacatcaatacccccgaagggatcatcccagcactgttcgaacccgagcgcgagaagtccgccgccatcgatggcgagtatcgtctgcgcggggaggcccgaaaaaccttcgtggagctcatgcgccgcggcgacctacccgtgtggctgagctacaaggtcgcctcggagggcttccagtatagcgaccgccgctggtgcttcgacggggagcggaacaaccaggtgctcgaggaaaacatggatgtggagatttggaccaaggagggcgagcgcaagaaacttcggccaaggtggctagacgcgcggacgtactccgacccgctcgctctgagagagtttaaagagttcgctgccgggcgccggtctgtcagcggcgacctcatactcgagatcggcaagctgcctcagcaccttactcttcgggcccaaaacgcgctggataacctcgtaatgctccacaactccgaacaaggcgggaaggcctaccgccacgccatggaggagctgcccgacaccatcgagaccctgatgctcctggctctgatcgcggtgttgaccggcggggtaaccctgttcttcctgagcggaaagggtttagggaagacctcaatcggcctactgtgtgttaccgcctcttccgccctcctgtggatggcaagcgtggagccccactggatcgccgcgagtataatcctggagttcttcctcatggtcctgctgatcccggagccggaccgtcagcgcacgccccaagacaatcagctcgcctacgttgtgatcggtctactcttcatgatcctcaccgtcgccgctaacgagatggggttactggagaccaccaagaaggacctcggcatcgggcacgtggccgcggagaaccaccagcacgccaccatgctggatgtagacttgcggccggccagcgcttggaccctctacgcagtcgcgaccaccgtgataacgcccatgatgcgccatacaatcgagaacaccaccgccaacatctccctgacggcgatcgccaaccaggccgcgatcttgatgggcctcgacaaagggtggcccatctcaaagatggacatcggggtgcccctgctggccctcggttgctactcccaagtcaacccactgacccttacagcggccgttctcatgctggtggcccactacgccatcatcggcccaggtctgcaggccaaggccacccgggaggcccagaagcgcacggcggcagggataatgaagaaccccactgtcgacggcatcgtggctatagatttggaccccgtggtctacgacgcaaagttcgagaagcagctgggccagatcatgctgctcatcctgtgcaccagccagatcctgctcatgcgcacaacgtgggccctttgtgaatccatcacgctggctaccgggccgctgaccacgttgtgggagggcagccccggcaagttctggaacaccacaatcgccgtgtccatggccaacatcttcagaggctcatacctggccggcgccgggctcgcgtttagcctaatgaagtccctgggaggagggcgccgggggaccggcgcccagggcgagacgctcggggagaagtggaagcgccagcttaatcagctgagtaagtctgagttcaacacctataagcggtcaggcatcatggaggtggacaggtccgaggccaaggagggcctcaagcggggcgagactaccaagcacgcggtcagcaggggaaccgccaaactacggtggttcgtggagcgtaacctggtgaaacccgaggggaaggtcatcgatctgggctgcgggcggggcggttggagttactactgcgccggcctcaaaaaggtaacggaggtgaagggatacaccaagggcggccccgggcacgaggagccgatacccatggccacctacggctggaacctggtcaagttacacagcgggaaggacgtgttcttcatgccgcccgagaagtgtgacaccctcctgtgcgacatcggcgagtccagcccgaaccccacgatcgaggagggccgaaccctgcgagtactcaagatggtcgagccatggctccgcggcaaccaattctgcatcaagatcctgaacccctacatgccgtccgtggttgaggccctcgagcaaatgcagcggaagcacggagggatgctggtgcgcaaccccctgagtcggaacagcacccacgagatgtactgggttagctgtggcaccggtaacatcgtctcggccgtgaacatgacaagccgcatgctactaaataggtttactatggcgcaccgcaagcccacctacgagcgcgacgtggatttgggcgcgggcacccggcacgtagccgtagaacccgaggtggccaacttggacatcatcgggcagcgcatagagaacatcaagaacgaacacaagtcgacgtggcactatgacgaggacaacccctataagacctgggcctaccacgggagctacgaggtgaaaccctccgggagcgcgtccagcatggtcaacggcgtggtccggctgctgaccaaaccctgggacgttatacccatggttacccagatcgcaatgacggacaccaccccgttcgggcagcagcgcgtcttcaaggagaaggtggacacccggacgccacgcgccaagcggggtaccacacagatcatggaggtcacagccaagtggctctggggcttcctctcccgcaacaagaagcctcggatatgtacacgcgaggagttcacccggaaggtccgcagcaacgccgcgatcggggccgtgttcgtggacgagaaccagtggaacagcgcgaaagaggccgtcgaggacgagagattctgggatctggtgcaccgcgagcgggagctccacaagcagggtaagtgcgcgacctgcgtctacaacatgatggggaagcgcgagaagaagctgggcgagttcgggaaggccaaggggtcccgggccatatggtacatgtggctgggcgcccgcttcttagagttcgaggccctggggtttatgaacgaggaccactggttcagccgggagaactccctgagcggcgttgagggggagggccttcacaagctggggtacatcctacgcgacatctccaagatcccgggcggcaacatgtacgcggacgacaccgccggctgggacacacggatcaccgaggacgacctccagaatgaggccaagataaccgagatcatggagcccgagcatgccctgctggcgacctctatattcaagctgacgtaccagaacaaggtggtgcgcgtccagcgtcccgctaagaacggtacggtgatggacgttatctcccgacgcgaccagcgggggagcggccaggtcggcacctacgggctgaacaccttcacaaacatggaggtgcagcttatccggcagatggagtccgagggcatcttcctccccagcgagctggagaccccgaacctagccgagcgggtccttgactggcttgagaagcacggggccgagcgcctgaagcggatggcgatctccggcgacgactgcgtcgttaagcccatcgacgaccgcttcgctaccgcgctcacggccctgaacgacatgggcaaggtgcggaaggacatcccacagtgggaacccagcaagggctggaacgactggcagcaggtcccgttctgctcccaccacttccatcagctgatcatgaaagacggcagggagatcgtggtgccctgtcggaaccaggacgagctcgtcgggcgcgcccgggtgagccagggcgccgggtggtccctgcgcgagacagcctgcctgggtaagagctacgcccaaatgtggcagctcatgtacttccaccgacgggaccttcggctggcagccaacgctatatgctcggcggtgcccgtcgattgggtgccaacgagccgcaccacctggagcatccacgcgcaccaccagtggatgaccacggaggacatgctctccgtgtggaaccgggtctggatagaggaaaacccgtggatggaggacaagacccacgtgagctcctgggaggaggtgccctacctggggaagagagaggaccagtggtgcggcagcctgatcggcttaacggcccgcgctacctgggccacgaacatccaggtcgcgatcaaccaggtgcggcgcctgatcgggaacgagaattacctggactacatgacctccatgaagcggttcaagaacgagagcgaccccgagggcgccctctggtag

SEQ ID NO: 23925 - RNA, 9879 nt, synthetic construct
  misc_feature 1..9879: note = derived and/or modified CDS sequence (opt11) from DENV-1__KJ189346__SS-prME
  source 1..9879: mol_type = other RNA
tcggtgaccatgctccttatgctgctgcccaccgccctagcctttcacctgaccaccaggggcggcgagccccacatgattgtgagcaaacaagagcgcggcaagagcctcctcttcaaaacctccgccggggtaaacatgtgtactctgatcgcgatggacctgggcgagctctgcgaggacaccatgacatacaagtgtcctcagataaccgaggccgaacccgacgacgtggactgttggtgcaacgccacagacacctgggtgacctacgggacctgcagccagaccggcgagcaccgccgggacaagcgctccgtggcactggcgccgcacgtgggcctggggctcgagacgcggaccgaaacctggatgtctagtgaaggcgcttggaaacagatccagcgcgtcgagacctgggccctacgccatcccgggttcacagtgatcgccctgtttctcgcgcacgcgatcggtacgagcatcacccagaaggggatcatcttcatcctgctgatgctcgtcaccccctccatggccatgcgctgcgtcggcatcggcaacagggactttgtagaggggctgagtggcgccacttgggtggacgtcgttctagagcacggatcctgtgttaccaccatggccaagaacaagccgaccctcgacatcgagctgctgaagacggaggtcaccaaccccgccatcttacgtaagctgtgcatcgaggcgaagatcagcaacaccaccacggatagtcggtgcccgacccagggtgaagcaacgctggtcgaggagcaggacgccaacttcgtgtgccgacggaccttcgtcgaccgcggctggggtaacggatgcggtctcttcgggaagggtagcctgctgacgtgcgctaagttcaagtgtgtgaccaagttggagggaaaaatcgtccaatacgagaacctgaagtattccgtcatcgttaccgttcatactggcgatcagcaccaagtgggaaacgagacaacggagcacggcacgatcgcgaccatcacgccccaggcgccaacaagcgagatccagctgaccgattatggggccctcacactggactgcagcccccggaccggtctcgacttcaacgagatggttctcctaaccatgaaagaaaagtcgtggttggtgcacaagcagtggtttctcgacctgccgttgccctggacctccggggccagcaccagccaggaaacctggaaccgccaggacttgcttgtgacgtttaagaccgctcacgctaaaaagcaggaggtggtcgtgctgggctcccaggaaggcgcgatgcacactgccttaacgggggctacggagatccagatgagcggcaccaccacgatcttcgccggacatctgaagtgccggctgaaaatggataagctcaccctgaaggggacctcctacgtcatgtgtaccgggagctttaagctggagaaggaggtcgcagaaacccagcacggtacggtgctggtgcaagtcaagtacgagggcactgacgccccatgcaagatccccttcagtacccaggacgagaagggggtcacacagaacggccgcctcatcacagccaatccaatcgtgaccgacaaagaaaagcccgtcaatatcgagaccgagccgccctttggggaaagctacatcgtcgtgggggccggcgagaaggcgctgaagctctcatggtttaagaagggtagctccatcggtaagatgttcgaggccacagcccgaggtgcgcgccggatggcgatcctcggcgacacagcgtgggacttcgggagcatcggtggcgtattcacctccgtggggaagcttgtgcaccaggtcttcggcactgcttatggggtactgttcagcggggtttcctggactatgaagataggtatcgggatcctcttaacgtggctgggcttaaacagcaggtctacgtcgctcagtatgacctgcatcgccgtcggaatggtgaccctgtacctcggcgtgatggtccaggccgactcaggctgcgtgatcaactggaagggccgcgagctaaagtgcggaagcggtatctttgtgacgaacgaggtccacacctggaccgaacaatacaagttccaggctgacagcccgaagcgattgagcgcggccataggcaaggcctgggaggagggcgtgtgcggcatccgctccgccacccggctcgaaaacatcatgtggaagcagatctctaacgagctgaaccacatcctgctcgaaaatgacatgaagttcaccgtggtcgtgggtgacgccaacggcatcctggcgcaggggaagaagatgatacgcccccagcccatggagcacaaatactcttggaagtcgtggggcaaggccaagatcatcggcgccgatatccagaacactaccttcataatcgacgggcccgacacccctgagtgccccgacaaccagagggcatggaacatatgggaggttgaggactacggcttcgggatcttcacaacgaatatctggctaaagttgcgcgactcctacacccagatgtgcgaccatcggctgatgagtgcggccatcaaggattccaaggccgtccacgccgacatgggttattggatcgagagcgagaagaacgaaacctggaaactggcccgcgctagtttcatcgaggtgaagacctgtacctggcccaagagccacaccctctggtccaatggcgtgatggagagcgagatgatcatccccaagatctacgggggcccgatcagccagcacaactacaggcccgggtatttcacccagactgccggcccctggcacctggggaagctggagttggatttcgacttatgcgagggcacgaccgtcgtggtggatgagcactgcggcaaccgcggaccaagtctgcggaccacaaccgtcacgggcaagatcatacacgagtggtgttgccgctcctgcaccctgccgcccctacggtttcgaggggaggacgggtgctggtacgggatggagatccggcccgtaaaggagaaggaggaaaacctcgtgaggtcaatggtctccgccggaagcggcgaggtggacagcttttccctcgggatcctctgcgccagcattatgatagaggaagttatgcggtctcgatggagccgcaagatgctgatgaccggcacgctcgctgtgttcctgctactcgtcatgggacagctgacctggaacgacctgatcagattgtgcattatggtgggcgcgaacgcctccgaccgtatggggatggggacgacctacctggcgctgatggcaacgttcaagatgaggccgatgtttgccgtcgggctcctatttcgccggctgacgagccgcgaggtgctcctgctgaccatcggactctccctggtggcgagtgtcgagctgcctaacagtctagaagagttgggggacgggctcgccatgggaatcatgatgctcaagctactgaccgagttccagccccaccaactctggacgaccttactgagcctcacctttatcaagaccacgctgtccctggactacgcctggaaaacaaccgccatggccctctcgatcgtgtccctattccccctgtgcctcagcaccacatcccagaagactacttggctgccggtactgctcggctcctttgggtgcaagcccctgaccatgttcctgatcaccgagaacaagatatggggccgcaaatcctggcccctcaacgaggggattatggccatcgggatcgtgagcatactgctgtcctcactcttgaagaacgacgtgcccctggccgggccactcatcgctggaggcatgctgatcgcttgctacgtcattagcggctcctccgcggacctgagcctcgagaaggccgccgaggttagctgggagcaggaggccgagcacagcggcacctcccacaacatcctggtagaggtccaggatgacgggaccatgaagataaaggacgaggagcgcgacgacactctgaccatcctcctgaaggccacgcttctcgccgtgtccggcgtgtaccctatgagcatacctgcaaccctgttcctgtggtacttctggcagaagaagaaacagagatcaggggtactctgggacaccccctcgccgcccgaagttgaaagagccgtgttagatgacggtatctatcgcatcttacagcgcggcctgctcggtcgctctcaggtcggagtgggggtgttccaagacggcgtcttccataccatgtggcacgtgacccgcggggcagtgttgatgtatcagggcaagcggctagagccaagctgggcctccgtcaagaaggaccttatcagctacggtgggggctggagattccaagggtcctggaataccggcgaggaagtgcaagtgatcgcggtcgagcccgggaaaaaccctaaaaacgtgcagaccacgcccggcacgttcaagacccccgagggtgaggtgggggccatcgctctggacttcaagcccggcaccagcgggtccccgatcgtgaaccgggaggggaagatcgtggggctgtatgggaacggggtggttaccacgagcgggacctacgtatccgccatcgcacaggcgaaggccagccaggaggggcccttaccagagatcgaggacgaagtgttcaagaagcgaaacctgaccatcatggacctgcacccagggagcggcaagacacgtcgctacctcccagccatcgtccgggaggcaatcaagcgcaagctgcggacgctgatcctcgcgcccacccgcgtggttgcctccgagatggccgaggcccttaaaggaatgccaatacgctaccagaccaccgccgtcaagagcgaacacacggggcgggaaatcgtggacctgatgtgccacgcgacgttcacgatgcgccttctgagtccggtacgagtccccaactacaatatgatcataatggatgaggcacacttcacagaccccgcctcgattgccgcccgcggctacatctccacacgggtggggatgggtgaggccgctgcgatcttcatgaccgccacgcctcctggcagcgtggaggcctttccccagtccaacgcggtcattcaggacgaggagcgcgacatccccgagcggagctggaactccggctacgattggatcaccgacttccccggcaagacggtatggttcgtgccctcaatcaagtccgggaacgacatcgccaactgcctgcgcaagaatggtaagagagtcatccagctctcccgtaagacatttgataccgagtaccagaagacgaagaacaacgactgggactacgtggtgacgaccgatatctccgagatgggggcgaactttcgggccgaccgcgtcatcgacccccggcggtgcctgaagcctgtgatcctgaaggacggccccgagcgggtgatcctcgcggggccgatgcccgtcaccgttgccagcgcggcccagagaaggggacgaataggccggaaccagaacaaggagggggaccagtatgtttacatgggccagcccctgaacaatgacgaggatcacgctcactggaccgaggcgaagatgttgctcgataacataaatactcccgagggtattatccctgcgctgttcgagcctgagcgcgagaagagcgccgcgatcgacggcgagtaccgcctgcggggggaggcccgcaagaccttcgtcgaactcatgcggcgtggcgacctaccagtgtggctgagctacaaggtcgcgtccgagggttttcagtactcagaccggcgctggtgtttcgacggggaacggaataatcaggtgctcgaggaaaatatggacgtggagatatggaccaaggagggcgagcgcaagaagctgcggcccagatggctggatgcccggacgtactccgacccgctcgccctgcgcgagttcaaggaattcgccgccgggcggcgctcggtcagcggcgatctgatcctcgagatcggcaagctcccccagcacctgacctccagggcacagaacgccctcgacaatctggttatgctgcacaatagcgagcagggggggaaggcctaccgccacgccatggaagagctcccagacacgatcgagacactgatgttgctcgcgcttatagccgtgctgaccgggggggtcaccctgttcttcctgtcggggaagggacttggtaagacgtcaatcggattactgtgcgtcaccgcctccagcgccttattgtggatggcctccgtggagccacactggatcgccgcaagtatcatactggagtttttcctgatggtcttgctgattccggagcccgacagacagcgtaccccccaggataatcaactggcgtacgtggtgatcggcctcctgttcatgatcctgaccgtcgctgccaacgaaatggggctactggagacgactaagaaggaccttggcatcgggcatgttgcggccgagaaccaccagcatgccaccatgcttgacgtggatctgcggccggcctccgcctggacgctgtacgcggtcgccacgaccgtgatcacccccatgatgcgccacactatcgagaacacaaccgccaacattagcctcaccgcaatagccaatcaggcggccatcttaatgggcctggataagggctggccaatctccaagatggacatcggggtcccactcctggccctgggctgttacagccaggtgaacccactcacgctaacggccgcggtactcatgctcgtcgcccattacgccataattgggcccggattgcaagcaaaagccacccgggaggcgcagaaacgcaccgcggccgggatcatgaagaaccccaccgtcgacggcatcgtggccatagacctggaccccgtggtctacgatgccaagttcgagaagcagctcgggcagattatgctgctgattctctgtacctcccagatcctgttaatgcgtactacctgggcgctctgtgagagcatcaccctggccacggggccgctgaccaccctctgggagggaagtcccgggaagttctggaacacgacgattgccgtgtctatggccaacatctttcggggctcgtacctggccggcgccggcctggcatttagcctgatgaagtccctgggcggcggccgaagaggaaccggcgcccaaggcgagacgctgggcgaaaagtggaagcggcaactcaaccagttatctaagagcgagttcaacacatataagcgatccggcatcatggaggtggaccgctcggaggccaaggaagggctgaagcggggagaaacgaccaagcacgcggtttcaagggggactgccaagctccgctggttcgtagagcgcaacctggtgaagccagaaggcaaggtcatagaccttggctgtgggcggggcggttggagctactactgtgcaggccttaagaaggttaccgaggtgaaggggtatacaaagggcggccctggccatgaggagccgatccccatggcgacctacggctggaaccttgccaaactgcactccgggaaggacgtcttcttcatgccacccgagaaatgtgatactctgctctgcgacatcggcgagtcctcaccgaatcctaccatcgaggaagggaggaccctgcgggttttgaagatggtggagccgtggttgcgaggcaaccagttctgcatcaaaatcctgaacccatatatgccgagcgtcgtggagactctggagcagatgcagcggaaacacggcgggatgttagtgcgcaaccccctgtcccggaacagtacccacgagatgtactgggtttcgtgcggcacggggaacattgtgagcgcagtgaatatgacctcccgcatgcttctaaacaggtttactaccgcacacaggaagcccacctacgagcgcgacgtcgacctgggcgccgggacccgacacgtagccgtggagcccgaggtcgccaatttagacatcatcggccagagaatcgagaacatcaagaacgagcacaaaagcacttggcactacgatgaggataatccatacaaaacctgggcgtaccacggctcctacgaggtgaagccctctgggtcggcgagctccatggtaaacggagtggtgcggctcctgaccaagccctgggacgtgatccccatggtcacccagatcgccatgacggacaccaccccgttcggccagcagagggtgtttaaggagaaggttgacacacggacgccgagggccaagcggggcacaacacagatcatggaagtgaccgccaagtggctctggggcttcctcagccgaaacaagaaacccaggatctgcacccgcgaggagttcacacggaaggtgagaagcaacgcggccatcggtgccgtattcgtggatgaaaaccagtggaactccgcaaaggaggcggtggaggacgagcggttctgggacctggtccaccgggagcgggagctgcacaagcagggcaaatgcgcgacctgcgtgtacaacatgatggggaagcgcgagaagaagctaggcgagttcgggaaagccaagggcagccgggccatatggtacatgtggctcggagcccgcttcttagagttcgaagcgctcgggtttatgaacgaagaccactggttttctcgagagaacagtctgtcaggcgtggagggggagggcctacataagctcgggtacatattgcgcgacataagcaagatcccgggaggcaacatgtacgcagacgacacggccgggtgggacacgcgaataaccgaggacgatctgcagaacgaagcaaaaatcaccgaaatcatggagcctgaacacgccctcctggcaacgtccattttcaagctgacataccagaacaaagtcgtgcgcgtacagagacccgcaaagaacggcaccgttatggatgtgatcagtcgtcgcgaccagcgggggtccggtcaggtgggcacctacgggctcaacaccttcactaacatggaagtccagctgattcgccagatggagagcgagggcatctttctgccctccgaattagagacccccaacttagccgagcgggtgcttgactggctcgagaagcacggggccgaacgcttaaagaggatggccatcagcggcgacgactgcgtggttaagcccattgatgaccgatttgcgaccgcattgaccgcactcaacgacatggggaaggtgcggaaggacatcttgcagtgggagccgagcaagggctggaacgactggcagcaggtccccttctgcagccaccacttccatcagctaatcatgaaggacggccgcgagatcgtcgtcccgtgtaggaaccaggatgagctcgtaggaagagcccgggtctcccagggggccgggtggagcctgagagaaacagcgtgcctgggcaagtcctacgcccaaatgtggcagctcatgtacttccaccggagagacctgcggctagccgcaaacgcgatctgcagcgccgttcccgtggactgggtccccacctcccgcacaacctggtccatacacgcacaccaccagtggatgaccaccgaggacatgttgtccgtgtggaaccgggtgtggattgaagagaatccctggatggaggacaagacgcacgtgtccagctgggaggaggtcccgtacctggggaagcgtgaagatcaatggtgcggaagcctcatcggcctcacggctcgcgccacgtgggcgacgaacatccaagttgccatcaaccaggtccggcgcctgatcgggaacgagaactacctggactatatgaccagcatgaagcggttcaaaaacgaatccgacccagagggggccttatggtga

SEQ ID NO: 23926 - RNA, 9879 nt, synthetic construct
  misc_feature 1..9879: note = derived and/or modified CDS sequence (opt11) from DENV-1__KJ189347__SS-prME
  source 1..9879: mol_type = other RNA
agcgtgaccatgctgctcatgctgctgcccaccgccctcgcctttcacctgaccactcggggcggggagccccacatgatcgtgagcaagcaagagcggggcaagagcctcttgttcaagacctcggccggagtgaatatgtgcaccctgatcgccatggacctgggagagctctgtgaggacacaatgacctacaagtgtccccagatcaccgaggccgagcccgacgacgtggactgctggtgcaatgctaccgacacgtgggtaacctacggaacctgcagccagaccggcgaacaccggcgcgacaagcgctctgtggccctcgccccccacgtcggcctggggctcgagacaagaaccgaaacctggatgagcagcgagggcgcctggaagcaaatccagcgcgtagaaacctgggccctgcggcaccccgggttcacggtgatagccctgttcctcgctcacgccatcggcaccagcattacccaaaaggggatcatctttatcctgctgatgctcgtaaccccctccatggccatgcgctgtgtcggtatcggcaaccgggacttcgtggaggggctgagtggcgccacgtgggtagacgtcgtgttagagcacgggtcctgcgtgaccaccatggccaagaacaagcccaccctcgacatcgagctgttgaagaccgaggtcaccaaccccgcgattctcagaaagttatgcattgaagccaagatatcaaacaccaccacggactcccggtgcccgacccagggcgaggccaccctcgtggaggagcaggacgccaactttgtgtgccgccggacattcgtcgacaggggatggggaaacggctgcggtctcttcggcaaggggagcctcctgacgtgcgcgaagttcaagtgcgtgaccaagctcgaggggaagatagtgcagtacgagaacctgaaatacagtgtcatcgtgacggtgcacaccggcgatcagcaccaggtcgggaacgaaacgaccgagcacggtaccatcgctaccatcacgccccaggccccgactagcgagatccagctcaccgactacggggccctcaccctggactgtagcccccggaccggcctggacttcaacgaaatggtcctcctgacgatgaaggagaaatcctggctggttcacaagcaatggttcctcgatttgccgctgccatggaccagtggggctagcacaagccaggagacctggaaccgccaagacctcctggtgacgtttaagaccgctcacgctaagaagcaggaggtggtggtgctgggctcccaagaaggcgccatgcacacagccctcaccggcgccactgagatccagacctctggcaccaccaccatcttcgctgggcacctgaagtgcaggctgaagatggataaactcaccctcaagggcacctcttacgtcatgtgcaccgggccgttcaagctagagaaggaggtcgcggagacgcagcacggcaccgtgctggtgcaggtcaagtatgagggcaccgacgccccctgcaagattcccttcctcactcaggacgagaagggggtgacgcagaacggccggttaattaccgccaaccccatcgtgaccgacaaggagaagcctgttaacatagaaaccgagcccccgtttggtgagagctatatcgtggttggcgccggcgagaaggcgctgaagctgtcctggttcaaaaaggggagctccataggcaagatgtttgaagccacggcacgcggtgcccgccggatggccatcctgggcgacaccgcctgggatttcggcagcatcggcggcgtcttcacctcagtaggaaagctggtgcaccaggtcttcggcaccgcctacggggtgctgttctcgggcgtgtcctggacgatgaagatcggtatcggcatcctgctgacctggttgggcctgaactcacgatccaccagcttgtccatgacctgcatcgccgtcggtatggtaacgctctacctgggtgttatggtccaggccgacagtggctgcgtgatcaattggaagggccgggagctgaagtgcgggtccggcatcttcgtaaccaacgaggtccacacctggaccgagcagtacaagttccaggccgacagcccgaagcggctcagtgcagccatcggcaaggcctgggaggagggggtgtgcggcatccggagcgccacacggctggagaacatcatgtggaagcagatcagcaacgagctgaaccacatcctcctggagaacgacatgaagttcaccgtggtcgtgggggacgctaatggaatactcgcgcagggtaagaagatgatccgaccccagcccatggagcataagtactcctggaaatcctggggaaaggccaagataatcggcgcagatatccagaatacaaccttcatcatcgatgggccggacacccctgagtgcccagataaccagcgagcctggaacatctgggaggtggaggactacggctttgggatcttcacgaccaatatttggctcaagctgcgtgattcatacacccagatgtgcgaccaccggctgatgagcgcggccataaaggactccaaggccgtccatgccgacatgggctactggatcgagtcagagaagaacgagacctggaagctggcccgcgcgagtttcatcgaggttaagacgtgcacctggcccaagagtcacaccctatggtccaacggcgtcctggaaagcgagatgatcattcccaagatctatgggggtcccatctcccagcacaactaccggcccgggtactttacccagaccgcgggcccatggcacctcggtaagctggagctggacttcgacctctgcgaaggaaccactgtcgttgtggacgagcactgcggcaaccgcgggccatctctgcgcaccaccacggtcaccggcaaaatcatccacgaatggtgctgccggagttgcaccctgccgcctctccggtttcgcggagaggacggctgctggtacgggatggagatccggcccgtgaaggagaaagaggagaacctagtgcgcagcatggtctccgccggcagcggcgaggtggattcgtttagcctggggattctctgcgtgagcatcatgatcgaggaggtcatgcggtcacgctggagccggaagatgctgatgacgggcaccttagccgtgttcctcctgctggtgatggggcagttgacctggaacgatctgatccgactgtgcataatggtcggcgcaaacgcgtcagaccgcatggggatgggcacgacgtacctcgccctgatggccaccttcaagatgcggcctatgttcgccgtgggtctcctattcagacggctgacgagccgtgaggtgcttctcctgaccatcgggctgtccttaatggcgagcgtcgagctgcccaactccctcgaggagctcggcgacgggctggcgatgggcatcatgatgctaaagctcttaactgagttccagccccaccagctgtggaccacccttcttagcctgacgtttatcaagactaccctcagtctggactacgcctggaagaccaccgccatggccctgagcatcgtgtccctcttcccgctgtgccttagcaccacctctcagaagaccacatggctccccgtcctgcttggctcttttgggtgcaaacccctcactatgttcctaatcacggagaacaagatctggggacggaagtcgtggcccctgaacgaagggatcatggcgattggaatcgtttcgatcctcctgtccagcctgctaaagaacgacgtgccgctggccgggccactcatcgcgggcggcatgctcatcgcgtgctacgttatctccgggagctccgccgatctgtccctggagaaggcggccgaggtgagctgggagcaggaggccgagcactccggcaccagtcataacatcctagtggaggtccaagacgacgggaccatgaagatcaaggatgaagagagagacgatactctgacgatcctgttaaaagctaccctgctggctgtgtccggcgtataccccatgagcatccccgcgaccctcttcgtctggtacttctggcagaagaagaagcagcggtccggggtgctgtgggacacaccgtccccgcccgaggttgagcgcgccgtccttgacgacggaatctaccgcatcctacagcgcggcctcttagggcgctcacaggtgggcgtgggggtctttcaggacggcgtcttccacacgatgtggcacgtgacccgcggggccgtcctgatgtaccagggcaagaggctcgagccctcatgggctagtgtgaagaaggatttaatcagctacggagggggctggcgcttccagggttcctggaacaccggcgaggaggtgcaggtcatcgccgtggagcccggcaagaaccccaagaacgtacagaccacgcccggcaccttcaagacccctgagggcgaggtcggagcgatcgccctggatttcaagccgggcactagcgggagtcccatcgtgaaccgggagggcaagatcgttggattatacgggaatggcgtcgtgaccaccagcgggacttatgtgagcgccattgctcaggcgaaggcgtctcaggagggccccctgccagagatcgaggacgaggtcttcaagaagcgcaatctgaccataatggatctccaccccggctccgggaagacgcggcgctacctacccgctatcgttcgggaggcgatcaaacgcaagctgcggaccctcatcctggcccccactcgcgtggttgctagcgagatggccgaggccctgaagggcatgccgatccgataccagaccactgccgtcaagagcgagcacacggggcgcgagatcgtggacctcatgtgccacgccacctttaccatgcgcctgctgtcccccgtccgggttcccaattacaacatgattatcatggacgaggcgcacttcacggaccccgcgagcatcgccgcccgcggctacatctccacccgggtggggatgggcgaggccgcagccatattcatgaccgccaccccgcccgggagcgtcgaggccttcccccagtcaaacgcagtgatacaggacgaggagcgcgacatccctgagcgcagctggaacagcggctatgattggatcacggacttcccgggcaagacggtgtggttcgtacccagcatcaagtccgggaacgacatcgcgaactgcctccgcaagaacggcaagcgggtgatccagctgagccgcaagacttttgacaccgagtaccaaaagacgaagaataacgattgggactacgtggttaccaccgacatctccgagatgggggccaactttcgagccgaccgggtcatagacccccggcgatgcctgaagccagtgatcctcaaggatggaccggagcgggtgatcctggccggaccgatgcccgtgaccgtcgcgagcgccgcccaaagacgcggtcgcatcgggcgcaaccagaataaggagggggaccagtacgtctacatgggccaacctctgaacaacgatgaggatcatgcccactggacggaggccaagatgctcctggacaacatcaacaccccggaggggatcatccctgcgctgtttgagcccgagcgcgagaagtcggccgccatcgacggcgaataccgactccgcggggaggcccgcaaaactttcgttgagctaatgcggcgcggcgacctgcccgtctggttatcgtacaaagttgcctccgagggcttccagtacagcgaccgcaggtggtgcttcgacggggagcggaacaaccaggtgctggaggagaacatggacgttgagatctggaccaaagagggcgagcgtaagaagctgcggccgcgctggttggacgctcggacctactctgatcccctggccctgcgggagttcaaggagtttgcagcggggcggagatcggtgtccggcgacctcatcctggagatcggcaagctgccccagcacctcacgctgcgggcccagaacgcgctggataacctcgtgatgctacacaacagcgagcagggcgggaaggcctatcgccacgcaatggaggagctcccagacaccatcgagaccctcatgctgctggccctcatcgcggtcctgaccgggggcgtgacgctgtttttcctctcggggaagggcctcggcaagacctccattggactgctctgcgtaacagcctcatccgccctcctgtggatggccagcgtcgagccgcactggatcgccgcgtccattattctggagttcttcctgatggttttgctcatccccgagcccgatcggcagcgaaccccgcaggacaaccagctagcctatgtcgtcatcgggctcctctttatgatcctaacggtggccgccaacgagatggggttgctcgagaccacaaagaaggatttaggcatcgggcacgtggccgcggaaaaccaccaacacgccactatgctggacgtggacctccggcccgctagcgcctggactctgtacgccgtggcgacaaccgtgatcacccccatgatgcgtcacacgatcgagaataccaccgccaacatcagtctgaccgccattgccaaccaggctgcgatcctcatgggcttggacaagggctggcccattagcaagatggacatcggcgtcccattgctcgccctgggctgctactcccaagtgaaccccctgacgctcacggccgctgtgctgatgctggttgcgcactacgcaatcattgggcccggcctccaagccaaggccacgcgggaggcccaaaagcgtaccgcggccgggatcatgaagaaccctacggtagacggcatcgtggccattgacctggacccggtagtttacgacgccaagttcgagaagcagctggggcagatcatgctcctgatcctgtgcaccagccagatcctcctgatgcgcaccacgtgggctctgtgcgagtccatcacccttgcgaccgggccgctgacaaccctgtgggaaggtagccccgggaagttctggaacacaaccatcgccgtgtccatggccaatatcttccgcggcagctacctcgcgggcgcagggttggcgttctccctaatgaagagcctcggcgggggccgtcgaggtaccggcgcccagggcgagaccctgggggagaagtggaaacgccagctgaaccagctcagcaagagcgagttcaacacatacaagcggtcaggcatcatggaagtggaccgcagcgaggccaaggagggacttaagaggggcgagaccaccaagcacgccgtgagccgcggcactgcgaagctgcggtggttcgtggagcgcaacctggtcaagcctgagggcaaggtaatagacctcggctgcgggcggggcggctggtcctactactgcgccggcctgaagaaagttacggaggtgaaggggtacacgaaaggtgggccggggcacgaggagcccatccccatggccacctatggctggaatctcgtgaagctccacagcgggaaggacgtgttcttcatgcccccggagaaatgcgataccctgctgtgcgatatcggcgagtccagccccaaccccactatcgaagaagggcgcacactccgtgtgctgaaaatggtggagccctggctacgcggtaaccagttctgcattaaaattctcaacccgtacatgccctccgtggtcgagaccctggagcaaatgcagcgaaagcacggcggtatgttagtgcgcaaccctttgagccggaactccacacacgagatgtactgggtaagctgcggaaccgggaacatcgtctcagccgtgaacatgacaagccgcatgctcctgaaccggtttactatggcccaccgaaagcccacctacgagcgtgatgtggacctcggcgcggggacacgacacgtcgcagtcgagccggaggttgccaacctggatatcatcggtcagcgcatcgagaacatcaagaacgagcacaagtccacgtggcactacgacgaggacaacccctataagacgtgggcctatcacggcagctacgaggtcagaccctccggaagcgcctccagcatggtgaacggggtggtccgactgctcaccaagccctgggacgtgatcccgatggtcacccagattgcgatgacggacacaacccccttcggacagcagagggtattcaaagagaaggtggacacccgcacgccccgggctaagaggggaacaacccagatcatggaggtcaccgccaaatggctgtggggctttctgtcccggaacaagaagccgcgcatatgcacgcgggaagagttcacccgcaaggtgcggagcaacgcagccatcggggccgtgttcgtcgacgagaaccagtggaactccgcaaaggaggccgtggaagacgagcggttctgggatctcgtgcaccgcgagcgcgagctgcacaagcaaggccggtgcgcgacctgcgtttataatatgatgggaaagcgcgaaaagaagctgggcgagttcgggaaggctaaggggagccgggccatctggtacatgtggctcggcgctcgctttctcgagttcgaggcactggggttcatgaatgaggaccattggtttagccgggagaactccctcagcggcgtggaaggggagggactgcacaagctggggtacatcctccgcgacatctccaagattcccggagggaacatgtacgccgacgacaccgcgggatgggacacgcggattaccgaggacgacctgcagaacgaggccaagatcaccgagatcatggaacccgaacacgccctgctcgccaccagcatcttcaagctgacgtaccagaataaggtcgtccgagtgcagagacccgccaagaatggcaccgtgatggacgtcatctcccggcgcgaccagcgcgggagcggccaggtgggcacctacgggctgaacaccttcacgaacatggaagtgcagcttatccgccagatggagtccgagggcatcttcctgccgagcgagttagagacccccaacctcgcggagcgggtcctggactggctggagaagcacggggccgaacgccttaagcgtatggccatctccggagacgactgcgtggtgaagcccatcgacgaccgcttcgctaccgcactgaccgcactgaacgacatggggaaagttcggaaggacatccctcagtgggagccgagcaagggctggaacgattggcagcaggtccccttctgctcacaccacttccaccaactcatcatgaaggacggtcgcgaaatagtcgtcccctgccggaaccaggacgagctcgtggggcgcgcccgggtgagccagggcgccggttggtccctaagagagacggcctgcctcggcaaaagctacgcccagatgtggcagttaatgtacttccaccggcgcgacctgagactcgcggccaacgccatctgctccgcagtccccgtggactgggtgccgacgagccgcacaacctggtccatccacgcgcaccaccagtggatgaccactgaggacatgctgagcgtctggaaccgagtgtggatcgaggagaacccttggatggaggacaagacccacgttagctcctgggaggaggtcccctacctggggaagcgagaggaccagtggtgcgggagcttgatcggcctgaccgcccgggccacttgggcgaccaacatccaggtggccataaaccaggtgcgccgcctgatcgggaacgagaactacctggattacatgacatctatgaaacggttcaagaacgagtccgaccccgagggcgcgctgtggtag

SEQ ID NO: 23927 - RNA, 9879 nt, synthetic construct
  misc_feature 1..9879: note = derived and/or modified CDS sequence (opt11) from DENV-1__KJ189348__SS-prME
  source 1..9879: mol_type = other RNA
tcagtaacaatgctattaatgctcttacccacggctctagccttccatttgaccacgagagggggagaaccccacatgatagtgagtaaacatgaacgcgggaaatcccttctgttcaaaacaagcgcgggggtaaatatgtgtacgctgatagccatggacctcggcgaactttgcgaggacaccatgacatacaagtgcccgaggataacagaagcggaacccgacgacgtcgactgttggtgtaacgccacagatacttgggtaacctatgggacgtgctcgcaaaccggtgagcaccgccgggacaagagatccgttgctctagcaccccacgtcggactaggactcgaaaccagaaccgaaacctggatgagcagcgagggtgcgtggaaacaaatacaaagagtagagacttgggcacttaggcaccccggattcactgtcatagctctcttcttggcacatgccataggcacatccatcacccaaaagggaataatattcatcctgctcatgctggtaacaccatctatggcgatgcgatgtgtcggtataggcaatcgagattttgtcgaggggctatcaggagcaacctgggtggacgtagtacttgaacacggttcctgtgtaactactatggccaagaacaagccaaccctagatatcgaactactcaaaacagaggttactaacccagcagtcctacggaaactgtgcattgaggccaagataagcaacacaaccactgatagtcgctgccccacccagggcgaggcaaccttagttgaagaacaagacgcaaatttcgtatgccgacggacctttgtcgacagaggatggggaaacgggtgcggacttttcggcaaaggttcgctgttaacctgcgccaagttcaaatgtgtaacgaaactggaggggaaaatcgtgcaatacgaaaacctaaagtacagtgtcatagtcacggtacacaccggtgaccagcaccaggtaggcaacgagacgaccgaacacgggaccatcgccaccatcacaccacaagccccgacatcagaaatccagcttacagactacggggcactgaccctagattgctcaccaagaacaggcttagacttcaacgaaatggtgctcctcacaatgaaagagaaaagctggctcgtacataaacaatggttcctggacctccccctgccctggacgtccggcgcaagcacctctcaggaaacgtggaacaggcaagacctcttagtcaccttcaagactgcacatgccaagaaacaggaagtggtagtactgggaagccaagaaggtgccatgcacacagcactaacaggagcaacggagatccagacgtcaggaacgaccactatattcgctgggcacctaaagtgtcggctgaagatggataagctcaccctgaaaggaaccagttacgtaatgtgtacaggctcctttaaacttgaaaaagaagtcgcggagacccagcatggaaccgtgctagtccaagtgaaatacgaaggcacggacgctccgtgcaagattcccttcagcacacaggatgaaaaaggcgtaacacaaaacggacgattaatcaccgcaaatccgatcgttacggataaggaaaagccagtaaatatcgagacggagccgccattcggcgaaagctacatagtagtaggcgcgggagaaaaggcactcaaactatcctggtttaagaaaggatccagcataggaaaaatgttcgaagcaacggcgcgcggagccagacgcatggcaatcttgggggacacggcgtgggatttcggatcaatcggaggggtattcacttcagtaggcaagttagttcaccaagtgtttggtacagcatatggtgtgcttttctccggggtgagctggaccatgaaaattggcatcgggatacttctaacgtggctcggcctaaacagtcgcagcacctcattcagcatgacctgcattgccgtcgggatggtaaccctgtacttgggagtaatggtccaggcggatagcggatgcgtcataaactggaagggtagagagctaaaatgcggaagcggcatctttgttaccaacgaggtgcacacttggaccgagcagtacaagtttcaagccgactcaccaaaaagactcagcgcggccattggcaaagcgtgggaggagggagtttgcggaatccgcagcgcaaccagactggaaaatataatgtggaagcaaatatctaacgagctaaatcacatactgctcgaaaatgacatgaaattcacagtagtcgtaggtgacgcgaacgggatcttagcccaaggcaagaaaatgatacgaccccaacccatggaacacaaatactcatggaaatcctgggggaaagcgaaaatcataggcgccgacatacaaaacacaacgttcataattgacggaccggatacaccggaatgtcctgacgatcagcgggcgtggaatatatgggaggtcgaggactacggattcggtattttcacaacaaacatatggctcaaactacgggatagttacacccagatgtgcgaccacagactaatgtcagcagccatcaaagactcgaaggcggtccacgcggacatgggttactggatcgagtcagagaagaacgaaacttggaagctggcgagggccagcttcatagaagtgaaaacctgcacctggccaaagagccataccctttggagtaatggagtgctagagtccgaaatgataattccgaagatctacggagggcccatctcacaacacaactacaggcccggttatttcacccaaacagcggggccctggcatctcggtaagctggaactagatttcgacctatgcgagggaaccacggtggttgtggacgagcactgcggcaacagggggccctcgcttcggacgaccacagtcactgggaaaataatacatgagtggtgctgtagatcatgcaccctgcccccattacgcttccgaggggaagacggatgttggtacgggatggaaatcaggcccgtcaaagaaaaagaggaaaacctcgtgagaagcatggtgagcgcaggatccggcgaagtagacagcttcagtctagggatattatgcgtgagcataatgatcgaagaggtcatgagatcgagatggagccgcaaaatgctcatgaccggcacactcgccgtcttcctcctactaataatgggccaactcacatggaacgacttgatcagactatgtatcatggtaggagccaacgcctcagaccgcatgggaatgggaacgacgtacctagcactgatggcaacattcaaaatgagacccatgttcgccgtaggcatcttattcaggcgattaacgtcacgagaggtcttactgttaacgataggcttaagcctagtcgcatctgtggaactgccaaactcgctcgaggaattaggggacggcctagcgatgggcatcatgatgttaaaactcttaactgagttccaaccgcaccagctctggacaaccctcctatctctcacgttcataaaaacaactctaagcctggactacgcctggaaaacaacagccatggcgctgagtatcgtatcgctctttccgctatgccttagtacaacctcccaaaagaccacctggcttcccgtactgctgggcagtttcggatgcaaacctctaacaatgttcttaataacagagaacaaaatatggggacgtaagagttggcctataaacgagggaataatggccatcggcatagtaagcatactcctttctagcctattaaagaacgatgttcccctagctgggccacttatagcaggagggatgctgatcgcgtgctatgtgataagcggcagctccgcggacctaagcctagagaaagcagcggaagtcagctgggaacaggaggccgaacattctggaaccagtcacaacatacttgtagaagtgcaggacgacggaacaatgcgcattaaagacgaagagaaggacgatacactcacaatactgctgaaggcgactctgctcgcagtatccggcgtgtacccgatgtccatccccgcaacactctttgtatggtacttttggcaaaagaagaaacagcgctccggcgtcctgtgggacacgccctcgccacccgaagtagaaagagcagttctcgacgatggaatatatagaatattacaacgcgggctactaggaaggtctcaagtgggagtaggagtgttccaggatggcgtattccacactatgtggcatgtaacaaggggagcagtactgatgtatcaaggtaagaggctggagccctcatgggcctccgtcaagaaggacctaatcagctatggaggaggctggaggttccagggtagctggaataccggggaggaggtccaagtaatcgctgtggagcctgggaaaaaccccaaaaatgtacagaccaccccaggaacctttaaaactcctgaaggtgaagtcggagcaatcgccctggacttcaaaccagggaccagtggttcccccatcgtcaaccgcgagggcaagatcgtaggactgtatggaaacggggttgtcacaacatctggaacctacgtgtcagccatagcccaagccaaagcgtcccaagaaggacccctgccggaaattgaggatgaagtgtttaaaaagcgaaatctaacgataatggacctccacccagggtcaggcaaaacacgacggtaccttccagctatcgttcgagaggcaatcaagcgaaagttgcgcacactaattttggccccgacgcgagttgtagctagtgaaatggcagaggcccttaagggaatgccgataagataccagacaactgctgtaaaaagtgaacacaccggacgcgaaatagtggacttgatgtgccacgccacattcacgatgcggctgctaagtcccgtccgtgtacccaactacaatatgataatcatggacgaagcacacttcacagacccagcgagcatcgcggcacgaggctatatatcaacacgagtaggaatgggtgaagcagcagcaatcttcatgaccgcaaccccaccggggtccgtggaggcattcccgcaatccaacgctgtgatccaagacgaggagagggatatcccggagagatcgtggaacagtgggtacgactggataaccgacttccctggtaaaacggtatggttcgttccatccatcaaaagcggaaacgacatagcaaactgcctcagaaagaatggcaaaagagtaatccagctgtcgagaaaaacattcgacactgagtatcagaaaaccaaaaataatgactgggattacgtagtgaccacagatatctcggagatgggagccaacttccgcgcagatcgtgtgatagaccccagacgctgcctaaaacccgttatcctcaaagacggcccggaacgggtgattctcgccggcccaatgcctgtaaccgttgccagtgccgcccaaagacgaggtcgcattggcagaaaccagaataaagaaggggaccaatatgtatatatgggccagccactcaataacgacgaagaccacgcacactggaccgaggcaaagatgctccttgataacatcaacactcccgaaggcataattcccgccctgttcgaaccggaacgggagaagtccgccgccatagacggcgaataccgcttgcgcggcgaggcccggaaaacattcgtcgaactcatgcgtagaggagacttacccgtctggctatcctataaggtggcgtcggaaggtttccaatactccgacagacgctggtgcttcgacggcgaacgcaataaccaggtgctagaagagaatatggacgtcgaaatctggaccaaagaaggggagcgtaagaaactacggccgcgatggctagatgcaagaacttacagtgatccgctcgcactcagagagttcaaggagttcgccgcaggaaggaggtcagtaagtggggacctgatcttagagatcggcaaactacctcaacacctcaccttacgagcccagaatgcactagataacctcgtcatgctccacaactccgagcaagggggaaaagcataccgccacgcaatggaagaactgccagacacaatcgagacactaatgctattagcgctaatcgcggtactgaccggaggagttaccctatttttcctgagcggaaaaggcctcggcaagacttccattggactactctgcgtaactgcatcaagcgcactcctctggatggcaagcgtcgaaccacactggatcgcggcgagcattattctggagttcttcttgatggtactgctcatcccagagcccgacagacagcgcacaccccaggacaaccaactggcatatgttgtcataggcctgctctttatgatactcacggtcgcggcgaacgagatggggttactcgagaccaccaagcgggaccttgggatcggccacgttgccgctgaaaatcaccagcacgcgacgatgctggacgtagacctacggccggcaagcgcgtggaccctttacgccgttgcaaccactgtaatcacacccatgatgcgtcacacgatcgagaacaccaccgccaacatctcgcttacagcaattgcgaatcaggcagcaatcctaatgggtctggacaagggttggccaatctctaaaatggacataggcgtcccactgttagcccttgggtgctatagtcaagtaaacccactcacactcactgctgcagtgctaatgctagttgcccactatgccataattgggcccggcctacaagcgaaggccacacgggaagcccaaaagaggaccgcggcgggtataatgaagaatccaacagtggatggaatcgtggccatcgatctggacccagtggtatacgacgccaagttcgagaagcaactcggacagataatgctgctgatactatgtacatcacagatactgcttatgaggaccacctgggcgttgtgcgaaagtattacacttgcgacgggtcccttaaccacgctctgggaaggaagcccgggaaaattctggaacaccacaatcgccgtttcaatggcgaacatattcaggggaagttaccttgcgggggcgggcctggcctttagtctaatgaaatcccttgggggaggccggagagggacaggagcccaaggagaaactctaggggagaaatggaaaaggcaactgaaccaactaagtaagcccgagttcaacacgtacaagcggtccggaatcatggaagtggacaggtcggaagcgaaagagggattgaaaaggggcgaaacaacaaaacacgcagtaagtaggggaacagctaaactacggtggttcgtagaacgcaacctcgtaaagcccgaaggaaaagtcatcgatttaggctgcggtcgaggaggatggtcatactactgcgctggtctcaagaaagtcaccgaggtgaaaggctacacaaagggcggaccgggacacgaggagccgatcccgatggcaacctacggctggaacctcgtaaagttgcactcaggaaaagacgtcttcttcatgccaccagaaaaatgcgatacactcctctgcgacatcggggaaagctcaccaaatcccacgatagaagaaggtcgtactctaagagtgctcaaaatggtggaaccatggctaagggggaatcaattctgcattaaaatactgaacccatatatgccgagtgtagtagagaccttggaacaaatgcaaaggaaacatggaggaatgcttgtgagaaatcccctaagtagaaatagcacgcacgagatgtactgggtctcctgtgggactggaaacatagtcagcgccgtcaatatgaccagcaggatgctcttgaatcgcttcaccatggcacataggaaaccaacctatgaaagagacgtcgacttgggagcaggaaccagacacgtcgctgttgagcccgaggtcgcaaacttagatattatagggcaaaggatagaaaacatcaaaaacgagcacaagagtacatggcactacgacgaagacaatccgtacaagacgtgggcttaccacgggtcctacgaggtaaaaccgtctggctcggcatcgtcgatggtaaatggagtcgtgcgactgctgacaaagccctgggacgtaattccaatggtaactcagatagcaatgaccgacacaactccgttcggccagcaaagagtattcaaagagaaggtagacacgcggaccccaagagccaaaagaggcaccacacaaatcatggaagtaacggcaaaatggctctggggttttctgagccgcaacaagaaacctcgaatatgcacacgggaggagttcacacggaaagtccgcagcaacgcggcgataggcgcagtcttcgtcgatgaaaatcagtggaacagcgcaaaagaggcggtcgaggacgaacgtttctgggatttggtacatagagaacgggagttgcataagcagggcaaatgcgcgacttgcgtatacaacatgatgggaaagcgtgaaaagaaactgggggagtttgggaaagccaaggggtcgagggcgatctggtacatgtggctaggcgcacgcttcctagagtttgaagcactaggcttcatgaacgaagaccactggttctccagggagaactcgctaagcggcgtagaaggcgaggggctccacaagctcggatacatcctaagagacatttccaaaattccaggcggtaatatgtatgcggacgataccgcagggtgggacacacgaataaccgaagacgacctccagaatgaggctaaaattacggatataatggagcctgagcacgcgctgctagccacttcgatattcaagctcacataccagaacaaggtggtacgggttcaacggcccgcaaagaatggaacagtaatggacgtgattagccgtcgtgaccaaagaggatctggccaggtgggcacatacggcctgaacaccttcacaaacatggaagtacaactcataaggcaaatggaatctgaaggcattttcctccccagcgaactggaaaccccaaacctcgcggagcgcgtactaaactggctcgaaaagcatggagcggaacggctcaaacgcatggccatttccggagatgactgcgtagtcaagcccatagacgatcgcttcgcgacagcactcacggccttaaacgatatgggaaaggtcagaaaagacataccccaatgggaaccgagcaaaggatggaacgattggcagcaagtgcccttttgcagccaccacttccatcagctaataatgaaagacggacgcgaaatagtcgtaccctgccggaaccaagacgaattagtagggcgcgcacgcgtgtcacagggagcgggatggagtttgagggaaacagcatgcctaggtaaatcatatgcacaaatgtggcagcttatgtattttcatcgacgggacctccgcctcgcggccaacgcaatctgttcagcagtaccagtcgactgggtacccaccagcagaactacatggagcatacacgctcaccaccaatggatgactaccgaggacatgctatccgtgtggaaccgggtgtggatagaagagaacccatggatggaagacaaaacacacgttagcagctgggaggaagtcccttatctcggaaagagagaagaccaatggtgcggctccctcatcggtctcactgcccgcgccacctgggcaaccaacatacaggtggccataaaccaagttaggcgattgatcggcaacgagaactacttagattacatgacatccatgaagcgcttcaagaacgagtccgacccggagggcgcgctatggtag

SEQ ID NO: 23928 - RNA, 9879 nt, synthetic construct
  misc_feature 1..9879: note = derived and/or modified CDS sequence (opt11) from DENV-1__KJ189368__SS-prME
  source 1..9879: mol_type = other RNA
agcgtgactatgctgctcatgctgctgcccaccgccctcgcctttcatttgaccactagaggaggggagccccacatgatagtctccaagcaggaacggggcaagagtctattattcaagacctctgccggggtgaacatgtgcaccctgattgcgatggacctgggcgagctctgcgaggacactatgacctataagtgtccccagataaccgaggccgaacctgacgatgtggactgctggtgcaacgcaaccgacacgtgggtcacctacggaacctgcagccaaaacggcgagcaccgccgggacaagcgcagcgtggccctagcgccacacgtgggcctggggctcgagacccggacggagacatggatgagctcggagggcgcctggaagcagatccagcgcgtcgagacctgggccttgcggcaccccgggttcaccgtgatcgccctgttcctcgctcatgccatcggtacgagcatcacccagaagggaatcatcttcatcttgctaatgttggtcacgccctccatggccatgcgctgcgtcggcataggcaacagagacttcgtggagggcctgagcggggcgacctgggtcgacgtcgtgcttgagcacggttcctgtgtgaccaccatggcaaagaataagcccaccctcgatatcgagctgctgaagaccgaggtcacgaaccccgcgatcttgcgcaaactttgtatcgaggccaagatctctaacaccaccaccgactcccggtgcccgacccagggcgaggccaccctggtggaggagcaggacgccaattttgtgtgccgtcggaccttcgttgaccgcggctgggggaacggctgtggcctcttcggaaagggcagcctgctgacgtgcgccaagttcaagtgcgtgacgaagttagagggcaagatcgtgcagtacgaaaatctgaaatacagtgtcatcgttaccgtgcataccggggatcagcaccaggttggcaatgagaccacggaacacggcaccatcgcgaccatcacgccccaagcacccaccagcgagatccagttgacggattacggagcactcacccttgactgtagcccccggacaggcctggactttaacgagatggtgctcctgaccatgaaagagaagtcctggctggtccacaagcagtggttcctcgacttgccgctgccctggacgagtggggccagcaccagccaggagacctggaaccgccaggacttactggttacctttaagacggcgcacgcaaagaagcaggaggtggtcgtgctgggcagccaggagggcgccatgcacacagccctcaccggggccactgagatccagaccagcggtaccaccactatattcgcggggcacctgaagtgccggttgaagatggacaagctcacgctgaagggcacatcctacgtcatgtgcaccgggccgtttaagttagagaaagaggtcgcggagacccagcacggaacggtgctagtgcaagtcaaatacgagggcaccgacgccccctgcaaaatcccgttcagcacccaggacgaaaagggggtgacccagaatggccgcctcatcaccgccaacccaattgtgaccgacaaggagaagcccgtcaacatcgagacggagcccccattcggggagtcatacatcgtggtgggcgccggcgagaaagcattgaaacttagctggttcaagaaggggtcctcaatcggcaagatgttcgaggccaccgcccgcggtgctcgccggatggccatccttggcgacacggcgtgggacttcgggtccatcggcggcgtcttcaccagtgtggggaagctggtgcatcaggttttcggcaccgcctatggggtgctgttctcaggcgtcagctggaccatgaagatcgggatcggcatcctccttacgtggctgggcctcaactctaggagcacctccttaagcatgacctgcatcgccgtcggaatggtgaccctgtacctcggcgtaatggtccaggccgactcagggtgcgtgattaactggaagggacgcgagctaaagtgcgggagcggcatcttcgtgacgaacgaggttcacacatggaccgagcaatataagttccaggccgactcccccaagaggctttctgcggccatcggcaaggcctgggaggagggggtgtgcggcatccgcagtgccacccgtctcgagaacatcatgtggaagcaaatcagtaacgagctgaaccatatcctcctcgagaacgatatgaagttcaccgtggtagtgggcgacgccaacggcattctggcgcagggtaagaaaatgatccgcccacaacccatggagcacaagtacagctggaaatcctggggcaaagccaagatcatcggcgccgacatccagaacacgactttcattatcgacggcccggacacgcctgaatgccctgacaaccagcgggcgtggaacatctgggaggtagaggattatggcttcgggatcttcaccactaacatctggctgaagctcagggacagctacacccagatgtgtgaccaccggctaatgtctgcggccattaaggacagcaaggccgtccacgccgacatgggctactggatagagtccgagaaaaacgagacctggaagctcgcccgcgcaagcttcatcgaagtgaagacctgcacttggcccaagagccacaccctctggagcaacggcgtgctcgagtccgagatgatcataccgaagatctatggaggccccatcagccagcacaactaccggcccgggtacttcactcaaaccgccggcccgtggcacctgggcaagctcgagctggacttcgacctgtgtgagggcacgaccgtcgtggtggatgagcactgcggcaaccgcgggccctccctccggactaccacagttaccggcaagatcatccatgagtggtgttgccgcagctgcaccctgccccccctgcggttccgcggagaggacggttgttggtacggcatggagattcggccggtgaaagagaaggaggaaaaccttgtgcgctccatggtaagcgccggctccggggaagtggacagcttctcactggggatcctgtgcgtgtccatcatgatcgaggaggtcatgcgtagcaggtggtcccggaagatgctcatgaccggtacgctcgccgtattcctgctcctggtgatggggcagctgacctggaacgacctcatccgcctgtgcattatggtcggcgccaacgcgagcgatcgcatggggatgggcaccacctatctggccctcatggccacgttcaaaatgagacctatgttcgccgtggggctgctgttccgccggctcacctcccgagaagttctgctgctcaccatagggctgtccctagtcgcgtccgtggagctccccaacagcctggaggagctgggcgacggcctcgcgatgggcatcatgatgttaaaactgctcaccgagttccaaccccaccagctgtggacgaccctgctctccctgaccttcatcaaaaccacgctgtccctcgactacgcctggaaaaccaccgccatggccctgtctatcgtctctctgttcccgctctgcctgagcacaacgagtcagaagacgacctggctgcccgtgctcctgggctcctttgggtgtaagcccttgaccatgttcctcatcaccgagaataagatctggggccggaagagctggcccctgaacgaagggatcatggcgattggcatcgtgagtatccttcttagctcgttactgaagaacgacgtcccgctcgccggacccctgatcgcgggcggcatgctgatcgcctgctacgttatctcagggagctcagccgacctcagcctagagaaggccgcggaggtgtcatgggagcaggaggccgagcacagcggcacgtcccacaacatcctggtcgaggtgcaggacgacgggaccatgaagatcaaggacgaggagcgggatgacaccctcaccatcctcctgaaggccacacttctggccgtgagcggcgtctaccccatgtccatccccgcaaccctgttcgtgtggtacttttggcaaaaaaaaaaacagcggagcggtgtgctgtgggacaccccgagcccgcccgaggtcgaacgcgccgttctggacgacggcatctaccggatattacagcgcggcctgttggggcggtcgcaggtcggcgttggggtatttcaggacggcgtttttcacaccatgtggcacgtcacgcgcggggccgtgctcatgtaccagggcaagcggctggagccttcctgggccagcgttaagaaagacctgatctcctacgggggaggctggcgcttccaagggagctggaatactggcgaggaggtccaggtgatcgccgtggaaccggggaagaaccctaagaacgtccagaccactcccggcacgttcaagacacccgagggggaggtgggggcgatagccctggattttaagccgggcacttccgggagcccaatcgtgaaccgggagggcaaaatcgtcggcttatacgggaacggtgtggtgaccacgtccggaacctacgtcagcgcgattgctcaggccaaggcgagccaagagggccccctcccggaaattgaggacgaggtgttcaagaagcggaacctgaccatcatggacctgcaccccgggagcggcaaaacccggcgctacctccccgcgatcgtgagagaggctattaaacgcaagctgcggaccttaatcctcgcccccaccagggttgtggcgagcgaaatggccgaggctctgaagggcatgccgatccgctaccagaccaccgccgtgaagtccgagcacacggggcgggagatcgtcgacctaatgtgccatgccaccttcaccatgaggttactgtcaccagtccgagtgccaaactacaacatgatcatcatggacgaggcgcacttcaccgaccccgcctccatcgccgccagagggtacatcagtaccagagtcgggatgggggaagccgcggcaatcttcatgacagccaccccccccgggtccgtggaggccttcccacagagcaacgccgtgatccaggacgaggagcgcgacatccccgaacggtcatggaactcgggctacgactggatcaccgactttccgggcaagacggtctggtttgtgcctagtataaaaagcgggaacgacatagcgaactgcctgcgcaagaacggcaagcgggtgattcaactctcccgcaagaccttcgacactgagtaccaaaagacgaaaaataacgactgggactacgtcgttacgaccgacattagcgagatgggggccaacttccgggccgaccgcgtgatagacccccggcgctgcctgaagcccgtcatcctgaaagacggcccggagcgggtgatcctcgctgggcccatgcccgttactgtcgcctccgccgcccaacgcaggggccgtataggccggaaccagaacaaggagggtgaccagtatgtgtacatgggccagcccctgaacaacgacgaggatcacgcccattggaccgaggccaagatgctgctcgacaatataaacactccggaggggatcatcccggcgctgttcgagcccgaacgcgaaaagtccgcggcaatcgatggcgagtataggctgcgcggcgaggcccgcaaaaccttcgtcgagctcatgcggcgcggcgacctacccgtgtggctctcctacaaggtggccagcgagggcttccagtattccgaccggcgctggtgctttgacggagagcggaacaaccaagttctcgaggagaacatggacgtggagatctggaccaaggagggcgagcgcaagaagctgcggccgaggtggctggacgctcgaacctactccgatcccctcgccttgcgagaattcaaagaattcgccgccgggcggcgctccatctcgggcgacctcatcctcgagatcggcaagctgccccagcacctgaccctccgtgcgcaaaacgcgctggacaatcttgtgatgctccacaacagcgagcagggcggtaaggcctaccgccacgccatggaggagctgcccgacacaatcgagaccctgatgctcttggccctgatcgcggtcctcaccgggggcgtgaccctgttcttcctgtccgggaagggccttggcaagacgtctattgggctgctgtgcgtgaccgcttccagcgcactcctctggatggcctccgttgagccgcactggatcgctgcgagcatcatcttggagttcttcctcatggttctactgatcccagagcccgaccggcagcgcaccccgcaagataaccagctggcctacgtggtgatcggcctgctgttcatgatcctcaccgtggccgcgaacgagatgggtctgctggagaccaccaagaaggacctcggcattgggcacgtggccgcggagaaccaccagcacgccaccatgctggacgtagacctgcggcccgcttccgcctggaccctctacgccgtggcgacaactgtgatcaccccgatgatgcgccatacaatcgagaacacgaccgccaacatcagcctgactgccattgccaaccaagccgcgatccttatgggcctcgacaagggttggcctatctccaaaatggacatcggggtcccgctgcttgcgctcggctgctactctcaagttaaccccctaaccctaactgccgccgttctcatgctggtcgcgcactacgccataatcgggcccggcctgcaagccaaggcaacccgggaggcccaaaagcgcacagcggccgggatcatgaagaatcccaccgtcgacggcatcgttgccatcgaccttgacccggtcgtgtacgacgccaagttcgagaaacagctgggccagataatgctgctgatcctatgtacgtcccagatcttgctcatgcgcacgacctgggccctgtgcgagagcattacattagcaacgggacccctcaccaccctgtgggagggctccccggggaagttctggaacacgacgatcgccgtgagcatggcaaatatcttccgaggctcctacctggccggcgcggggctcgcgttcagcctgatgaagtccttaggcgggggccgccgggggaccggtgcccagggcgaaactctgggggagaagtggaaaaggcaactcaaccagctgagcaagtccgagttcaacacctacaagcggagcggcatcatggaggtcgatcgcagcgaggcaaaggaagggttaaagcgtggcgagactaccaagcacgccgtatcccgcgggaccgctaagctgagatggttcgtggagcgcaacctggtaaaacccgagggcaaggtgatcgacctgggatgcgggaggggcgggtggagctactactgcgctggcctcaaaaaggtgacggaggtcaagggatacacgaagggcggcccggggcacgaggagcccatccccatggccacgtacggctggaaccttgtgaagctgcactccgggaaggacgtgttcttcatgcccccggaaaagtgcgatacccttttatgcgacatcggtgagagcagtcccaaccccaccatcgaggaggggcgcacactgcgggtcctcaagatggtggagccctggctgcgcggcaatcagttctgtatcaagatcctgaatccttacatgccgagcgtcgtggagacgctagagcagatgcagcgaaagcacggtggaatgctggtgcgcaaccctctgtcccggaacagtacccacgaaatgtactgggtgtcctgcggaactggcaacatcgtcagcgccgttaacatgacatcccgcatgctgctgaatcggttcacgatggctcaccgcaagcctacatacgagcgcgacgtagacttaggcgcgggcacccggcacgtcgccgtggagccggaggtggccaacctcgacatcatcgggcagcgaatagagaacatcaagaacgagcacaaaagcacttggcactacgacgaagacaacccttacaagacgtgggcgtaccacggctcctacgaggtcaagcccagcgggtccgccagctcaatggtcaacggcgtggttcgcctcctaacgaagccgtgggacgtgatcccaatggtcacgcagatcgcgatgaccgacacgacaccgttcgggcagcagcgcgtgttcaaggaaaaggtggacaccagaacgccccgggccaagcggggcacgacccagatcatggaggtcaccgccaaatggctctggggcttcctgagccgaaacaagaagccgcggatctgcactcgcgaggagtttacgagaaaagtccgcagcaacgccgccatcggcgcggtgttcgtcgatgagaaccagtggaatagcgcgaaggaggccgtggaggacgagcggttctgggacctggtgcaccgcgagagagagctccacaagcagggcaagtgcgcgacgtgcgtttacaacatgatggggaaacgcgagaagaagctgggcgagttcgggaaggcgaagggcagccgtgccatctggtacatgtggcttggcgcccggttcttggagttcgaggccctggggttcatgaacgaagaccactggttctcccgggagaacagcctgtccggcgtcgagggtgaggggctccacaagctgggatacatcctgcgcgacatcagcaagatccccggcggcaacatgtatgccgacgacaccgcggggtgggacacccggatcacggaggacgacctccagaacgaggccaagatcaccgagttcatggagccagaacacgccctgctagcgacctctatcttcaagcttacctaccagaacaaagtggtacgcgtgcagcgccccgccaaaaacggcacggtgatggacgtcatcagccggcgagaccagcggggttccggccaggtgggcacctacgggctaaacacattcaccaacatggaggtgcagctgatccgccagatggagtccgaaggcatcttcctcccgtccgagttagagacgccaaacctggcggagcgggtgtttgactggcttgagaagcacggggccgagcgccttaaacgaatggccatcagcggcgacgactgcgtggtgaagcccatcgacgaccgcttcgccaccgcgttaaccgcgctcaacgacatggggaaagtacggaaggacatcccgcagtgggagccttccaagggttggaacgactggcagcaggtccccttttgttctcatcacttccaccagctgattatgaaggacggacgcgagatcgtggtcccatgtcggaaccaagacgagctggtggggcgcgcccgggtttcccagggcgccgggtggagcttacgcgagaccgcctgcctgggcaagtcctacgcccagatgtggcagctgatgtacttccatcggcgggacctccggctggcggccaacgcaatctgcagtgccgtcccagtggactgggtcccgactagtcgcacgacctggagcatccacgctcaccaccagtggatgaccaccgaggacatgctgagcgtctggaaccgggtctggatcgaggaaaacccctggatggaggacaagactcatgtgtccagctgggaagaggtcccctacttaggtaagcgcgaggaccagtggtgcggctcactgatcggcctgaccgcccgcgcaacctgggccaccaacatccaggtcgccataaaccaggtgcgccgcctcatcgggaacgagaactacctggactacatgacgagcatgaagcgtttcaagaatgagtccgatccagagggtgcgctgtggtga

SEQ ID NO: 23929 - RNA, 9879 nt, synthetic construct
  misc_feature 1..9879: note = derived and/or modified CDS sequence (opt11) from DENV-1__KJ189369__SS-prME
  source 1..9879: mol_type = other RNA
agtgtgacaatgctcctcatgttactgcccaccgccttagccttccacttgaccacccggggcggggagcctcatatgattgtctcgaaacaggagcggggcaaatccctcctgttcaagacgtccgcgggggtaaacatgtgcaccctgattgccatggacctgggtgaactctgcgaggacaccatgacctacaagtgtccccagatcacagaggccgaacccgacgacgtagactgctggtgcaacgccactgatacttgggtgacatatgggacctgctctcagactggcgagcatcggcgggacaagcgctctgtggccctagccccccatgtgggactaggattggagacacgtaccgaaacttggatgtcttccgaaggtgcctggaagcagatccagcgtgtcgagacctgggccctgaggcacccaggcttcacggtgatcgctttgttcttggcgcacgcgataggcaccagcataacccagaaagggataatattcatcctgctgatgctcgtgaccccgtccatggcgatgcgctgcgtggggatcggtaaccgggacttcgtcgaggggcttagcggcgccacgtgggtggacgtcgttttagagcacgggtcatgcgtcaccaccatggccaagaacaagcccactctagatatcgagctcttaaagacggaggtcaccaaccccgcgatcctacgcaagctttgtattgaagccaagatcagcaacaccaccaccgactcgcggtgcccgacacagggagaagccactctggttgaggaacaggacgcaaacttcgtgtgtcgtcggaccttcgttgaccgcggctgggggaacggctgcggcttattcggcaaggggagcctgctgacatgcgctaagtttaagtgcgttacgaagctcgaaggtaagatagtgcagtacgagaaccttaaatactccgtcatcgtgaccgtgcataccggcgaccaacaccaggtcgggaacgagacgaccgagcacggaacaattgcgacaatcacgccccaggccccgacgagcgagatccagttgacggactatggcgcgctgaccctcgattgcagcccccggaccgggctggacttcaacgaaatggtgttgctgaccatgaaggagaagtcctggttagtgcataagcagtggttcctcgacctgcccctgccctggaccagcggggcctctaccagccaggagacttggaatcgacaggacctcctggtgacgttcaagacggcccacgcgaaaaagcaagaggtggtcgtactgggctcccaggagggcgcgatgcacacagccttaaccggggccaccgagatacagaccagcggcacaaccacgatcttcgccggtcatcttaaatgcaggctcaagatggataagctgacactgaagggaacctcttatgtcatgtgcaccggaagtttcaagctggagaaggaggtggcggaaacacaacatggcaccgtgctggtgcaggtcaagtatgaaggcaccgacgccccgtgtaagatcccgttctccactcaagacgagaagggggtaacgcagaacggtcgcctcatcacggccaaccccatcgtaaccgataaggagaagcccgtaaatatcgaaacagaacctcccttcggggagtcttacatagtggtcggcgcgggtgagaaagcgctgaagctgagttggtttaaaaagggcagctccatcggcaaaatgttcgaggccacggcacgcggggcgcgccggatggcgatcctcggcgatacggcctgggatttcggcagcatcggcggcgtcttcacgtccgtagggaagctagttcaccaggtcttcggcaccgcctacggagtgctgttctcgggtgtgtcctggacgatgaaaattgggatcggcatcctcctgacctggttgggcctaaacagccggtccaccagcctgtccatgacctgtatcgccgttgggatggtgacgctttacctcggcgtcatggtccaagcggatagcggttgcgtgataaactggaagggccgcgagctgaaatgcgggtccggcatattcgtgacgaacgaggtccacacttggaccgaacaatacaagttccaagcagacagcccgaaacggctttccgctgccatcggtaaggcctgggaggagggggtgtgcggcatcaggtccgccacccggcttgagaatatcatgtggaagcagatcagcaacgagctgaaccatatactcctcgagaatgacatgaaattcaccgttgttgtgggggatgccaacggcatcctggcccagggcaagaagatgatcaggccccagcccatggagcataaatactcctggaagtcctggggcaaggctaaaattattggggccgatattcaaaatactactttcataatcgacggccccgacacgccggaatgccctgacaaccagcgcgcctggaacatatgggaggttgaggattacgggttcggcatattcacgactaacatttggttgaaactccgggacagttatactcagatgtgcgaccaccgtctgatgagcgcggcgatcaaggactcaaaagccgtccatgccgacatgggttactggatagaaagcgagaagaacgagacgtggaaactggcccgcgcgagtttcattgaggtgaagacgtgcacctggcccaagagccacaccctatggtccaacggagttctggagagcgagatgataatccccaagatttatggggggccgatatcccaacacaactatcggcccggttatttcacccagaccgccggaccctggcaccttgggaaattagaactggacttcgacctgtgtgagggtaccaccgtcgttgtggacgagcactgcggcaatagggggccgtctctccggacgacgactgtcacgggcaagatcatacacgaatggtgctgccgctcatgtaccctgccccccctgcggttccgtggggaggacggctgctggtacggaatggaaattcggccagtgaaggaaaaggaggagaacctcgtccgctcaatggtatccgccggcagcggggaggtggacagctttagtctggggatcctgtgcgtgagcatcatgatcgaggaagtgatgcgatcccgctggagccggaagatgcttatgacgggcaccttggccgtattcctgctattggtgatgggacagctgacgtggaacgatctcatccgcctgtgtatcatggtcggcgcgaacgcctccgatcgaatggggatgggtacaacatacctggccttaatggccacttttaagatgaggccaatgtttgccgtgggtctgctgttccgccggctcaccagccgcgaggtgctgttgctgacaatcgggctgtcactcgtcgcgagcgtagagctccctaactcccttgaagaactcggtgatgggctcgcgatgggcataatgatgcttaagctgctgacggagttccagccccaccagctgtggaccaccctactaagtctcacatttattaagacgaccctgtccctggattacgcctggaagacgactgccatggctctgagcatagtatccctattccccctctgtctaagcacgacctcacaaaagaccacctggctgccggtgctgcttggctcattcgggtgcaaacccctaaccatgttcctcatcacggagaacaaaatctggggacggaagtcttggcccctcaacgagggaatcatggcgatcgggatagtgagtatactattgtccagcctgctaaagaacgacgtcccactcgccgggccgctgatcgccggtggaatgctaatcgcctgttatgtgatcagcgggtcctccgccgacctctccctggagaaggcggctgaggtgagctgggagcaagaggccgagcactccgggaccagccataacatactggtcgaggtccaggacgatggcaccatgaagatcaaggacgaggaacgcgacgatactctcacgattttgctaaaggccaccctgctggctgtgtccggggtgtaccctatgtctattcccgcaactttattcgtgtggtacttctggcagaagaaaaaacaacggtcaggcgtgctctgggataccccttcaccgccagaggtagagcgcgcagtactggatgacggcatctaccggatcctgcaaagaggcctgctcggtcggtcccaagttggcgtcggggtgttccaggacggcgtgttccacacgatgtggcacgtcactcgcggggccgtgttaatgtaccaaggcaagcggctcgagcctagttgggcgtccgtcaagaaggacctcattagctacggagggggctggcgcttccaggggtcgtggaacacgggtgaggaagtgcaagttatagccgtggagcccggcaaaaaccctaagaacgttcaaacgacaccaggcactttcaagacccccgagggcgaagtcggagctatcgctttagacttcaagcccggcacctccgggtccccgatcgtgaatcgtgagggcaagatcgttggcctctacgggaacggcgtggtgacaaccagcggtacatacgtaagcgccatagcccaagcaaaagcgagccaggagggcccgctccccgagatcgaggacgaggtgttcaagaagagaaacctgactatcatggatttgcaccctggctcagggaagacgcggcgatacctccccgccatagtacgagaagccatcaagcgtaagttgcgtactctcattctcgcccctacacgcgtggtggcttcggagatggccgaggctctgaagggcatgcctatccgctaccagaccacggccgtcaaaagcgaacacaccgggcgggagattgtggacctgatgtgccacgccactttcaccatgcgcctcctgtctccggtacgagttcccaactacaacatgattatcatggacgaagcgcacttcacagaccccgccagcattgcggctcgaggctatatctccacccgggtcggcatgggcgaggccgccgctatcttcatgactgcaacgccccccgggagcgtagaggccttcccccaatccaacgccgttatacaggatgaggaaagggatatacccgagcgttcatggaactccggttacgattggatcactgacttccctgggaagaccgtctggttcgtccctagcattaagtccggtaacgacatcgcgaactgcctgcgaaagaacggcaaacgggtcatccagctctcaaggaagacctttgacaccgagtatcagaagacgaagaataatgactgggactacgttgtgaccacagacatctctgagatgggggccaacttccgggccgaccgcgtgatcgacccccggagatgcctgaagcccgtcatcctgaaggacggccctgagcgagtgatactcgccggaccgatgccggtgaccgtcgcaagcgcagcccagcgccggggtcgcatcggtcggaaccaaaataaggagggggatcaatacgtgtacatgggtcaaccgctgaacaatgacgaggatcacgcccactggacagaggccaagatgttgctcgacaacatcaacacccccgaggggattatcccggcgctgttcgagcccgagagggagaagaacgcagccatagacggcgagtaccgtctgcgcggggaagcccgtaagactttcgtcgagctcatgcgccgcggggacctgcccgtgtggctgagctacaaggtggcctcggagggcttccaatacagtgaccggcggtggtgctttgacggtgagagaaataaccaggtgctcgaggaaaacatggacgtggagatctggaccaaggagggcgagcgaaagaagctacgcccccgctggttggacgcgcggacttactcagatccgctcgcactccgcgagttcaaagagttcgccgccgggcggaggtccgtgtcgggcgacttaatcttggagatcggcaaactgccacagcacctaacattaagagctcagaacgcgctggataatttggtcatgttgcacaacagcgagcagggagggaaggcctaccgccacgccatggaggaattaccggacaccatcgagaccctgatgctccttgcgctgatagcggtactgaccgggggggtgacacttttcttcctgtccgggaagggcctcggcaagaccagcattggattgttgtgcgtcaccgcctccagcgccctcctgtggatggcctccgtggagccccactggatcgctgcttccatcatcttagagttcttcctcatggtgctgttgatcccggagccagaccggcaaagaacgccccaagacaatcaactcgcctacgtcgtaatcggcctgctgtttatgatactcacggtggccgccaacgagatggggctgctcgagaccaccaagaaggacctcggcatcggacacgtagccgcagagaaccatcagcatgcgacgatgctggacgtggatttgcgacctgcctccgcctggacgttgtatgccgtggcaaccactgtgataacccctatgatgcgccatacgatcgaaaatacaaccgccaatatcagcctgactgccatagcgaatcaagccgcgattctcatggggcttgacaagggctggcccatctcgaagatggatattggcgtgcctctgctggccttgggttgctacagccaggtgaacccgctgactctgaccgccgccgtgctcatgctcgtggcccactacgccataatagggcccggcttacaggctaaggccacccgggaagcccagaagcgcaccgctgctggaatcatgaagaaccccacggtggatggcatagttgcgatcgacctcgacccggtggtgtatgacgccaagttcgagaaacaactgggccagatcatgctgctcatcttgtgcacgtcccagatattactcatgcgaaccacgtgggcactgtgcgagagcataacgctggcgactgggccactcaccactctgtgggagggatccccagggaagttttggaacaccaccatagctgtcagtatggcgaatatctttcggggctcctacctggcgggcgcagggctcgcgttcagcctaatgaagtccttgggtgggggccgccgggggactggcgcccagggcgagacattgggggaaaagtggaagcgccagcttaaccaactgagcaagtccgagtttaacacgtacaagagaagcgggatcatggaggtggatcgcagcgaagccaaggaggggctcaaacggggcgagacgaccaaacatgctgtttcacgcgggaccgcgaagttgcggtggttcgttgagcgcaatctggtgaagcccgagggcaaggtgattgacctggggtgtggacggggcggatggagctactattgcgctgggctcaagaaagtcacggaggtgaagggatacacaaagggcgggcccggccacgaggagccgatccccatggccacctacggttggaacctggtgaagctgcactccgggaaagacgtcttcttcatgcccccagagaagtgcgacaccctcctctgtgatatcggcgagagctccccaaacccgaccattgaagaggggcgcacacttcgggtactcaagatggtggagccgtggctccggggcaaccaattttgcattaagatccttaacccctacatgccgagcgtcgtggagacactggagcagatgcagagaaagcacggtgggatgctggtacggaaccccttgtcccggaatagcacccacgaaatgtactgggtatcctgcgggaccggaaacatcgtgtcagccgtgaatatgacgtcccgcatgttactcaaccggtttaccatggcccaccgcaagcccacctacgaacgggacgttgaccttggcgctggcacccggcacgtggccgtggagcccgaggtcgcgaacctagacataataggtcaacgcatagagaatattaagaacgagcacaagagcacgtggcactacgacgaggataatccgtataagacctgggcctaccacggctcctatgaggtgaagcccagcggatccgcctcgtccatggtgaacggagtggtgaggctgctgacaaagccgtgggacgtcatccctatggtgacccagattgcgatgacggacaccaccccgttcgggcagcagcgtgtattcaaggaaaaggtggatactaggacgccccgtgccaagcggggcactacccagattatggaggtgaccgccaagtggctctggggcttcttatctcgtaacaagaagccccggatctgcacgcgtgaggagttcacccggaaggtccgctccaacgcggcaattggagccgtcttcgtggacgagaaccagtggaactctgctaaggaggcggttgaagacgaacggttttgggacctggtccatcgcgagcgggagctacacaaacagggcaagtgcgcgacatgcgtttacaacatgatggggaagcgggagaagaagctgggcgagttcggtaaagcgaagggaagtagagccatctggtacatgtggctgggcgcccgcttcttagagttcgaggccctggggttcatgaacgaagaccactggttcagtcgggaaaacagcctgtcgggcgtagagggtgagggcctccataagctggggtacatcttacgcgacattagcaagataccgggcgggaatatgtacgccgacgacaccgcggggtgggatacccgaatcacagaggacgaccttcaaaatgaggccaagatcaccgaaatcatggagcccgaacacgcacttctagccacgagcatctttaaactcacgtaccagaacaaggtggtgcgggtgcagcgccccgcgaagaacggcacagttatggacgtgatctcgcgccgcgaccagcgagggtctggccaggttggcacgtacggcctgaacaccttcacgaacatggaggtccagctaatacgccagatggagtcggagggtatatttctcccctccgagctcgaaaccccgaacctggcggaaagagtgctcgactggttagagaagcatggggccgagcgattgaagcggatggcgatcagtggcgacgactgcgtggttaagcccatcgatgaccgcttcgccactgcactcaccgcactgaacgacatgggtaaggtgcggaaagacatccctcaatgggagccaagtaagggttggaacgactggcaacaggtgccattctgtagccaccacttccaccagctgatcatgaaagacggtagagaaatagtcgtgccatgccggaaccaggatgagctcgtggggcgggccagagtgtcccagggcgccgggtggagcttacgcgagacagcctgtctgggcaagtcctacgcccaaatgtggcaattaatgtacttccacagacgcgacctgagactggcagccaacgcaatttgcagtgccgtgcccgtggactgggtccccacaagccgcaccacctggagcatccacgcacaccaccagtggatgaccacggaggatatgctcagcgtgtggaaccgggtttggatcgaggaaaacccgtggatggaggacaagacccacgtaagtagctgggaggaggtgccctatctggggaaacgcgaagaccaatggtgcggatcccttatcggcctcaccgcgcgcgcaacctgggcgacaaacatacaagtggcaataaaccaggttaggcgcctgataggcaacgagaactacctagactatatgacaagcatgaaacggtttaagaacgaatcggaccccgaaggcgcgctctggtga

SEQ ID NO: 23930 - RNA, 9879 nt, synthetic construct
  misc_feature 1..9879: note = derived and/or modified CDS sequence (opt11) from DENV-1__EU482615__SS-prME
  source 1..9879: mol_type = other RNA
tctgtaaccatgctgctcatgttgctacccaccgccctcgcatttcacctgactacccggggaggagagcctcacatgatcgtgagtaagcaggagcggggcaagagcctcttgttcaagacctccgcaggagtgaacatgtgcactctgatcgcgatggacctgggggagctctgcgaggacactatgacctataagtgcccccagatcaccgaagcggagcctgatgatgtcgactgctggtgcaacgccactgacacgtgggtcacatacggcacctgctcgcaaaccggcgagcacagacgggacaagcggagcgtggccctggctccccacgtgggcctggggctcgaaacgcggaccgaaacctggatgagcagtgaaggggcatggaagcagatccagcgcgtcgagacctgggccttacggcaccccgggttcacggtgatagcactttttctcgcacacgccatcggtacctctatcacccagaaaggcattattttcatactgctgatgctcgtcaccccctccatggccatgcgctgcgtcggtatcggcaaccgggacttcgtggaggggctgagcggcgccacgtgggtggacgtcgtgcttgagcacgggtcttgcgtaaccaccatggccaagaacaaacccaccttagatattgagctgcttaaaacggaggttaccaaccccgcgatcctccgcaaactttgcatagaggccaagatcagtaacaccaccacggactcccgatgtccgacccaaggggaagcgacgctagttgaggagcaagacgccaatttcgtttgccgccggacctttgtcgaccgcggctgggggaatggctgcggtctcttcggcaaggggagcttattgacatgcgccaagttcaagtgcgttaccaagctcgagggcaagatcgtgcagtatgagaacctgaagtattccgtcattgtgacagtgcacaccggcgatcagcaccaggtcggaaacgaaaccaccgaacacgggacaatcgctaccatcacgccacaggccccgacgtctgagatccagcttaccgactatggggcactcaccctggactgcagcccccggaccgggctggatttcaacgagatggttctcctgacgatgaaagagaaatcctggctggtgcacaaacagtggttcctcgacttgcctctgccctggacatccggggccagcacatcgcaggagacgtggaaccgccaggaccttctggtgaccttcaagaccgcccacgcaaagaagcaggaggttgtggtgctggggtcccaggagggcgccatgcacaccgccctcaccggggccacggaaatccagaccagcgggaccacgacgatcttcgccgggcacctgaagtgtcgattgaagatggacaagctcaccctaaagggcacgtcgtacgtaatgtgcaccggaagcttcaaattggagaaggaggtcgcggagacgcagcatgggacggtgctggtacaagtcaagtatgaaggcaccgacgccccttgcaagatccccttctccacccaggatgagaaaggggttacgcaaaatggccgcctgatcaccgccaacccgattgtgaccgataaggagaagccggtaaacatcgagaccgagccgcccttcggggagagctacatcgtcgtgggcgccggcgagaaggcgctcaagctgtcctggttcaagaaggggtcttccatcggcaagatgttcgaggccaccgcccgcggcgcacgccgaatggcaatcctaggggacaccgcgtgggacttcggaagcatcggcggtgtctttaccagcgtggggaagctggtgcaccaggtctttggcaccgcatacggtgtgctgttcagcggggtttcgtggacaatgaagatagggataggcatacttctcacctggctgggcctcaacagccgctccaccagcctgtctatgacctgcatcgctgtggggatggtaacgctgtacctcggcgtgatggtccaagctgacagcgggtgcgtgataaactggaagggccgtgagttgaaatgcgggtccggcatcttcgtgaccaacgaggtccacacgtggaccgagcaatacaagttccaggctgacagcccgaagcggttaagcgctgccatagggaaggcttgggaagaaggggtgtgcggcatccgatccgcgaccaggctggagaacatcatgtggaagcagatcagcaacgagctgaaccacatcctgctcgagaacgatatgaagttcactgtggtcgtgggggacgccaatggcatcctggcgcaggggaaaaagatgatccgcccacaacccatggagcataagtactcctggaagtcctgggggaaggccaaaatcatcggcgcggacatccaaaacaccacctttataatcgacgggcccgacaccccggagtgccccgacaaccagcgtgcctggaacatctgggaggttgaagactatggctttggtatctttacgacaaacatctggcttaagctcagggactcctatacccaaatgtgcgaccaccggctcatgagcgcagccatcaaggactccaaggccgtccacgccgacatgggctactggattgagtccgaaaagaacgagacatggaagctggcacgcgcaagtttcatcgaggtgaagacgtgtacttggcccaagtcccacaccttatggtccaacggcgtgttggagtccgagatgatcatccctaagatctatggagggccgatatcccagcataactaccggccggggtactttacccagaccgccggaccctggcacctggggaagctagagttagacttcgatctgtgcgaggggaccaccgttgttgtcgatgagcattgtggcaacagagggccgagtctccggacaaccaccgtcacaggaaagatcatccacgagtggtgctgccgatcctgcaccttaccccccctgaggtttcgcggggaggacggttgctggtacggtatggagatcaggcctgtgaaggaaaaggaggagaacctggttcgtagcatggtctcggccggcagcggcgaggtagactcattctcacttgggatcctatgtgccagcatcatgatagaagaggtgatgcgttcccgctggagccggaagatgctcatgacaggtacactggccgtgttcctgctgctgatcatgggccagctgacctggaacgacctcatccgcctgtgcataatggtaggagcgaacgcatccgaccgcatgggtatgggcaccacatatctggccctaatggccaccttcaagatgcggcctatgtttgccgtcggtctactgttccgccggctcaccagccgcgaggtgctgctcctcacgatcgggttgtccctggtggctagcgtggagctacccaactccctggaggagctgggcgacgggttagcgatgggcattatgatgctgaagctcctcacggagttccaaccccaccaactgtggaccaccttgctatcgctgaccttcatcaagacgaccctgtccctcgactacgcgtggaaaactacggccatggctctgtcaatcgtctccctgttccccctctgccttagcaccaccagtcagaagacaacctggctgccggtacttctgggcagcttcgggtgcaagcccttgacgatgttcctcatcacggagaacaagatctggggccggaagtcctggccgctgaacgagggtatcatggccatcggaatcgtcagcatcctcctctcctccctgctgaagaatgacgttcccctcgccgggccactaatcgcaggggggatgcttattgcatgctacgttatcagcgggtccagcgcggatctaagtctggagaaggccgccgaggtcagttgggaacaagaggcggaacattccggtaccagccacaacatactggtcgaggtgcaggacgacgggaccatgaagatcaaggacgaggagcgagacgacacgttaacgatcttactaaaggccaccctactggcggtctccggcgtgtatcccatgtcgatacccgcgacgctcttcgtgtggtatttctggcagaagaaaaaacaacggtccggggtcctctgggacacccccagccctcccgaggttgagcgtgccgtccttgatgatggcatctacagaatacttcaacgcggcttgctcgggcggtcccaggttggcgtgggtgtgttccaagacggcgtctttcacacgatgtggcacgtgactcgcggggctgtcctgatgtatcaggggaagcgactggaacccagctgggcctccgtgaagaaagatctaatcagctatgggggcggctggcgcttccaagggtcttggaatactggagaggaggtccaggtaatagccgtcgagcctggtaaaaaccccaagaacgtgcagaccacgcccggcactttcaagaccccagaaggcgaggttggagctatcgcactggacttcaagcccggaaccagcgggagtccgatcgtgaaccgtgagggcaagatagtggggctgtacgggaatggtgtggtcacgaccagcgggacttacgtgtccgccattgcccaagcgaaggccagccaagagggccctcttcccgagattgaggacgaggtgttcaagaagcgtaacctgactattatggacctgcacccggggagcggcaagactaggcgctacttgccagccattgttcgggaagccatcaaacgcaagctgcggactctcatcttggcgcccactcgcgtagttgcgtcggagatggcggaagcactgaagggcatgcccattcgctaccagaccaccgctgtcaagagcgagcataccggtcgtgaaatcgtggacctgatgtgccacgcgactttcaccatgaggctactgtccccggtccgtgttcccaattacaacatgatcataatggacgaggcccactttaccgacccggcatccatagccgctcgtggttacatcagcacccgggtgggaatgggcgaagcggccgccatttttatgaccgccacgcctccgggcagcgtcgaggcctttccacagtccaacgcggtcattcaagacgaggagcgcgacatcccagaacggagctggaacagcggctacgattggataacggacttccctggcaagaccgtgtggttcgtccccagcatcaagtccgggaatgacatcgccaactgtctgcgcaagaatggcaagcgcgtcatacagctcagccgcaagacctttgacaccgagtaccagaagacgaagaacaacgactgggactacgtcgtgaccaccgacataagcgaaatgggcgccaactttcgcgccgacagggtgatcgacccacggcgctgcctgaagcctgtgatcctgaaggatggccccgaacgtgtgatactcgcggggccgatgcccgtcaccgttgctagcgccgcccagcggagaggccggatcggacggaaccaaaacaaggagggagaccagtacgtgtacatgggccaacccctgaacaacgacgaggaccacgcccactggacggaggcgaagatgctgctcgataacattaacactcccgaaggtataatcccggcgctgttcgaaccagagcgcgagaagtccgctgccatagacggcgagtatagattgcggggagaggccagaaaaacctttgtggaactcatgcgtcgcggcgacctgcccgtgtggctgagctacaaggtcgcatcggagggctttcaatatagcgaccggcgttggtgcttcgacggggagaggaataaccaggtgctagaggagaacatggacgtggagatctggaccaaggagggcgagcgcaagaagctgcggccccgctggcttgatgctcggacctacagtgatccgctcgccctgcgcgaattcaaggagttcgccgctgggcgccgctccgtcagcggcgacttaatactcgagatcggcaagctgccccagcacctgacgcttcgggcgcagaacgccttagacaatctggttatgctccacaactcggagcagggcggtaaggcgtaccgccacgccatggaggagctgcccgataccattgagacgctgatgctcctggcgctaatcgccgtgttgacggggggcgtcacgctgtttttccttagtggcaagggcctagggaagacctccatagggctgctatgcgtgaccgccagctccgctctcctgtggatggcctcggtggagccccactggatcgcagcatccatcatcttagagttttttctaatggtcctactgatccctgagcccgaccggcaacgcacgccccaggacaaccagcttgcctatgtcgttatagggctgctcttcatgatcctcacggtagcagccaacgaaatggggctactggagacaaccaagaaagatttgggcatagggcatgtagcggcagagaaccatcagcacgcaaccatgttagacgtggacctccggccggccagcgcctggaccctgtacgcggtcgccaccaccgtgataactcccatgatgagacacacgatagagaacaccaccgccaacatttccctgacagccatcgcaaaccaggccgccatccttatgggcctcgacaagggctggcccatcagcaagatggacataggggtgccactgctggccctaggctgctactcgcaggtaaatccgttgacgctgacagcagcggtgttgatgctggtagcccattacgccatcataggcccgggcctgcaggcgaaggccacgcgggaggctcaaaaacgcacagccgctgggatcatgaaaaacccgacggtcgacggcatcgtggccatcgacctcgacccggtggtctacgatgctaaattcgaaaaacagctaggccagatcatgctgttaatcctgtgtaccagccaaatcctgctgatgcgcaccacctgggccctgtgcgagtctattacactcgcgaccgggccgttgacaaccctgtgggaggggagccccgggaagttctggaacactacaatcgccgtatccatggcgaatattttccggggtagctacctggccggcgcggggctcgctttctccctgatgaagtcattaggcgggggccgccggggtaccggcgcgcagggggagaccttaggggaaaagtggaagcgccagctgaaccagttgtcgaagagcgaattcaacacgtacaagcggtcaggcatcatggaggtggaccgctccgaggccaaggagggcctcaagaggggcgaaaccaccaagcacgctgtctcccggggtaccgccaagctgcggtggttcgtggaacgcaacctggtgaagccagagggtaaggtaatcgacttgggctgcgggcgcgggggttggtcctattattgcgccggcttgaagaaagtcaccgaggtgaaggggtacacgaagggcggaccagggcacgaagagccgatacccatggcaacctacggctggaatctagtcaagctacatagcggtaaggacgtttttttcatgccacccgaaaaatgtgacactctactgtgcgacatcggcgagtccagcccgaatccaaccatcgaagaggggcgcactttaagagtgttgaagatggtcgaaccctggctgcgaggcaaccaattctgtattaagatcctgaatccctacatgccttccgtggtggaaaccctcgagcagatgcagcggaagcatggcgggatgttagtccgtaaccccctgagccggaactcgacccatgaaatgtactgggttagctgcgggacggggaatatcgtctccgccgtcaatatgacgagccgaatgctcctgaatcggttcaccatggcgcaccgaaaacccacctatgagcgcgacgtcgacctgggagccggcactcggcacgtggccgtcgaaccggaggtggctaacctcgacatcatagggcagcgcatagagaacatcaagaacgagcacaagtccacgtggcactacgacgaggacaatccgtacaagacctgggcctaccacggatcgtacgaggtgaagccaagcgggtcggcttctagcatggtcaacggcgtggttcggctgctgaccaagccgtgggacgtcatccccatggtgacccagattgctatgaccgacaccacgccgttcgggcaacagcgagtcttcaaagagaaagtggacactcggacgccccgcgccaagcggggcaccacccagatcatggaagtcaccgccaagtggctctgggggttcctgtctagaaacaagaagccacggatctgtactcgcgaagagttcacccggaaagtccgcagcaacgccgcgattggggcggtgttcgtggacgagaaccagtggaatagcgccaaagaggctgtcgaggacgaacggttctgggacctggtgcaccgggagcgggagctccacaagcagggcaagtgcgcgacctgcgtgtacaatatgatgggtaagcgagagaagaagctgggagagttcgggaaggccaaaggctcccgcgccatctggtacatgtggctgggcgcgcgcttcctcgagttcgaagctctggggtttatgaacgaagaccactggtttagccgggagaactccctgtcaggcgtcgagggggaaggcctccacaagctggggtacatcttacgcgacatcagtaagatccccggcggcaatatgtacgcggatgacaccgctggctgggatacgcggattacagaggacgacttgcagaacgaggccaagatcaccgacattatggagcccgagcatgccctgttggctaccagcatattcaaactcacgtatcaaaataaggtggttcgtgttcagcgccctgctaagaacggcaccgtgatggacgtgatcagccggcgcgaccaacggggaagcggtcaggtcggcacctacgggctgaacaccttcacgaatatggaggttcagctgatacgtcagatggaatccgagggcatcttcctccctagcgagctagagacccccaatctcgccgagagggtactcgactggctggagaaacacggggccgagcgtctgaagcggatggccatctccggcgacgactgtgtcgtgaagcccatcgatgaccgcttcgccaccgcgctcaccgctcttaacgacatgggaaaggttcgtaaggatatcccccaatgggagcctagcaagggctggaacgactggcagcaggtcccgttctgctcccaccacttccatcaattaatcatgaaggacggacgcgagatcgtggtgccatgccggaaccaagacgagctagtcgggagagctagagttagccagggcgccgggtggagtttacgcgaaaccgcctgcctgggcaagtcatacgcgcagatgtggcagcttatgtactttcatcggagagacctgcggctcgcagccaacgctatctgcagcgcggtgccagtcgactgggtgcccacgtcacgcaccacctggagcatacacgcccaccaccaatggatgaccacggaagacatgctctccgtatggaaccgggtttggatcgaggaaaacccatggatggaggacaagacccacgtgtcgtcatgggaggaggtaccatatctgggcaaacgcgaggaccagtggtgtggtagcctgatcggcttaaccgctcgcgccacttgggccacgaacatccaggtcgcgataaaccaggtgcgtcgcctgatcgggaatgagaactacctggattatatgacttcgatgaagcggttcaagtcggaatctgaccccgaaggcgccctctggtga

SEQ ID NO: 23931 - RNA, 9879 nt, synthetic construct
  misc_feature 1..9879: note = derived and/or modified CDS sequence (opt11) from DENV-1__EU482616__SS-prME
  source 1..9879: mol_type = other RNA
agtgttaccatgctgttaatgttactgcccactgccttggccttccatctgacgaccagaggaggggagcctcacatgatcgtgaacaagcaggagaggggcaagagcctactgtttaagaccagcgcgggggtaaacatgtgtaccctgattgccatggatctgggcgagctctgtgaggacacgatgacttataagtgccctcaaattaccgaggccgagcccgatgatgtggactgctggtgcaacgcgaccgacacctgggtcacctacgggacctgctcgcagaccggtgagcaccggcgggacaagcgaagtgtagcactggcgccccacgtgggcttgggcctcgaaacccgcaccgagacgtggatgagtagcgaaggcgcctggaagcagatacaacgggtcgaaacgtgggccctgaggcacccagggtttacggtaatagccctgtttctagcgcacgccatcggcacctccatcacccagaaggggataatattcattctgctgatgctcgtcaccccgagcatggccatgcgctgcgtcgggattgggaaccgagacttcgtagaggggctgtccggcgccacgtgggtggatgtcgtgctggagcacgggagctgcgtgaccaccatggccaagaacaagcccactctcgacatcgaactactgaagacggaggtcacgaatccggcgatcctccgaaagttatgcatcgaggccaagatttccaacaccaccacagactctcggtgcccgacccagggtgaggccacgctcgtggaggagcaagatgccaacttcgtgtgccgtcggaccttcgtcgaccgggggtggggtaacgggtgcgggctctttggaaaggggtccttactgacctgtgcgaagttcaagtgcgtaaccaagctcgagggcaaaatcgtccagtatgaaaacctgaagtacagtgtgatcgtgactgtgcacaccggcgaccagcaccaggtcggcaacgagacaaccgagcacggtaccatagcgaccatcacaccccaggcccccacctccgagattcagctgaccgactacggggctctcaccctggattgctctccccggaccggcttggacttcaacgagatggtgcttctgacaatgaaggagaaaagttggctggtacacaagcagtggttcctcgacctacctctgccctggacctccggggcctccacgtcacaagagacctggaacagacaggacctcctggtgacgttcaagaccgcccacgcgaagaagcaggaggtggtcgtcctgggcagccaagagggcgccatgcacacagccctgaccggggcgacggagatccagacctccggcactaccacgatcttcgccgggcacctgaagtgccggctgaagatggacaagttgaccctgaagggcaccagctacgtcatgtgcaccgggagtttcaagctggaaaaggaggttgcggagacgcagcacggtacagttctggtgcaagtcaagtacgaagggactgacgccccctgtaagatcccgttctcgacacaggacgagaaaggagtgacacagaacggaaggttaatcactgcgaacccgatcgtgaccgataaagagaagcccgtcaacatagaaaccgagccgcccttcggggaaagctatatagtggtcggtgccggcgagaaggcgttaaaactgagctggttcaaaaaggggtccagcatcggaaagatgttcgaggccaccgctcggggagcccgtcggatggccatactcggcgataccgcgtgggacttcggcagtatcggcggagtcttcaccagcgtggggaaacttgttcaccaggtcttcgggaccgcatacggggttctgttctccggtgtgagctggaccatgaagataggcatcggcatcttgctcacttggctgggcctcaatagtcgcagtacctccctgtcgatgacctgcatcgcagtcgggatggttacgctgtacctcggcgttatggtccaggcggactccgggtgcgtaatcaattggaagggccgcgagctgaagtgtggctcgggcatttttgtgaccaatgaggtccacacctggacggagcagtacaagttccaggccgactccccaaagcgcctgagtgccgccatcggcaaagcctgggaggagggcgtatgcggcatcagaagcgccacacggctcgagaatataatgtggaaacagatctccaacgagctgaaccacatcttactcgagaacgacatgaaattcacggtggtcgtgggagacgcgaacggcatcctggcgcaggggaagaaaatgatccgccctcagcccatggagcataagtactcttggaagtcctggggaaaggccaagattatcggcgcggatatccagaatacaaccttcataatcgacgggcccgatacaccggagtgtccagacgaccagcgggcttggaacatatgggaagtggaggactatggattcggtatctttacgaccaatatctggttgaaacttcgcgacagctacacccagatgtgtgaccaccggctgatgtccgcggccatcaaggacagcaaagccgtccacgccgatatgggctactggatagagtccgaaaagaacgagacctggaagctggcacgcgcgagcttcatcgaggtgaaaacttgcacatggcccaaatcccacaccctctggtcaaacggcgtgctggagtccgagatgattatcccgaagatatacgggggcccaatcagccagcacaactacagacccgggtacttcacccagacggcaggcccctggcatctggggaagttggaactggacttcgacctctgcgagggcacaaccgtcgtggtggacgaacactgcggcaaccgagggccgtccttaagaaccacgaccgtcaccggtaagataatccacgagtggtgctgccgcagctgcaccctgccgcccctgcggttccgcggggaagacggctgttggtatgggatggagatccgacccgtaaaagagaaggaagagaacttagtgcgctccatggtcagcgccggttccggagaggtggatagctttagcctggggattctgtgcgcatcgattatgatcgaggaggtgatgagaagtcgttggagtcgaaagatgcttatgacaggcactctggccgtcttcttgttactcatcatggggcagctaacctggaacgatctcatccgactgtgcattatggtgggcgcgaacgccagcgaccgcatggggatgggcaccacttacctggccctcatggcaaccttcaaaatgcggcccatgttcgccgtgggactactcttccgccggctaaccagtcgcgaggtcctgttgttaaccatcggcctgtccctggttgccagtgtagagctccccaatagcttagaggagctaggcgacggcctcgccatgggcattatgatgctgaaactgcttacggagttccagccacaccaactgtggaccacactgctttctctgacctttatcaagaccaccttgagcctcgactacgcctggaaaaccactgccatggcgctgtccatcgtctctctgttcccgctttgcctgtccacaacgtcacagaagactacctggctaccggtgctcctgggatccttcggatgcaagcccctgaccatgttcctcatcacggagaataagatctggggccgaaagagctggcccctgaatgaggggatcatggccatcggcatcgtctccatcctgctcagctcccttctcaagaacgacgtgcccctggccggcccgctgatcgctgggggaatgctgatcgcctgctacgtgatcagcgggagctccgccgacctctccctggagaaagccgccgaggtgtcctgggaacaggaggccgagcacagcggcacctcccacaacatcttagttgaggtgcaggatgacgggaccatgaaaatcaaggacgaggagaaggacgacaccctcacgatactgctgaaggccaccctcctggcagtaagcggcgtgtacccaatgtccattcccgccaccctttttgtctggtacttctggcaaaagaagaagcagcgctctggggtcttgtgggataccccctccccgcccgaagtcgagcgggccgtgttggacgacggcatttatagaatcctgcagcggggcctgcttgggagaagccaggtaggggttggggtattccaggacggcgtcttccatacgatgtggcacgtgacacgtggggctgtgctgatgtaccagggtaagcgcctggagccatcctgggccagcgtaaagaaggacctcatctcgtacggcgggggctggcgtttccaggggagctggaatactggggaggaggtgcaggttatcgcggtagagcccgggaagaacccgaaaaacgtgcagaccacgcccgggacctttaagacccccgaaggcgaggttggcgccatcgccctggacttcaagcccggcacttcgggaagcccgatagtcaaccgtgaaggcaagatcgtaggcctgtacgggaacggcgtggtcaccacctccgggacctacgtaagcgcaattgcccaggcgaaagcctcccaggagggccccctccctgagatcgaggacgaggtattcaagaagcggaacttaaccatcatggacttacatccggggagcggaaagacgcgccggtacctccccgcaatcgtccgcgaggcgatcaagcggaagctgagaaccctgatcctcgcgccaactcgggtggtggccagcgaaatggccgaagccctgaagggcatgccgattcgctaccagaccacggctgtcaaaagtgagcacaccggacgcgagatcgtggaccttatgtgccacgcgaccttcacaatgcggctgctgtcaccggtgcgcgtccccaactacaacatgatcataatggacgaggctcacttcaccgacccagcatccatcgccgcccgtggttacatatcgacccgggtggggatgggcgaagcggccgccatcttcatgaccgccacgccgcctggcagcgtcgaggccttcccccaaagcaatgcggttatccaagacgaggagcgggatatacctgagaggtcctggaacagcgggtacgactggatcacggacttccccggcaaaaccgtgtggttcgtgccctccattaagagcgggaacgacatcgcgaactgcctccggaagaacggcaaacgtgtgatccagctcagccggaaaaccttcgacacagagtaccaaaagaccaagaacaacgattgggactacgtcgtgaccacagacatctcggaaatgggtgccaatttccgcgccgatcgggtcatcgacccccgtcggtgcctgaagcccgtgatccttaaggacggccccgagcgggtgatcctcgcggggccgatgcccgtcaccgtggcctccgccgcccagcggcgtggacggataggccgcaatcagaacaaggagggggaccagtacgtttatatgggccaacccctgaacaacgatgaggaccacgcccattggacggaggcgaagatgcttctcgacaacataaatacccctgaggggatcatcccggccctgtttgagccggagcgggaaaaatcggccgccatcgacggggaataccggttacgcggggaggcccgcaagaccttcgtcgagttgatgcgccggggcgacctacccgtgtggctctcgtacaaggtcgccagcgagggcttccagtactcagacagacgttggtgctttgacggggaacgcaacaaccaagtcttagaggaaaatatggacgttgagatctggaccaaggagggcgagaggaagaagttacgtccccggtggcttgacgcccgcacctatagcgaccccctcgccctgcgggagtttaaggagttcgccgctgggcgccgatccgtctcaggggacttaatcttagagattggaaaactgccccagcacttgacgcttcgcgcgcagaacgcgctcgacaacctggtaatgcttcacaatagtgaacagggcggaaaggcgtaccggcacgcgatggaggagttgcctgacaccatcgaaacactgatgcttttggcgctgatagcggtgctcaccgggggcgtcacactattcttcttgtccgggaaaggtctcgggaaaaccagcatcgggctgctgtgcgtgaccgccagttcggccctgttgtggatggcctccgtggagccgcactggatcgcggccagcatcatactggagttcttcctcatggtcctgctgatcccggagcccgaccgccaacgcacgccccaggacaaccagctcgcctacgttgtgatcggcctattattcatgatcttaacggtcgccgcgaacgagatggggctgctggagacgacgaagaaagaccttggtattggccatgtagctgccgagaaccatcagcatgccaccatgctggacgtggacctccgccctgcatccgcttggacgctttacgcggtcgctacgaccgtgatcacacccatgatgagacacacgatcgagaataccaccgccaacatcagcctgacggctatcgccaaccaggcggccatactgatgggcttggacaagggctggcccatctccaagatggacattggggtgccgctgttagcattaggctgctactctcaggtcaaccccctgacactaacagccgcagtgttaatgttagtagcgcattacgccatcattgggccgggcttacaggccaaggccaccagagaggctcagaaacggacagcagccgggatcatgaagaaccccacggtcgacggaatcgtcgctatcgacttggatccggtagtctacgacgccaagttcgagaaacaattgggtcagatcatgctgctaatcctgtgcaccagccagatcctgcttatgcgcacaacgtgggcgctgtgcgagtctatcaccctagccaccgggccgttgaccacgctgtgggaaggcagccccgggaagttctggaacacgaccatagctgtgagcatggccaacattttcagaggctcctacttggctggagcgggtctggccttcagcctgatgaagtccctgggcggagggcggcgcggcaccggcgcccagggcgagaccctcggggagaagtggaagcggcagctcaaccaactttctaaatctgagttcaatacgtacaaacgctcagggatcatggaggtggaccgaagcgaggcgaaggagggactcaagcgcggcgaaaccaccaaacacgcggttagccggggaaccgccaaacttaggtggttcgtcgagagaaacctggtgaagccggaaggcaaggtaattgacctggggtgcgggcgcggagggtggagctactactgcgccggcctcaagaaggtgaccgaagtgaagggatacacgaagggcggccccgggcacgaggagcccatccccatggcaacctacggttggaacttggtcaagttgcactcagggaaagacgtcttcttcatgccgccggaaaagtgcgatacactactatgcgacattggcgagagctcgccaaacccgaccatcgaggagggccggacactgcgcgtgctcaagatggtcgagccttggctgcggggcaaccagttttgcatcaagatcctgaacccctacatgccgtcggtggtggagaccctcgagcagatgcaaaggaagcacggaggcatgctggtccggaatcctctgtcaagaaacagcacccacgagatgtactgggtatcctgcgggaccgggaacattgtgagcgctgtcaatatgacctcccggatgctccttaacaggtttaccatggcacatcggaaacccacttacgagcgagatgttgacttaggcgccggcacaaggcatgtagcagtagagcccgaggtggcaaacctcgacatcatcgggcagcgcatcgagaacatcaagaatgagcacaagagcacgtggcactacgacgaagacaacccgtacaaaacctgggcataccacggctcctacgaggtgaagcccagcgggtccgcgagctccatggttaacggagtggtgaggctgctcaccaaaccctgggacgtgatccccatggtgacccagatcgccatgacggacacgacgccgttcgggcagcagagggtcttcaaggagaaggtggacacccgcacaccccgtgccaagcgcggcaccacccaaataatggaggtgacggcaaaatggctctggggatttttaagccggaataagaagcccaggatctgtacgcgtgaggagttcactcgcaaggtacgttccaacgccgctatcggcgccgtattcgtggacgagaaccagtggaacagcgccaaagaggccgtcgaggacgagcgcttctgggacctagtgcatcgagagcgcgaactacataagcagggaaaatgcgcgacctgtgtttacaacatgatgggaaagcgggagaagaaacttggcgagttcgggaaggccaagggcagccgcgcaatctggtacatgtggctgggggcccggttcttggagttcgaggccctagggtttatgaacgaggatcactggttctcccgcgagaacagcctgtccggcgtcgagggggagggcctccacaagctgggatatatccttcgggatatcagtaagataccgggcggcaatatgtacgcggacgacaccgcggggtgggacacgcgcatcaccgaggacgacctccaaaacgaggccaagatcactgacatcatggagccggagcacgccctgcttgccacctccatcttcaagctaacctatcagaacaaggtggtgcgcgtgcaacgcccggcgaagaatggcaccgtgatggacgtgatcagccgccgggaccagcgcgggtcagggcaagtcggcacctatgggctgaacacgttcaccaatatggaggtgcagctgataaggcagatggaatccgaaggcatattccttccatcggagctggagaccccgaacctagccaagagagtactcgactggctggagaagcatggggctgagaggcttaagcgaatggccatcagcggagacgactgcgtcgtaaagcccatcgacgaccggttcgccacagcgctaaccgccttaaacgacatggggaaggtgcgcaaggacataccacagtgggaaccgtcaaagggctggaatgactggcagcaggtccctttctgcagccatcatttccaccagcttatcatgaaggacggccgtgagattgtggtgccctgccgaaaccaggatgagctcgtcgggcgggccagggtgtcacaaggcgctggttggagcctgcgcgaaactgcctgtttaggcaaatcctacgcgcagatgtggcaactcatgtacttccatcgccgggatctgcggttagccgcaaacgccatctgcagcgcggtcccggtcgattgggtgcccaccagtcgcaccacatggagcatccatgctcaccatcagtggatgaccacggaggacatgctcagcgtgtggaaccgcgtatggatcgaagagaatccgtggatggaggacaagactcacgtctcctcatgggaggaggtgccctacctgggaaaacgggaagatcagtggtgcggctccctgatcggcctcaccgcccgcgccacctgggcgaccaacatccaggttgcgatcaaccaggtgcgccgcctgatcgggaacgagaactacctggactacatgacgtccatgaaacgattcaagaacgagtccgacccagagggcgcactctggtga

SEQ ID NO: 23932 - RNA, 9879 nt, synthetic construct
  misc_feature 1..9879: note = derived and/or modified CDS sequence (opt11) from DENV-1__EU482618__SS-prME
  source 1..9879: mol_type = other RNA
agcgtgaccatgctgctcatgctgctgcccaccgcgctcgccttccacctgactacccgaggcggggaaccccacatgatcgtgagcaagcaggagagaggcaaaagcctactattcaagaccagcgcgggggtaaacatgtgtaccctgatagccatggacctgggcgagctgtgcgaggacacgatgacctataagtgcccccagattaccgaagcagaacccgacgacgtggactgctggtgcaacgccaccgacacgtgggtcacctatgggacctgcagccagactggagagcaccgccgagataaacgctccgttgcactggcgccccacgtgggcctgggactcgagactcggactgagacctggatgagctctgaaggcgcctggaaacagattcagcgcgtcgagacctgggccctgcggcaccccgggttcacggtgatcgccctgttcctcgcgcacgcgatcggcacaagcatcacgcagaaggggatcatatttatcctgctgatgcttgtgaccccttccatggcgatgcgctgcgtcggcatcggcaaccgggactttgtggagggactgagcggcgccacgtgggtggacgttgtgctggaacacgggtcctgtgttaccacaatggccaagaataagcccaccctggacatcgagctgcttaagacagaggtcacaaacccagcgatcctccgcaagctgtgcatcgaggcaaaaatcagcaacaccaccacggactcacgatgccctacccagggcgaggccaccctagtggaggagcaagacgccaacttcgtttgccgcaggaccttcgtcgaccgcggctgggggaatggctgcggactcttcggcaaagggagcctgctaacgtgcgccaagttcaagtgcgtcacgaagctagagggcaagatcgtgcagtatgagaacctgaagtactcagtaatcgtgaccgtgcacaccggcgaccaacaccaggtgggtaacgagacgaccgagcacggaaccatcgcgacaataacgccccaggcaccgacgagcgagatccagctaaccgactacggggcactcacactggactgctcaccacggacgggcctggacttcaatgagatggtgctcctgacgatgaaggagaagtcctggctggtccacaagcaatggttcctcgacctgccgctgccctggacttccggtgccagcaccagtcaggagacctggaaccgacaggatctcctggtgacgtttaaaaccgcccatgcgaaaaagcaggaagtcgtcgtgcttggctcccaggagggcgcaatgcacactgcccttaccggggctacggagatccaaaccagcggcaccaccacgatctttgcaggacacctcaagtgccggctgaagatggacaagctcacccttaagggcacctcctacgttatgtgcaccgggagcttcaagctggagaaggaggtcgcagagacacagcacggaacagtgctggtacaggtgaagtacgagggcacagacgccccgtgcaagatcccctttagtacccaggacgagaagggtgtgacgcaaaacggcaggctaataaccgcgaacccgatcgtgactgacaaggagaagccggtcaacatagagaccgagccacccttcggggaaagctatatcgtggtcggcgccggtgagaaggcgctaaagctctcctggtttaagaaagggagctccattggcaagatgttcgaggcgacggcacgtggggcccgccggatggccattctcggcgacaccgcgtgggacttcggtagcatcggcggcgtcttcacctccgtggggaagctggtgcaccaagtgttcggcaccgcctacggggtgctgttctcaggtgtttcctggacgatgaagatcggcatcggcatactcctgacctggctaggcctcaactcacgctccacgtctctgtccatgacatgtatagccgtcgggatggttacgctgtacctcggggtcatggtccaagccgactctgggtgcgtgataaactggaagggccgcgagttaaagtgcgggtccggtatcttcgtgaccaatgaggtccacacctggaccgagcagtacaaattccaggccgacagcccgaaacggctgagcgcggctatcggcaaggcctgggaggagggggtgtgcggcatccgctccgccacccgactcgagaacatcatgtggaagcaaatcagcaacgagctgaaccacatcctgctcgagaacgacatgaagttcacggtggtcgttggggacgccaacggcatcctggcgcaggggaagaagatgatacgcccccagcccatggagcacaagtactcctggaagtcttggggcaaggccaagatcatcggcgccgacatccagaacactaccttcattatcgacgggcccgacaccccggagtgccccgataaccagcgggcctggaatatctgggaggtggaggattacgggtttgggatcttcacgaccaatatctggctgaagctccgcgacagttacacacagatgtgtgaccaccggctgatgagcgcggctatcaaggactccaaggccgttcacgccgacatgggctactggatcgagtcagagaagaacgagacttggaagctggccagggcgagcttcatcgaggtgaagacatgcacctggccgaaatcacacaccctctggtccaacggcgtgttggagagcgagatgatcatacctaagatttacgggggccccatctcccaacacaactatcggcccgggtacttcacccaaacggccggcccctggcacctggggaagctcgagttagacttcgacctgtgcgagggcaccaccgtggtagtggacgagcactgcggcaaccgggggccgagtctccggaccacgaccgtaacgggcaaaataatccacgagtggtgctgtcgctcctgcacacttccgccgctccggttccgcggggaggacggctgctggtacgggatggaaatccggcccgtcaaagagaaggaagagaacctcgtccgcagtatggtctccgccggcagcggggaggttgattccttctccttagggatcctgtgcgccagcatcatgattgaggaggtgatgcggtcccgctggtctcgtaaaatgctcatgacgggcaccctggccgttttcctgctcctgatcatggggcagcttacctggaacgatcttatcagactgtgcatcatggtgggcgctaatgcctccgaccgcatggggatgggcaccacgtaccttgccctcatggccaccttcaagatgcggccgatgttcgccgtggggctgctgtttcgcagactcaccagccgcgaagtcctgctgctgacgattgggctgtccctggtggcgagcgtggaactacccaactcactggaggagctgggcgacgggcttgctatgggcattatgatgctgaagctgctcacggagttccagccccaccagctgtggacgaccctgctgagcctgactttcatcaagaccacgctttccctcgactacgcgtggaagaccaccgccatggccctgagcatcgtctccctgttccccctctgtctgtcaacgacctcccagaagaccacttggctgccggtgcttctgggcagcttcgggtgcaagcccctgaccatgttcttgatcacggagaataaaatctggggccggaaatcctggcccctaaacgaagggatcatggccatcgggatcgtgtctatcctgctctccagcctgttgaagaacgacgttcccctcgccgggccattgatcgccgggggcatgttgattgcgtgttacgtgatcagcgggagcagcgcggacctgtccctggagaaggcagccgaggtcagctgggaacaggaagccgagcacagcggcaccagccacaacatcctggtggaggtgcaggacgacggcaccatgaaaatcaaggacgaggaacgcgacgacaccctcacgatccttctgaaggccaccctcctggcggtctctggggtgtatcctatgagcatccccgccacactgttcgtgtggtatttctggcaaaagaagaagcagcgctccggggtcctctgggacacccccagccctcccgaggtggagcgcgccgtgctggacgatgggatttaccggatcctgcagcgcggcttactcggccggagtcaggtcggcgtgggggtgttccaggatggcgtcttccacacgatgtggcacgtaacccgcggggccgttctgatgtaccaagggaagcggctggagcccagctgggcctccgttaagaaggacctcatcagctacggcgggggctggcgcttccaggggtcctggaacaccggcgaagaagtccaggtgatcgcggtggagccagggaagaaccccaagaacgtgcagaccacgccgggcacgtttaagacccccgaaggcgaggtgggggcaatcgccctggactttaagcccggcaccagtggttccccgatcgtcaaccgggagggcaagatcgtgggcctgtacgggaacggcgtggtgacgaccagcgggacttacgtgtcagccatcgcccaggcgaaagccagccaagagggccccctcccagagatcgaggacgaggtgttcaagaagcgcaacctgaccataatggacctgcacccggggagcggcaagacgcggcgctacctgcccgctattgtccgggaggcaatcaaacggaagctgcggaccttaatacttgcgcccacccgcgtggtggcctccgagatggccgaggcactgaagggcatgcccatacgctaccagactacggccgttaagagcgagcatactgggcgggagatcgtagaccttatgtgccatgcgaccttcaccatgcggctcctgtccccggtgcgggtccccaactataacatgatcataatggacgaggcgcatttcacagatcccgcgagcatagccgctcgcggctacatctccacccgggtaggtatgggagaggcggccgcgatttttatgactgccacaccgcccgggtctgtggaggccttcccccaatccaacgcggtcatccaagacgaggagcgcgacatccccgagcggagctggaattctggatacgactggatcacggacttccccggcaagaccgtgtggttcgtgcccagcatcaagtccgggaacgacatcgccaactgcctacgcaagaacggcaagcgggtcattcagctcagccgcaagacctttgacaccgagtatcaaaaaacgaagaacaacgactgggactacgtggtgaccaccgacatctcggagatgggggccaacttccgagccgaccgcgtcatcgacccccggcgctgcctgaagccggtgatcctgaaagatggccccgagcgggtaatcctcgccgggccgatgcccgtcacggtggcatcggccgcccagcgacggggccgtatcggccggaatcagaacaaggagggagaccagtacgtgtacatgggccaacccctgaacaatgatgaagatcacgctcattggacggaagcgaagatgctgctcgacaacataaacacccccgaggggatcatcccggccttgttcgagcccgagagggagaagagcgccgccatcgacggcgagtacagactccgcggggaggcccgcaaaacctttgtagagctcatgcgacgcggcgatctgcccgtgtggttgagctacaaggtcgcgtccgagggcttccagtatagcgaccggcgctggtgtttcgacggggagcggaacaaccaggttctcgaggagaacatggacgtggagatctggacgaaggagggcgagcgcaaaaagctgaggccccgctggctggacgcccggacctactccgatccgctcgccctgcgcgagttcaaggagttcgcggccggtcggcgaagcgtctcaggcgacctgatcctcgagattggcaagctgccgcaacacctgacgctccgggcgcagaacgctctggacaacctagtaatgctccacaattccgagcagggtgggaaagcctaccgccacgccatggaggagctgcccgacacgatcgagaccctgatgctcttagcgctgatcgccgtgctcaccggcggcgtcacgctgttcttcctgtccggtaagggcctcggcaagacctccatcgggctgttgtgtgtgaccgcctcttccgcattgctgtggatggccagcgtagaaccccattggatcgcggcctccatcatcctggaatttttcctcatggtcctgctgatcccggagcccgaccggcaacgcacgccccaggacaatcagctcgcctacgtcgtaatcggcctgttattcatgatcctcactgtcgccgccaatgagatggggctgctggagacgaccaagaaggacctgggcatcgggcacgtggcggccgagaaccaccagcacgccacgatgctggacgtggatctgcggccggccagcgcgtggaccctctacgcggtcgcgaccaccgtgatcacgcccatgatgaggcacacgatcgagaacaccactgccaacatctcccttaccgctatcgctaatcaggctgccatactgatgggcctggataagggctggcccatcagtaaaatggatattggagtgcccctgctggccctcggctgctactcccaggtgaatccgctgactctaacggccgcggtgctcatgctggtggctcattacgccatcatcggtcccggattacaggctaaggccactcgggaggcgcaaaagcgcaccgccgccggaatcatgaaaaaccccacggtcgacggcatcgtagccatagacctcgacccagtggtctacgacgccaagttcgagaagcagctgggccagatcatgctgctcatcctgtgcaccagccagatcctgctcatgcgcaccacctgggcgctgtgcgagtccatcacgctagcaaccgggcccctcaccacactctgggagggcagccccgggaaattctggaacacgaccatcgcggtgtcaatggccaacatctttcggggtagctacctggccggagcgggactcgccttctccctgatgaagtccctgggcgggggccgccgggggaccggagcccagggcgagaccctcggggagaaatggaaacgccagctgaaccagttatccaaaagtgagtttaatacgtacaagcggagtggcatcatggaggtggaccgctccgaggccaaggaggggctcaagcgcggcgagacaacaaagcacgcggtcagcagaggtactgctaagctgcggtggttcgtggaacgcaacttggtgaagcccgagggcaaggtcatcgacctgggctgcgggcggggcggctggtcctactactgcgccggactcaagaaggtgaccgaggtaaagggttacactaagggcggtcccgggcacgaggagcccatccccatggccacctacgggtggaatcttgtgaaactgcactcggggaaggacgtgttctttatgccgcccgagaagtgcgataccctcctgtgcgatatcggcgagtccagcccgaaccctaccatagaggaggggcgcacgctgcgggtactcaagatggtcgagccctggctgcgcggcaaccagttctgcatcaagatcctgaacccctacatgccgtccgtggtggagaccctcgagcagatgcagcggaagcacggtggcatgctagtccgcaaccccctgagccggaactccacccacgagatgtactgggtgtcctgcggaacggggaacatagtgtccgccgtcaacatgacgagccgcatgctcctgaaccgtttcaccatggcgcaccgcaagcccacctacgagcgcgacgtggacctgggagccggcacccggcacgttgccgttgaacccgaggtggcgaacctcgacatcatcggccaacgcatcgagaacataaaaaatgaacacaaatctacttggcactacgacgaggacaacccgtacaagacgtgggcctaccacggatcgtacgaggtgaagccatccgggagcgcgtcctcgatggtcaatggcgtggtgcggctgctgaccaagccatgggatgtcatcccaatggtgacccagatcgcgatgactgacacaacgccgtttgggcaacagcgcgtcttcaaggaaaaagtggacacccgtacacctcgggccaagcggggcactacccagatcatggaggtgaccgccaagtggttgtggggcttcctttcccgcaataaaaagccccggatctgcacgcgcgaggagttcacccggaaagtccgcagcaacgccgccatcggtgccgtgttcgtggacgagaatcaatggaacagcgccaaggaggccgtcgaggacgagcggttctgggatctggtgcaccgcgagcgggagctccataagcaaggcaagtgtgccacctgcgtttataacatgatggggaagcgcgagaagaagctgggcgagttcgggaaggccaagggatcacgagccatatggtatatgtggctgggcgcccgcttcttggagtttgaggcgctggggttcatgaacgaggaccactggttcagccgggagaacagtttaagcggcgtcgagggggagggcctccacaagctggggtacatcctgcgcgacatatccaagattccaggcggcaatatgtacgcagatgacaccgctggatgggatacgcgaatcactgaggacgaccttcagaatgaggccaagatcacggacatcatggaacccgaacatgcgttactggctaccagcatcttcaagctcacttaccagaacaaggtggtgcgcgtccagcgccccgcgaagaacggcaccgtgatggacgtgatctcccggcgcgaccagcggggaagcggccaggtcggcacgtacggactgaacacctttaccaatatggaggtgcagctgatcaggcagatggagtccgaggggatcttcctacccagcgagttggagacgccgaacctggcagagcgggtgctcgattggctggagaagcatggggcagaacgcctcaagcggatggccatcagcggggacgactgcgtagttaagcccatcgatgaccgcttcgccacagcgctcaccgcgcttaacgacatggggaaggtgcggaaggatatcccccagtgggagcccagcaagggctggaatgactggcagcaggtccctttttgctcacaccacttccatcagctgatcatgaaggacggccgcgagattgtggtaccctgcaggaaccaggacgagctagtcgggcgcgcccgggtgtctcagggcgccggatggtcccttcgcgaaaccgcttgcctgggcaagagctacgcgcagatgtggcagctcatgtactttcaccgccgcgacttgcggctggccgccaacgctatctgctccgcggtgcccgtcgactgggtgcccaccagtcgcacaacctggtctatccatgcccaccaccagtggatgaccacggaggacatgctctccgtgtggaaccgggtctggattgaagagaacccgtggatggaggacaagacccacgtgagctcgtgggaggaggtgccctacctgggaaagcgcgaagaccagtggtgcggcagcctaatcggcctaaccgccagagctacgtgggccacgaatattcaagtcgcgatcaaccaggtgcggcgcctgattgggaacgagaactacctggactacatgacatccatgaaacggttcaagaacgagtccgaccccgagggcgcgttatggtag

SEQ ID NO: 23933 - RNA, 9879 nt, synthetic construct
  misc_feature 1..9879: note = derived and/or modified CDS sequence (opt11) from DENV-1__EU482619__SS-prME
  source 1..9879: mol_type = other RNA
agcgtgacaatgctgctgatgctgctgcccaccgccctcgctttccacctgacgacacggggcggggagccccacatgatcgtgagtaaacaggagcggggcaagtctctcttattcaagaccagcgcgggggtcaatatgtgcaccctgatcgccatggacctcggcgagctctgtgaggacaccatgacctataagtgcccccagataactgaagcggagcccgacgacgtggactgctggtgcaatgccacagacacctgggtcacctatgggacctgcagccagaccggcgagcaccggcgggacaaacgctcagtggcgctggctccccacgtgggtctggggctcgagacgcggacggagacctggatgagcagtgagggcgcctggaagcagatccagcgcgtagagacctgggccctgcggcacccagggttcacagtgatcgccctgttcctcgcgcacgccatcggcaccagcattacccagaaagggattatcttcatcttgctgatgctcgttactccctccatggccatgcggtgtgtcggcatcggcaaccgggacttcgtggaagggctaagcggcgccacgtgggtagacgttgtgctggagcacgggtcctgcgtaactaccatggccaagaacaagcccaccctcgacatcgagctactgaagacggaggtcactaaccccgcgatcctccgcaagctgtgtatcgaggccaagataagcaacaccacgacggactcccggtgccctacccagggagaggccaccctggtggaggagcaggacgccaacttcgtgtgtcgccggacgttcgtcgacagagggtggggtaatggctgcggcctcttcggtaaggggagcctgctgacgtgtgcgaagttcaaatgcgtgaccaagctcgaaggcaagatcgtgcagtacgagaacctaaagtacagtgtcatcgtgaccgtgcacaccggcgaccagcaccaggtcgggaatgagacaaccgagcatggcactatcgctaccatcacgccccaggcccccacgagcgagattcagttgaccgactacggggccctcaccctggactgcagcccccgcaccggcctagatttcaacgagatggtgctcctgacaatgaaggaaaagtcctggctggtccacaagcaatggttcttggacctgccgctgccctggacctccggagcaagcacaagccaggagacctggaacagacaggacctcctcgtgacctttaagaccgcacacgcgaagaagcaggaggtggtagtgctgggcagccaggaaggcgccatgcacacggcccttaccggtgccacggagatccagaccagcggcaccaccaccattttcgccgggcacctgaagtgccgtttaaagatggataagctcaccctgaagggcacctcctacgtgatgtgcaccgggagcttcaagctggagaaggaggtcgcggagactcagcacggcaccgtgcttgtgcaggtgaagtacgaggggaccgacgccccctgcaagatccctttctccacacaagacgagaaaggggtgacacaaaacggccgcctcatcaccgccaaccccatcgtgactgacaaggagaagcccgtcaacatcgagaccgagccgcccttcggggagtcttacatcgtggtgggagccggcgaaaaggcgctgaagctgtcctggttcaagaaagggagctccattggcaagatgttcgaggccacggcccgcggggcgcgccgtatggctatcctcggcgacacagcgtgggatttcgggagcatcgggggcgtcttcacctccgtggggaagctggtgcaccaggtcttcggcaccgcctacggggtcctattcagcggcgtgtcctggacgatgaagatcgggatcggcatactcctaacctggctgggactgaactcccgctccaccagcctgtccatgacctgcatcgccgtcggtatggtaacgctgtacctcggcgtgatggtgcaggcggatagcgggtgcgtgatcaactggaagggccgcgagctcaagtgcgggtccggcattttcgtgaccaacgaggtccatacctggaccgagcagtacaagttccaagcggactctccgaagcggctgagcgcggccatcggcaaggcctgggaggagggggtgtgcggtataagatccgcaacacggctcgagaacatcatgtggaagcagataagcaacgaactaaaccacatcctgctcgagaacgacatgaagttcacggtggtcgtgggggacgccaacggcatcctggcacaagggaagaagatgatccgtccccagccaatggaacacaagtactcctggaagtcctggggcaaggccaagatcatcggcgccgacatccaaaacaccacgttcataattgacggacccgacacaccggaatgccccgacaaccagcgggcctggaacatctgggaggtggaggactacggcttcgggatcttcaccaccaacatatggctgaaactccgcgactcctacacccagatgtgcgaccaccggctgatgagcgcggccatcaaagactccaaggctgtccacgcagatatgggctactggatcgagagcgagaagaatgagacctggaagctagcccgagcgagcttcatcgaggtgaagacgtgcacctggcccaagagccacaccctctggtccaacggagtgctggaaagcgaaatgatcatccccaagatctacgggggaccgatctcccagcacaactaccggcctgggtactttacccaaacggccggcccctggcacttggggaagctcgagctggacttcgatctgtgcgagggcaccaccgtcgttgtggatgagcactgcggaaaccgagggcccagcctccggactacgaccgtgaccggcaagatcatccacgagtggtgctgccgttcctgcaccctgccgcccctgcggttccgcggggaggacggatgctggtacgggatggaaatccggccggtgaaggagaaggaggagaatctcgttaggagcatggtcagtgctgggtccggtgaggtggattcgttctcacttggaatcctgtgcgcctcgatcatgatcgaggaagtgatgcgaagtcgctggagccggaagatgctcatgacgggaaccttagccgtcttcctgctcctcataatggggcagttgacctggaacgatctcatccgcctgtgtattatggttggtgcaaacgcctccgaccggatggggatgggcacaacgtacctagcactcatggccacatttaagatgcgaccgatgtttgccgtggggctgctgttccgccggctcactagccgcgaggtcctgctattaaccatcgggttatccctggtagctagcgttgagctcccgaactccctggaggagttgggcgacgggctcgccatgggtatcatgatgctaaaactgctcacggaattccagcctcaccagctgtggaccaccctgttgagtctgaccttcatcaagacgaccctttccttagactacgcgtggaagaccaccgctatggctctgtcgatcgtctccctgtttcccctttgtctgtccacgacctcacagaagacaacctggctgccggttctcctgggcagcttcgggtgcaaacccctgaccatgttcctcatcacggagaacaagatctggggccggaagtcctggcccttaaatgaggggatcatggccatcggcatcgtcagcatcctgctatcaagcctactcaagaatgacgtgcccctcgccgggccgctgatagccggcgggatgctcatcgcctgctatgttatcagcgggtccagcgcggatctctccctggagaaggccgccgaggtcagctgggagcaggaggccgagcactccggcaccagccacaacatactggtggaagttcaggacgacggaacgatgaagattaaggatgaggagcgcgacgacaccctgacgatcctgctgaaggccacgctcctggcggtctccggcgtgtacccaatgagcatccccgccaccctgttcgtatggtacttctggcagaagaagaaacagcgctccggggtcctctgggatacacccagcccgcccgaagtggagcgcgccgtgctggatgacggcatctatcggatcctgcagcgcggactactggggcggtcccaggtcggagtgggggtgttccaggatggcgtcttccacacgatgtggcacgttacccgcggggcggtgctgatgtaccagggcaagcgactggaaccgagctgggcctccgtgaagaaggacctcatcagctacggtgggggctggcgcttccaggggtcctggaacaccggcgaggaggtccaggtgatcgcggtcgagcccggtaaaaacccgaagaacgtgcagactacgcccggaacctttaagacccccgagggcgaggtgggggcgatcgccctggatttcaagcccgggacctctgggtccccgatcgtcaatcgggagggcaagattgtgggtctgtacggtaatggcgtggtgacaaccagcggaacctatgtgtccgccatcgcccaggccaaagccagccaggaaggaccgctccccgagatcgaggacgaggtattcaaaaagcgcaacctgactatcatggacctgcacccggggtcaggcaagacccggcgctacctcccggccatagtgcgggaggcaatcaagcgcaagctgcggaccttaatcctcgcgcccacccgcgtggtggcctccgagatggccgaggccctgaaggggatgcccatcaggtaccagaccacggccgtcaagtccgagcacaccgggcgggagatcgtagacttaatgtgccacgcaaccttcaccatgcgcctcctgagcccggtgcgggtccccaactacaacatgatcatcatggatgaagcccacttcacggatccagccagcatcgccgcccggggctatatctccacccgggtagggatgggcgaggcagccgccatcttcatgaccgcaacaccgcccgggtcagtcgaggccttcccccagtccaacgcagtcatccaggacgaggagcgcgacatccccgaacgtagctggaactccggctatgactggatcacggactttcccggcaaaactgtgtggttcgtgcccagcatcaagtccggaaacgacatcgccaactgcctgcgcaagaacggcaagcgggtcatccagctcagccgcaaaacctttgacaccgaataccagaagacgaagaataacgattgggactatgtggtgaccaccgacatctccgagatgggtgccaacttccgcgccgaccgcgtcatcgacccccggaggtgccttaagcccgtcatcctgaaggatggccccgagcgggtgatcctcgcggggcctatgcccgtcaccgtggccagcgcggcccagcgccgtggcagaatcggacggaaccagaacaaggagggggatcagtacgtatacatgggacagcccctcaacaatgacgaggaccatgcccactggacggaggcgaagatgctactcgataacatcaacacccccgaagggattatcccggccttatttgagcccgaacgcgagaagtccgccgccatagacggcgagtaccgcctgcgcggtgaggcccgcaaaacctttgtcgagctcatgcggcggggcgacctgccggtatggctgagctacaaggtcgcgtccgagggcttccagtacagcgaccggagatggtgcttcgacggggagcgtaacaaccaggtgctcgaggagaatatggacgtcgagatatggaccaaggagggcgaacgcaagaagttacgaccccggtggctggacgccaggacctattccgacccgctcgccctgcgcgagttcaaggagttcgcggccgggcggcgcagcgtctccggcgacctgatcctggagatcggcaagctgccccaacatttgacgttacgggctcagaacgccctcgataacctggtcatgctccacaactccgagcagggcgggaaggcctaccgtcacgccatggaggagttacctgacaccatcgaaaccctgatgctcctagcgctgatcgctgtgctcaccgggggcgttacgctgttcttccttagcgggaagggcttggggaagacatccatcgggctgctgtgcgtgaccgcgtcctccgcgctcttatggatggcgagcgtagaaccccactggatagcggcctccatcatcctggagttcttcctaatggtcctgctgatcccagagcccgatcggcagcgcacgccccaagacaaccagctcgcctacgttgtgatcggcctgttatttatgatcctcacggtcgccgccaacgagatgggactgctggagaccacaaagaaggatctcgggatagggcacgtggcggcagagaaccaccagcacgcgaccatgctggacgtcgacctgcggccggccagtgcctggacgctctacgcggtcgccactaccgtgatcacccccatgatgaggcacaccatagagaataccaccgcgaacatctcactgaccgccatcgccaaccaggcggccatccttatgggcctcgacaagggctggcccatcagcaaaatggacataggcgttcctctgctggctctcggctgctacagccaggtcaacccgctgacgctgaccgccgcggtgttaatgctggtggcccactacgccatcatcgggcccgggctgcaggccaaggccaccagggaggctcagaagcgcaccgccgccgggataatgaagaaccccacggtcgacggcatcgtggccatcgacctcgaccccgtggtctacgatgccaagttcgagaaacagctaggccagatcatgctgctcatcctgtgcaccagccaaatcctgctcatgcgcaccacctgggcgctgtgcgagtccatcacgctagctactgggccgctcaccactctgtgggaaggctcgcccgggaagttttggaatacgaccatcgccgtgtccatggcaaacatctttcggggctcgtacttagccggcgcggggctggccttctcccttatgaagtcccttggcgggggcagacgggggacaggcgcgcagggagagacccttggtgagaagtggaagagacaactgaaccagttgtccaagagcgaatttaacacgtacaagcggtcgggaatcatggaagtggaccgatccgaggcaaaggagggcctcaagcggggcgagaccaccaaacacgcggtaagccgcgggaccgccaagctacggtggttcgtggagcgcaacttagtgaaacccgagggcaaggtcatcgatctcggctgcggccggggcgggtggtcctactactgcgccggcctcaagaaggtaaccgaggtgaagggatacacaaaggggggccccggtcacgaagagccgattcccatggcaacctacggctggaacttagtcaagctacacagcgggaaggacgtcttcttcatgccgcccgagaagtgcgacaccctcctttgcgacatcggtgaatcctctccgaaccctaccatcgaggaggggcgcacgctgcgggtcctcaagatggtcgagccgtggctgcgcggcaaccagttctgtataaagatactaaacccctacatgccgtccgtagtggagaccctcgagcagatgcagcggaagcacggcgggatgcttgtgcgcaacccgctgtctcggaactccacccatgagatgtactgggtgagctgcggcaccgggaatattgtttctgctgtaaacatgacgtcacgcatgctcctgaaccggttcaccatggcgcacagaaagcctacctacgagcgcgacgtagacttgggagcaggtacccggcatgtggccgtcgagcccgaggttgcgaacctagacatcatcgggcagcgcatcgagaacattaagaacgaacataaatccacgtggcattacgatgaagacaacccgtacaagacctgggcctaccacggcagctacgaggtgaagccttccgggagcgcatctagcatggtcaacggcgtggtgcggttattaaccaaaccctgggacgtcatccccatggtcacccagatcgccatgaccgacaccacccctttcgggcagcagcgcgtcttcaaggagaaggtagacacgagaacaccccgcgccaagcggggcaccacccagatcatggaggtgaccgcgaagtggctctggggcttcctgtcccgcaacaagaagccgcggatctgcacgcgtgaggagttcaccagaaaggtccgcagtaacgcggcgattggggccgtgttcatcgacgagaatcagtggaacagcgccaaggaagccgtggaggacgaacggttctgggacctagtccacagagagcgggagctccacaagcagggcaaatgcgctacctgtgtgtataacatgatgggaaaacgcgaaaagaagctcggcgagttcgggaaagctaagggctcccgggccatctggtatatgtggctgggcgcacgcttcctcgagtttgaggccctaggtttcatgaacgaggatcactggttcagccgggagaactccctgagtggcgtagagggggagggcctccataagcttgggtacatcctgcgcgacatatccaagatcccgggcggcaacatgtacgcggacgacaccgccgggtgggacacgcgtgtaaccgaggacgacctacagaacgaggccaagatcaccgacatcatggagccagagcacgccctgctggccaccagcatcttcaaactaacataccagaacaaggtggtgagggtccaacgccctgcgaagaacgggaccgtcatggacgtaatctctcgacgcgaccagcgggggagcggccaggttgggacctatgggctgaatacatttacgaacatggaggtgcagctgatccgccaaatggagtccgagggcatcttcctcccttccgagttggagaccccgaacctggccgagagagtgctcgactggctggagaagcacggggccgagcggctgcggcgaatggccatctccggcgatgactgcgttgtgaagcccatcgacgaccggttcgccaccgctctcaccgcccttaacgacatggggaaggtgaggaaggatatcccccagtgggagcccagcaagggctggaacgactggcagcaagtcccgttctgctcccaccacttccaccagctgatcatgaaggacggcagagaaatcgtggtgccctgtaggaaccaggacgagctcgtcgggcgggcacgagttagccagggagccgggtggtccctccgagagaccgcatgcttaggcaagagctacgcgcagatgtggcagctgatgtacttccaccgtcgtgacctgcgcctggccgccaatgccatctgctccgcggtgccagtcgactgggtgcccacgtcacggacgacctggtcaatccacgcccatcaccagtggatgaccaccgaggatatgctgtccgtgtggaaccgcgtctggatagaggagaacccgtggatggaggacaagacacacgtgagctcctgggaggaggtgccgtacttagggaagcgcgaggaccaatggtgcggcagcctgattggcctcaccgcccgggccacgtgggccacgaacatccaagtcgcgatcaaccaggtccgccggctgatcgggaacgagaactacctggattacatgacctccatgaagcgcttcaagaacgagtcagatcccgagggcgctctctggtga

SEQ ID NO: 23934 - RNA, 9879 nt, synthetic construct
  misc_feature 1..9879: note = derived and/or modified CDS sequence (opt11) from DENV-1__FJ898433__SS-prME
  source 1..9879: mol_type = other RNA
agcgtgacgatgctgctcatgttgcttcccaccgctttggctttccacctgacgacccggggcggggagccccacatgatcgtgagcaagcaggaacggggcaagagcctcctcttcaagacgtctgccggggtgaacatgtgtaccctgatagccatggatctgggcgagctctgcgaggacaccatgacttacaaatgccctcaaatcacggaggcagagcccgacgacgtggactgctggtgcaacgccaccgatacgtgggtcacatacgggacctgcagccagacgggtgagcaccgtcgggagaagcgatcagtggccctggcgccccacgtgggcctggggctcgaaacgagaactgagacctggatgagttctgagggcgcgtggaagcagatccagcgggtcgagacctgggcactgcggcaccccggcttcacggttaccgctctgttcctcgcgcatgccatcggcacctcaatcacccaaaaggggatcatcttcatcctgctgatgctcgttactcccagcatggctatgcgctgtgtagggatcggcaatcgggacttcgttgaaggcctcagcggcgccacctgggtggatgtcgtactggaacacgggtcctgcgtgactaccatggcaaaaaacaagcccaccctcgacatcgagctgctgaagaccgaggtcaccaaccccgcgatcctccgcaagctgtgcatagaggccaagatcagcaacacaactacggactcccggtgccccacccagggcgaggccactctggtcgaggagcaagacgcgaactttgtgtgtcgacgtacgttcgtcgatcgcggctggggcaacggctgcggcctcttcggcaaagggagcctcctgacatgtgccaagttcaaatgcgtgaccaagctcgagggcaaaatcgtgcaatatgagaacctgaagtactccgtcattgtgacggtgcacacgggcgaccaacaccaggtcggcaacgagaccaccgagcatggcaccatcgcgaccatcacgccacaggcccccaccagcgagatccaactgaccgactacggggccctcaccctagactgctcaccgaggacgggtttagacttcaacgagatggtgctcctcacaatgaaggaaaagtcctggttagtccacaagcagtggttcctcgacttaccactgccctggaccagcggggccagcaccagccaagagacgtggaatcgacaggacctccttgttaccttcaagaccgcccacgcgaagaagcaggaggtggtagtgctgggctcccaagagggcgccatgcataccgccctcacgggtgccaccgagatccagaccagcggtaccacaaccatcttcgctggacacctgaaatgccggctgaagatggataagctcaccctgaagggcacctcctacgtgatgtgcactgggtccttcaagctggagaaggaggtagcggagacccagcatggcacagtgctggtgcaggtgaagtacgagggcaccgacgcgccctgcaagatccccttctccacccaagatgagaagggggtgacgcagaatggccgactcattacggccaacccgatcgtgaccgacaaagagaaacccgtgaacatcgagacggagccacccttcggggagagctacatcgtggtgggcgccggcgagaaggctctgaagctgtcttggttcaagaaagggtcatccatcggcaagatgttcgaggccaccgcccgcggggcgcgacgtatggcgatactgggggacaccgcttgggacttcggatccatcggaggcgtcttcacctccgtgggaaagctggttcaccaggtcttcggcacggcttacggggtgctgttcagcggcgtgagttggaccatgaaaatcgggatcggtatcctcttgacctggctgggcctcaactcacgctccacatcactgtccatgacgtgcatagccgtcgggatggtgaccctgtacctcggcgtgatggtgcaggccgacagcgggtgcgtcatcaactggaagggccgtgaattaaagtgtgggtccggaattttcgtgaccaacgaggtacatacctggaccgagcagtacaagtttcaggccgacagcccgaagcggcttagcgcggctatcggaaaggcgtgggaggagggcgtctgcggcatcaggtccgccacgcggctggagaacatcatgtggaagcagatcagcaacgagctgaaccatattctgctcgagaacgacatgaagttcaccgtggtcgtcggggacgccaacggcatcctggcgcaggggaagaagatgattcgtccccaacccatggagcacaagtattcctggaagtcctggggtaaggccaagatcatcggagcggacattcagaacaccaccttcatcatcgacggacctgacaccccggaatgccccgacaaccagcgggcctggaacatctgggaagtggaggactacgggtttggcatcttcacaaccaacatctggctgaagctacgggactcctacactcaaatgtgcgaccatcggctgatgagcgcagcaattaaagactccaaggccgtccacgccgacatgggctactggatcgagtcagaaaaaaacgaaacttggaagttagcccgcgcgagttttatcgaggtgaagacctgcacctggcccaagagccatacgctctggtccaacggcgtattagaaagcgagatgatcatcccgaagatctacggggggccgatctcacagcacaattatcggccgggctacttcactcagaccgccggcccctggcacctggggaagctcgagctggacttcgactcctgcgagggcaccacggtggtcgtggatgagcactgtggcaacagagggccgtcgttaagaacgaccactgtcaccggcaaaatcatccatgaatggtgctgtaggagctgcacgctgccgccacttcggttccgcggggaggacggctgttggtacgggatggagatcaggccggtgaaagagaaggaagagaacctggtgcggagcatggtcagcgctggcagcggtgaagtggactccttcagtctcggaatcctgtgcgtgtccatcatgatcgaagaggtgatgcggagccgctggtcccgcaagatgctgatgactggtaccttagccgtttttcttctgttaattatggggcagctgacctggaaggacttgatccgcctctgcatcatggtgggcgccaacgcgtcggaccgcatggggatgggtacgacctacctggcgctgatggccacctttaagatgcggccgatgttcgccgtaggcctcctgtttaggcggctgacatcccgcgaagtgctcctgctgacgatcgggctcagcctggtggcctccgtcgagctacctaacagcctcgaagaactgggcgatggcctggcgatgggaatcatgatgctcaagctgctgacagagttccaccctcatcagctctggaccacgctgttgtccctaacgttcataaagaccaccctctcgctggactatgcatggaagaccacggcaatggcattgtcaatcgtgagcctgttcccactctgcttatcgacaacgtcgcagaagaccacctggctgccggtcctgctcgggtccttcgggtgtaagccactgacgatgtttctcatcaccgagaacaagatctggggccgcaaaagctggcccctcaacgagggcatcatggcgatcggcatcgtgtccatcttactgagcagcctcctgaagaatgatgtgcccctggcaggacctctcatcgccggcggaatgctgatcgcgtgctacgtaatctccggttcgtccgctgacctgagcttggagaaggcggccgaggtgtcctgggagcaggaggctgagcatagcggtacttcccacaacatcctggtggaggtacaggacgacgggacaatgaagataaaggacgaggagcgcgacgacacgttaaccatactcctcaaggctaccctgctagcagtgagcggcgtataccccatgtcgatccccgcgacactcttcgtctggtacttctggcagaagaagaagcagcgtagcggggtcctgtgggacacaccctcaccacccgaagttgagcgcgccgtgttggacgacggcatctaccgtatcctgcaacgtggcctgctgggccggagccaagtgggcgtcggggttttccaggacggagttttccataccatgtggcacgtgacccgcggggccgtcctcatgtaccagggcaagcggctggagccgtcctgggccagcgtgaaaaaggacctgatctcctacggcgggggctggcgtttccaggggagctggaacaccggagaagaggtgcaggtaatcgccgtggagcccgggaagaatccgaaaaatgtgcagacaacccccggcaccttcaagacacccgagggtgaagtcggggcgatcgccctcgatttcaagcccggcacgtccggttcaccgatcgtgaaccgggagggaaaaatcgttggcctgtacggtaacggcgtagtgaccacctccgggacgtacgtcagcgcgatcgcccaggcaaaagcgagccaggagggccccctgcccgaaattgaggacgaggtcttcaagaagcgcaacctaacgatcatggaccttcacccggggtccggcaaaaccagaaggtacctgcccgccatcgtgcgtgaggccatcaagcgcaagttgaggaccttgatcctggcacccacccgcgtggtcgcgagcgagatggccgaggccctaaaaggcatgcccatccggtaccagacgaccgccgtgaagtccgagcacaccgggcgagagatcgtggacctgatgtgccatgccaccttcacgatgcgccttctgagcccggtacgcgtgccaaactacaacatgatcataatggacgaggcacacttcacagaccccgcttctatagccgcccggggctatatcagcacccgggtggggatgggcgaggccgcggccattttcatgacggccacgcccccaggctcagtcgaagccttcccccagagcaacgccgtgatccaggatgaggaaagggacatccccgagaggagctggaacagcggctacgactggatcaccgactttcccggcaagactgtgtggttcgtaccctccattaaaagcggaaatgacattgctaactgtctgcgcaagaacggcaagagagtgatccagctcagccggaaaaccttcgacacggagtaccagaagaccaagaacaacgattgggattatgtggtaaccaccgatatcagcgaaatgggggccaacttccgggccgaccgcgtgatcgacccccggagatgcctcaagcccgtgattcttaaggacggacccgagagggtcatcctggccgggcctatgcccgtgacggtggcgagtgccgcccagcgtcggggccgcatcggccggaaccagaacaaggagggtgaccagtacgtatacatgggccagcccctcaacaacgatgaggaccacgcccactggaccgaggccaagatgctgctggacaacattaacacccccgaggggatcattccggccctcttcgagcccgagcgcgagaagagcgccgccatcgatggcgagtaccgcctgcgcggggaagcaaggaagacctttgtggaattaatgcggcgcggcgacctccccgtatggttatcctacaaggttgcctctgagggcttccagtacagtgatcggcgctggtgcttcgacggggaacgtaacaaccaagttctggaggagaacatggacgtagagatctggaccaaggagggcgaacgcaaaaagctaaggccccggtggctggacgcgcggacttacagtgacccgctggcccttcgcgagttcaaggagttcgccgctgggcggcgcagcgtgagtggggacctgatcctggaaatcggaaaactcccccagcatttgactctgcgggcccagaacgcgctcgacaatctggtgatgctgcacaatagcgagcagggcgggaaggcctaccgccacgcgatggaggagcttcccgacaccatcgagaccctgatgctactcgctctgatcgcggtcctgaccggaggggtgaccctgttcttcctgtccggaaaagggctgggcaaaaccagcattgggctcctgtgcgtgaccgcgtcctctgccctgctgtggatggccagtgtcgagccccactggatagccgctagcattatcctggagttcttcctgatggtgctcctgataccagagcccgaccggcagcgcacgccccaagacaaccagctggcctacgtggtcatcggcctccttttcatgatcctgaccgttgccgctaatgagatggggctactggagaccaccaagaaggatctgggaatcggtcacgtggctgcagagaaccaccagcacgccacgatgctcgacgtcgatctgcggccggcctccgcctggacactgtacgcggtggcgactaccgtgattacgcccatgatgcgccacacaatcgaaaataccaccgccaacattagcctcacggccatcgctaaccaggccgcgatactgatgggactcgataagggttggcccatctctaagatggacataggtgttcccctccttgccctgggctgctacagccaggtgaacccgttgacgctgacagccgccgtgctgatgctcgtcgcgcactacgccatcattggacccggcctgcaggctaaggccaccagggaagcccagaagcgtacggcggccgggattatgaagaaccctacggtggacggcatcgtggccatcgacctagatcccgtcgtgtacgatgccaagtttgagaagcagttgggccaaattatgctgctgattctatgcacctcccagatactgctgatgaggactacttgggccctctgcgagagcattaccctggcgacgggaccgctcaccacgctctgggaaggctcaccagggaagttctggaacaccaccatcgccgtgagcatggccaacatattccgcggaagttacttggcgggcgccgggttagcgttcagcctcatgaagtccctgggtggggggagacggggtacgggagcacagggcgagacgctcggggagaaatggaagcgtcaactcaatcagctgagcaagagcgaattcaacacctacaagcggtctggcatcatggaggttgacagaagtgaggccaaggaggggcttaaacggggcgagactaccaagcacgccgtgtcccgcgggacggcaaagctgcgatggttcgtggagcgcaacctagtcaagcccgagggcaaagtgatcgacctgggctgcggccggggagggtggtcatattattgcgccggcttaaagaaagtgactgaggttaaggggtacaccaaagggggcccagggcacgaagagccgatccccatggccacatatggttggaacctggtgaagcttcactccgggaaggacgtgttcttcatgcctcccgaaaagtgcgacaccctgctctgtgatatcggcgaaagctcccctaatcctacgatcgaagaagggcggaccctgcgcgtcctaaaaatggtggagccgtggctccgcggcaaccagttctgcataaagattctgaatccttacatgcctagcgtggtcgagaccctggagcaaatgcagcggaagcacggcgggatgctcgtgcgcaaccccctgtcccgtaattccacccatgagatgtactgggtgagctgtggcacaggaaacatcgtcagcgcagttaacatgacctcccgcatgctgctcaaccgctttaccatggcgcaccgcaagcccacctacgagaaagacgtggacctgggcgcgggtacgagacacgtcgccgtggagccagaggtggccaacctcgacataatagggcagcggatcgagaatatcaagaacgagcacaagagcacctggcattacgacgaggacaacccgtataagacctgggcgtaccacggctcctacgaggtgaagcccagcgggtccgcctcttccatggtgaacggcgtggtccgactcttaacaaagccctgggacgtgataccgatggtcacgcagatcgcgatgaccgacacaaccccgttcgggcaacagcgggtgtttaaggagaaggtggacacacgtacaccccgggccaagcgcggcaccacccagatcatggaggtcaccgcgaaatggctgtggggcttcctctcgcgaaacaagaaaccccgaatatgcacccgggaagagttcacacgcaaggttagatcgaacgctgccatcggggcggtgttcgtcgatgagaaccagtggaactccgccaaagaggcagtggaggacgagcgcttctgggacctggtgcaccgggagcgcgagctgcacaaacaaggcaagtgcgccacctgtgtctacaacatgatggggaagcgggagaagaagcttggcgagtttgggaaagcgaagggcagccgtgcaatatggtacatgtggctgggcgcccggtttctagagttcgaggccctagggttcatgaacgaggaccattggttctctcgcgagaatagcctatccggcgtggagggggagggccttcacaagctcggctacattctgcgggacatcagcaagattccgggcggcaacatgtacgccgacgacacggctgggtgggacacccgcatcaccgaggatgacttacagaatgaggccaagataaccgacatcatggagcccgagcacgctcttctggccacgtctatctttaagctgacttaccagaacaaggtggtcagggtgcaacgccccgccaagaacgggaccgtcatggacgtcatctccagaagagaccagagggggtcgggccaggtgggcacatacggcctcaatacgttcaccaacatggaggtgcagctcatccggcagatggagagcgagggaatcttcttaccctccgagctcgaaaccccgaacctcgcggaacgcgtccttgattggctcgggaagcacggagccgagcggctgaagcgcatggctataagcggggacgactgcgtggtgaagcccatcgacgaccgatttgccaccgcactgaccgcgctgaacgacatgggcaaggtccgcaaggacatcccccagtgggagccatccaaaggctggaacgactggcagcaagtacccttctgcagccaccacttccaccaattaatcatgaaagatgggagggagatcgtggtcccctgcaggaatcaagatgaactggtgggccgggcccgcgtgtcgcagggggccggctggtccctgaaggaaacggcctgcctggggaagagctacgcccagatgtggcagctgatgtacttccaccggcgtgacctccggctggcggcaaacgccatctgcagtgctgtccctgtggactgggtgcctaccagccgcaccacctggtctatacacgcgcaccaccagtggatgacgaccgaggacatgctgagcgtctggaatagagtgtggatcgaggagaacccgtggatggaggacaagacccatgtgtcctcgtgggaagaggtcccctacctcgggaagcgcgaggaccagtggtgcggctccctgatcgggctgaccgcccgggccacgtgggccaccaacattcaggtggccatcaatcaggtacgccgactcatcggcaatgagaactacctggactacatgacaagtatgaaacggttcaagaacgagtccgaccccgagggcgcgttgtggtga

SEQ ID NO: 23935 - RNA, 9879 nt, synthetic construct
  misc_feature 1..9879: note = derived and/or modified CDS sequence (opt11) from DENV-1__FJ547088__SS-prME
  source 1..9879: mol_type = other RNA
agcgtcaccatgctgctcatgttacttccgaccgcactcgctttccacctgactacccggggcggcgagccccatatgatcgtgagcaagcaggagcggggcaagtcgctactcttcaagaccagcgccggggtcaacatgtgcaccctgatcgcaatggacctgggagagctttgtgaggatactatgacgtacaagtgcccacagatcaccgaagccgagccagatgatgtggactgctggtgcaacgccacagacacttgggtcacctacgggacgtgctcacagaccggggagcaccggcgggataagcgctccgtggccctcgcgccccacgtgggcctggggctcgagacgaggacagagacctggatgagctccgagggcgcctggaagcagatccagcgcgtcgagacttgggccctgcggcaccccgggttcacggtgatcgccctattcctcgcgcacgccatcgggaccagcattacccagaagggtatcatattcatcctgctgatgctcgtgacaccctccatggccatgcgctgcgtaggcatcggtaacagggatttcgtggaggggctgtctggcgccacctgggtcgacgtcgtgctggagcatggatcgtgcgtcaccaccatggccaagaataagcccaccctcgacatcgagttactgaaaacggaggtaaccaatcccgcaatactgcgtaagctgtgtatcgaggctaagatcagcaacaccaccacggactctcggtgcccgacccagggggaggccacccttgtggaggagcaggacgccaacttcgtgtgccgccggacgttcgtcgaccgcggctgggggaacggctgcggcttatttggcaagggaagcctgttaacgtgcgcaaagttcaagtgcgtgaccaaactcgagggcaagatcgttcaatacgagaacttgaaatactccgtcatcgtgaccgtgcacacaggcgaccagcaccaggttggtaacgaaacgaccgaacacggtaccatcgcgaccatcacgccccaggcaccgacgagcgagatccagctgaccgattacggggccctcacgctggactgcagcccccggaccggccttgatttcaacgagatggtgctcctgaccatgaaggaaaagtcctggctcgtccacaagcaatggttcctcgacctgcctctgccctggacctccggggccagcaccagccaagagacctggaaccgacaggacctcttggtgacgttcaagaccgcccacgccaagaagcaggaggtagtagtattgggctcccaggagggtgcaatgcacaccgccctcaccggggcaacggagatacagacaagcggtaccaccacgatcttcgccgggcatctgaagtgccggctgaaaatggacaagttgaccctgaagggtacttcctatgtcatgtgcaccgggtccttcaagctggagaaggaggtcgcggagacgcagcacggcaccgtgctggtgcaggtgaagtatgaaggcacagacgccccctgcaagatccccttctctacccaggacgagaagggggtgactcaaaatggccgcctgatcaccgccaacccgatcgtaaccgacaaggaaaagcccgtgaacatcgagaccgagccgcccttcggcgagtcgtacatcgtcgtgggcgccggcgagaaggcactgaagttaagctggttcaaaaaggggagctccatcggcaagatgttcgaggccacggcccgcggggcccgccggatggcgatcctcggggataccgcgtgggacttcgggagcatcgggggcgtcttcacctccgtgggaaagctggtgcaccaggtcttcggcaccgcctatggggtgctgttcagcggcgtatcctggaccatgaagatcgggatcggcatcctccttacttggctaggactaaatagccgttcgacgagcctttccatgacgtgcatcgctgtcgggatggtgactctgtacctcggagtgatggtccaggccgatagcgggtgcgtgatcaactggaagggcagagagcttaagtgcgggtccggtatctttgtgaccaacgaggtccacacttggaccgagcagtacaagttccaggccgacagcccgaagcggctgagcgcggccatcggcaaggcctgggaagagggggtgtgtggcatccgctccgccacacggctcgaaaacatcatgtggaaacagatcagcaacgaactgaaccacatcctgcttgagaatgacatgaagttcacagtggtcgtgggggacgcaaacggcatcctggcgcaggggaagaagatgattcgcccccagcccatggagcacaagtactcctggaagtcctggggcaaggccaagattatcggcgccgacatccagaacaccacctttatcatcgacggacccgataccccggaatgccccgataaccagcgggcctggaacatctgggaggtggaagactacggctttggtattttcacgactaacatatggctgaagctcagagactcctacacccaaatgtgcgaccatcgactgatgagcgctgccatcaaggattcgaaggccgtccacgccgacatgggttactggatcgagagtgagaagaacgagacctggaagctggcacgcgcttccttcatcgaggttaagacgtgcacgtggcctaagtctcacaccttgtggtctaacggagtcctggagagcgaaatgatcatccccaagatctacgggggcccgatatcccagcacaactaccggcccgggtacttcacccagacggctgggccctggcacctgggaaagctcgagcttgatttcgacctctgcgagggcaccaccgtcgtggtcgacgagcactgcggcaatagagggcccagcttgcggaccactaccgtcacaggcaagataattcacgagtggtgctgccgcagttgcaccctgccgccccttcgctttcggggggaggacggctgctggtatggtatggagatccggccggtgaaagagaaggaagagaacctcgtgcgcagcatggtctccgccggcagcggcgaggtcgacagcttctccttggggatcctgtgcgcctctatcatgattgaggaggtgatgcggtcccgctggagccggaagatgctcatgacgggaaccctggccgtcttcctgttactgatcatgggccaactcacctggaacgacctcataagactgtgcatcatggtgggggcgaatgcatccgataggatgggaatgggcacaacctacctggccctcatggccacgtttaaaatgcgcccgatgttcgcggtgggcctgctgtttcgccgactcacctcgcgcgaagtccttctgctcacaattgggctgtccttggtagccagcgttgaactgcccaactccctcgaggagttgggcgatgggctcgctatgggcatcatgatgttaaagctgctcacggagttccagccccaccagctgtggaccaccttgctcagccttaccttcatcaagaccacccttagcctcgactacgcctggaaaaccaccgccatggcgctcagcatcgtgtctctgttcccgctctgtctaagcacgacctcgcagaaaaccacttggctgccggtgctcctgggcagcttcggttgcaagccactgacaatgttcttgatcacagagaacaagatctggggtcggaaatcctggccattgaacgaggggatcatggcgatcgggatcgtcagcattctgctgtccagcctgctgaagaacgatgtgcctctcgcaggtccgctgatcgcgggcggcatgctgatcgcctgctacgtgatcagtgggtcaagcgcggacctctccctggagaaggctgccgaagttagctgggagcaggaggccgagcactctggcacaagccacaacatccttgtggaggtgcaggacgatgggaccatgaagatcaaggacgaggagcgcgacgacaccctcacgatactgcttaaggccacccttctggcagtatccggcgtttatcctatgagcatcccggccaccttgttcgtgtggtatttctggcagaagaagaaacaacggtccggggtactttgggacacccccagcccacccgaggtggagcgcgccgtcctcgacgacggaatctaccggattctgcaacgcggcctgctcgggcgatcacaggtaggagtgggggtgttccaggacggtgtcttccacaccatgtggcacgtcactcgcggcgccgtgctgatgtaccagggcaagcggctggagccgagctgggcgtccgtcaagaaggacctcatcagctacggcggaggttggcgcttccagggatcctggaacaccggcgaggaggtccaggtaatagcggtcgagcccggcaagaacccgaagaacgtacagacgacgcccggtaccttcaaaaccccggagggcgaggtaggggctatcgccttggacttcaagcctggcacctccgggtccccaattgtcaaccgggaagggaagattgtgggcctgtacggtaatggagttgtcacaaccagcgggacctatgtttctgccatcgcccaggcgaaggccagccaggaaggccccctccccgagatcgaggacgaggtcttcaagaagcgcaacctcaccatcatggacctgcacccggggagcggaaagacgcggcgctacctccccgccattgtgcgggaggccatcaagcgcaagctgcggaccctgatcttggcgcccacgcgagtggtggcttccgaaatggccgaagctctgaaaggtatgcccatccgatatcagaccacggccgtcaagagcgagcataccggacgcgagatcgtggacctaatgtgccacgcgaccttcaccatgcgccttctgtcacctgtgcgggtaccgaattacaacatgatcattatggacgaggcccacttcacggaccccgcgtccatcgccgcccgcggctacatctccacgcgggtggggatgggcgaggctgccgcgatctttatgactgccacgcctcccgggtcagtggaggccttcccccagtccaatgcggtcatccaggacgaagagcgcgacattcccgagcgatcgtggaactccggctacgactggatcacagacttccccggcaaaaccgtatggttcgtgcccagcatcaagtccgggaacgacatcgcaaactgcctaagaaaaaatggcaagcgtgtcatccagctctcacgcaagacctttgacaccgagtaccagaaaacgaagaataacgactgggactacgtggtgacaacggacatctccgaaatgggggccaacttccgggccgaccgcgtcatcgaccccaggcgctgcctgaagcccgtgatcctgaaggatggccccgagagggtgatcctcgcggggcccatgcccgtcaccgtggccagcgccgcccagcgacggggacgcattggccgtaaccagaacaaggagggggatcagtacgtgtacatgggccagccactgaacaacgacgaggaccatgcccactggacggaggcgaagatgctgctcgacaatatcaataccccggaaggcatcataccggcgctgttcgagcccgagcgtgagaaatccgctgccatcgacggcgagtacaggctgcgcggggaggcacgcaagactttcgtggagttaatgcgccgtggcgacttgccagtgtggctgagctacaaagtcgcgtcggagggcttccagtactctgaccgacgctggtgcttcgacggagagcggaacaaccaggtgctggaagagaacatggatgtggagatttggaccaaggaaggtgagagaaagaagctgcgtccacgctggctggacgcccgtacctactccgacccgctcgcgctgcgcgagttcaaggagttcgccgctggccggcgcagcgtcagcggcgatctgattctcgagatcggcaaactgccccagcacctgacgctccgcgctcagaatgctctggacaacctggtgatgctacacaactccgagcaagggggtaaagcctaccgccacgccatggaggagctgcccgacaccatcgagacgctgatgctactggcgttgatcgccgtgctcaccggcggcgtcacactgtttttcttaagcgggaagggcctcggcaagactagcatcgggctcctgtgcgtgaccgctagcagcgccctcctttggatggccagcgtcgagccgcactggattgcggcctccatcatcctggagttcttcctcatggtccttctaatccccgagcccgaccgccagcgcacgccacaagacaaccagctcgcttatgtggtaatcggcttgctgttcatgatcctcacggtcgccgccaacgagatggggctgcttgagaccaccaagaaggacctcggaatcggacacgtggcggccgaaaaccaccaacatgccaccatgctggacgtggacttacggccggcgagcgcctggacgctatacgccgtcgccacaacagttatcacccccatgatgcgccacacgatcgagaacaccacagccaacatctccctgaccgccatcgctaaccaagcggccatcctgatgggcctggacaaaggctggcccatctcgaagatggacattggagtgcccctgcttgctctcgggtgctacagtcaagtaaacccgttgacgctgactgcggcggtgctcatgctggtagctcactacgccatcatcggccccggcttacaggccaaggcgacccgggaggcccagaagcgcaccgccgcagggatcatgaaaaaccccacggtcgacgggatagtggctatcgacctggaccccgtcgtgtacgacaccaaatttgagaaacagttaggccagatcatgttgctcatactttgcacgagccagatcttactcatgcgcaccacgtgggccctctgcgagtccatcaccctggcgacggggcccctaaccacgctatgggagggcagccccgggaagttctggaacaccaccatcgccgtgtccatggcgaacatcttccgtggctcgtatctggccggcgcagggctcgcgttctccctgatgaagtccctgggcggaggccggcgcgggactggcgcgcagggtgaaacactaggagagaaatggaaacggcaactgaaccaactgagcaagtcagagttcaacatatataagcggtccggcataatggaggttgaccgctccgaggccaaggaggggctcaaacgaggcgaaaccaccaaacacgccgtcagccgcggtaccgcaaagctgcggtggttcgtggagcgcaacctggtcaagccagagggaaaggtgatcgacctgggctgcgggcggggcggttggtcctactactgtgctggcctaaagaaggtgactgaggtgaaggggtacactaagggcggtcccgggcatgaggagccaatccccatggccacctacggatggaacctggttaagctccacagcggtaaagacgttttcttcatgccgcccgaaaagtgtgataccctcctctgtgatatcggcgagtccagcccgaaccccaccatcgaggaggggcggacgctgcgggtgctcaagatggtcgagccatggctacgcggtaatcaattctgcatcaaaatcctcaacccctacatgccgtccgtggtggaaaccctcgagcagatgcagcggaagtacggcgggatgctcgtccgcaaccccctgagccggaactccacccatgagatgtattgggtgagttgcggcacgggcaacatcgtgtccgccgtcaacatgacctcgcgcatgttactgaaccgcttcaccatggctcaccgcaagcccacctacgagcgcgacgtggacctgggcgcgggcacccggcacgtagctgtagagcctgaggtggccaaccttgacatcatagggcagcgcatcgagaacattaagaacgagcacaagtccacctggcactacgatgaggataacccgtacaagacctgggcctaccacgggagctacgaggtgaagccttccgggtctgcctccagtatggtcaacggcgtcgtgagactgctgaccaagccctgggacgtcattcccatggtaacccagattgcgatgacggacaccactccattcgggcagcagcgcgtcttcaaggaaaaggtcgacacccggacgccccgcgccaagcggggcaccacccagatcatggaggttaccgccaagtggctctggggcttcttatcccgcaataagaaaccccggatatgcacgcgcgaggagttcacccggaaggttcgcagcaacgccgcgatcggggcggtcttcgtggacgaaaaccagtggaacagcgccaaggaggccgtcgaagacgagcggttttgggacctggtgcatcgtgagcgggaacttcacaagcaagggaagtgtgcgacttgcgtgtacaacatgatggggaagcgagagaagaagctgggtgagttcgggaaagccaagggttcgcgggctatctggtatatgtggctcggcgctcgctttctagagttcgaggccctggggtttatgaatgaggaccattggttcagccgggagaactccctgagcggcgtagagggggagggcctccataagctggggtatattctgcgcgatatatccaagatcccgggcggcaacatgtacgccgacgacaccgctgggtgggacacgcggatcacggaggacgacctccagaacgaggccaagatcaccgacatcatggagcccgaacacgccctgctcgcaacctctattttcaagctgacgtaccagaacaaggtggtgcgcgtccaacgaccggccaaaaacggaactgtgatggacgtaatctccagacgcgaccagcggggctccggccaggtgggcacttacgggctaaataccttcacgaacatggaagtgcagcttatccgtcagatggagtccgagggcatcttcctgccctcagagctggaaacaccgaatctggctgggcgggtgttggactggctggagaagcacggggccgagcgacttaaacggatggccatctctggagatgactgcgttgtgaagcctatcgacgacagattcgccaccgccctcactgctctgaacgacatgggcaaggtccggaaagacatcccgcagtgggagccctcgaagggctggaacgactggcagcaggtcccgttctgctcccaccatttccaccagttaatcatgaaggacgggcgcgagatcgtggtgccctgccggaaccaggatgagctagttggccgtgcccgtgtgtctcagggggccggctggagcctgcgcgagacagcctgcctgggcaaaagctacgcccagatgtggcagctcatgtacttccaccgccgcgacctgcggttagcggccaacgccatatgctcagccgtgcccgtggactgggtacccacgagccgcaccacctggagcatccacgcgcaccaccagtggatgaccacggaggacatgttgagtgtgtggaaccgggtctggattgaagagaacccctggatggaggacaagacccacgtcagctcctgggaggaagtgccgtacctcggcaaaagggaggaccagtggtgcggcagcctgataggcttaacagcccgcgccacctgggccacgaacatccaggttgccatcaaccaggtgcggaggttgatcggcaatgagaactacctggactacatgacaagcatgaagcgcttcaagaacgagagcgacccagagggcgcgttatggtga

SEQ ID NO: 23936 - RNA, 9879 nt, synthetic construct
  misc_feature 1..9879: note = derived and/or modified CDS sequence (opt11) from DENV-1__FJ810419__SS-prME
  source 1..9879: mol_type = other RNA
agcgtgaccatgctgttgatgctgctgcctaccgccctagccttccatttaaccacccgaggcggggagccccatatgattgtgagcaagcaagagcggggcaagagcctccttttcaagacgagcgcgggggtgaatatgtgcaccctgatcgccatggatttaggcgagctctgcgaggacacgatgacctataaatgcccccagatcaccgaggcggaacccgacgacgtggactgctggtgcaatgcaaccgacacctgggtcacctacgggacctgctcccaaaccggcgagcaccggcgggacaagcggtccgtggccctggctcctcacgtgggacttggactcgagacgcggactgagacgtggatgtcctccgagggcgcctggaagcagatccagcgcgtcgagacttgggcactgcgccacccgggcttcacggtgatcgcccttttcctcgcgcacgccatcggtaccagcataacccagaagggcattatattcattctgctgatgctcgtgacccccagcatggccatgcggtgcgtcgggataggtaaccgggacttcgtggagggattgagtggtgccacgtgggtcgacgttgtgctggagcatgggtcctgcgtgaccaccatggctaagaacaaacccaccctggacatcgagctcctaaagacggaggtcaccaaccccgcgatcctccggaaactgtgtatagaggccaagatctcaaacaccaccacggactcccggtgcccgacccagggcgaggccaccctggtggaggagcaagacgccaacttcgtctgccgccgtaccttcgtagaccgcggctgggggaacggctgcgggctcttcggcaaggggagcctgctaacttgtgctaagttcaagtgcgtgaccaagctcgagggcaaaatcgtgcagtacgagaacctgaaatactccgtcatcgtgaccgtacacacgggcgaccagcaccaagtcgggaacgaaacaaccgagcacggcactatagcgaccatcacgccacaggcccccacgagcgagatccagctgaccgactacggggctctcaccctcgactgcagcccccggactggcctggatttcaacgagatggtgctcctgacaatgaaggagaagtcctggctggttcacaagcagtggttcctcgacctccccctgccttggacgtccggggccagcaccagccaagagacatggaaccgccaagacctcctggtgacgttcaagaccgcccacgctaagaagcaggaggtggtggtgctggggtcccaggaaggggccatgcacaccgccctcaccggcgccacggaaatccagactagcgggaccacaacgatctttgccgggcacctaaagtgccggctgaagatggataagctcaccctaaagggaacctcctacgtgatgtgcaccggtagcttcaagctggagaaggaggttgctgagacgcagcatgggactgtgttggtgcaggtcaagtacgaagggaccgacgccccctgtaaaatcccgttttccacccaggacgaaaagggcgtgacgcagaacgggcgactcatcaccgccaatccgatcgtgaccgacaaggagaaacctgtcaacatcgaaaccgagccgccctttggggaaagctacattgtggtgggggcaggagagaaggcgctaaagttgtcctggtttaagaaagggagttccattggcaagatgttcgaggccacggctcgcggtgcccggaggatggccatcctcggcgacaccgcgtgggactttgggagcatcggcggagtcttcacctccgtgggtaagctggtgcaccaggtgtttggcacggcgtacggtgtgctgttcagcggggtgtcctggacaatgaagatcggcataggcattctcctgacctggctgggcctcaacagccgatccacatcactctccatgacctgcatcgcagtcgggatggtaacgctttacctcggcgtgatggtccaggccgacagcgggtgcgtgatcaactggaagggccgcgaacttaagtgcgggtcagggatcttcgtgaccaacgaggtacatacttggaccgaacaatacaagttccaagccgattcaccgaagcggctgtcggcggccatcggcaaggcctgggaagagggggtgtgcgggattcgctccgccacccggcttgagaacatcatgtggaagcagatctcaaacgagctgaaccacatcctgctcgagaacgacatgaagtttactgtggtcgtgggggatgccaacggtatcttagcgcaggggaaaaaaatgattcgcccccagcccatggagcacaaatactcctggaagtcctgggggaaggcgaagatcataggcgccgacatccaaaacaccacctttataatagacgggcccgacaccccggagtgccccgacaaccagcgagcctggaacatttgggaggtggaggactacggcttcgggatcttcacaaccaacatatggctaaagctccgcgactcctacacccagatgtgtgaccacagactgatgagcgcggccatcaaggactccaaggccgtccacgccgacatgggatactggattgagagcgagaagaacgagacctggaagttagcccgagcaagtttcatcgaggtgaaaacgtgcacctggcctaaatcccacaccctctggtccaatggggtactggagagtgaaatgatcattcccaaaatctacgggggcccgatctcccagcataactaccgccccgggtacttcacccagacggcaggcccctggcacctggggaagctcgagctggacttcgacctatgtgagggcacaaccgttgtggtggacgagcactgcgggaaccgcgggccgagcctccggaccacgacagtcaccggcaagatcatacacgaatggtgctgccgctcctgcaccctaccgcccctgcggtttagaggggaagacgggtgctggtacggcatggagatccggcccgtgaaagagaaggaggagaacctcgtgcgcagcatggtctctgcaggcagcggcgaagtggacagcttctccctgggaatcctctgtgctagcatcatgatcgaggaggtgatgcggtcccgttggagtcggaagatgctcatgaccggcaccctggccgtcttcttgctccttatcatgggacagctcacctggaatgaccttatccgcctgtgcatcatggtgggtgcgaacgcctccgatcgaatgggaatgggcacgacgtatttggccctcatggccaccttcaaaatgcggccgatgtttgccgtgggactgctgttccgccggttaacgtcgcgcgaggtcctgctgcttaccatcggcctgtccctggtggcgtccgtagagctgcccaactccttagaggaactaggcgacgggctcgcaatgggcatcatgatgctgaagctgctcacggaattccagccccaccagctctggaccaccctgctgagcctgaccttcattaagacgaccctgagcttggactacgcctggaagactaccgccatggcgctgagcatcgtttcccttttccccctctgtctgagcacgacctcccagaagacaacttggctgcccgtcctcctgggcagcttcgggtgtaaacccctgaccatgttccttataacggagaacaagatatggggccggaagtcctggcccctgaacgagggtatcatggcgatcggcattgtcagcatcctgctctccagccttttgaagaacgacgttcctctcgcggggccgctcatcgccggcggcatgctaatcgcctgttacgtgatcagcgggtccagcgcagacctcagcctggagaaggccgccgaggtgagctgggaacaggaggcggagcattccggcacctcgcacaatatcctggtagaggtgcaggatgatggaaccatgaagatcaaggacgaagagcgcgacgataccctcaccatcctgctgaaggcaaccctcctggcggtcagtggcgtgtaccctatgagcatccccgcaaccttattcgtgtggtacttctggcaaaagaagaagcaacgctccggggtactctgggatacaccgagcccgccggaggtggagagagccgtgctggatgacggcatctaccggatcctgcagcgagggttactcgggcggtcccaggtcggtgtgggggtgttccaggacggtgtcttccacacgatgtggcacgtgacccgcggggccgtgctgatgtaccagggcaagcggctggagcctagctgggcgtcggtcaagaaggacttgatcagctacggcgggggctggcgttttcaagggtcctggaacaccggcgaggaggtccaggttatcgcggtcgagcccggaaagaatccaaagaacgtgcaaaccactcccggcaccttcaaaaccagcgagggcgaggtgggagccatagcactggacttcaagccgggcacatctgggagccccatcgtcaatcgggagggtaagatcgtgggtctgtacggcaacggtgtggtcacgacaagtggaacctacgtgagcgccattgcccaagcgaaggcctcccaggagggcccgctgcccgaaatcgaggatgaagtgttcaagaagcgcaacctgaccatcatggacctgcaccccgggtccggcaagacacgccgctatcttccggccatcgtccgggaggccatcaagcgcaagctccggaccttgatcctggcgcctacgagagttgtggccagcgagatggccgaggcccttaagggcatgcccatccgctaccaaacaacggccgttaaatccgagcacacagggcgtgagatcgtggacctaatgtgccacgcgaccttcacaatgcgcctccttagccccgtgcgggtgccgaactacaacatgatcatcatggacgaggcgcactttacggaccccgcttccatcgccgcgcgcggctatatcagcacgcgggttgggatgggagaggcagccgctatcttcatgaccgcaacgccgcccggttccgtggaggcttttccgcagagcaatgccgttatacaggacgaggagcgcgacatccccgagaggagttggaacagcggctacgactggattacggacttccccggaaagacggtgtggttcgtgccctccatcaagagcggtaacgatatcgcgaactgcctgcgcaagaacggcaagcgggttatccagttgtcgcgcaagacctttgacaccgagtaccagaaaacgaagaacaacgactgggactacgttgtcacgacggacatcagcgagatgggggctaacttccgggccgaccgcgtcatagacccacggcgctgcctgaaacccgtcattctgaaggacggccccgagcgggtgatcttggcggggcccatgccggtcaccgtagccagtgccgcccaacgccggggccgaattggccggaatcagaacaaagagggcgaccagtacgtgtacatgggccagccgctcaacaatgacgaggaccacgcacactggacggaagcgaaaatgctgctcgacaatatcaacacccccgagggcatcatccctgctctgttcgagcctgagcgcgagaagtccgctgctatagacggcgagtaccgcctgcgcggcgaggcgagaaagacctttgtcgagctcatgcggcgcggcgatctgcccgtttggctgtcctacaaggtcgcgagcgagggcttccaatattccgatcggcgctggtgcttcgatggggagcggaataaccaggtgctcgaggaaaacatggacgtcgaaatctggaccaaggagggcgagcgcaagaagttacgacctagatggctggacgccaggacctatagcgacccgctcgccttacgcgaattcaaagagttcgccgccgggcggcggagcgtgtcaggagacttgatactcgagattggcaagctgccgcagcacctgacgctacgggcgcagaacgctctggacaacctcgtcatgctccacaacagtgagcagggtgggaaggcttaccgccacgccatggaggagttaccggacaccatcgagaccttgatgttgctggcgctgatcgctgtgctcaccgggggcgtaacgctgttctttctatccgggaagggcctcggcaagacgtcaatcgggctgctgtgcgtgacggcctcctcagcactactgtggatggcctccgtggagccgcactggatagcggcctctataatcctggagttcttcctcatggttctgttaataccagagccggaccggcagcgcacgccccaggacaaccagctcgcatacgtggtgatcggcctgctgttcatgatcttgacggtcgccgctaatgagatggggcttctggagaccacgaagaaggacctcggcattgggcacgtggcggccgaaaaccatcagcacgccaccatgctggacgtggacctgagacccgcttcggcctggacgctctatgccgtcgccaccaccgtgatcacacccatgatgaggcacacgatcgagaacaccaccgccaatatttctctgaccgccattgcaaatcaggcggccatcttaatgggcctcgacaaggggtggcccatatccaagatggacattggggtgcccctactggccctcggatgttacagccaggtcaaccccctgacgttaaccgccgcggttctcatgctggtagcccactacgcaatcatcgggccgggcctgcaggccaaggccactcgggaggcgcagaagcgcacggccgccgggattatgaagaaccccacggtcgacggcatcgtagcgattgaccttgaccccgtggtctacgacgcaaagttcgaaaagcagctggggcagatcatgctgctcatcttgtgtacctcccagatccttcttatgcgcaccacgtgggccctgtgtgaaagcataacactcgccaccgggcccctcaccacactgtgggagggctccccggggaagttttggaacacgaccatcgccgtaagcatggccaacatcttccggggctcctacctggcaggcgcggggttggcatttagcttgatgaagtccttgggcgggggccgaagggggaccggcgcccagggggagaccctcggcgagaagtggaagcgccagctgaaccaactgagtaagtcggaattcaatacctacaagcggtccggtatcatggaggtcgaccggagcgaggccaaagagggcttaaagcgtggcgagaccaccaaacacgcggtctcccgtgggaccgcaaaactaagatggttcgtggagcgcaacctggtaaagccagagggcaaggtgatcgatctcggctgcggtcggggcgggtggagctactactgcgcaggactcaagaaggtgaccgaagtgaaagggtacacgaagggaggccccgggcatgaggagcctattcccatggcgacttacggctggaatctagttaagctgtacagtggaaaagacgtgttctttatgccgcccgagaagtgtgacaccctcctttgcgacataggcgagagctctccgaaccccactattgaggaggggaggacgctgcgagtgctcaagatggtcgagccgtggcttcgcggcaaccagttctgcattaagatcctgaacccctacatgcccagcgtggtggagaccttagagcaaatgcaacggaagcacggcgggatgttggtccgcaacccgttatcccggaacagcacccacgagatgtactgggtgtcctgcgggaccgggaacatcgtgagcgccgtcaacatgacgtcgcgcatgctcctgaaccggttcaccatggcccaccgcaagcccacctacgaacgcgacgtcgacttgggggccgggacccgacacgtggccgttgagcccgaggtggccaacctcgacatcatcgggcagcgcatcgaaaacattaagaacgagcacaaaagcacatggcactacgacgaggacaacccctacaagacctgggcctatcacggcagctatgaggtgaagccgagtgggtccgcgtcgtccatggtcaacggagtagtgcggctgctgaccaagccctgggacgtcatacccatggtgacccagatcgccatgacggacaccacacccttcgggcagcaacgcgtcttcaaggagaaggtggatacccggacgccgcgcgccaagcgggggaccacccagataatggaggtaaccgccaagtggttgtggggcttcctgagccggaacaagaagccccggatctgtacgcgcgaggagttcacccggaaggtccgcagcaacgccgcgatcggggccgtgttcgtggacgagaaccagtggaactcggccaaggaggcggtcgaagatgagcggttctgggacctggtgcaccgcgaacgggagctccacaagcagggcaagtgcgcgacgtgcgtgtataacatgatggggaaaagagagaagaagctaggcgaattcgggaaagctaaggggagccgggccatctggtatatgtggctgggtgcccggttcctggagttcgaggccttagggttcatgaacgaggaccactggttctcccgcgagaatagcctttccggcgtcgaaggggagggcctccataaactggggtacatactgcgcgacatcagcaagatccccgggggcaacatgtatgcggacgacaccgccggctgggacacacggataaccgaagacgatctacagaacgaggccaagatcaccgacatcatggagccagagcacgcgctgctggccacctccatcttcaagctcacataccagaacaaggttgttcgcgtccagcgccccgcgaagaatggcaccgtgatggatgttatcagccgtcgcgaccagcgggggtctggacaggtcggcacgtacggtcttaacacctttacgaacatggaggtacaactgatccgccagatggagtctgagggaatcttcctcccatcagagctggagacccccaacttggcagagcgggtgctagactggctggagaagcacggggctgagaggcttaagagaatggccatcagcggggacgattgtgtggtgaagccgatcgacgaccgcttcgccaccgctctaaccgccctgaacgacatggggaaggtgcggaaggacatcccccagtgggaaccctccaagggctggaacgactggcagcaggtccccttctgcagccatcacttccaccaactaatcatgaaggacggccgcgagattgtcgtgccgtgccggaatcaggacgagctcgttggtcgcgcccgagtgtcccagggcgccgggtggtccctgcgggagacagcctgcctaggcaaatcctacgcgcagatgtggcagctcatgtactttcaccggcgcgaccttcggctggccgccaacgcgatttgctcggccgtgccagtcgattgggtacccaccagccgcaccacgtggtccattcacgcccaccaccagtggatgaccacggaggacatgctatctgtatggaatcgcgtctggatcgaggagaacccctggatggaggacaagacccacgtgtccagctgggaggaggtgccgtacctggggaagcgcgaggaccaatggtgcggctccctgataggcctcaccgccagagccacgtgggccacgaacatccaggtcgcgattaatcaggtgcggcgcctgatcgggaacgagaactatctagactatatgaccagtatgaagcgcttcaaaaacgaaagtgatcccgaaggtgccctctggtga

SEQ ID NO: 23937 - RNA, 9879 nt, synthetic construct
  misc_feature 1..9879: note = derived and/or modified CDS sequence (opt11) from DENV-1__FJ547068__SS-prME
  source 1..9879: mol_type = other RNA
agcgtgaccatgctgctcatgctgctgcccaccgccctcgccttccacctgaccacccggggtggggagccccacatgatagtcagcaagcaggagcggggcaagagcctcttgttcaagaccagcgcgggggtgaacatgtgcaccctgatagccatggacctgggcgaactctgcgaagacactatgacctacaaatgtccgcagattaccgaggccgagcccgacgacgtggactgctggtgcaacgccaccgacacctgggtgacctacgggacctgcagccagaccggcgagcatcggcgggataagcggtctgtcgcccttgcgccccacgtgggactggggctcgagacgcggactgagacctggatgagctccgagggcgcctggaagcaaatccagcgcgtcgagacctgggccctgcggcatcccggtttcacggttatcgccctgtttctcgctcatgccataggcacttctatcacccagaaggggatcatcttcatcttactgatgctcgtcaccccctctatggctatgcgctgcgtgggcatcggcaatcgtgatttcgtggagggtctgagcggcgccacgtgggtggacgtcgtactggaacacgggtcctgcgtgaccaccatggcgaagaacaagcccaccctcgatatagaactcctgaagacggaagtcaccaaccccgctatcctccgcaagttatgcatcgaggccaaaatcagcaacaccacaacggactcaagatgcccgacccagggcgaggcaaccctggtcgaggagcaggacgccaacttcgtgtgtcggcggaccttcgtcgatcgaggatgggggaacggctgcggcctctttggcaaggggagcctgctgacgtgcgcaaaattcaagtgcgttaccaagctcgagggcaagatcgtacagtacgaaaacctgaagtacagcgtcatcgtgaccgtccacaccggcgaccagcaccaagtcgggaacgagacaaccgagcacggcaccatcgcgaccatcacgcctcaagcgccgacgagcgagatccaactgacggactacggggccctcaccctggactgcagcccccgtacgggcctggacttcaacgagatggtactcttaacgatgaaggagaaatcctggcttgtgcacaagcaatggttcctcgacctgccactgccctggacctccggggccagcaccagccaggagacctggaaccgccaagatctcttagtaacgttcaagactgcccacgcgaagaagcaggaggtggtcgtactcggctcgcaggagggcgccatgcacaccgccctcaccggtgcaacggagatccagacctccggcacaaccacgatcttcgccggacacctgaagtgccggctgaagatggacaagctcaccctgaagggtacatcctacgtgatgtgcaccgggagctttaagctggaaaaagaggtcgcggagactcagcacggcaccgtcctggttcaagtcaagtacgagggcaccgacgccccctgcaagatccccttctccacccaggacgagaagggagtgacgcagaatggccgcctcatcacggccaacccgattgtgacagacaaggaaaagccagtcaacatcgaaaccgagccgccattcggggagagctacattgtggtgggtgccggtgaaaaggcactaaagctatcctggttcaagaaggggagctccatcggcaaaatgttcgaggcaacggcgcgcggtgcccgccggatggccatcctcggcgacacggcgtgggacttcgggagcatcggcggcgttttcacctcggtgggcaagctggtgcaccaggtcttcggcaccgcctacggggtgctgttcagcggcgtgtcctggacgatgaaaatcgggattgggatcctgctgacctggctgggtctcaattcacgctccacaagcctaagcatgacctgcatcgccgtcggcatggtgacgctgtacctcggagtgatggtccaggccgacagcgggtgcgtaatcaactggaagggccgtgagctgaagtgcggatccggtatctttgtgaccaacgaggtccatacctggacggagcagtacaagttccaggccgactctccgaagcggctgtctgcggcaataggcaaggcctgggaggagggggtgtgcggcattcgttccgccacccggcttgagaacatcatgtggaagcagattagtaacgagctgaaccacatcctgttggaaaacgacatgaagttcacggtggttgtcggtgacgccaacggcatactggcccaggggaagaagatgatccgcccccagcccatggagcacaagtactcctggaagagttggggcaaggccaagataattggcgccgacatccagaataccaccttcatcatcgacgggccggacaccccggagtgccccgataaccagagggcctggaacatctgggaggttgaggattatggctttgggatcttcacgacaaacatctggctgaagctccgcgactcatacacccagatgtgcgaccaccggctgatgagcgcggccatcaaggactccaaggccgtccatgcggacatgggctactggatcgaaagcgagaaaaacgagacctggaagttagcccgtgcgtcctttatcgaggtgaaaacatgcacctggcccaagagccacaccctgtggtccaacggggtgctggagagcgagatgatcataccgaagatctatgggggcccaatctcccagcataattaccggcccgggtacttcacccaaacagcgggcccttggcatctgggcaagctcgagctggacttcgacctgtgcgagggcaccaccgtcgtggtggacgagcattgcggtaaccgcgggccgagcctcaggacaacgaccgtgacgggcaagattatccacgagtggtgttgtcgctcatgtacactgccgcctctgcggttccgcggggaggacggctgctggtacgggatggagatccgccccgtgaaggaaaaggaggagaacctcgtacgatcaatggtctccgccggatctggcgaggtggactcattctcccttgggatcctgtgcgccagcatcatgatcgaggaggtcatgcggtcccgctggagccggaagatgctcatgacgggcacccttgccgtcttcctgctcctaatcatggggcagctgacttggaatgacctcatccgcctatgcatcatggtgggtgcgaatgcaagtgaccgcatggggatgggcaccacctacttagccctgatggccaccttcaagatgagaccgatgttcgccgtagggctgctgttccgccggctcacgagccgggaggtcctgttactcaccatagggctgtcactggctgccagcgtggagctacccaatagcctggaggagctgggcgacgggctcgccatgggcatcatgatgctgaagctgctcacggagttccagccccaccaactgtggaccaccctgcttagcctgaccttcatcaagaccacgctgtccttggactacgcctggaagaccacggcgatggccctgagcatcgtgtcgctgtttcccttatgcctgagcacgacctcccagaagaccacctggttaccggtcctccttggaagcttcgggtgcaaaccccttactatgttcctcatcacggaaaacaagatctggggccggaaatcctggcccctcaacgaggggatcatggccatcggaatcgtgagcatactgctcagcagcctgctgaagaatgacgtcccccttgccgggccattgatcgccggcgggatgcttatcgcgtgttacgttataagcgggtctagcgccgacctctccctggagaaggccgccgaggtgagctgggagcaagaggccgagcactctggtacctcacacaacatactggtcgaggtgcaagacgacgggaccatgaagatcaaggacgaggagcgcgacgatacgttgacgatcctgctgaaggctaccctgctggccgtatccggcgtctacccaatgagcatccccgccaccctgtttgtgtggtacttctggcagaagaaaaagcagcggtccggcgtgctctgggacacccccagcccgccggaggtcgagcgcgccgtgttggacgacggcatctatcggatcctgcagcggggcttgctcgggcggtcccaggtgggcgtgggggtcttccaggacggcgtgttccacacgatgtggcacgtaaccaggggggccgtgcttatgtaccagggcaagaggttggagcccagctgggcgtccgtgaaaaaagacctcatctcctacggcgggggctggcgcttccaggggtcctggaacaccggcgaggaggtccaggtgatagccgtggaaccggggaagaacccgaaaaacgtccagaccacgccaggcaccttcaagacccccgagggcgaggtcggggccatcgccctggatttcaagcccggcaccagcggctcaccgatcgtgaaccgagagggcaaaatcgtcggcctgtacgggaacggcgtggtgacgaccagcgggacctacgtctccgccatagcgcaggctaaggcctctcaagaaggccccctccccgagatagaggacgaagtgttcaagaagcgcaatctgaccatcatggacttgcaccctgggagcggcaagactcgacgctacctcccggctatcgtgcgggaggccatcaagagaaagctgcggacgctgattctcgccccaacccgggtcgtggcttcagagatggccgaagccctgaaaggaatgcccatccgctaccagactacggccgtcaagagtgagcacaccggtcgggagattgtcgacctgatgtgccacgctactttcaccatgcgcttgctgtcccctgtgcgggtgcccaactacaatatgataatcatggacgaagcccatttcaccgaccccgcgagcatagcagcgcgcggctacatctccacacgggtcgggatgggtgaggctgccgctatcttcatgaccgccaccccgcccgggagcgtggaggcgtttccacaatccaacgccgtgatccaagacgaggagcgcgacattcctgagagaagctggaactccggatacgactggattactgatttccccggcaagaccgtctggttcgtgcctagcatcaagtccgggaacgacatagctaactgtctgcgcaagaacggcaagcgggtgatccagctcagccgcaagaccttcgacactgagtatcagaagacgaagaacaacgactgggactacgtcgtgaccaccgacatctccgagatgggggccaacttccgggcggatcgcgtgatcgacccccggagatgtctgaagcccgtcatcctgaaggacggccccgagcgggtgatcctcgccggtccgatgcccgtaaccgtcgccagcgccgcccagcgccggggccgcatcggccggaaccagaacaaagagggggatcagtacgtttacatggggcaacccctgaacaacgacgaggaccacgcgcactggaccgaggccaagatgctgctcgataacatcaacaccccagaagggatcatcccggccctgttcgaacctgagcgggagaagtcagcagccatcgacggggagtaccgcctccgcggagaagcgcgcaagaccttcgtggagctcatgcggcgcggcgacctgcctgtatggctgagctacaaagttgcatccgagggctttcagtatagcgaccggcgctggtgtttcgacggagagagaaacaaccaggtcctcgaggagaacatggacgtggagatctggaccaaggagggcgagcgcaaaaagttacggccccgctggctggacgcccggacttactccgacccgttggcgctgagggaattcaaggagttcgccgcggggcggaggagcgtgagcggcgacctgatcttggagatcggtaagctgccacagcacctgacgttgagggcccaaaacgccctggacaatctggtcatgctccacaacagtgagcagggcgggaaggcctaccgccacgcgatggaggagctgccggacaccatcgagactctgatgctcctggccctgatcgcggtcctcacgggtggcgtgacgctgttcttcctgtcagggaagggcctcggcaagaccagcatcgggctgctgtgtgtgaccgccagctccgccctcctgtggatggcgagcgtggagcctcactggatcgctgccagcatcattctggagttctttctcatggtgctattgatcccggagcccgaccggcagcgcacgccccaggacaaccagctcgcttacgtcgtgatcggcctgttgttcatgatcctcaccgtggccgcgaacgagatggggctgttggaaaccaccaagaaggatctcggcatagggcacgtcgcagccgaaaaccatcaacacgccaccatgctggacgtggacctgagacctgccagtgcgtggacgctctacgccgtggcaaccaccgtcatcacccctatgatgcgccacacgatcgaaaacaccacagccaacatctccctgacggccatcgcgaaccaggcggcgatcctgatgggtctcgataaaggctggcccatcagcaaaatggacatcggggtgcccctgttggcactcggctgctactcccaggtgaacccactgacgctgaccgccgccgtcctcatgctggtggcccactacgccatcataggccccgggctgcaggctaaggcgacccgggaggctcagaagcggaccgccgccggtatcatgaagaaccccacggtggatggcatcgtcgctatagacttagaccccgttgtgtacgacgcaaagttcgagaagcagctaggccagatcatgctgctgatcctatgcacctctcagatcctgctcatgcggaccacctgggccctgtgcgagtccatcacgttggctaccgggcctctcaccaccttgtgggaggggtctcccggaaagttctggaacaccaccatcgcggtctccatggccaacatctttcggggcagctacttagcaggcgccgggctcgccttctccctgatgaaatccctcggggggggccgccgggggaccggcgcccagggggagaccctcggggagaaatggaaacgccaacttaatcagctgagtaagagcgaattcaatacgtacaagcggagcggcatcatggaggtggatcgctccgaggccaaggaagggctcaagcgcggagaaaccaccaaacacgcagtgagccgcgggaccgccaagctgcgttggttcgtcgaacggaatctggtgaagcccgaggggaaagtgatagacttgggctgcgggcggggcgggtggtcctactactgcgccggcctcaagaaggtgaccgaagtgaaggggtacacgaaggggggtcccgggcatgaggagccgattcccatggccacctacggctggaacctggtgaagctgcacagcgggaaggacgtattttttatgccgcccgagaagtgtgacaccctcctgtgcgacattggcgagtccagcccgaacccaaccatcgaggaggggcgcacgctgcgggtgctcaagatggtcgagccgtggctgcgaggcaaccagttctgtatcaagatcctgaacccctacatgccgtccgtcgttgagacactcgaacagatgcagcggaagcacggcgggatgctggtgcgcaaccccctgagccggaactccactcatgagatgtattgggtctcatgcggcacagggaacattgtgagcgcggtgaacatgacatctcgcatgctcctgaaccggttcaccatggcccacagaaagcccacctacgagcgcgacgtcgacctcggtgctggaacccggcacgtcgctgtggagcccgaggtcgccaacctcgatatcatcggtcagagaatcgagaacatcaagaacgagcacaagtccacatggcactacgacgaggacaacccgtataagacatgggcgtaccacggctcttacgaggtgaagccctccgggagcgcctcatcaatggtgaacggcgtcgtgcggctgctgacaaagccctgggacgtgatccccatggtgacccagattgccatgacggacaccaccccgttcgggcagcagcgcgtgttcaaggagaaggtcgacacccggacaccccgcgcaaaacggggcacaacccagatcatggaggtgaccgccaagtggctctggggattcctgtcccgcaacaagaagcccaggatctgcacgcgcgaggagttcacccggaaggtgcgcagcaacgccgcgatcggggccgtcttcgttgacgaaaaccaatggaacagcgccaaagaggcggtggaggacgagcgtttctgggacctggtacaccgcgagcgggagctccataagcagggcaagtgcgcgacctgcgtatacaacatgatgggaaagcgcgagaaaaagctgggcgaattcgggaaggccaaaggcagccgggccatctggtacatgtggctgggggcccgcttcctcgagttcgaagcactggggttcatgaacgaggaccactggttcagcagagagaattccctgtcaggcgtggagggggagggcctccacaagctggggtacattctgagagacatttcgaaaatccctggcggcaacatgtacgccgacgataccgccgggtgggacactcggatcaccgaagatgacctccagaatgaagccaagatcaccgacatcatggagcccgagcatgccctgctggcgacctcaatctttaagctaacctatcagaacaaggtcgtgagggtgcaacgccctgctaagaacggcacagtcatggacgtaatctcccggcgcgaccagcgcggaagcggtcaggtgggtacctacgggctcaatacattcacgaacatggaggtccagctgatccgccagatggagtccgagggcattttcctcccaagcgagctcgagaccccgaacctggccgagcgggtgctcgactggctagaaaagcacggagccgagcgcctgaaacggatggcgatctccggcgatgactgtgtggtaaagcctattgacgaccgcttcgcgaccgccctcaccgccctcaacgacatggggaaggtgaggaaggacattccccagtgggagccaagtaaaggttggaacgactggcagcaggtcccgttctgctcccaccatttccaccaactgataatgaaggatggccgagaaatcgttgtgccctgccggaaccaagacgagctcgtgggtcgagctcgtgtcagccagggcgcgggctggtccctgcgcgagaccgcgtgcctgggcaagagctacgctcagatgtggcaactcatgtacttccatcggcgcgatctgcggctcgccgccaacgcgatctgctccgctgtacccgtagactgggtcccgactagccgcaccacgtggagcatccacgcgcaccaccagtggatgaccacggaggacatgctcagcgtgtggaaccgagtgtggatagaggagaacccgtggatggaagacaagacccacgtcagctcctgggaggaagttccctacctggggaagcgcgaagatcaatggtgcggcagcctgataggcctcacggcgcgtgcgacatgggctacgaacatccaggtggccatcaaccaggtccgacgcctgatcgggaacgagaactacttagactacatgacctccatgaaacggttcaagaacgagtccgacccggagggcgccctctggtga

SEQ ID NO: 23938 - RNA, 9879 nt, synthetic construct
  misc_feature 1..9879: note = derived and/or modified CDS sequence (opt11) from DENV-1__FJ562104__SS-prME
  source 1..9879: mol_type = other RNA
agcgtcaccatgctcctcatgctgctgcccaccgcgttagccttccacctcactacccgggggggggagccccacatgatcgttagcaagcaggaacgcggcaagagcctcctgtttaagactagcgccggggtgaacatgtgtaccctgatcgctatggatttgggcgagctctgcgaagacacaatgacgtacaagtgtcctcagatcaccgaggccgagcccgatgacgtggactgttggtgcaacgccacagacacctgggtcacttacgggacttgtagccagaccggggagcaccggagggacaagcgctccgtggctctggcaccccatgttggcctggggctcgagacgcggaccgagacctggatgagctccgagggagcctggaagcagatccagcgcgtcgagacatgggccctgcggcaccccgggttcacggtgatagccctgttcctcgcgcacgccatcggcacctccatcacgcagaaagggataatcttcatcctgctgatgctcgtgacgccctccatggccatgcgctgcgtcggtatcggcaaccgggacttcgtcgaggggctgtccggcgccacgtgggtcgacgtagtgctggagcacgggtcctgcgtgaccaccatggctaagaacaagcccacgctcgacatcgagctgctgaagacggaggtcactaacccagcgatcctccgcaagctgtgcatcgaggcaaagatctctaacaccaccacggactcccggtgccctacccagggcgaggccacactggtggaggagcaggacgccaacttcgtctgtcgccggaccttcgtagatcgcggctgggggaacggatgcggcctcttcggcaaaggaagcctgctgacttgcgccaagttcaaatgcgttacgaagctcgagggcaagatcgtgcagtacgagaaccttaagtactccgtcattgttaccgttcacaccggcgaccagcatcaggtagggaacgagaccaccgagcacggaacgatcgcgaccataacgccccaggcccccactagcgagatccaattaaccgactacggggccctcaccttggactgcagcccccggaccgggctggacttcaatgagatggtgttgctgacgatgaaagaaaagtcctggctggtccataagcagtggttcctggacctgccgcttccctggacttccggggccagcacaagccaggagacctggaaccgccaggacctcctggtgacgttcaagaccgctcacgctaagaagcaagaagtagtcgtgctgggctcccaggagggcgccatgcacaccgctctaacgggggccacagagatccagaccagcggtaccaccaccatcttcgccgggcatttaaagtgccgcttgaaaatggacaagctcacactgaaaggcacttcatacgtgatgtgtaccgggagcttcaaacttgagaaggaggtcgcggagacgcagcacggaaccgtgctggtacaggtcaaatacgaaggcaccgacgccccctgcaagatccctttctctacccaagatgagaaaggggtcactcagaacggccgactaatcaccgcgaacccgatcgtgaccgacaaggagaaacctgtaaacatcgaaaccgagccgcccttcggtgagtcatacatcgtggtgggcgccggcgaaaaggcgttgaagctgtcctggttcaaaaagggtagttccatcggcaagatgttcgaggcgacggcaaggggggcgagacggatggccatactcggcgacaccgcgtgggacttcggaagcatcggcggcgtcttcacctccgtcgggaagctggtccaccaggtcttcggaaccgcctacggggtgctcttctctggcgtgtcctggacgatgaagattgggatcggcatcctcctgacctggctgggcctcaacagccgttccacctccctgtctatgacctgcatagctgtcgggatggttacgctctacctaggcgtaatggttcaggccgacagcgggtgtgttatcaactggaagggccgagagttaaaatgcgggtccgggatcttcgtgaccaacgaggtccacacctggactgagcagtataaattccaggcggacagcccaaagcggctgagcgcggccatcggcaaggcgtgggaggagggggtgtgtggcatacgatccgccacacgcctcgagaatataatgtggaagcagataagcaacgaactgaaccatatcctgttagaaaacgacatgaaattcacggtggtcgtcggggacgccaacggaattctcgcgcaggggaagaaaatgatcagaccccagcccatggaacacaagtactcctggaagtcctggggaaaggccaagatcatcggagccgacatccagaacacaacctttatcatcgatggccccgacaccccggagtgtccggacaaccaacgggcctggaacatctgggaggtggaggactacggcttcggtattttcacgaccaacatctggctgaaactccgcgatagttacacccagatgtgcgaccaccggctcatgagcgcggccatcaaggactcaaaagccgtgcacgcggacatgggctactggattgagtcggagaagaatgagacatggaagctggccagagcttccttcatcgaggtgaagacatgcacatggccaaaaagccacactctctggtccaacggcgtgctggaaagcgagatgatcatccctaagatatacgggggcccgatctctcagcacaactaccgccccgggtacttcacccaaacggccggcccctggcacctgggaaagctcgagctggacttcgacctctgcgagggcaccaccgtagtggtggatgagcactgcggcaatcgcgggccgagcctccgtacgacgaccgtcaccggcaagatcatccacgagtggtgctgtcgctcctgcaccttgccgcccttgagatttcgcggggaggacggctgctggtacgggatggagatccgacccgtgaaggagaaggaggagaacctcgtgcgcagcatggtatccgcaggatcaggcgaggtggacagcttcagtctgggcatcctgtgcgcctccatcatgatcgaggaggtgatgcggagccgctggtctagaaagatgctcatgacgggcacgctggctgtcttcctgctcctgatcatggggcaacttacctggaacgatctaatccgactgtgcatcatggtgggcgcgaatgcctccgaccgcatggggatgggcaccacgtacctggccctgatggccactttcaagatgcggcccatgttcgccgtggggctgctgttccgccggctcaccagccgcgaagtcctgctgttaaccatcgggttatctctggtggcgagcgtggagctcccaaactccctggaggaacttggcgatggcctcgccatgggcatcatgatgttaaaactgctcacggagttccagcctcaccagctgtggaccactctgttaagcctgaccttcatcaaaacgaccctgtccctcgactacgcgtggaagaccacggccatggcgctgagcatcgtctccctattcccgttatgcctgtctacgacctcccagaagaccacctggctgcccgtgctcctgggcagcttcgggtgcaaacccttgaccatgttcctcataacggagaataaaatctggggtcggaagtcctggcccctgaacgagggcatcatggccatcggcatagtcagcatcctgctctcaagcttgcttaagaacgatgtgcccttagccgggccgctgatcgctggcggtatgctgatcgcctgctacgtaatcagcggctcctctgcggacctctccctggagaaggccgccgaggtcagctgggaacaggaggccgagcattcgggcacttcccacaacatcctggtggaggtacaggatgacgggaccatgaaaatcaaagatgaggagcgcgacgacactctaacgattctgctgaaagcgaccctcttagcggtctccggagtataccccatgagcatccctgccaccctgttcgtgtggtatttctggcagaagaagaagcagcggtccggggtcctctgggacacccccagcccgcctgaagtggaacgcgccgtcctggatgacgggatctaccggatcctgcaacgcggcctgctcgggaggtcccaggtaggggtgggggtgttccaggatggcgttttccacacgatgtggcacgtcactcgcggcgccgttctgatgtaccagggcaagcggttggagccaagctgggcaagcgtcaagaaagacctcatcagctacggggggggctggaggttccaggggtcctggaacaccggcgaggaggtccaggtgattgcggtcgagcccgggaaaaaccccaagaacgtgcagactacacctggcacgttcaagactcccgagggcgaggtaggcgccatcgcgttagattttaaacccgggaccagcggatccccgatagtaaaccgggagggcaaaatcgtgggcctgtacgggaatggcgttgtcacgacctctgggacatacgtgagtgcgatcgcccaggcgaaggcttcccaggagggccccctccccgagattgaggacgaagtgttcaagaaacgcaaccttacaattatggacctccacccagggtctggcaagacgcggcgctacttgcccgctatcgtccgtgaggccatcaagcgcaagctgcggaccctcattctcgcgcccacgcgcgtggtggcgtccgagatggccgaagctctaaaaggcatgcccatccgctaccagactaccgccgtcaagagcgaacacacagggcgagagatcgtggacctgatgtgccacgcgaccttcaccatgcgcctcctgtcaccggtgcgggtccccaactacaacatgattatcatggacgaggctcacttcacagaccccgccagcatcgccgcgcgcgggtacatctccacccgggttggcatgggcgaggcggcggccatctttatgaccgccacgccgcccgggagcgtggaggccttcccacaatccaacgcagtcatacaggacgaggaacgcgacattccagagcgtagctggaattccggctatgactggatcaccgactttcccggaaagaccgtgtggttcgtgccctccatcaagagtgggaacgacatcgccaactgcttacgcaaaaacggcaagcgagtcattcagctcagccgcaagaccttcgacaccgagtaccagaagacgaaaaacaacgattgggattacgttgttaccacagacatctccgagatgggggccaacttccgagcagaccgcgtcatcgatccccggcgctgcctgaagccggtgatactgaaggacggcccggagcgggtgattctcgctggtcccatgccggtcaccgtggccagcgcagcgcagaggcgcggccgcatcggccggaaccagaacaaggagggcgaccagtacgtatacatgggccaacccttaaacaacgacgaggaccacgcccattggactgaggcgaagatgctgctcgacaacatcaatacccctgaggggataatcccggcactgttcgagcccgaacgcgaaaagtcagccgccatcgacggcgagtaccgcttaagaggggaggcccgcaagaccttcgtcgagctcatgcgtcggggcgacctgcccgtctggctgagctacaaggtagcgtccgagggcttccagtatagcgaccggcgctggtgcttcgacggcgagcggaataaccaggtgctcgaggagaacatggacgtagagatctggaccaaggagggcgaacgcaagaagctgcggccccgatggctggacgcccggacctactccgatccgttggccctgcgcgagtttaaggagtttgccgccgggagaagaagcgtcagcggcgacctgattctcgagatcggcaaattgccccagcatctgacgttgcgggcgcagaacgccctggacaatcttgtgatgctccacaatagcgagcaagggggcaaggcctaccgccacgccatggaggagctacccgacacaatcgagaccttgatgctcctggcgctgatagcagtgctcacggggggcgtcacgttattcttcctgtcagggaagggcctgggcaagacctccatagggctgctgtgcgtgacagcctcctccgccctcttgtggatggccagtgtagagccccattggatcgcggcttccatcattctggagttcttcctcatggtgttattgattcctgaacccgaccggcagcgcactcctcaggacaaccagttggcctacgttgtgatcggcctgctgttcatgatcctaacggtggccgctaacgagatggggctgctggagaccaccaaaaaagacctcggcatcgggcacgtggcggcagagaaccaccaacacgcgactatgctggacgtggacctgcggccggcttccgcgtggacgctatacgcggtcgccactaccgtgatcacccccatgatgcgccacacaatcgagaacactacagccaacatttccctaaccgccatcgccaatcaagcggccattctgatgggcctagacaagggctggccgatctccaagatggacatcggggtacccttgctggccctcggctgctactcccaggtcaacccgcttacgctgaccgccgcggtgctcatgttggtggcccattacgcgatcatcggcccaggcctgcaggccaaagcaacccgggaggcgcagaagaggaccgctgccgggatcatgaagaacccaacggttgacggcattgtcgccatcgacctcgaccccgtcgtctacgataccaagttcgagaagcagctgggccagatcatgctgttgatcctctgcacgtcacagatcctgctcatgcggaccacgtgggccctgtgcgagtccatcacgctcgcgaccggaccgctcaccacattgtgggagggcagccccggaaagttctggaacactaccatcgcagtgtccatggccaacatctttcggggcagctaccttgccggcgctgggctcgcattctccctgatgaagtccttaggcgggggccgccgagggacaggtgcccagggcgagacgctaggggaaaagtggaaacgccaactgaaccagttgtccaagagcgagttcaacatttacaagcgtagcggtataatggaagtcgatcgctccgaggccaaggagggactcaaacggggagagaccacaaagcatgcggtctcgcgcggcacggctaaactgcggtggttcgtagagcgcaacctagtgaagcccgaaggcaaggtcattgacctgggctgtgggcggggcgggtggtcctactattgtgccggccttaagaaggtgaccgaggtcaagggatacactaagggcggcccggggcatgaagagccgatccccatggccacctacggctggaacttagttaagctacacagcgggaaggacgttttcttcatgccgcccgagaagtgtgataccctcctctgcgacatcggcgagtccagcccgaaccccaccattgaagagggacgcacactgcgggtgctcaagatggtcgagccctggttacgcggcaaccagttctgcatcaagattctgaacccctacatgccgtccgttgtggagaccctcgagcagatgcagcggaaatacggcgggatgttagtccgcaaccccctgtcgcggaatagtacccacgagatgtactgggtgtcgtgcggcaccgggaacatcgtgtcagccgtgaacatgacgagccgcatgctcctgaaccggttcaccatggcccatcgcaagcccacctacgagcgcgacgtggacctgggcgcaggcacgcggcacgtggcagttgaacccgaggtggccaacctcgatatcatagggcagcgtatcgaaaacatcaagaacgagcataagtccacgtggcactatgacgaggacaacccctacaaaacctgggcctaccacggcagctacgaggtgaagcccagcggaagcgcctccagcatggtgaacggagtggtgcggctgctgaccaagccttgggacgtcatcccaatggtgacccagatagcgatgacggacacgacgccgttcgggcagcagagagtcttcaaggagaaggtggacacccggacaccccgcgccaaacggggcaccacccagatcatggaggtgaccgccaagtggctctggggcttcctgtcccgcaacaagaagccccggatatgcacgagagaggagttcacccgaaaggtaaggtccaacgccgcgatcggggcggtgttcgtcgacgagaaccagtggaacagcgccaaagaggccgtagaggacgagcggttctgggacctggtgcatcgcgaacgggagctccacaagcaaggaaagtgcgcgacctgcgtatataatatgatgggtaaacgcgagaagaaattaggtgaattcggtaaggcgaagggcagccgggctatctggtatatgtggttgggcgcccgcttcctcgagttcgaggccctgggctttatgaacgaggaccactggttcagccgggagaactctctgagcggagtcgagggggagggcctccataagctggggtacatcttgcgcgacatctccaagatcccgggtggtaacatgtacgccgatgataccgcggggtgggatacacgaatcactgaggacgacctccagaacgaggccaagatcaccgatatcatggagcctgagcacgctttgctggccacatcgatcttcaagctgacgtaccagaacaaagtggtgcgagtccagcgccccgcaaagaacggcaccgtgatggacgtgatatcccggcgcgaccagcgggggagcggccaggtcggaacctatgggctgaataccttcacgaatatggaagtacagctgatccgccagatggaatccgagggtatctttctaccctcagaactagagaccccgaatctggcggagcgggtattagattggctggagaagcacggggccgaacgtctgaagcggatggccatatccggtgacgactgcgttgtgaaacctatcgacgaccgcttcgccaccgctctcaccgcgctgaacgacatgggaaaggtccggaaagacataccccagtgggagcccagcaagggctggaacgactggcagcaggtcccgttctgtagtcaccactttcaccagctgatcatgaaagacggccgggagatcgtggtgccctgccggaaccaagacgaactcgtcgggcgcgcccgggtgagccagggcgccggctggtccctgcgcgagaccgcctgcttgggcaaaagctatgcccaaatgtggcagctaatgtacttccaccggcgcgacctgcggctagccgctaacgccatctgctcggccgtcccggtcgactgggtgcccacctcccgcaccacctggagcatccacgcacaccaccagtggatgactaccgaagacatgctctccgtgtggaaccgggtttggatcgaggagaacccgtggatggaagacaagacccatgtgagctcatgggaggaggtcccctacctggggaagcgcgaagaccaatggtgcggctccctgattggcctaaccgctcgcgccacctgggcgactaacatccaggttgcgataaaccaggtgcgccgccttatagggaacgaaaattacctggactatatgaccagcatgaagcggttcaagaacgagagcgaccccgagggggcgctctggtga

SEQ ID NO: 23939 - RNA, 9879 nt, synthetic construct
  misc_feature 1..9879: note = derived and/or modified CDS sequence (opt11) from DENV-1__GQ199857__SS-prME
  source 1..9879: mol_type = other RNA
tccgtaactatgctgctgatgctgttaccgacggcgctcgcctttcatttgaccacccgagggggtgaaccgcacatgattgtgagtaagcaagaacggggcaagtcgctcctgttcaagacaagcgccggggtgaacatgtgcaccctgatcgccatggacttaggtgaactttgcgaagacaccatgacgtataagtgcccccagatcaccgaagccgagcccgacgacgtggactgttggtgcaacgccacggacacctgggtgacctacgggacctgctctcaaactggcgagcataggcgggacaagcgctctgttgccttggcgcctcacgtgggtctgggcctcgagactcggacagaaacctggatgtcctccgagggcgcgtggaagcagatccaacgcgtcgaaacctgggccctgcgacatcccgggttcacggtgatcgccctattcctcgcgcacgccataggcacctcaatcactcaaaaggggatcatcttcatcctgcttatgctcgtgaccccctccatggccatgcgctgtgtcgggattggcaaccgggatttcgtcgaggggctgagcggggccacgtgggtggacgtcgtcttagagcacgggtcctgcgtgaccaccatggctaagaacaagccaaccctcgacatagagctcctgaagacggaagtcaccaaccccgcgatcctccggaagctgtgcatcgaggccaagattagcaacaccactactgactcaaggtgtccgacccagggcgaggccaccctggtggaggagcaggacgccaacttcgtgtgtcgccggaccttcgtcgaccgcggttggggtaatggctgcggactctttgggaaggggagcctgctgacgtgcgccaagttcaagtgcgtcaccaagctcgagggcaagatcgttcagtacgagaacctaaagtactccgtgatcgtgacagtgcacaccggggatcagcaccaggtcggtaacgagacgactgagcacggcaccattgcgaccatcacgccacaggcccccacaagcgagatccaactgaccgactacggggcactcaccctggactgcagccccaggaccggcctggacttcaatgagatggtgctcttaacgatgaaggaaaagtcttggctggtccataagcaatggttcctcgacctgccgctgccctggacctccggggccagcacctcacaagagacttggaaccgccaggatctgctggtgacattcaagacggcccacgcaaagaagcaggaggtcgtcgtgttaggctcccaggaaggcgcaatgcacaccgcgctcaccggtgccacagagatccagaccagcggcaccaccacgatctttgcggggcacctgaagtgtcggctgaagatggacaagctaacgttaaaggggacctcctacgttatgtgcaccggcagcttcaaacttgagaaggaagttgcggagacgcagcacggcaccgtgctggtccaggtcaagtacgagggaaccgacgcgccttgtaaaatccccttctccacccaagacgagaagggggtaacgcagaatggccgcctgatcaccgcgaatccaattgtaacagacaaggagaagcccgtcaacatcgagacggagccgccattcggcgagtcgtacatcgtggtgggcgctggcgaaaaggcgctgaaactttcgtggttcaagaaggggtcgagtatcggaaagatgttcgaggctacggcccgcggggcccgccggatggccatcctcggcgacaccgcttgggacttcggtagcatcggaggcgtctttaccagtgtgggaaaacttgtgcaccaggtttttggcacggcttacggggtgttattcagcggcgtatcctggacgatgaaaatagggatcggcatcctactgacgtggctgggcctcaacagccgctccaccagcctatcgatgacctgcattgccgtcgggatggtgactctgtacctcggcgtcatggtacaggccgacagcgggtgtgtgatcaactggaaggggagagagctaaaatgcgggtccggcatcttcgttaccaacgaggtacacacctggaccgagcaatacaagttccaggccgactctccgaagcggcttagcgcggctatcggcaaagcctgggaggagggtgtgtgcggcattcgatccgccacccgactcgaaaacatcatgtggaagcagatcagcaacgagctgaaccacatcctgctcgagaatgatatgaagttcaccgttgtcgtgggagatgccaacggaatcctggctcaagggaagaagatgatccgcccccaaccgatggagcacaagtactcctggaagtcctggggcaaggccaagattatcggcgccgacatacaaaatacgaccttcattatagacggccccgatacccccgagtgtcccgacaaccaaagagcctggaatatatgggaggtggaggactacggcttcgggatctttaccaccaacatatggctgaagctacgcgactcctacacccagatgtgcgaccaccggctgatgagcgccgccatcaaggactccaaggccgtccatgcggatatgggatactggatcgagagcgagaagaacgagacttggaaactcgccagggcctccttcatcgaggttaagacatgcacctggcccaaaagccacacactctggtccaacggcgtgctggaaagcgagatgatcatcccgaagatatacggagggccgattagtcagcacaattatcgccccgggtacttcacccagacggcgggcccctggcacctggggaagctcgagctggacttcgacctgtgcgagggcactaccgtcgtggtggacgagcactgcggcaaccgcggtccgagccttcggacgacgacggtcaccggcaagatcattcacgagtggtgctgccgctcatgcacactgccgcccctccggtttcgcggggaggacggctgctggtacgggatggagattcggccagtgaaggaaaaggaagagaaccttgtgcgcagcatggtctccgccggcagcggcgaggtggattctttctccctagggatcctgtgtgcctcaatcatgatcgaagaggtgatgcgctcccgctggagccgaaagatgctcatgacaggtactctggccgtcttcctgctcctgatcatgggccagctgacatggaacgacctcattcgcctttgcatcatggtgggcgccaatgcctccgaccgcatgggaatggggaccacgtatttagctctcatggccacttttaagatgcgtccgatgttcgccgtggggctactcttccggcggttgaccagccgcgaggtcctgcttctcactatcgggctgtccttagtggcgagcgtagagttacccaactccctggaggagctgggagacgggctcgccatgggcatcatgatgctgaaactgctcacagagttccagccccaccagctgtggaccacccttctcagcctgaccttcattaagaccactctgtccctggactacgcttggaagaccaccgcgatggcgctgtccataatctcgctgttccccctctgcctgtccacgacctcccaaaagactacctggctgcctgtcctcctgggctcttttgggtgcaagcccctgaccatgtttctcatcacggagaacaagatctggggcagaaaatcctggccgctgaacgaaggaatcatggcgatcggaatcgtcagcatcctcctctccagtcttctaaagaacgacgttcccctcgccgggccgctgatcgcgggcggcatgctgatcgcgtgttacgtgatcagtgggtctagcgctgacttgtccctggagaaagccgccgaggttagctgggagcaggaagccgaacactcagggaccagccataacatcctggtcgaagtgcaagacgacgggaccatgaagatcaaggacgaggaaagggacgacaccctaaccatcctgctcaaagcgaccctcctcgcggtatccggcgtctaccccatgtccatccccgccactctgttcgtatggtacttctggcagaagaagaagcagcggtccggtgtcctctgggatacccccagcccacccgaggtcgagcgcgccgtcctggacgacggaatctacagaatcctgcaacgcgggctactcgggcgttcccaagtgggcgtaggcgtgttccaggacggcgtgtttcacacgatgtggcacgtcacacgcggggccgtgttaatgtatcagggtaagcggctggagcctagctgggcgagcgtcaagaaggaccttatcagctacggcggtggctggcggttccaggggtcctggaacaccggcgaagaggtccaggtgatcgcggtagagcccgggaagaacccgaagaacgtccagaccacgcccggtacctttaagacccccgagggcgaggtaggggccatcgcactggacttcaagcccggcaccagcggttccccgatcgtgaacagggagggcaaaatcgtcggtctgtacggcaatggggttgtgacgacaagcggcacctatgtcagcgccatcgcgcaggccaaggctagtcaggagggcccccttcccgagatagaggacgaggtgttcaagaagcgtaacttaacaatcatggacctccaccctggaagcggcaaaacacggcgctacctccccgccattgtgcgagaagcaatcaagcgcaaactgcggaccctgatcctcgcgcccacccgcgtcgtggcttccgagatggccgaagccctaaaaggcatgcccatcaggtaccagaccacggccgttaagagcgagcacactggtcgggagatagttgacctgatgtgccacgccacattcacgatgagactcttgtcccccgtgcgcgttcccaactacaacatgatcatcatggacgaggctcacttcacggaccccgccagcatcgccgcccgtggctacatatccacgcgggtcgggatgggggaggcggctgccatcttcatgaccgccacgccgcccggtagcgtggaagccttcccccagtccaacgcggtgatccaggacgaggagcgcgacatccccgaacggtcatggaacagtggttatgattggatcacggacttcccgggcaagaccgtctggttcgtgccctccattaagtccgggaatgacatcgcaaactgcttacgtaagaacgggaagcgggtgatccagctcagtcgcaagacattcgacacagagtaccaaaagacgaagaacaacgactgggactatgtcgtgaccactgacatcagtgagatgggggccaatttccgggccgatcgcgtcatcgacccccggcgctgcctgaagcccgtgatcctcaaggacggcccggaacgagtgatcctagcggggccgatgcccgtgaccgtcgcctccgccgctcaacgccggggccgcatcggccgtaatcagaacaaggaaggggatcagtatgtatacatggggcagccacttaataacgacgaagaccacgcccattggacggaggctaagatgctgctcgacaacatcaacaccccagaggggatcatcccggccctctttgagccagagcgcgagaaaagtgccgccattgatggcgagtatcgtctgaggggcgaagcccgcaaaaccttcgtggagctcatgcgccgcggcgacctgcccgtctggctaagctataaggtcgcgtccgaaggcttccaatacagcgaccggcggtggtgttttgacggagagcggaacaatcaggtcctcgaggagaacatggatgttgaaatctggaccaaggagggcgagagaaagaagctgcggccccgatggcttgatgctcggacctactccgacccgctcgccttgcgcgagttcaaggagttcgccgccgggcggcgcagcgtgtctggcgacctaatcctcgagataggtaaattacctcaacacttgacgctacgcgcgcagaacgccctagacaacctggtaatgttgcataatagtgagcagggcgggaaagcctacaggcacgccatggaggagctgcccgacaccatcgaaaccctgatgctcctcgcgctgattgccgtgctcacagggggcgtgacgcttttcttcctgagcgggaaaggcctaggcaagacctccattgggctgctgtgtgttaccgcaagctccgcactcctgtggatggccagcgtggagccccactggattgctgcttcaatcatcctggagttcttcctcatggtgctgttaatcccggagcccgatcggcagcgtacgccccaggacaatcagctcgcttacgtcgttatcggcctgctgttcatgatcctaaccgtggccgccaacgagatggggctcctggaaaccaccaagaaggacctcggtatcgggcacgtcgcggcggagaaccaccaacacgccacgatgcttgatgttgacctgcggccggccagcgcctggacgctctacgcggtagccaccacggtaatcacacctatgatgcgccatacgatcgagaacaccaccgcaaacatctccttgaccgccattgccaaccaggcggccattctgatgggcctagacaagggctggcccataagtaagatggatatcggggttccccttctggccctaggctgttactcccaggtgaacccactgaccctgaccgccgcggtcctcatgctggtcgcccactacgccataatcggcccggggctacaggccaaggcgacacgggaggcgcagaagcgcaccgcggccgggatcatgaagaaccccacagtggacggcatcgtcgccatcgacctagaccccgtggtctacgacaccaagtttgaaaagcagcttggacaaatcatgctgctcatcttgtgcacctcccagatcctgctcatgcgcactacttgggcactgtgcgagtccatcaccctagctaccgggccgcttaccacattgtgggagggaagccccgggaaattctggaacaccaccatcgccgtctccatggccaacatattccgcggttcatatctggccggtgccgggctcgctttctctttgatgaagtccctgggcgggggccgacgggggaccggggcacagggcgaaacgctgggggagaagtggaaacgacagctgaaccagctgtccaagtccgagttcaacatctacaagcggagcggcattatggaagtagaccgcagcgaggccaaggagggtttaaagcggggtgagacgacgaaacacgccgtgagccgcgggacggcgaagctgcgatggtttgtcgagcgcaacctggttaagcccgagggcaaggtgatcgatctgggctgcggtagaggcgggtggtcctattactgcgccggcctcaaaaaggtcacagaggtgaagggatacacgaagggcggccccggccatgaagaaccgatcccgatggccacatacggctggaaccttgttaagctgcacagcggtaaggacgtattcttcatgccgccggagaagtgcgacaccttactgtgcgatatcggtgaatccagccctaaccccaccatcgaggaagggcggacgttgcgggttctcaagatggtggagccatggttacgtggcaatcagttttgtatcaaaatcctgaatccctacatgccgtccgtcgtggagaccctcgagcagatgcagcgtaagtacggtgggatgcttgtgcgcaaccccctcagccgcaattccacccacgagatgtactgggtctcgtgtggcacagggaacatcgtgagcgctgtgaacatgacctcacgcatgctcctgaatcggttcactatggcccacagaaagcccacctacgagcgcgacgtcgatctcggggctgggacccgacatgtagccgtggagcccgaagtcgccaacctcgacataatcggtcaaagaatagagaatattaagaatgaacacaagtccacgtggcattacgacgaggacaacccgtacaagacctgggcataccacggctcatacgaggtgaagccttcgggaagcgcctccagcatggtgaacggcgtcgtgcggctgctgaccaaaccatgggacgtgatacccatggtcacccagatcgcgatgacggatacgaccccgttcgggcagcagcgcgtgtttaaggagaaggtcgatacgagaacgccgcgcgccaaaagaggaaccacccaaatcatggaggtcacagccaagtggttatggggcttcctgtcccgtaacaagaagccacggatctgtacgcgggaagagttcaccaggaaggttcgcagcaacgccgccataggtgctgtattcatcgacgagaaccagtggaacagcgccaaagaagccgtggaggacgagcggttctgggacctggtgcaccgcgagagggagctccacaagcaaggcaaatgcgcgacctgcgtctacaacatgatggggaagcgcgagaagaagctgggcgagttcgggaaggcgaagggcagccgggctatatggtacatgtggctgggcgctcgcttcttagagttcgaggccctggggttcatgaatgaggaccactggttctcacgagagaactcccttagcggagtggagggggaggggttacacaaactgggttacatactacgagacatctcaaagatcccgggcggcaacatgtacgccgacgacaccgccgggtgggacacgcggatcaccgaggatgacctccagaatgaggcgaagatcacagatatcatggagcccgagcatgccctcctggcgactagcatattcaaacttacgtaccaaaacaaagtggttcgtgttcagcgacccgccaagaacggcacagttatggacgtaatatcgcgtcgtgaccaacgtgggagcggccaagtgggcacgtacggattgaataccttcacgaacatggaggtccagctgatccgccagatggaatctgaggggatctttcttcccagcgagctggagaccccgaacctggcggagcgggtcttagactggctggagaagcacggggccgagcgtttaaagcggatggccatctccggcgacgactgcgtggtgaagcccatcgacgaccgatttgcgaccgccctcaccgctctgaacgacatggggaaggttcggaaggatatcccacagtgggagcccagcaagggctggaacgactggcagcaagtcccgttctgctcccatcacttccatcagctgatcatgaaggacggccgcgagattgttgtgccctgccggaatcaggacgagctggtggggagagcccgggtgagccagggcgcagggtggtccctccgggaaacagcgtgcttaggtaagagctacgcccagatgtggcagttgatgtatttccacaggcgcgacctgcgactggcggccaacgcaatctgttcagcagtccccgtggactgggtgcctacgagccgcaccacctggtcgatccacgcccaccatcagtggatgactacagaggatatgctcagtgtgtggaaccgtgtgtggattgaggagaacccgtggatggaagacaaaacccacgtgagcagttgggaagaagtcccctacctggggaagcgggaggaccagtggtgcggcagtttaatcggcctcaccgcccgcgcgacctgggccacgaacattcaggtagcaatcaaccaagtgcgacgcctgatcgggaacgagaactatctggattacatgaccagtatgaaacggtttaagaatgagagcgaccccgaaggtgctctctggtga

SEQ ID NO: 23940 - RNA, 9879 nt, synthetic construct
  misc_feature 1..9879: note = derived and/or modified CDS sequence (opt11) from DENV-1__GQ199858__SS-prME
  source 1..9879: mol_type = other RNA
tcggtgacaatgctgctcatgctgctgccaaccgcactcgcctttcacctgactaccagaggaggggaaccccacatgatagtgagtaaacaagagcggggcaaaagcctcttattcaaaaccagtgctggtgtgaatatgtgcaccctgattgcgatggacctgggcgagttgtgcgaggacactatgacttacaagtgcccccagatcaccgaggccgaacctgacgacgtagactgttggtgcaacgccacggatacctgggtgacctacgggacctgcagtcagaccggggagcaccggcgcgataaaagatcagtggccctggcgccccacgtaggtctgggcctggagacgaggacggagacttggatgtcgtccgaaggcgcgtggaagcagatacagcgggtcgagacttgggccctccggcaccccgggtttacggtgatagccctgttcctcgcacacgccatcggtaccagcatcacccagaaggggataatcttcatcctgctcatgcttgtgaccccctccatggcgatgcgctgcgtcgggatcggtaatcgggacttcgtagaggggctaagcggcgccacgtgggtcgacgtcgtgcttgaacacggttcgtgcgtgaccacaatggccaagaacaaacccactctcgatatcgagctgctgaagacggaagtaaccaacccggcgattctccgcaagctctgcattgaggcaaagatatctaacaccactacggactcccgatgtccgacccagggggaggctaccctcgtagaggaacaggacgccaatttcgtgtgcaggcggacgtttgttgaccgcggctgggggaacggctgcggccttttcggcaaggggagcctgctgacttgcgctaagtttaagtgcgtgaccaaactcgagggcaagatagtgcaatacgagaacttgaagtactccgtcatagtgacggtgcacaccggtgatcagcaccaggttggtaacgagacaaccgagcacgggaccatcgctaccattacaccccaggcccccacaagcgagatacagctgactgactatggggcgttaacccttgactgcagccctcgaactgggctggacttcaacgagatggtgctcctgacgatgaaggagaaaagctggctggtgcacaagcagtggttcctcgacctgcccctgccctggacctccggggccagcacctcacaggaaacctggaaccgacaggatctcctcgtgacgtttaagaccgcccatgcgaagaagcaggaggtggttgtgctggggtcccaggagggtgccatgcatacggcactcaccggggccacagagatccagacgtccggcaccaccactatattcgccggccacctgaagtgcaggctgaaaatggacaaattgacactgaagggcacctcctacgtgatgtgcaccgggagcttcaagctggagaaggaggtcgcggagacgcagcacggcaccgtgttggtgcaggtcaaatacgaaggcacggacgctccctgcaagatcccattctccacacaagatgagaagggggtgacgcagaacggccggctcattaccgccaatccgatcgtgacggataaggagaaacccgtcaatatcgagaccgagccacccttcggggagtcctatatcgtggtgggcgccggcgagaaggcattgaaactgtcctggtttaagaagggaagctccatcggcaagatgtttgaggcaacggcccgcggtgcccgacggatggccatactcggggacacggcgtgggactttgggagcatcggaggcgtcttcacctccgtgggcaagctggtccaccaggtgttcggcaccgcctacggcgtgctgttcagcggcgtgtcctggacgatgaaaatcggcatcggtatcctcctgacctggctgggcctcaacagcaggtctacctccctgtccatgacctgtatcgctgtcgggatggtgacattatacctaggcgtgatggtccaagctgatagcgggtgcgtcatcaactggaagggccgagagctcaaatgcgggtctgggatctttgtgacgaacgaggtccacacctggaccgaacagtacaaattccaggccgactctccgaagagactgagcgcagcaatcggcaaagcgtgggaagagggggtgtgcggtataaggtccgcgacccggctagagaacatcatgtggaagcagatcagcaatgagctcaaccacatcttactcgagaacgacatgaagttcacggtagtagtgggtgacgccaacggcatactggcgcaagggaagaagatgatccgcccccagcccatggaacacaaatactcctggaaatcctggggaaaggctaagatcatcggagccgatatccagaacaccaccttcatcatcgacgggcccgacaccccggagtgccccgacaaccagcgggcctggaacatctgggaggttgaggattacggcttcgggatcttcacgaccaatatttggctgaagttgcgcgactcctacacccagatgtgtgaccatcggctcatgtctgcggccatcaaggactccaaggccgtgcacgctgacatgggttattggatcgagagcgagaagaacgaaacctggaagctggcgcgagcgtccttcatcgaagtgaagacatgcacctggcccaagagccacaccctatggtccaacggcgtgctggaaagcgagatgatcatcccgaagatctacggtggccccatctctcaacacaactaccgcccagggtacttcacccagactgcgggaccatggcacctcggtaagctcgaactggacttcgacctgtgtgagggaacaactgtcgtggtggacgagcactgcggcaaccgcgggccgagcctacggaccacgaccgtaaccggcaagatcatccacgagtggtgctgccgttcctgcaccctgcctcccctgcgtttccgcggggaggacggctgttggtatggaatggagatccggcccgtgaaggagaaagaggagaacttagtgcgctccatggtgtccgcaggtagtggagaagtggactctttctccctggggatcctgtgcgccagcattatgatcgaagaggtgatgcggtccaggtggtctaggaagatgctcatgaccggcaccctggccgtcttcctgttgcttatcatggggcagttaacctggaacgacctcattcgcctgtgcattatggtcggtgcgaacgcgtccgatcgcatgggtatgggcaccacgtacctcgccctcatggccaccttcaagatgcggcccatgttcgccgtgggcctgcttttcaggcggctgaccagccgcgaggtcctactcctcacgatcgggctatccctggtggccagcgtggagctcccgaactccctggaggagctgggtgacgggctagccatgggcatcatgatgctgaagttgctcacggagtttcaaccccaccagctgtggaccaccttgctgtctctgaccttcatcaaaaccaccctgtccctcgattacgcgtggaagaccaccgccatggcgctgagcatcatttccctgtttcctctctgcttgagcacgacctcccagaagaccacctggctgccggtcctccttggctcttttgggtgcaagcccctaaccatgttcctcatcaccgagaataaaatctgggggcgcaagtcctggcccctaaacgaggggattatggccatcggcatcgtcagcatcctgctctcgtccctgctgaagaacgacgtccccctcgccgggcccttaatcgcgggcggcatgctgattgcatgctacgtgatcagcgggtccagcgcggacctctccctggaaaaggccgcggaggttagctgggagcaggaggccgagcactccggtaccagccacaatattctggttgaagtgcaggacgacgggaccatgaaaatcaaggacgaggagcgagacgacactctcacaatcctgttgaaagccaccctcctcgctgtgtccggcgtctatcctatgtctatccccgccacacttttcgtgtggtatttctggcagaagaagaagcagcggtccggggttctttgggacaccccctcaccccctgaggtagagagagccgtgctggacgatggcatctaccggatcctgcagcgcggcctactcgggagatcccaggtgggagtcggggtgttccaggacggcgtatttcacacgatgtggcatgtcactagaggggccgtcctaatgtaccaaggcaagcggctggagcctagctgggcatccgtaaagaaggacctcatcagctacggcggtggttggagattccaggggtcctggaacaccggcgaggaggttcaggtaatcgcggtggagcccggcaaaaatccgaagaacgtccagacaacgcccggcacttttaagacccccgaaggtgaggtgggcgccatagcgctcgacttcaagccaggcactagcggatcccccatcgtgaacagagagggcaagatcgtaggcctttacgggaacggcgtggtaacgaccagcggcacctacgtatccgccatcgcccaggcgaaagccagccaggagggccccctcccggagatcgaggacgaggtgtttaagaaacgcaacctgaccatcatggacctgcacccagggtcaggcaagactcggagatacctccccgccatcgttcgggaggccatcaaacgtaagttgcggaccctgatcctcgcaccaacgcgcgtcgtagcttccgagatggcagaggcgctcaagggaatgccgattcgctaccagaccacggccgtcaagagtgaacataccgggcgggagatagtcgatctgatgtgtcacgcgaccttcacgatgcgcctcctgtcgccggtgcgggtgcccaactataacatgatcataatggacgaggcccacttcacggacccagccagcatcgccgcccgcggctatatctccacccgggtcgggatgggcgaggcagctgccatcttcatgacagccactccgcctgggtcagtggaagccttcccccagtcgaatgcggttatccaggacgaggaacgtgacatccccgagcggtcgtggaactccggctatgactggatcacggattttcccggcaaaaccgtctggttcgtaccgagcatcaagtccgggaacgacatcgcgaactgtttgcgcaagaatggcaagcgggtaatccagctcagccgtaaaaccttcgacaccgagtaccagaagactaagaacaacgactgggactacgtcgtaaccaccgacatcagcgagatgggagcaaattttcgggcggaccgtgtcatcgacccgcggcgctgcctgaagcccgtcatcctgaaagatggtccggagcgggtgattttagcaggtcctatgcccgtgacagtggccagtgccgcccagcgcaggggccgcattggccgcaaccagaacaaggagggggaccagtacgtatacatggggcagcccctgaacaacgacgaggaccatgcacactggacggaggcgaagatgctgctcgacaacatcaatacccccgaggggattattccggctttattcgagcccgagcgcgagaagtccgccgccatcgatggcgaataccgcttacgcggggaggcccgcaaaaccttcgtggagctcatgcggcgcggcgacctgcccgtttggctgagttacaaggtggcgtccgagggctttcagtactcagacagacgctggtgcttcgatggagaacgcaacaaccaggtgctcgaggaaaacatggacgtggagatctggaccaaagagggcgagcgcaagaagctgcgacccagatggctcgacgcccgaacctactccgacccgctcgcactacgcgagttcaaggagttcgcggccgggcgccgctctgtgagcggcgacctgatcctcgagatcggcaaacttccccagcacctgacccttcgggctcagaacgctttagacaacctggtcatgctccacaactccgaacagggcggtaaggcctaccgtcacgcgatggaggaactgccagacaccattgagaccctaatgctcctggcactgatcgcagttctcactgggggcgtgacgttatttttcctgagcgggaagggactgggaaagacctccatcgggctgttgtgcgtcaccgccagctccgccctcctttggatggccagcgtggagccccattggatagcggcctccatcatcctggagttcttcctcatggtgctgctcatcccggagcctgaccggcagcgcacgccccaagacaatcagttggcttacgtcgtgatcggtctgctgttcatgatcctcactgtggctgccaacgagatggggctcttggaaaccacaaagaaggatctcgggatcgggcacgttgcggcggagaaccaccagcacgctacgatgctagacgtggatcttcgtccggcctcggcctggaccctctacgcggtggctaccacggttatcacaccaatgatgcgccatacgatcgaaaacactaccgccaacatctccttaacggctattgctaaccaggccgccatcttgatgggcctagacaagggctggccgatcagcaagatggatatcggggtgcccctgttagccttaggctgctattcccaggtaaatccgctgactctgaccgcggcggtcctcatgctggtggctcattacgccataataggtcccggtctgcaggcgaaggccacccgggaggcgcaaaagagaaccgccgccggcatcatgaagaaccccacagtggacggcatagtagccatcgacctcgaccccgtagtgtacgacactaaattcgaaaaacagctgggacagatcatgcttctaatcctgtgcacctcgcagattctgctcatgcgcacaacttgggccctgtgtgaaagtatcaccctggcgacgggacccctcacgacgctgtgggagggcagccccgggaagttctggaacacaaccatcgccgtctccatggccaacatctttagggggagctacctggccggagccgggctcgcgttttcactaatgaagtccctcggcgggggccgccgggggaccggagcccagggcgagaccctcggggagaagtggaagcgccaactgaatcagctgtcgaagagtgagtttaacatctacaagcggagcggcatcatggaggtcgaccgcagcgaggccaaggaggggctcaagcggggcgagaccacaaagcacgccgtaagtcgcggcacagcgaaacttcgttggttcgtagagcgaaacctggtgaaacccgaaggcaaagtgatagatttagggtgcgggagaggagggtggtcctattactgcgccggattaaagaaggtcaccgaggtcaaggggtacacgaagggcggactggggcacgaggagcccatcccgatggcgacctacggatggaacctggtgaaactacacagcggcaaagacgtcttcttcatgccaccagagaaatgtgataccctgctatgtgacatcggcgaatccagccccaatccgaccatcgaggaggggcggacgctccgggtgctgaaaatggtggaaccctggctgcgcggcaaccagttctgcatcaagatcctcaacccctacatgccgtccgtcgtggagacgctggagcagatgcagcgtaagtacggagggatgctggtccggaacccgctctcaagaaattccacgcacgagatgtactgggtctcttgcggcacgggaaacatcgtgtccgccgtaaacatgaccagccgcatgctgctgaatcggttcacaatggcccatcgcaagcccacatacgaacgcgatgtcgacctgggcgcgggcacccgtcacgtggccgtggagcccgaggtggccaacctggacatcatcgggcaaagaatcgagaatattaagaacgagcataagtcaacgtggcattacgacgaggacaacccctacaagacttgggcctaccacggtagctacgaggtgaagccgtcaggctctgcctccagcatggtcaacggcgtggtgcggctgttaaccaagccatgggacgtgatccccatggtcacccagatcgcgatgacggataccacccctttcggtcagcagcgtgtgttcaaggaaaaggtggacacccgtactccgcgcgccaagcggggcaccacccagattatggaggtgaccgccaagtggttgtggggatttctgtcgcgcaataaaaagcctaggatctgcacgcgcgaagagttcacccggaaggtgcgctcaaacgccgcaatcggggcggtcttcgtggacgagaaccaatggaactcggccaaggaggcagttgaggacgaacggttttgggacctcgttcacagggagcgggagctgcacaaacagggaaaatgtgcgacctgcgtctacaacatgatggggaagcgcgagaagaaactgggcgagtttgggaaggcgaagggctcccgggccatctggtacatgtggctcggcgcccggttccttgagtttgaggccctggggtttatgaatgaggaccactggtttagcagagagaactccctcagcggcgtggagggcgagggcctgcacaagctggggtacatccttcgcgacatctccaaaatacccggcggtaacatgtacgcagacgacacagcggggtgggacacccggatcactgaggacgacctgcagaatgaggccaaaataaccgatatcatggagccggagcatgccctgctcgctacctccatcttcaagctgacgtatcagaacaaagtcgtgcgagtgcagagacccgcaaagaatggcaccgttatggacgtaatctcacggcgcgaccaacgggggagcggccaggtgggcacctacggattaaatacattcacgaatatggaggtccagctcatcaggcagatggagtcggagggcatcttcctgccttcggagctggaaaccccgaatcttgcagagcgggtgctggactggctggaaaagcacggagctgagcgattaaagcgtatggccatctccggcgatgattgcgtcgtcaagccgattgacgaccgtttcgccaccgccttaactgctctgaacgacatggggaaggttcggaaagacatcccgcagtgggagcccagcaagggctggaacgattggcaacaggtccccttctgctctcaccacttccaccagctgatcatgaaggacggccgcgagatcgtcgtgccgtgccggaaccaggacgagctggttggtcgcgcccgcgtgtcacagggagccggttggtcactgcgcgagactgcctgcctcggcaagtcttacgcccagatgtggcagttgatgtactttcatcgtcgcgacttgcggttagcggccaacgccatctgctctgccgtgcccgtcgactgggtccccacgagccgtaccacctggagcatccatgcgcaccaccagtggatgactacggaggacatgttgtccgtgtggaaccgggtgtggatcgaggagaacccctggatggaggacaagacccacgtgtcttcgtgggaagaggtgccctacctggggaagcgcgaggaccagtggtgtgggagcttgattggcctcaccgcacgcgccacctgggcgaccaacatacaggtggcaatcaaccaggttcggcgcctaatcgggaacgagaactacctcgactacatgacctccatgaaacgcttcaagaatgagtccgaccccgagggcgctctgtggtga

SEQ ID NO: 23941 - RNA, 9879 nt, synthetic construct
  misc_feature 1..9879: note = derived and/or modified CDS sequence (opt11) from DENV-1__GQ199859__SS-prME
  source 1..9879: mol_type = other RNA
agcgtgaccatgttactgatgttactgcccaccgctcttgcctttcacctcacaactcgcggcggggagccccacatgattgtgtctaagcacgaacgggggaagagcctcctattcaagacgtcaaccggggtgaacatgtgcacgctgatcgccatggacctgggcgagctctgtgaggacaccatgacctacaagtgcccccgtattacagaggcggagcccgacgacgtggactgctggtgcaacgcaacggacacctgggtgacctacgggacctgcagccagacgggcgagcaccggcgcgataagcgttccgtggccctggctccccacgtgggcctggggttagagacccgcaccgagacctggatgagctccgaaggcgcctggaagcagatccagcgggtggagacgtgggccctacgccacccggggtttaccgtgatcgccctgttcctggcccacgcgataggcaccagcatcacccagaaggggatcatcttcatcctgctgatgctcgtcacgcccagtatggccatgcggtgcgtcggcataggcaaccgtgacttcgtggaggggctgtcgggcgccacctgggtggatgtcgtgttggaacatgggtcctgcgtgacaaccatggccaagaacaagcccacgctcgacatagaactgctgaaaaccgaggtgaccaaccccgccgtgctgcggaagctttgcatcgaggcgaagatcagcaacaccacgaccgacagtcgatgccccacgcagggcgaggccaccctggtggaggagcaggacgccaactttgtatgccggagaacgctcgtggatcggggttgggggaacggctgtggactgttcggcaagggaagcctgctgacgtgcgccaagtttaagtgcgttacaaagctggagggcaagatcgtccagtatgagaacctgaaatactctgtgatcgtaactgtccacactggcgaccagcaccaggtggggaacgagaccaccgagcacggcaccatcgccacgatcacgcctcaagcgcccaccagcgagatccagttaaccgactatggcgccctgactctggactgtagcccccggacgggtctcgatttcaatgagatggttctgctgaccatgaaagagaagtcctggctcgtgcacaaacagtggttcctggacctgccgcttccatggacctccggagccagcacaagccaggagacgtggaaccggcaggacttactggtcaccttcaagaccgcccacgccaagaagcaggaagtcgtcgtgctcggctcccaggagggcgcgatgcacaccgccctgaccggggctaccgagattcagacttccggcacaacgaccatcttcgcagggcatctcaagtgccgcttgaagatggataagctgaccctgaaaggcaccagctacgttatgtgcacggggtcgttcaagctggagaaggaggttgccgagacccagcacggcaccgtgctcgtccaagtgaagtacgagggaaccgatgcgccctgcaagatccccttcagcacgcaggacgagaagggggtgacacagaacggcaggctgattaccgccaacccgatcgtgaccgacaaggagaagcccgtgaacatagagactgagccgcccttcggggagagctacatcgtggtcggcgccggcgagaaggcgcttaaattatcatggttcaaaaaggggagcagtatcggcaagatgtttgaggcgaccgcccgcggcgcccggcgcatggccatcctgggcgataccgcctgggacttcggcagcatcggcggagtgttcaccagcgtggggaagctggtccaccaggtgttcggcacggcgtacggtgtcctcttcagcggcgtatcctggaccatgaagatcgggatcggcatcctactgacctggctaggactgaacagccgcagcaccagcctgagtatgacgtgcattgccgtggggatggtcactctctaccttggcgtcatggttcaggccgactcaggatgcgtgatcaactggaagggacgggagctaaagtgcgggtcaggcatctttgtcactaacgaagtgcatacctggaccgagcagtacaagttccaggccgacagcccgaagcgactcagcgccgcaatcggcaaggcatgggaggagggggtctgcggcatccggagcgccacgcgcctggaaaacattatgtggaagcagattagtaatgaactgaaccacatcttgttagagaacgacatgaagttcaccgtcgtggtgggcgacgccaacggaatcttggcccaggggaagaagatgatcagaccccagcctatggagcacaagtactcctggaaatcttggggcaaggcaaagataatcggcgctgacatccagaataccaccttcatcatcgacgggcccgacacgccggagtgccccgacgaccagcgcgcttggaacatctgggaggtcgaggactacggattcgggatctttaccacaaacatctggctcaaactgcgggactcctacacgcagatgtgcgaccacagattgatgagcgccgcgatcaaggactccaaggctgtgcatgcggacatgggctattggatagaaagcgagaagaacgagacgtggaagctcgcccgggcctccttcattgaggtgaagacttgtacctggcccaagagccacaccctgtggtccaacggcgtcctggagagcgagatgattattcccaagatctacggaggcccgatctcccagcacaactatcgccccgggtacttcacgcaaaccgcgggcccctggcacctcggtaagctggagctggacttcgacctctgcgaggggaccaccgtagtggtcgacgaacattgcggcaatcgggggccgagcctgcgcacgaccaccgtgaccggcaagatcatccacgagtggtgctgtcggtcctgcactctgccgcccttacgattccgcggggaggacggctgctggtacgggatggagatccgccctgtgaaggagaaggaagagaacctggtccggagcatggtgtccgccggcagcggcgaagttgacagcttctccctggggatcctctgcgtctcaatcatgatcgaggaggtgatgcgctcaagatggagccgaaagatgctgatgaccggcaccctggccgtattcctcctgctgatcatggggcagctcacctggaacgacctgatccgtctgtgcatcatggttggcgccaatgcctccgaccgtatggggatgggcacaacctacctcgctctgatggctaccttcaagatgcgcccgatgttcgccgtgggcatcctgtttagacgcctcacaagtcgggaggtgctgctgctcacgatcggactgtccttggtcgccagtgtggagctccccaactccttggaggagctgggcgacgggttggccatgggcatcatgatgctgaagctgctcactgagttccagccacaccagctatggacgaccttgctgagcctgacgttcataaagaccaccctgtccctcgactacgcatggaagacaacggccatggccttaagtatcgtaagcctgttccctctctgcctgtcaaccacctcccaaaagaccacctggttgccggtgctcctcggcagcttcggttgcaagccactgacgatgtacctcatcaccgagaacaagatttggggtcgcaagtcctggcccatcaacgaggggatcatggccatcggcatcgtgagcatccttctatcaagcctcctgaagaatgacgtgcccctggccgggccgctcatcgccggagggatgctgatcgcctgctacgtgattagcgggtcgagcgccgacttatcgttagaaaaggccgcggaggtgagctgggagcaggaggccgagcactccggcacatcccacaacatccttgtcgaggtgcaagacgacgggaccatgaggatcaaggacgaggagaaggacgacacgctgacaatattactgaaagccacacttctcgccgtgtccggtgtctacccaatgagcatccccgccactctgtttgtgtggtacttctggcagaagaagaagcagcgctccggggtgttgtgggacaccccttccccgcccgaggtcgagcgggcagtgctcgacgatggcatctaccgcatcctgcagcggggcttactggggcgctctcaggtgggagtcggggtgttccaggacggcgtgttccacaccatgtggcacgttacacgcggggcagtgctgatgtaccagggcaagcgcctggaacccagctgggcctccgtgaagaaggacctgatcagctacggcggcgggtggcggttccaggggtcttggaataccggcgaggaggttcaggtgatcgcagtggaacccgggaaaaacccgaagaacgtacaaacaacccctggcacgttcaagacacccgaaggcgaggtcggggcaatagcactcgatttcaagccgggcactagcgggtcgccgatcgtgaaccgagagggcaagatcgtcggcctgtatgggaacggcgtggttaccaccagcgggacctacgtcagcgccattgcccaggccaaggccagccaggagggccccctgcccgagatcgaggacgaggtgttcaaaaaacggaacttgacgatcatggaccttcacccgggtagcggcaaaacccgccggtacctgcccgccatcgtgcgagaagccatcaagcgaaagttgcgtacgctgatcctggcccccacccgcgtagtggcctccgagatggcggaggccctcaaaggcatgcccatccgttaccagacaaccgccgtaaagagcgagcacaccgggcgcgagatcgtcgacttaatgtgccacgccaccttcacgatgcgactgctctcaccagttcgcgtgcccaactataacatgatcatcatggacgaggcccatttcaccgacccggcgagcatcgccgccagaggctacatctccacccgcgtcgggatgggcgaagccgcagcgatctttatgaccgccacgccccccggcagcgtcgaggcctttccccaatccaacgccgtcatccaggacgaggagcgggatatccccgagcgcagctggaactccggctacgactggatcaccgacttccccggcaagaccgtctggtttgtgccgagcatcaaatccggcaacgacatcgccaattgcctgcggaagaacggtaagcgcgtgatacagctgagccgtaaaaccttcgacacggaataccagaagacaaagaacaacgactgggactacgtagtgaccaccgacatcagtgagatgggggctaacttccgcgccgaccgggtcatcgacccccgccggtgcctcaagcccgtcatactgaaggatggccccgagcgcgtgatcctggccggaccgatgcccgtgactgtcgccagcgccgcccaacggcgcggccggatcggccgcaaccagaacaaggagggggaccagtacgtgtacatgggccagcccctaaacaacgacgaggaccacgcccactggaccgaggcaaagatgctgctagacaacataaacacccccgaggggatcatcccggcccttttcgagcccgagagagagaagtccgcggccatcgatggcgagtaccggctgcgcggggaggctcggaagaccttcgtcgagctgatgcgccggggagacctacctgtatggctcagctacaaggttgcctccgagggcttccaatacagcgaccgccgatggtgcttcgacggcgaacgcaacaatcaggtcctggaggaaaacatggacgtggaaatctggaccaaggaaggcgagcggaagaagctccgccctcggtggcttgacgcccgaacgtactccgaccccctggcgctccgggagtttaaggagtttgccgccgggcgccggagcgtgagcggcgacctgatcctggagatcggcaagctcccccagcacctgaccctgcgtgcccagaatgcgctcgacaacctggtcatgctgcacaactccgagcagggcggaaaggcgtaccgacacgccatggaagagctccccgacaccatcgagacccttatgctgctcgccctgatcgccgtgcttaccgggggcgtgaccctcttcttcctgagcggtaagggcctgggcaaaacctccattgggctgctgtgcgtcaccgcgtcatccgccctgctctggatggccagcgtggagccccactggatcgccgcctccatcatcctggagttcttcctgatggtgctcctgatccctgaacccgatcgccagcggacgccccaggacaaccaactggcgtatgtcgtgatcggcctgcttttcatgatcctgaccgtcgcagccaacgagatggggctcctagagaccaccaaaagggacctgggcataggacacgtagccgcggagaaccaccagcacgcgacgatgctcgacgttgacctgcggccggctagcgcctggaccctgtacgccgtggccaccaccgtcatcacgcccatgatgcgccacaccatcgagaataccaccgcgaacatctccctcacggccatcgcaaaccaggccgccatcctgatgggcctcgacaagggatggcccatctccaagatggatataggggttcccctcctggcgctggggtgctattcccaagtgaacccgctcaccctcacagccgccgtcttaatgctcgtggcccactacgcaatcatcgggcccggcctgcaggccaaggctacccgcgaggcccagaagcggacggccgcggggatcatgaaaaaccccaccgtcgacgggatcgtcgccatcgatttagaccccgtggtgtacgacgccaaattcgagaaacagttaggccaaataatgctgctgatcttgtgcaccagccagattctgctgatgaggaccacgtgggccctttgtgagtccatcacgctggcaaccgggccgctgacaacgctctgggagggtagccccggtaagttttggaacaccaccatcgcagtctcgatggccaacatcttccggggcagctacctggcaggcgcagggctggctttctccctcatgaagtctttaggcgggggccgccgggggaccggcgcgcagggggagacactgggggagaagtggaaacgtcagctaaaccagctatccaagcccgaatttaacacctacaagcggtcaggcatcatggaggtggaccgctcagaggcaaaggaagggctgaagcggggcgagaccaccaagcacgccgtgagtcgcggaaccgccaagctacggtggttcgtcgagcgcaatctggtaaagcccgagggcaaggtgatcgacttggggtgcgggcggggcggatggagctattactgcgcgggcctgaagaaggtcacggaggtgaaggggtataccaaaggaggcccgggccacgaggagcctatccccatggccacttacggctggaacttagtgaagctgcactccgggaaggacgtctttttcatgcccccggaaaagtgtgacaccctgctctgcgacatcggcgagagctcccccaaccccacgatagaggaggggaggaccctacgggtgctgaagatggtggagccctggctccgcggcaaccagttctgcataaagatcctgaacccgtacatgcccagcgtcgtggagaccctggagcagatgcagcggaagcacggggggatgctcgtgcgcaaccccctctcccggaacagcacccacgagatgtactgggtctcctgcggcacggggaacatcgtgagcgcggtgaacatgacctcccgcatgttgctcaaccgcttcaccatggcacaccggaagcccacctacgagagggacgtcgacctgggcgccggcacacgccatgtcgcagtggagccggaggtcgccaacctagacatcatcgggcaacggatcgagaacataaagaacgagcacaagagcacctggcactatgacgaagacaacccctataagacgtgggcctaccacggatcctacgaggtgaagccctcggggtccgcgagctccatggttaacggtgtagtgcggctcctgaccaagccctgggacgtcatcccgatggtgactcagatcgccatgaccgacacaaccccctttgggcagcagcgtgtcttcaaggagaaggtcgacactcggacacctcgggctaagcggggtaccacacaaatcatggaagtcacagccaagtggctgtggggcttcttaagccgcaacaagaagccgcggatctgtacccgcgaggagttcacccgcaaggtacgctccaacgccgcaatcggggccgtctttgtcgatgaaaaccagtggaacagcgcgaaggaggccgttgaggacgagcgtttctgggacctggtgcaccgcgagcgggagctgcacaagcagggcaaatgcgcgacctgcgtgtacaatatgatggggaagcgagagaagaagctcggagagttcggaaaggccaagggctcacgggcaatctggtatatgtggctgggcgcccggttcctggagttcgaggccctcgggttcatgaacgaggaccactggttctcccgggagaacagcctgagcggagtggagggggagggcttacacaagctcgggtacatcctgcgcgacatcagcaagatcccaggtggtaacatgtacgccgacgacacggccgggtgggacacccgcatcaccgaggacgacctacagaacgaggcgaagatcacagacatcatggagcccgagcacgccttactggctacatcgatatttaagttaacctaccagaacaaggtagtgcgggttcagcgccccgcgaagaacggaaccgtcatggacgtaatctcccggcgcgaccagcggggatccggacaggtgggaacgtacggtctcaacacgttcacgaacatggaagtccagcttatccgccagatggagagtgagggcatcttccttccctccgaactcgagaccccgaacctggccgaacgggtgctggactggctggagaagcacggcgcggagagactgaaacggatggcgatctcaggcgacgactgcgtggtcaagccaatcgacgacagattcgctaccgccctgaccgccctcaacgacatggggaaggtgcggaaggacattccccagtgggagccgtccaaaggttggaacgactggcagcaggtcccattctgcagccaccactttcaccagctgatcatgaaggacggccgcgagatcgttgtaccctgccggaaccaggacgagctggtagggcgggcgcgggtctcgcagggcgctgggtggtccctccgcgagacggcctgtctgggcaagtcctacgctcaaatgtggcagctgatgtacttccatcggcgcgacctccggctggctgcgaatgccatctgttcagcggtgccggtggactgggtcccgacctcccgcacgacctggagcatccatgcgcaccaccaatggatgaccacagaggacatgctgagcgtctggaatcgcgtgtggattgaggagaacccctggatggaggacaagacccacgtctccagctgggaggaggtcccctacctaggaaagcgggaagaccagtggtgcggcagcctaatcggcttaactgcgcgcgcaacgtgggccaccaacatccaggtagcaatcaaccaggtacggcgcctcatcggtaacgaaaactacttagactacatgaccagcatgaagcggtttaagaacgagtccgaccccgagggcgccctgtggtga

SEQ ID NO: 23942 - RNA, 9879 nt, synthetic construct
  misc_feature 1..9879: note = derived and/or modified CDS sequence (opt11) from DENV-1__JF937645__SS-prME
  source 1..9879: mol_type = other RNA
agcgtaacgatgttactcatgctattacccaccgcactagcttttcacctcaccacacgcggaggagaaccgcacatgatagtgtccaaacaagaacgaggaaaatcactgctattcaaaacgtcggcaggagtcaacatgtgcacgctcatagcgatggatctcggggaactatgcgaagacaccatgacgtacaaatgcccgcaaatcacggaagcggaaccagacgacgtagactgctggtgcaacgcgacagacacatgggtaacatacggaacctgctcacaaaccggcgaacatagaagggacaaacgaagcgtggccctcgctccacatgtcggtctcggactcgaaacccgaaccgaaacatggatgtcgtcagaaggggcttggaaacagatccaacgcgtagaaacatgggcattaagacacccggggttcacagttatagccctgttcttagcgcacgccataggcacttcaatcactcagaaaggtataatattcatcctactaatgctagtcacacccagcatggccatgaggtgtgtggggattgggaaccgggacttcgtcgaaggcttaagcggggccacctgggtcgacgtggtcctcgaacacggaagttgcgtcaccaccatggccaaaaataaacccacactagacattgaactattaaaaaccgaagtcacaaaccctgcgatactgcgaaagctatgcatagaggcaaaaatctccaacacgacaaccgacagcagatgcccaacgcaaggcgaggccaccctcgtcgaggagcaagacgcaaactttgtatgccgccggacactcgtcgacaggggctgggggaatggctgtggtttattcggcaaaggaagcctactgacatgcgccaaatttaagtgcgtgactaaactggaaggcaaaatcgtacaatacgaaaacctgaaatacagtgtgatcgtgactgtccatacaggcgaccaacaccaggtcggaaatgagacaaccgagcacggaacaatagccactatcaccccacaggcccccacgagcgaaatccaattgacagactacggtgcactcacacttgactgctcaccccggactggcctcgacttcaatgagatggtattactcacgatgaaagagaaatcatggttagtccataaacaatggtttctagacctgccattaccctggaccagcggggcatccaccagccaggagacatggaacaggcaagatctcctagtcacgttcaaaaccgctcacgccaagaaacaggaggtagtggtactgggcagccaggagggggcgatgcacacggccctaacaggagccactgaaattcagacgagtgggaccacgacgatcttcgcagggcacctaaagtgccgactgaagatggataagctaaccctcaaaggaacctcatatgtaatgtgtaccggttctttcaagttagagaaagaagtcgcggaaacgcagcatggaacagtgctcgtgcaggtcaaatacgaggggacagatgcgccatgtaaaatccccttcagcacacaggacgaaaagggggtaacgcagaacggccggctgatcacggcaaaccccattgtaactgacaaggagaaaccagtcaacatagaaaccgaaccacccttcggcgaatcgtacatcgtggtaggagcgggggaaaaagcactaaaattaagctggttcaagaagggaagcagcatcggaaaaatgttcgaagcaacagctcgaggggcacggcggatggcgatactaggagatacagcctgggatttcggcagcataggcggagtctttacatcggtagggaagctagtacatcaggtctttggaacagcgtacggagtactattcagtggggtaagctggacaatgaaaataggaatcgggattcttctaacctggttaggattaaacagccgaagcacaagtctatctatgacatgcatcgccgtaggcatggtgacactctaccttggcgtgatggtccaagccgatagcggatgtgttatcaattggaaaggacgggaactgaagtgtggttcagggatcttcgtgacgaatgaagtacacacttggactgaacagtataaatttcaagcggacagcccaaagagactcagcgccgccatcggtaaagcgtgggaagagggcgtatgcgggatccgcagcgcaacaagactagagaatataatgtggaaacaaatctccaatgagcttaaccacatcctgctagaaaacgacatgaaattcaccgtcgtggtcggagatgctaacggaatcctcgctcaaggcaagaagatgatacgcccacaaccgatggagcacaaatactcatggaaaagctggggcaaagcaaaaattataggagcggatatccagaacacgaccttcataatagacggtccagatacaccggagtgccccgacaaccaacgcgcatggaatatctgggaggtagaagactatggcttcggaatctttacaacaaacatctggctcaagctccgagacagctatacccagatgtgtgaccaccgtctcatgtcggcagccatcaaagatagcaaggcagtgcacgcagacatgggctattggatagagagtgagaaaaacgagacttggaagttagcccgcgcgtccttcatcgaggttaagacctgtacatggccaaaaagccacacactttggtcaaacggagtcctcgagtcggagatgataatcccgaaaatatacggaggacctataagccaacacaactaccgccctggctacttcacgcaaacggctggcccatggcatctgggtaagctagagctcgacttcgacctgtgcgaagggaccacagtagtagtggacgagcactgcggcaaccgggggccttcgctacgcacaaccaccgtcaccggaaaaataatacatgaatggtgttgccgatcctgcacgctgcccccacttcggtttcgaggcgaggacggatgctggtacggaatggagatacgaccagtgaaagagaaagaggaaaacctagttcgctccatggtctcagcaggatcgggcgaggtagattctttctcactaggcattctttgcgcaagtataatgatcgaggaagtgatgcggagccgctggagcaggaaaatgctcatgacgggaacgctcgcagtatttcttcttctaataatgggacaactaacgtggaacgacctaatacggttatgtataatggttggggcgaatgccagcgaccggatgggcatgggtaccacgtacctcgcgttaatggccacgttcaaaatgagacccatgttcgcagtcggactactattccgaagactaacaagtcgagaagtactactgctaacaattgggttatccctagtagcaagcgtcgaactaccgaatagcctcgaagaactgggagacggcctcgctatggggattatgatgttgaagctgctgacggagttccagccgcaccagctctggacaaccctcctgtcactcacattcatcaagacaacgctgagccttgactatgcctggaaaacgacggcgatggccctctccatagtgagccttttccccctctgcctaagcaccaccagtcagaaaacgacttggctgccggtactactaggatcgttcggatgcaagcctctcaccatgttcctaataacagaaaataaaatctggggccggaagtcttggcctctcaatgaagggattatggcaatagggatagtatccatactactcagcagccttctcaaaaatgacgtcccactggcggggcccctcatcgccggcgggatgcttatagcgtgctacgtcatcagcggatcgtccgcggacctctcccttgaaaaggcagcggaagtgtcctgggagcaagaagcggagcattcagggacgagccataatatattagtcgaggtccaggacgacggtacaatgaagattaaagatgaagaacgagatgacacactgacgatacttctcaaagctaccctcctagctgtatcgggggtctaccccatgtcaatcccggcgacactattcgtctggtatttctggcagaagaagaaacaaagaagcggggttctttgggacactccatctcctccggaagttgaaagggcagtcctagacgatggcatataccgcatactacagaggggactactggggcggtcgcaagtgggtgtgggagtgtttcaagacggagtctttcatactatgtggcacgtgacccgcggtgcggtgttaatgtaccagggcaaacgactagagccgagctgggcaagcgtcaagaaagacttaataagctacgggggcggctggcgtttccaaggaagttggaataccggagaagaggttcaagtcatagcggtcgagcccggtaagaacccgaaaaacgtgcaaacaaccccggggaccttcaaaacccccgaaggggaagtcggagccatcgcactagactttaagccgggaacaagtggatcgcccatcgttaaccgggaaggaaaaatagtcggactctatggaaatggcgtggtcaccacgagcggaacatatgtttctgccatagcacaggcaaaggcgtctcaggaaggccccttgccagaaatagaagacgaagttttcaagaagcggaacttaacgatcatggacttacaccccggctcgggaaagacgaggcggtacctgcccgcaatcgtaagagaggccatcaagaggaaacttagaaccctaatcctggcaccgacacgtgttgttgcatcagaaatggccgaagccttgaagggcatgcccatccgctaccagaccacagcagttaagtcggaacataccggtcgagaaatagtcgacctcatgtgtcacgccaccttcaccatgcgacttttaagccctgtcagagtgccaaactataacatgatcataatggacgaagcacattttacagacccggcaagcatagccgcacgcggatacatctcaacgcgggtaggtatgggcgaagcggccgccatctttatgaccgccaccccgcccggcagcgtagaagcattcccacaaagcaatgccgtcatacaagacgaagaacgcgacatcccagaacgcagctggaactcaggttacgactggatcaccgatttccctggaaaaacagtgtggttcgtgccaagcattaaatccggaaatgacatagccaattgcctaaggaaaaacggcaagcgggtaatacaattaagccgcaaaaccttcgacaccgagtaccagaaaacgaaaaacaacgattgggactatgtcgtgacaacagacataagcgaaatgggtgcgaacttccgggctgaccgcgtgatagatccacgcagatgcctgaaaccggtgattctcaaggacggacccgagagggtaatcctagctggtcccatgcccgttacagtcgcctcggccgcccaacggagaggacgaattggtaggaatcagaataaggaaggggaccagtatgtatacatgggacaaccactcaacaacgatgaagaccacgcgcactggaccgaagcaaaaatgctactcgacaatatcaacacgcccgaaggaattataccggcgttgttcgagccggagcgagagaaaagtgcagctatagacggggaataccgtctgcggggagaggcaaggaaaacattcgtagagctcatgcgacgaggcgacctcccggtctggctatcatacaaagtcgcatccgagggcttccagtattctgaccgccgctggtgcttcgatggggaacgaaacaaccaagtgctcgaggaaaatatggacgtagagatctggaccaaagagggcgagaggaagaaactaaggccacgctggcttgacgcaagaacatacagcgaccccctcgcacttcgggagttcaaggagttcgccgccgggcggcgcagtgtctcaggggacctgatattagaaattggaaagttgccccaacacttgacactacgggcacaaaacgctctcgacaatcttgtgatgctgcacaacagcgaacagggtgggaaagcctacaggcacgccatggaagaactccccgacacaatcgagacgttgatgcttctagccctaattgcggtcctaacaggtggggtcacgctgtttttcctttcaggcaaaggcctcggcaaaacctcgataggactgctgtgcgtaacagcttcaagcgctctactctggatggcctccgtcgaaccccattggattgcagctagcataatcctcgagttcttcctaatggtactactgataccagaacccgaccgacaacggacccctcaagacaaccagctagcgtacgtggtaatcggactcctgtttatgatacttactgttgccgcgaacgaaatgggcctcttggaaacgactaagaaagacctggggatcggccatgtagcagctgaaaaccaccaacacgcaactatgctagacgtcgatttacgacccgcgtcagcatggaccctgtacgcagtagccacgactgtcataacgccaatgatgcgacacaccattgagaataccacggccaacatcagcttgactgcaatcgcaaaccaagcggcaatcctgatgggattagacaaagggtggcctatatcaaaaatggacatcggagtaccactactcgcactaggatgttacagccaggtcaatccacttacattaaccgccgccgtccttatgctagtagcgcattacgccataataggcccaggactgcaagccaaggctacccgcgaggcgcaaaaacggacagcggccggaataatgaaaaaccccaccgtggatggaattgtcgcgatagacctggaccccgtagtttatgacgcgaagttcgaaaaacaactaggccagatcatgttactaattctctgcacatcccagatactgttaatgcgaacaacatgggccctatgcgagtccataaccctcgcaacagggcccctcaccaccctgtgggaaggtagtccagggaaattctggaacacaaccatcgcagtatcgatggcaaacatattcagaggaagctacttggccggtgctgggctcgcgttcagcttaatgaaatcgctagggggcggccgaagaggcacaggtgctcaaggagaaacactaggtgaaaagtggaaaaggcaactcaaccaactaagcaaaagtgaatttaacacctataaacggtcaggaataatggaagtagacagatccgaggcgaaggaaggcttgaagagaggcgaaacaactaaacatgcggtctccagaggcacagcgaaactcaggtggttcgtggaaaggaacctggtgaaacccgaagggaaagtgatagacctaggatgtggaagaggtggatggtcctattattgcgcaggtttgaaaaaggtcaccgaagtgaaaggctacacgaaaggaggcccgggccacgaagaacccatcccaatggccacgtacggttggaacctagtaaaactacactccggaaaagatgtattctttatgccgcctgagaagtgcgacacacttttgtgtgatattggcgaatcaagcccaaacccaacaatcgaggaagggcgtaccctaagagtcctcaagatggtggaaccgtggctgcgaggcaaccaattctgcataaaaatactgaatccgtacatgccgtccgttgtagaaacgttagagcagatgcaaagaaagcacggagggatgttggtgaggaatcccctgtcccggaacagcacacacgagatgtactgggtctcttgcggaacaggcaacatcgtctccgccgttaacatgacaagcaggatgctactcaatcgcttcacaatggcccacagaaaacccacctatgaacgagacgttgacctaggagccggaacccgacacgtggcagtagaacccgaggtggccaatttagatataattgggcagaggatagaaaatatcaagaatgagcataaatcaacgtggcattatgacgaggacaacccatacaaaacatgggcataccatggaagttatgaagtgaaaccgagcggcagtgcgtcctcaatggttaacggggtggtgagactgctcacgaaaccctgggacgtaataccgatggtaacacagatcgccatgaccgatacaacgcccttcgggcaacaaagggtcttcaaggaaaaagtagacacaagaacaccccgtgccaagcgcggcacaacacaaatcatggaggtaaccgcgaaatggctctggggcttcctgagtcgcaataagaaaccaaggatttgtacaagggaggagttcacgcgaaaagtccggagtaatgccgcaatcggagccgtattcgtcgacgagaaccagtggaactccgcgaaggaagcagtcgaggatgaacgcttctgggatctagtacaccgtgaacgggaactacataaacaaggcaaatgcgcgacatgcgtatataacatgatgggaaaacgggagaagaaactaggtgaatttggaaaagccaaagggagtcgcgccatctggtacatgtggttaggcgcgaggtttctcgagttcgaagctctcggcttcatgaacgaagatcactggttctcacgcgagaacagcctatcaggagtggagggagagggcctgcacaaactaggatacattctgcgagacatctcaaagatcccaggaggcaacatgtacgccgacgacacggcaggctgggacacacgaatcacggaagacgacctacaaaatgaagccaagatcactgacataatggaacctgagcacgcgttattagcaacaagcatcttcaaattaacctatcaaaacaaagtggtccgagtccaacgacccgcaaagaacggcaccgtaatggatgtgatctcacgacgggaccaacggggcagcgggcaagtcggcacatacggtctcaacacgttcaccaacatggaagtgcagttgatccgccagatggagagtgaaggcatatttctaccgagcgaactcgagacaccgaacctagcagaacgggttctcgactggcttgagaagcatggcgcggaacgcctaaagcgtatggcaataagcggtgacgactgtgtcgttaaacccatagatgaccgcttcgcaacggcactgacggcacttaacgacatgggaaaggtaaggaaggatataccgcagtgggagccaagcaagggttggaacgactggcaacaagtcccgttctgcagccaccacttccaccagcttataatgaaagacggcagagagattgtggtgccatgtagaaaccaggacgaactggtagggcgcgcccgagtgagtcaaggcgcaggttggagtctcagagaaacggcctgcctgggcaagtcatacgcccagatgtggcagctgatgtatttccatcggagggacctacgcctcgctgcaaatgcaatatgcagtgcagtcccagtcgactgggtcccaacgtcccgaacgacctggagcatccacgcccatcaccagtggatgactacagaagacatgcttagcgtatggaaccgagtatggatcgaagaaaacccatggatggaggacaaaacccacgtgtcgtcatgggaagaagtcccatacctcgggaagcgggaggaccagtggtgcggctcactgataggactaacagcgcgcgctacatgggccacaaacatccaggtagccatcaaccaggtcagacggctaataggaaacgaaaactacttagactacatgacctctatgaaacggtttaagaatgagagcgacccagaaggagccctatggtga

SEQ ID NO: 23943 - RNA, 9879 nt, synthetic construct
  misc_feature 1..9879: note = derived and/or modified CDS sequence (opt11) from DENV-1__FJ850114__SS-prME
  source 1..9879: mol_type = other RNA
agtgttaccatgttactcatgctcctacccaccgccctcgccttccacctgacaacgcgtggaggggaaccccatatgatagtttccaaacaagaacgtggaaagtccctcctgttcaaaacctcggccggcgtaaacatgtgcaccctcatagcgatggaccttggagaactctgcgaagacaccatgacttataaatgccctcaaattactgaagccgagccagatgacgtcgactgctggtgcaatgccacagatacctgggtaacctacggcacatgcagccagaccggagaacatcgacgggataagcggagcgtcgccctggcaccccatgtggggctcggactggaaaccaggacagaaacctggatgtcgtcagagggggcctggaaacaaatacagagggtggagacctgggcccttaggcacccgggttttacggtgatagcgctattcctagcccacgcgatcgggacctcgataacccagaagggaatcatcttcattttgcttatgctggtgactccctccatggcaatgagatgtgtaggcatcggtaacagggatttcgtggagggcctatccggtgcgacctgggtagacgtggtactcgagcacggaagctgcgtcacaacaatggccaaaaacaaacccaccctcgatatagagctattaaagaccgaagtcacttccccagcgatcttaaggaagttatgcatagaagcgaagatctcgaacactacaacagactccagatgccctacacaaggagaggcaaccctcgtggaagaacaagacgcaaacttcgtatgccggcggaccttcgtagaccggggatggggtaacggttgcggattgtttgggaagggttccctactgacctgcgcaaaattcaagtgcgtcacaaagctcgagggcaaaatcgttcagtacgagaaccttaaatacagcgtaatcgtgacagtccatacgggtgatcaacatcaagtaggcaacgaaactacggagcacggcacgatcgccacaataacgcctcaagccccaacgtccgagatccagttaacagactacggcgcactcacgctcgactgctctccacgaactggcctggattttaacgaaatggtactactaactatgaaggagaaaagctggctcgtgcacaaacaatggttcctagatctcccactgccgtggacaagcggggcatctactagccaagagacgtggaatcgacaggatctcctagtaacctttaaaacagcgcatgcaaagaaacaagaggtcgttgtgctgggcagtcaagagggcgccatgcacacggccctaacgggtgcgacggagatacaaacgtcgggcacaacgacgatcttcgcgggacacttaaagtgtcgcctaaagatggataagttgacactcaagggcacctcgtacgtgatgtgcacaggatccttcaaattagagaaagaagtcgcagaaacccaacacggtactgtcctcgtccaagtcaagtacgaaggaaccgacgctccctgcaagatccccttcagcacgcaagacgaaaagggggtcacgcaaaacggacgactcatcacagcaaaccccattgtcaccgacaaagaaaagccagttaacattgaaacggagccacccttcggagaatcgtatattgtagtaggcgccggcgaaaaggccctgaaattaagctggttcaagaaaggctccagcatcggcaaaatgttcgaggccaccgctcgcggagccaggaggatggcgatactcggcgacacagcctgggacttcggaagcatcggaggcgtttttaccagcgtcggaaagttagtccaccaagtattcggaacggcctacggcgtacttttctccggagtctcgtggacaatgaaaattggaattggcatccttctgacttggcttggtctaaattcacgaagtacctctctctcaatgacgtgcatcgctgtgggcatggtcacactctatctgggcgttatggtacaagcagacagcggctgcgtcataaactggaagggccgggaactgaagtgcggaagcggcatattcgtaacaaatgaagtccacacctggacagagcaatataaatttcaggcagacagcccaaaaagactctcagccgccataggaaaggcctgggaagaaggggtgtgcggaatcagaagtgcaacccgccttgaaaacattatgtggaagcaaatttcaaacgaactcaatcacatcctactcgaaaacgacatgaaattcacggtagtagtcggagacgcgaacggaatactagcgcagggtaagaagatgatccgccctcaacctatggaacataaatactcctggaagtcctggggcaaggcaaaaatcataggcgccgacatccagaatacaacattcatcatagacggcccagacacgcccgaatgcccagacaaccagcgagcatggaatatatgggaagtggaagactacggattcggaatcttcaccaccaatatttggctcaagctaagagactcatacacccaaatgtgcgaccacaggctcatgtcagccgcaatcaaagattcgaaggcagtacacgctgatatgggatactggatcgaaagcgagaaaaacgaaacttggaaacttgcgcgcgcatctttcatcgaggtgaagacatgcacctggcccaaatcacacactctgtggtcaaatggtgtccttgagtccgaaatgataattccaaagacttacggcggcccaatctcgcaacacaactacagaccagggtactttacacagaccgccggaccttggcatttaggcaagctcgaacttgacttcgacctatgcgaagggactaccgtagtcgtcgacgagcattgtggtaaccgaggcccaagtctaagaaccactacagtcacaggaaaaataatacacgagtggtgttgtaggagctgcaccttgccccctctacgattccggggcgaagacgggtgctggtacggcatggaaatcagacctgtgaaggagaaagaagagaacttggtacggagtatggtgagtgcgggttcaggggaggtcgactccttttccctgggaatactatgcgcgtcgataatgatcgaagaagtaatgaggtcaagatggtcaagaaaaatgctaatgacgggcacactggctgtgttcctcctactaatcatgggccagcttacatggaatgacctgattcgtctgtgtatcatggtcggagccaacgcctccgaccggatggggatgggcacaacctacctagccctcatggcgacattcaaaatgcggccgatgttcgcggttggactgctgttcagaaggctaacatcacgggaagtactactacttaccatcggactcagcctcgtggcatctgtcgagctacccaacagcctcgaagaattaggcgacgggctggcgatggggattatgatgctcaagctcctaacagagttccaaccccaccagctatggactaccctactcagcctgaccttcataaaaacgaccctgtctttagactacgcctggaaaaccacggcaatggcattaagtatagtgagtctattccccctgtgtctctcgacaacttctcagaaaactacctggctgccggttcttctagggagctttggatgcaagccgctaactatgttcctaatcacagaaaacaagatttggggccgaaagtcgtggcccttgaatgagggtatcatggccataggcatcgtaagcatcctactcagctcgctcttgaaaaatgacgtgccccttgccggtccactgatagccggcgggatgcttatagcgtgctacgtgatctcgggcagctcagctgacctatcactggagaaagcagcagaagtctcatgggaacaagaagcagaacacagcggaacctcccacaatatacttgtagaagtacaggacgacggcacaatgaaaatcaaagacgaagaacgagatgatacgctaaccatattactcaaggccacccttctcgcggtaagtggagtctacccaatgtcaatcccagcgaccctcttcgtctggtacttctggcaaaagaagaaacaaagatctggcgtactttgggacacacctagccctccggaagtcgaacgcgccgtgttagatgacggcatataccgcatcctacaacgagggttactgggcagatcacaagtgggagtaggggttttccaagacggggtattccacacgatgtggcacgtcacccgcggcgccgtgctcatgtaccagggcaaaagactcgagcccagctgggcctcagtcaagaaagacctaatcagctacggtgggggctggagattccaaggaagctggaatacgggggaagaggttcaggttatagcagtcgaacctggaaagaatcccaaaaacgttcaaacaaccccaggaacattcaagacgccggagggcgaagtaggggccatcgcgctagacttcaaacctggcacctcgggatccccgatagtgaacagagaaggaaaaatcgtaggcttatacgggaacggggtagtgactacatcaggaacctacgtctccgccatcgcacaggccaaggccagtcaagagggccccttaccggaaatagaggacgaagttttcaagaaacgaaacctcacgatcatggacctacacccagggagtggcaaaacgcgtcggtacttaccggcaatcgtgagagaagcgataaagaggaaactccgcacgctaattctcgccccaacgagagtagtcgcctcagagatggcggaagcactgaaggggatgccgatccgatatcaaaccacagccgtcaaaagcgagcacaccggaagagagatcgtagacctaatgtgccatgcgacattcaccatgcgcctactctccccggtacgggtacccaactacaacatgatcataatggacgaagcgcacttcactgaccccgcaagcattgccgcgcgaggatacatatccacgcgcgtcggaatgggtgaagcagcggcaatattcatgaccgcgacaccgccagggagcgtggaagcatttccccaaagcaacgcggtgattcaagacgaagaaagggacatcccagaacgatcttggaacagtggctacgactggatcaccgacttccccggtaagacagtatggttcgtccccagcataaaaagtggaaacgacatcgcaaattgcctacggaagaacggcaagcgcgtcatacaactcagccgcaaaacattcgacaccgaataccagaagactaagaacaacgattgggattatgtcgtaacaaccgacatctcagagatgggcgccaacttcagagcagatcgcgtcatcgacccacgccgatgcttaaaacctgtgatacttaaggacggacccgagcgcgtgatcctggctggtccgatgccagtgacggttgcaagcgccgcacaacgccgaggacggatcggtcgaaatcaaaataaagaaggtgaccaatacgtctacatgggccaaccgctaaacaacgacgaggaccacgcccactggaccgaagcaaaaatgctactagataacataaacaccccagaaggtatcattcccgcgctctttgaaccggaaagagagaagtcggcagcaattgacggcgagtaccgactccgaggtgaggccagaaaaacattcgtggaactgatgcggcgaggagacctcccagtctggctaagctacaaagtggcaagcgaaggattccagtactcagaccgccgctggtgctttgacggagaacgcaacaaccaggtgctagaagagaacatggacgtagagatctggactaaggagggagaacgtaagaaacttagaccccggtggctcgatgcaagaacatatagcgatccgttagcactgcgcgagtttaaagagttcgctgcaggtagaaggagtgtatccggcgacctcatactggaaatcggcaaacttccacaacacctgacgttgcgagcacaaaacgccctagacaaccttgtcatgcttcacaattccgaacaaggagggaaagcgtacaggcacgccatggaagaactaccggatacgattgagacactaatgctcctcgccctgatagctgtgctaacaggaggtgtaacacttttcttcttaagcggaaaaggactgggaaaaacaagcataggcctcttgtgtgtcacagcgagctcagcactactgtggatggcatcggtcgaaccacactggatagcggcgtccattatactcgaatttttcctcatggtgctactcatcccagagccagaccgacagcgaacaccccaagacaaccaactcgcatacgtcgtaattggtctcctatttatgatactaacggtcgctgcgaacgagatgggattgttggagacgacgaaaaaggacctaggaatagggcacgtagccgcagaaaaccatcaacacgcaacaatgctcgatgtagatttacgtccagcaagtgcctggacactatatgcagtcgcaacaacggtaataactccgatgatgagacacacaatcgaaaacacaacagcaaacatttccctaaccgcgatagcaaaccaggcagcgatcctcatgggacttgacaaagggtggccaataagtaaaatggacatcggagtcccgctactagcgctggggtgttattcacaagtcaacccccttacgctcacagctgcggtattaatgctggtcgcccactacgcaatcatcggacctggactacaagcgaaagcaacccgcgaggcacagaaacgaacagcggctggcataatgaaaaacccgaccgtcgatgggatagtcgcgatcgacctggacccggttgtgtatgacgcgaaattcgaaaaacaactagggcagataatgctgctgatcctatgcacctcccaaatcctcctcatgagaacaacctgggcgttatgcgaatctatcacgctcgcaacaggaccgcttacgacactgtgggaggggtcgccaggtaaattttggaacacaaccatagcggtatctatggcgaacatcttccgcggctcctacttggccggtgcaggcctagcattctcactaatgaagtctctcgggggtggacgcagagggacaggggcgcaaggagaaaccttaggtgaaaaatggaaaagacaactaaaccagttaagcaaatcagagtttaacacatacaaacgctcgggcattatggaagtagatagatccgaggcaaaggaaggtctaaagcggggagagacaacaaagcacgcagtgtcgcgagggacagccaagctcagatggtttgtcgaaagaaatttggtgaaacctgaagggaaagtaatcgacctgggatgcgggcgaggaggttggagctactattgcgcgggcctcaaaaaggtcaccgaagtcaaaggctatacaaaaggaggcccgggacacgaagaacccatcccaatggcaacgtacggatggaacctagttaagctacactccgggaaggacgtattctttatgcctcccgaaaagtgcgacacactcctctgcgacatcggtgaatcgtcaccgaacccgacaatcgaagaaggccgaaccctacgagtcctcaagatggtagaaccgtggttaaggggcaaccagttctgtatcaaaatactaaacccttacatgccatccgtagtagagatccttgaacaaatgcaaaggaaacacggaggaatgctcgtgcgcaatcccctaagccgcaattctacgcatgaaatgtactgggtatcctgtggaaccggtaatattgtatccgcagtaaacatgacgagccggatgttactaaataggttcacaatggcgcacaggaagccgacgtacgaacgtgacgtcgacctcggagcaggaacacgacacgtggccgtagaacccgaggtggccaacctcgatataataggacaaagaatcgagaacatcaagaatgagcacaagtcaacgtggcactacgacgaagacaacccctacaagacatgggcgtaccatggctcctatgaagtcaaaccgagcgggtccgcgagcagtatggtcaacggggtcgtccgcctactcaccaaaccttgggacgtcataccaatggtcacacaaatcgccatgaccgatacgacccctttcgggcaacaacgcgtcttcaaggaaaaagtagacacacggacgccccgcgctaaaagaggaactacccaaataatggaagtaacagccaaatggctgtggggcttcctctcacgaaacaagaagccacgaatatgcacgcgtgaagagttcacgagaaaggtcagaagtaacgccgcaataggggccgtgttcgtcgacgagaaccaatggaactcggcaaaagaggccgtcgaggacgaacggttctgggatcttgtgcaccgcgaacgggaactgcacaagcaaggcaagtgcgctacctgtgtctacaacatgatgggtaaacgggagaagaaattaggggagttcggcaaagctaaagggtcgcgagctatctggtacatgtggctcggcgcgaggttcctagagttcgaggcactcggtttcatgaatgaagaccactggttctccagagaaaattcactcagtggtgttgagggagaagggctacataaactggggtatatcctcagagacattagcaaaattccaggaggaaacatgtatgcagacgacaccgcgggctgggatacacgtatcacagaagatgatctgcagaacgaggcgaaaataaccgacatcatggagccggagcacgcgctactcgcgaccagcatattcaagctgacttaccagaacaaagtggtacgtgtacaacgcccggctaaaaacggcaccgtcatggacgtaatttctagaagagaccagaggggatccggccaggtaggtacgtatggactgaacacatttacaaatatggaagtccaattaattcggcagatggaaagtgaggggatcttcctccccagcgaactcgagacaccgaacctggccgagcgagtcctagactggctcgaaaagcatggagcggaaaggttgaaaagaatggccataagcggtgacgactgtgtcgtcaagccgatcgacgatcggttcgcaacggcactgaccgcgctcaacgacatgggcaaagttagaaaagacatcccccaatgggagccgagcaaaggctggaatgactggcagcaagtcccattttgtagtcaccacttccaccagttaataatgaaagacgggcgcgaaattgtggttccttgccggaaccaagatgaacttgtaggtcgtgcgagggtctcacaaggcgcaggctggtcactgcgagagacagcctgcctggggaaatcgtacgcacaaatgtggcaactcatgtacttccacaggcgggacctccgcctcgcagctaacgccatatgcagcgccgtgccggtcgactgggtacccacatccaggacaacatggagcatccatgcgcaccaccagtggatgaccaccgaggacatgctcagcgtctggaaccgagtgtggatcgaagagaacccttggatggaggataaaacgcatgtatcatcatgggaggaggtaccctatctaggaaaacgcgaggaccaatggtgcggcagcctaataggcctgacagcccgggctacatgggcaacgaacatacaagttgctattaatcaagttcgacgtttaataggaaacgagaactacctcgattacatgatatctatgaagcggtttaaaaacgaaagtgatccagaaggagcattatggtga

SEQ ID NO: 23944 - RNA, 9879 nt, synthetic construct
  misc_feature 1..9879: note = derived and/or modified CDS sequence (opt11) from DENV-1__JN819402__SS-prME
  source 1..9879: mol_type = other RNA
agcgtgacgatgttgctcatgttactgcccaccgctcttgcattccacctgactacccgcggcggggagccccatatgatcgtgagcaaacaagagcgggggaaaagcctcctgttcaagaccagcgccggcgtcaacatgtgcaccctgattgcgatggacctgggcgaactatgcgaggacaccatgacctacaagtgcccccagatcaccgaggccgagcccgacgatgtcgactgctggtgcaatgccaccgacacctgggtaacctacggaacctgcagccagacgggcgagcaccgcagggacaagcggtccgtggccctggccccccacgtgggtctggggctcgaaacacgtacagagacatggatgtcatccgaaggcgcctggaagcagatccagcgcgtcgagacctgggcgctgcggcatccggggttcactgtaattgccctgttcctcgcacacgccataggcactagcataacacagaagggtatcatcttcatcttgctgatgctcgtgaccccctcaatggccatgcgctgcgtcggcatcggtaatcgggacttcgtggaagggctgagcggcgctacgtgggtggacgttgtgctggagcacggttcctgcgttaccacaatggccaagaacaagcccacgttagacatcgagctgttgaagacggaagtcaccaaccccgctatccttagaaagctgtgtatcgaggccaagatcagcaatacaaccacggactcccggtgcccgacacagggagaggccaccctagtcgaggagcaggacgctaacttcgtctgccgccggacctttgtcgatcgcggctgggggaacggctgcggcctcttcggcaaggggtcattactgacgtgcgcgaagttcaagtgcgtgaccaaactcgagggcaagatcgtgcagtacgagaatctgaagtactccgttatcgtgaccgtgcataccggcgatcagcatcaggtaggaaacgaaacgaccgagcacggcactatcgcgaccatcacgccccaggccccaacatcagagatccagctgaccgactatggggctctaaccctggactgctccccccgcaccggcctggacttcaacgaaatggtgctcctgacaatgaaggagaagtcctggctggtccacaagcaatggtttctagacctgccgctgccttggacttcaggggcctctaccagccaggagacctggaaccgccaggaccttctggtgacgttcaagactgcgcacgcgaaaaagcaggaggtcgtagtgctgggctcccaggagggggccatgcacaccgccctcacaggggccacggaaatccagaccagcggcaccaccacgatattcgccgggcacctgaagtgcaggttaaaaatggataagttgactctaaaggggacatcctatgtgatgtgtaccggtagcttcaaactggagaaggaggtcgcggaaacgcagcatggcacggtgctggtgcaggtgaagtacgagggcaccgatgccccctgcaagatccccttcagcacccaggacgagaagggggtgacgcagaacggtcgcctcatcaccgccaacccaatcgtgacggacaaggagaaacccgtcaacatagagaccgagcccccattcggggagtcgtacattgtcgtgggcgccggcgagaaggcgctgaagctctcctggttcaagaaagggagctccatcggcaagatgttcgaagccacggcccgcggggcacgccggatggcgatcctcggtgacaccgcctgggactttgggagcatcggcggcgtattcaccagcgtggggaagctggtccatcaggtcttcggcaccgcttacggggtgctcttcagcggagtgagctggacgatgaagatcgggatcgggatcctcctgacctggctaggcttgaacagccgctccaccagcctaagcatgacctgcatcgccgtcggcatggtgactctgtacctcggcgtaatggtccaggcagactctgggtgcgtgatcaactggaagggccgcgagcttaagtgcgggtccggaatcttcgtcaccaacgaagtccacacatggacggagcagtataagttccaggccgacagcccgaagcggctgtctgcggccatcggcaaggcctgggaagagggggtgtgcggcatccgcagtgccacccggctcgagaatataatgtggaagcagatctccaacgagctgaaccacatccttctcgagaacgacatgaaattcacggtggtcgtgggggacgcaaacggcatcctggcgcaggggaagaagatgatcaggccccagcccatggagcacaagtactcctggaagagctggggcaaggccaagattattggagccgacatccagaacaccacatttatcatcgatgggcctgacacaccggaatgccccgacaatcagcgggcctggaacatctgggaggtggaggactacggctttgggattttcacaaccaatatctggctgaagctccgtgactcctacacccagatgtgcgaccaccggctgatgagcgcggccatcaaggacagtaaagccgtccacgccgacatgggctactggatcgagagcgagaagaatgagacatggaagctggccagggcctccttcatcgaggtgaagacatgtacctggcctaagagccacacactctggtccaacggcgtgctggagagcgagatgatcatcccgaagatctacgggggcccaatctcccagcacaactaccggcccggatacttcacccagacggcgggcccctggcacctgggtaagctcgagctggacttcgacctttgtgagggcacgaccgtagtggtggacgagcactgcggcaaccgcgggccgtcgttacggaccacgaccgtcaccggaaagatcatacatgagtggtgctgccgctcctgcaccctgccgcccctgcggtttagaggagaggacggctgctggtacgggatggagatccgccccgtcaaggagaaggaggagaaccttgtgcgcagcatggtttctgccggcagcggcgaggtggacagcttctccctgggcatcctgtgcgccagcatcatgatcgaggaggtgatgcggtcccgctggagccggaaaatgctcatgaccggcaccctggccgtgttcctactcctgatcatggggcagctgacttggaacgatctcatcagactgtgcatcatggtcggcgcgaacgccagcgaccgcatgggtatggggaccacgtacctcgccttaatggccaccttcaagatgcggccgatgttcgccgtgggtctgctgttccgccggcttactagccgcgaggttctgctgctcactatcgggttgtcactggtggcgagcgtcgagctccctaactccctggaggaactgggcgacgggttagccatgggcatcatgatgctgaagctgctcacggagttccagccccaccagttgtggaccaccctgctctcactaacctttatcaaaacgaccctgtccctagactacgcttggaagaccacagcaatggcgttgtccatcgtcagtctcttcccgctctgcctaagcacgacaagtcaaaagaccacctggctgcctgtgctgctggggagcttcgggtgcaagcccctgaccatgttcctcatcacggagaataagatctggggccggaagtcttggccgctgaacgaggggattatggccatcgggatcgtctcaatcctgctctccagcctgctaaagaacgacgtccccctcgccgggccgctgatcgccggcggcatgctaatagcctgctatgtgatcagcggatccagcgcagacctctcgcttgaaaaagccgccgaggtcagctgggagcaggaggccgagcattccggaaccagccacaatatcctggtggaggtacaggacgatgggaccatgaaaatcaaggacgaggagcgtgacgacaccctcactatcctgctaaaggccaccctcctggcggtctccggcgtgtaccccatgagcatccccgccaccctgttcgtatggtacttctggcagaagaagaagcagcgctccggggtcctctgggacaccccgtccccaccggaagtggagagggcggttttggacgacggcatatacagaatcctccagcgcggcctcctaggacgttcccaggtcggcgtgggagtgttccaggacggcgtcttccacacgatgtggcacgtgacccgcggggccgttttaatgtaccagggcaagagattagagcccagctgggcctccgtgaagaaagatctcatcagctatggcggagggtggaggttccaggggtcctggaacactggtgaagaggtccaggtgatcgctgtagaacccgggaagaacccgaagaatgtgcagacaacgccgggcaccttcaaaacccccgagggtgaggtgggggccatcgctctggacttcaaacctggcaccagcgggtccccgatcgtcaaccgggagggcaagatcgtggggctgtacgggaacggcgtggtcacgaccagcgggacttacgtctccgctatcgcacaggcgaaggccagccaggagggaccactccccgagatcgaggacgaagtcttcaagaagcgcaatctgacaatcatggacttacatcctgggtctggcaagacgcgccgctacctccccgccatcgtccgggaggctatcaaacgcaagctgcggacactcatcttggctcccaccagggtcgtggcatccgagatggctgaggcactgaagggcatgcccatccgctaccagaccacggcggtcaagagcgagcacaccgggcgcgagatcgtggacctgatgtgccacgcaaccttcacgatgcgcctcctgtccccggtgcgggttcccaactacaacatgatcatcatggacgaggcccacttcacggaccccgccagcatcgcagcccgcggatatatctccacccgggtggggatgggggaggcggccgccatctttatgaccgccacgcctcccggcagcgtggaggcctttccccagtccaacgcggtcatccaggacgaggaacgcgacatccccgagcggagctggaactccggctacgactggatcacggacttccccggcaagaccgtgtggttcgtgccaagcatcaagtccgggaacgatatcgccaactgtctgcgcaagaacggcaagagggtcatccagctcagccgtaaaaccttcgacaccgaataccagaagacgaagaacaacgactgggattacgtcgtgaccaccgacatttccgagatgggggctaacttccgggccgatcgcgtcatcgacccccggcgctgcctgaagcccgtcattctgaaggacggccccgagcgcgtgatcctcgcggggccgatgcccgtcaccgtggcctccgccgcacagagacgagggcgcatcggccggaatcagaacaaagaaggcgaccagtacgtgtacatggggcagcccctgaataacgacgaggaccatgcccattggacggaggcgaagatgctgctcgacaatatcaacacccctgaggggatcatcccggcacttttcgagcccgaacgcgaaaagagcgccgccatcgacggcgagtaccgtctgcgcggggaggcccgaaagaccttcgtcgagctaatgcgccgcggcgacctgcccgtgtggctgagctacaaagtagcttccgagggctttcagtacagcgaccggaggtggtgctttgacggggagcgtaacaaccaggtccttgaagagaacatggacgttgagatatggaccaaggagggcgagcgcaagaagttacggccgcgctggctggatgcccggacatactccgacccgctagccctgcgcgagtttaaggagttcgccgccgggcggagaagcgtatctggcgacctgatcctcgagataggcaagctgcctcagcacctgacgctcagggcgcagaacgcccttgacaatctggttatgttacacaatagtgaacagggcggcaaggcctaccgccacgccatggaggagctgccggacaccatcgagacactcatgctcctggccctgatcgccgtgttaacggggggcgtcacgctgttcttcctgagcgggaagggcctcggcaagacctccatcggtctgctgtgtgtgaccgccagcagcgccctcctgtggatggccagcgtagagccgcactggatcgcggcctccatcatcctggaattcttcttaatggtcctgctgatcccagagcccgaccggcagagaacgccccaggacaaccaactagcctacgtggtgatcggcctgttgttcatgatcctaacggttgcggctaacgagatggggctgcttgaaaccaccaagaaagatctcggcatcgggcacgtggccgccgagaaccaccaacacgccaccatgctggacgtggatttacggccggccagcgcctggacgctctatgcggtcgctaccaccgtgatcacccccatgatgcgccacacgatcgagaacaccaccgcgaatataagcctgaccgccatcgccaaccaagcggccatactcatgggcctcgacaaaggctggcccatcagcaagatggacatcggggtgcccctactggcactcggctgctacagtcaggtcaacccactgacgctaaccgccgccgtcctcatgctcgtcgcccattacgccatcatcgggcccggcctgcaggccaaggcgacgcgggaggcgcagaagcgcaccgctgccggaattatgaaaaaccccacggtagacggcatagtggccatcgacctcgaccccgtggtgtacgacgctaagttcgagaagcagctgggccaaatcatgctgctgatcctgtgcacgagccaaatcctgctcatgcgcactacctgggcgctgtgcgagtccatcacgctagccaccggtccgctcaccaccctgtgggagggcagccccggcaagttttggaacacgaccatcgccgtttccatgactaacatcttccggggcagctacctggccggtgccgggttggcgttctccttaatgaagtccctgggcggggggcgccgggggaccggcgcccagggcgagacgctcggcgagaagtggaagcgccagctgaaccagctgtccaaaagcgagtttaacacctataagcggagcggcatcatggaggtcgaccgctccgaggcgaaggaggggctcaagcggggcgaaaccaccaagcacgctgtctcacgcgggacggcgaaactccggtggttcgtggagaggaacctggtgaagcccgaggggaaagtcattgaccttggctgcggacggggcgggtggtcatactattgcgccgggctcaagaaggtgacggaagtgaaggggtacaccaaaggcggccctgggcacgaggagccgatcccaatggccacctacggctggaacctggtcaagctgcacagcgggaaagacgtattcttcatgccccccgagaagtgcgacactctcctgtgtgacatcggcgaatcaagcccgaaccccacgattgaggaagggaggaccctccgggttctcaagatggtcgagccctggttgcggggcaaccagttctgcattaaaattttgaatccctatatgccgtccgtcgtggaaaccctcgagcagatgcaacggaagcacggtgggatgctggtccggaatcccctgtcgcggaactccacccacgagatgtactgggtgagctgcggaacggggaacatcgtgtccgccgtcaacatgaccagccggatgcttctgaaccggttcaccatggcccacaggaagcccacctacgagcgcgacgtggacttgggcgcgggcacgcgacatgtagccgtcgagccagaggtggccaacctcgacatcatcgggcagcgcatagagaacatcaagaacgagcacaagtccacctggcactacgacgaggacaacccatacaaaacttgggcctaccacggctcctacgaggtaaagccctccgggagcgcctcgtcaatggtcaacggagtggtgcgtctactgaccaagccttgggacgtcattcccatggtgacacagatcgcaatgaccgacaccaccccgttcgggcagcagcgcgtcttcaaggaaaaggtggatacgagaacgccccgggccaaacggggcaccacccagataatggaggtgacggccaagtggctctgggggttcctctcccggaacaagaagccccggatctgcacccgcgaagagttcacccggaaggtccgcagcaacgccgccatcggggcggtgtttgttgacgagaaccagtggaacagcgccaaggaggccgtagaggacgagcgcttctgggacctggtgcacagggagagggagctccacaagcagggcaagtgcgccacctgcgtgtacaacatgatggggaagcgcgagaagaagctgggggagttcgggaaggcgaagggctcccgggccatctggtacatgtggctgggcgcccggttcttggagttcgaggccctggggttcatgaacgaggaccactggttctctcgggagaactccttaagtggcgtcgagggggagggactccacaagctgggctacatcctgcgcgacatctccaagatcccggggggcaacatgtacgccgacgacacggcgggttgggacacgcgtatcacagaagacgacctccaaaacgaggccaaaatcaccgacataatggagcccgagcacgcactgctcgccacgtcgatattcaagctcacctaccagaacaaagtggtgcgcgtacagaggcctgccaagaacggcaccgtgatggacgtgatctccaggcgcgaccagcggggatctggccaggtcggcacctatgggctgaacacgttcaccaacatggaggtgcagctgatccgtctcatggagtcagagggcatcttcctgcccagcgaactggagacaccgaatctcgcggagcgggtactggactggctggagaagcacggtgccgaaagactcaagcgtatggccatctccggcgatgactgcgtcgtcaagcccatcgacgatcgcttcgcgaccgccctcactgcgctgaacgacatggggaaggtgcggaaggacatcccccagtgggaacccagcaagggatggaacgactggcagcaggtaccgttctgctcccaccatttccaccagctcatcatgaaggacggccgcgagatcgtggtgccctgtcggaaccaggacgaactggttgggcgggcgcgggtgagtcagggcgccgggtggagcctgcgagagacggcctgcctcgggaagagctatgcccagatgtggcagctgatgtatttccaccggcgggaccttcggctcgcggccaacgctatctgctccgccgtgcccgttgactgggtgccgacgtcacgcaccacctggagcatccacgcgcaccatcagtggatgacgacagaggacatgctgtccgtgtggaaccgggtttggatcgaggagaacccgtggatggaggacaagacccacgtgagctcctgggaggaggtgccctacctgggcaagcgcgaggaccagtggtgcggcagcctcatcggcctgaccgcccgcgccacctgggccaccaacatccaggtcgccatcaatcaggtgcggcgcctcataggtaacgagaattacctcgactatatgacctccatgaaaagattcaagagcgaatccgaccccgagggcgcgctttggtga

SEQ ID NO: 23945 - RNA, 9879 nt, synthetic construct
  misc_feature 1..9879: note = derived and/or modified CDS sequence (opt11) from DENV-1__FJ850113__SS-prME
  source 1..9879: mol_type = other RNA
agtgtgaccatgttactcatgttactgcccaccgctctcgccttccacctaaccacacggggcggagagccacatatgatcgtgagcaagcaggaacgggggaagtccctactgttcaagaccagcgccggggtgaacatgtgtaccctgattgcaatggacttgggagagctctgcgaggatacaatgacctacaagtgtcctcagattaccgaggcggagcccgacgacgtggactgctggtgcaacgccaccgacacctgggtgacctacgggacatgtagccagactggagagcatcggagagacaaacgatccgtggctctggcgccacacgtgggcttggggctcgagacgcggacggagacctggatgagctctgagggcgcctggaagcagatacaacgcgtcgaaacgtgggctctgcggcaccccggcttcacggtgatcgccctttttctcgcccatgccatcgggactagcatcacacaaaaggggatcatattcatcttgctgatgctcgttactccatccatggccatgcgctgcgtcggcatcggcaatagggacttcgtggaggggctgtctggggcgacgtgggtggatgtcgtactcgagcacgggtcctgcgttacaaccatggcaaagaacaagcccactctcgacattgaactgttgaagactgaggtcaccaatcccgcaatcttgcgcaagctgtgtatcgaagccaagatcagcaacaccacgactgattcccggtgtccgacgcaaggagaggctacgctcgtggaggagcaggacgcaaactttgtgtgccgccggacgtttgtcgaccgcggctggggaaacggctgcggtctgtttggtaaggggagtcttctgacgtgcgccaagttcaagtgtgtgactaagctggagggcaagattgtgcagtacgagaacctgaagtattccgttatcgtaacagtccacaccggcgaccaacaccaggtcgggaacgaaactactgagcatggtacaatcgcgactatcacgccccaagcccccacgagcgagatacagctgaccgactatggggcattaacgttagactgcagccctcggacgggtctggacttcaacgagatggtgctactcactatgaaggagaaatcctggctggtccacaagcagtggttcttggatcttcccctgccctggacatctggcgcttcgacgtcacaggagacatggaatcgccaagacctcttagtgaccttcaagaccgcccatgcgaagaaacaagaggtggtcgttctgggctcacaagagggcgcaatgcacaccgccctaaccggggccacggaaatacagaccagcggtaccactacgatattcgccgggcacctgaagtgtcgtctgaaaatggacaagctgaccctgaagggcacgagttacgtgatgtgcactgggagcttcaagctcgagaaggaagtcgcggagacgcagcacggcaccgtgctggtgcaggtcaagtatgagggcaccgacgccccttgcaagatcccattttccacacaggacgagaaaggagttacgcagaacggcaggcttattaccgccaacccaatcgtgaccgataaggagaaacctgtcaatatcgagacagagccgcccttcggggaaagctacatcgtggtgggggcaggggagaaggcgctgaagttatcctggttcaagaaagggagctcaatcgggaagatgttcgaggccaccgcccgcggggcacgcaggatggcgatcctcggcgacaccgcctgggacttcggtagcatcggtggcgtgttcacctccgtgggaaagttggtgcatcaggtgttcggcaccgcctacggggtcctgttctcgggcgtatcatggacgatgaagattggaatcgggatcctcctgacctggttgggcctcaatagccgctccacctcgctgtccatgacctgcatcgcggttgggatggtaacgctgtacttaggcgtgatggtgcaggccgactcggggtgtgtaattaactggaagggacgcgagctaaaatgcggctcgggcatattcgtgaccaacgaggtccatacatggaccgaacaatacaagtttcaggctgacagcccgaaacggctgtccgccgccattggcaaggcttgggaggagggcgtttgcgggattcgctccgccacccggctcgagaacatcatgtggaagcagatatcgaacgagctgaaccacatactgctggagaatgacatgaagtttacggtggttgtgggcgatgccaatggcatccttgcgcaagggaaaaagatgatccgcccccagcccatggagcataagtactcctggaagtcctggggcaaggccaagatcatcggtgctgatatacaaaacactaccttcatcatcgacggacccgacaccccggagtgccccgacaaccagcgggcctggaacatctgggaagtcgaggactacgggttcggtatcttcactacgaacatttggctcaagctacgcgactcctatacccagatgtgcgaccacagactgatgagcgcggcaataaaggattccaaagccgtccacgccgacatgggctactggatcgagtctgaaaagaacgagacctggaaacttgcccgcgcgtccttcatagaggtgaagacgtgcacctggcctaaaagtcataccctttggtcaaacggcgtgttagagagcgaaatgatcatccccaagatttatgggggtccgatatcccagcataactaccggcccgggtacttcacccagactgccgggccgtggcacctgggcaagctagagctggacttcgacctgtgcgagggcaccacggtcgtggttgacgaacactgcggaaaccgtgggccgtcgttacggaccacgacagtcaccggcaagattatccacgagtggtgctgtcgcagttgcaccctgccgcccttacggttccgcggggaagacggatgctggtacggtatggagattcgtcccgtcaaggagaaggaagaaaacctcgtgcgctcaatggtcagtgccggtagtggagaagtggacagcttttcgctcggaatattgtgcgcctccattatgatcgaggaggtgatgaggtcccgctggtcacggaagatgctcatgacggggactctggccgttttccttctccttataatggggcagctgacctggaacgatctcatcagattgtgcataatggtaggcgcaaatgcctccgaccgaatggggatggggaccacatacctggcccttatggctaccttcaagatgcggccgatgtttgccgtggggctcctgtttcgcagactgaccagcagagaggtactgctccttaccatcggtctttccctggtggctagcgtggagttacccaactccctcgaggagctgggcgacgggctcgccatgggtattatgatgttgaagctgctcacagagttccaaccccaccagctgtggaccaccctactctcgctgaccttcatcaaaacgaccttatcgcttgattatgcctggaaaaccaccgcgatggtactgtctatagtgtccctgttccccctctgcttgagcaccacctcccagaagaccacctggcttccggtcctcctgggctcattcggctgcaaacccctgaccatgttcctcatcacggaaaacaagatatggggccggaagtcctggccactgaacgaagggatcatggcgattggtatcgtctctatcctgctctcctccttgctaaaaaacgatgtgcccctcgccgggccgcttatagccggcggcatgttaatcgcatgctacgtcataagcggttccagcgctgacctctccctggaaaaggcggctgaggtgagctgggagcaagaggccgagcactccggtacttcgcataacattctggtggaggttcaagacgacggtaccatgaagatcaaggatgaggagcgcgatgacactctcactatcttgctgaaggccactctcctggccgtgagtggcgtgtaccctatgtccatcccggcgaccctgtttgtctggtacttctggcaaaagaaaaaacagcggagcggggtcctctgggacacccccagcccgcccgaggtggagcgggcggtcctagacgatggcatctaccgcatcctgcaaagaggcctcctgggccgatcccaggtgggcgtgggggtcttccaagacggcgtgttccacacgatgtggcacgtgacgcgtggggccgttctgatgtaccaggggaagcgtctagagcccagctgggctagcgttaagaaagacctcatctcgtatggtggagggtggcgcttccagggatcctggaatacgggcgaggaagtacaggtcatcgctgtggagcccgggaagaatcctaagaacgtacagaccacccccggaacctttaagacgcccgagggggaggttggggcaatcgcgcttgatttcaaacccgggacaagcgggtccccgatcgtgaaccgcgagggcaagatcgtgggcctgtacggaaatggcgtagtgacgacaagcggtacctacgtatccgccatcgctcaggccaaggcgtcgcaagagggccccctaccagagatcgaagacgaggtcttcaagaaaaggaatctgaccatcatggacctgcacccgggaagcggcaagactaggcgttacctgcccgctattgtgcgagaggccatcaagcgcaagctgcgaacactgatcttggcccccacccgcgtagtcgcatccgagatggcagaggcactaaaaggtatgcccatccgctaccagaccacggccgtcaagagcgagcacaccgggcgtgagatcgtggacctgatgtgtcacgccacgtttacgatgagattgctgtctccggtccgggttcccaactacaacatgattattatggacgaggcgcacttcaccgaccccgccagcatagctgctcgtggctatatctctacccgggtgggcatgggggaggccgcggcgatcttcatgactgctacgccgcccggatcagtcgaagccttcccccagtccaacgctgttatccaggatgaagagcgcgacatccccgaacggtcctggaattctggatacgactggatcacagattttcccggtaagaccgtgtggttcgtacctagcatcaagtccgggaacgacatcgcgaactgcttacgcaagaacggcaagcgggtgatccagctcagcagaaagaccttcgacaccgagtaccaaaaaacaaagaacaacgactgggactacgtggtcaccactgacatctccgagatgggggccaatttccgggctgaccgcgtgatcgaccccagacgctgcctgaaacctgtgatcctgaaggatggccccgaaagggtcatcctcgccggcccgatgcctgttaccgtcgccagcgctgcgcagcgtcgcggccgaataggcagaaatcaaaataaagagggggaccagtatgtctatatgggccaacccctgaacaacgacgaagaccacgcccactggacggaagctaagatgcttctagacaatataaatacccctgaagggatcatcccggcgctgttcgagccggagcgcgaaaagtccgccgccatagacggcgaataccgcctgcgaggggaggcccgtaagaccttcgtggagttaatgcggcgcggcgacctgccggtctggctgagctacaaggtggccagtgaaggcttccaatatagcgaccgacgctggtgcttcgacggcgagcgaaacaaccaggtcttggaagagaacatggacgtcgagatctggaccaaggaaggcgaacgcaaaaaactgcggccccgctggctagatgctcgtacgtactccgacccactcgcccttcgcgagttcaaagaattcgccgcggggcgacgcagcgtgagcggcgaccttatcttagagatcggcaagttaccccaacatctgaccctccgggcacagaacgcgctcgataacctggtgatgctccacaactccgaacagggcggaaaagcctacagacacgccatggaggagcttcccgacaccatagagaccctgatgctcctcgcgctcatcgcggtcctcacagggggggtgacgctgttcttcctgtctggcaaaggcctcggcaagacttccatagggttactctgcgtaaccgccagctcggccttactgtggatggctagcgtcgagccccactggatagccgcctccatcatcctggagtttttcttgatggtgctgctgatccctgagccggaccggcaaagaacgccccaggacaatcagctcgcgtacgtggttatagggttgctgtttatgatcctcaccgtggctgccaacgagatggggcttctggaaaccacgaagaaggacctcggcatcggccacgtggctgccgagaaccaccagcacgccaccatgctggacgtcgacttacggcccgccagcgcctggacgctctatgctgtagcgacgaccgtgatcacccccatgatgaggcacacgatcgagaacaccacagcgaacatatctctgaccgccatcgccaatcaggcggcgatactgatgggcctagataagggctggcccatcagcaagatggacatcggtgtccccctgctagctctcggctgttactcccaggtgaacccattgacgctgaccgccgccgttcttatgctggtcgcgcactatgcaatcatcggtcccggccttcaggccaaagccaccagggaggcccaaaaacgcacggcggcggggatcatgaagaacccaacggtcgacggcatcgtggctatagacctcgatccggtcgtgtacgacgctaaattcgagaaacagctcggccagatcatgctcctgatactgtgcaccagtcaaatcctgctcatgcggactacctgggccctgtgcgagtccataacactagcgacaggcccgctcaccaccctttgggagggcagccccgggaagttctggaataccaccatcgccgtgtccatggccaatatcttccgaggaagctacctggccggcgccgggctcgcgttctccctgatgaagtccctgggcggtggacgcagagggaccggcgcccagggtgagaccctcggcgagaaatggaaacgccagctgaaccagctgagtaagagcgagttcaacacgtacaagcgcagcggcatcatggaagtcgataggtcggaggcaaaggagggacttaagcggggcgaaaccactaagcacgccgtgtcaagaggtaccgcaaaactgcggtggttcgtagaacgtaaccttgtaaagccagagggcaaggttatagacctggggtgcgggcggggcgggtggtcctactactgcgctggcctgaaaaaagtcacagaggtgaaggggtacacgaagggcggccccgggcacgaggagccgatacccatggcaacctacggctggaatctggtgaagcttcatagcggaaaggatgtgttcttcatgccgcccgaaaaatgtgatactcttctgtgcgacatcggggaatcctcgccgaatcccacgatcgaagaagggagaacgctgcgggtcctcaaaatggtcgaaccatggttgcgcggaaaccagttctgcatcaagatcctgaacccctacatgccgtccgtggtagagacgttagaacagatgcagcggaaacacggtggaatgctggtgcgtaacccactgagccggaattccacccatgagatgtactgggttagctgtggtaccggtaacatcgtttccgccgtgaacatgacgagccgcatgctcctgaatcgtttcaccatggcgcatcggaagccgacatacgagcgcgacgtggacctgggagcagggaccaggcacgttgccgtggagcccgaggtggccaacttggacatcattgggcagcgcattgagaacatcaagaacgaacacaagagcacgtggcattacgacgaggacaacccgtacaagacctgggcctatcacggctcttacgaagtcaagccctccggctccgcctccagcatggtcaacggggtggttcgactgctgaccaagccctgggacgtaattcccatggtcacgcagatagcaatgacggacaccacacctttcgggcagcagcgcgtgtttaaggagaaggtggacaccagaacgccccgggccaagcggggaaccactcagataatggaggtcacagctaagtggctctggggcttcttaagtcgcaacaaaaagccacggatttgcacgcgggaggaattcacccggaaagtgcgctctaacgctgccatcggggcggttttcgtcgacgagaaccagtggaactctgccaaggaggccgtcgaggacgagcggttctgggacttagtgcatcgcgagcgggagctgcacaagcaaggtaaatgtgcaacctgcgtctacaacatgatgggtaagcgcgagaagaagctgggcgagttcggcaaggcgaagggatctcgtgcaatttggtacatgtggctaggcgcacgcttcttagagttcgaggctttagggttcatgaatgaagaccactggttctctagagagaactccttaagcggcgtcgagggggaaggactacataaactcggatatatactgcgagacatttcgaagatcccgggcggcaacatgtacgccgacgataccgcaggttgggacacgcggatcaccgaggacgacctccagaatgaggccaaaatcaccgacataatggaacccgagcacgcactgctggccactagcatcttcaaattaacgtaccagaacaaagtggtccgcgtgcagcgcccagccaagaacgggaccgtgatggacgtgatctcccggcgcgatcaacgggggtccggtcaggtgggcacctacgggctgaacacctttaccaacatggaggtgcaactgatccgcctcatggagagcgaaggcatcttcttgccgagcgagttggagaccccgaacctcgcggaacgtgtccttgactggctggagaagcacggagccgagcgactcaagaggatggctatctcgggtgacgactgcgttgtgaagccaatcgacgaccgcttcgccaccgcattgacagcgctgaacgacatggggaaagtaagaaaggacataccacaatgggagccctcaaaaggctggaacgactggcagcaagtgccgttttgctctcaccatttccatcagttgatcatgaaggatggccgcgagatcgtggttccctgcagaaaccaagacgagctggtgggccgcgcccgggtcagccaaggcgctgggtggtcgcttcgggagaccgcctgcctcggcaagtcatatgcccaaatgtggcaactgatgtacttccaccggcgcgacctgcgattagcggccaacgccatatgctccgccgtccctgtggactgggtgcccacgagccgcaccacctggagcatccacgcgcaccaccagtggatgacgacggaggatatgctgtctgtctggaaccgggtgtggatcgaggagaatccgtggatggaagataaaacacacgtgagcagctgggaggaggtgccttacctagggaaacgcgaagaccaatggtgcggcagtctcatcggcctgaccgcccgagcgacctgggccacgaatatccaggtggccatcaaccaggtccggcgtctgatcgggaacgagaactatcttgactacatgacctccatgaagcggttcaaatctgagtcagaccctgagggagcattatggtaa

SEQ ID NO: 23946 - RNA, 9879 nt, synthetic construct
  misc_feature 1..9879: note = derived and/or modified CDS sequence (opt11) from DENV-1__JF937635__SS-prME
  source 1..9879: mol_type = other RNA
tcggtgaccatgctgctcatgcttatgcccaccgccctggccttccacttaaccaccaggggcggcgagccccacatgatcgtcagtaagcacgagagaggcaaggcgctgctattcaagacgagcaccggggtgaacatgtgcaccctcatcgccatggacctcggcgagctgtgcgaagacaccatgacatacaagtgccccaggataactgaggccgagcccgacgacgtggactgctggtgcaacgccaccgacacatgggtgacctacgggacctgctcccagacgggggagcatcgtcgcgacaagcgtagtgtggccctcgcgccccacgtcggcctggggcttgaaacccgcaccgagacatggatgtccagcgagggcgcctggaagcagatccaacgggttgagacgtgggccttacgccaccccggattcacagtcatcgccctgttcttagcgcacgccatcggcacttcaatcacccagaaggggatcatcttcatcctgctgatgctggtgacgcctagcatggccatgcggtgcgtgggcataggcaaccgcgatttcgtggagggcttgtccggtgccacatgggtggacgtagtgctggagcacgggtcctgcgtaacgacaatggccaagaataagcctactctggatatcgagctcctgaagaccgaggtcaccaaccctgcagtgctacggaagctctgcatcgaggctaaaatatccaacaccacgaccgatagccgctgtccgacccagggcgaggcgaccctggtagaagaacaagacgctaacttcgtctgccggcggacgttcgtggaccggggctgggggaacggctgcgggctgttcggcaaggggtcgctcctgacctgcgccaagttcaaatgcgtgaccaaattggagggcaagatcgtccagtacgaaaacctcaagtacagcgtaatcgttactgtccacacgggcgaccagcaccaggtggggaacgagaccacggagcacggcaccatcgcaaccatcacgccccaagccccgacaagtgagatccaactgaccgactacggggccctgacccttgactgcagccctcgcacgggcctggactttaacgagatggttctgctcacaatgaaggagaaatcctggctggtgcacaagcagtggttcctggaccttccgctcccctggacaagtggggcttccacctcgcaggagacgtggaaccggcaggacctgctcgtgaccttcaagactgcccacgcgaagaagcaggaggtagtcgtgctgggcagccaggaaggcgccatgcacaccgcactgacgggggccaccgagatacagacttccggcaccacgacaatattcgcgggacacctcaagtgtcgcctgaagatggacaagctgaccctcaagggcaccagttatgtcatgtgcacgggctccttcaagctggagaaggaggttgcggagactcaacacggcacagttctagtccaagttaagtacgagggcaccgacgcgccctgcaaaattcccttcagcacgcaggacgagaagggggttactcagaacgggcgactgatcaccgccaacccgatcgttaccgacaaagagaagcccgtcaacatcgagacagagccgcccttcggggagagctatatcgttgtcggcgcgggcgagaaggctctcaagttaagctggttcaagaaagggtccagcataggtaagatgttcgaggcgaccgcgagaggggctcgtcgcatggccatcctaggtgatacagcgtgggacttcggttccatcggcggcgtgtttaccagcgttggtaaattagtgcaccaggtgtttggaacggcgtacggggtcttgttctccggggtcagctggaccatgaagatcggcatcggcatcctactgacctggctgggcctgaactcccgcagcacctccctcagcatgacgtgcatcgctgtgggaatggtcaccctatacctgggcgttatggtgcaggccgacagcggctgtgtgatcaactggaagggccgagagcttaagtgcgggagcggaatcttcgtcacaaacgaggtccacacttggaccgagcagtacaagttccaagcagactccccaaagcgcctgagcgcggccatcggcaaggcttgggaggagggtgtgtgcgggatccggagcgccactcggctcgagaacatcatgtggaagcagatctccaatgagctcaaccacatactgttagagaacgacatgaagttcaccgttgtggtgggggacgccaacggcatcctcgcgcaggggaagaagatgatccgcccccaaccgatggagcacaagtatagctggaaaagctggggcaaggccaagatcatcggcgccgacattcagaacaccacatttatcatagacggacccgacacgccggaatgccccgacgaccagcgcgcgtggaacatctgggaggtcgaggactacggcttcggtatcttcaccaccaacatctggctgaagttacgggactcttacacccagatgtgcgaccacagactcatgtccgcggccatcaaggacagcaaagccgtgcacgccgacatgggctactggattgagtccgagaagaacgagacgtggaagctggcccgggcgagcttcatcgaagtaaagacttgcacatggccgaagtcccataccctgtggagcaacggcgtccttgaatccgagatgatcatccccaaaatctatgggggcccgatcagccaacacaactataggcctgggtacttcactcagactgccggaccctggcacttagggaaactggagcttgatttcgatttgtgcgagggcaccaccgttgtggtcgacgaacactgtggcaaccgagggccgtctctgcgcacgaccaccgtgacaggcaagattatccacgaatggtgctgccgaagctgcactctgccgcctctccgcttccgcggcgaggacggctgctggtacgggatggagatccgccccgtgaaagagaaggaggagaacctggtccggagtatggttagcgccggcagcggtgaggtggatagcttcagcttggggatcctttgtgtctccatcatgatcgaggaggtgatgaggagccggtggtccagaaagatgcttatgaccggcacactcgccgtattcctgctgctcatcatggggcagttaacctggaatgacctaatccgcctctgcataatggtcggcgccaatgcaagcgatcggatggggatgggcacgacgtacctggcactgatggccacgttcaaaatgcgcccgatgttcgccgtaggcattctcttccggcgcctcacctcccgtgaggtgctgcttctgacgatcgggctatcgttggtcgcctctgtggagctgcccaattctcttgaggagctcggagatgggctcgcgatgggtatcatgatgttgaagctcctgaccgagtttcagccgcaccagctgtggacgaccctcctatccttaacgttcatcaagaccactctcagcctggactacgcgtggaaaaccacggccatggccctgtcaatagtgagcctctttcccctgtgcctgtccaccacttcgcagaagacaacctggcttcccgtattgcttgggtccttcggttgcaagcccctcaccatgtttctgatcaccgagaacaagatctgggggcgtaagagctggcccatcaacgagggaatcatggcgatcggcatcgtgtccattctgctgagctccctgctgaagaacgacgtccccttggccgggcctctgatcgccggcggcatgctgattgcatgctacgtgattagcggtagcagtgcagacttgagcctggagaaggcggccgaggtgtcctgggagcaggaagccgagcatagcggcacatcacataatatcttagtcgaggtgcaggacgacgggactatgcggatcaaggacgaggagaaggacgacacgctcaccatcctgctgaaggcaaccctcctggccgtgagcggcgtctacccgatgtcaatccccgcgacccttttcgtgtggtacttttggcagaaaaagaagcagcgcagcggggtgctctgggacacgccctcccctcccgaggtcgagagagctgtgttggacgacggaatctaccgcatcctgcagagaggcttactggggcgcagccaggtgggcgtcggggtgttccaggacggggtgttccatacaatgtggcacgtgactcgcggggccgttctgatgtatcagggtaagcgcctggagccctcctgggccagcgtgaaaaaggacctcatatcctacggcgggggctggaggttccaggggagctggaataccggcgaggaggtccaggttatcgctgtcgagcccggtaagaatcctaagaacgtccagacgaccccagggaccttcaagacctccgagggggaggtgggggcgatcgccctagacttcaagcccggcacgagcgggtcccccatcgtgaaccgcgaaggtaagatcgtaggtctctacggcaatggtgtggtgaccaccagcgggacatacgtctccgccatcgcccaagccaagacgtcacaggagggcccgccgcccgagatcgaggacgaggtgttcaagaagcggaacctcacgatcatggacctacacccggggtcgggcaagacccgccggtacctacccgcgatagtgcgcgaggccatcaagcggaagctccgcaccctgatcctggcccctacgcgcgtagtggcgtccgagatggcggaagcattaaagggcatgcccatccggtatcagaccaccgcagtgaaaagcgagcacacaggccgtgagatcgtcgacctgatgtgccacgctacgttcacgatgaggctcctatccccggtgcgcgtgcccaactacaacatgattatcatggacgaggcccatttcaccgacccggcgtcgatcgccgcacggggttatatttccactcgcgttgggatgggcgaggcggccgcaatcttcatgacggcaaccccacccggatcggtggaggcattcccccagagtaacgccgtgatccaggacgaggagcgcgacatccccgagagatcatggaactcaggctacgactggatcactgacttcccgggcaagaccgtctggttcgtgcccagcattaagtccgggaacgatatcgccaactgtctgcggaagaacgggaagcgcgtgatccagctaagccggaagacgttcgacaccgagtaccagaagaccaagaacaacgactgggactacgtcgtgaccacggatatctccgagatgggagccaacttccgtgccgaccgggtgatcgacccaagacggtgcctcaagccagtaatcctgaaggatggtcccgagcgcgtaattctggccgggccgatgcccgtgaccgttgccagcgcggcacagcggcgcgggcggatcggccgcaaccagaacaaagagggggaccagtacgtgtacatgggccaacccttaaacaacgacgaggatcacgcccactggaccgaggccaaaatgctgctggacaacatcaatacccccgaggggatcatcccggcgctctttgaacccgagcgtgagaagtccgcggcgatcgacggcgagtataggctgcgcggggaggcgcggaagaccttcgtcgagctaatgcggcggggcgatctacccgtgtggctgagctataaggtggcctccgagggcttccagtatagcgaccgccgttggtgcttcgacggggagcgcaacaaccaagtcctggaggagaacatggacgtggaaatatggacgaaagagggtgagcggaaaaagctccgtcctcggtggctggacgcccgaacctattccgatccgctggccctgcgggagttcaaggagttcgccgccgggcgccggagcgtgagcggcgacctgattctggagattggcaagctccctcaacacctgaccctgagggcccaaaatgcactcgacaacctcgtgatgctgcataacagcgagcaaggagggaaagcgtaccgccacgcgatggaggagctccccgacaccatagagacgctgatgctactcgccctgatcgccgtactgaccgggggcgttaccttgttcttcctgtccgggaagggcctgggcaaaacctccatcgggctgctgtgcgtcacggcaagcagtgctctgctctggatggccagcgttgagccccactggatcgccgcctccatcatacttgagtttttcctgatggtgctgctgatcccggagcccgaccggcagcgtacaccccaggacaaccagctggcgtacgtcgtgataggtctgctgttcatgatccttaccgtcgccgccaacgagatggggctcctggagaccacgaaacgtgacctgggcatcgggcacgtcgccgcggagaaccaccagcacgcgaccatgctcgacgtggacctgcggccagccagcgcatggaccttatacgctgtggccaccacggtcatcacaccgatgatgcgccacaccatcgaaaacaccacggcgaatatcagtctaaccgccatcgccaaccaagcagccatactgatgggcctggacaagggctggcctatctcgaagatggacatcggggtgcccctcctggcgctggggtgctactcgcaagtgaacccactaaccctgaccgctgccgtcctgatgctcgtggcccactatgcgatcatcggccccggcctgcaggccaaggcgacccgcgaggctcaaaagcggaccgcagcggggatcatgaaaaaccctaccgtggacgggatcgtcgccattgacctcgatcccgtcgtgtacgacgccaagttcgaaaagcagcttgggcagatcatgctgctgatcttgtgtaccagccaaatcctgctgatgcgcactacctgggccctctgcgagtccatcaccctggccaccgggccgctgacgacactgtgggagggcagccctgggaagttctggaacaccaccattgcggtctccatggccaacatattccggggctcatacctggccggcgcggggcttgcattctccctcatgaagtcattaggcgggggtcgccgtgggacgggcgcgcagggcgagacgttaggagagaagtggaagcgccagcttaaccagctgtccaaacctgagttcaacacgtacaagcgcagcggcatcatggaggttgaccgcagcgaggccaaggagggactgaagcggggcgagaccactaagcacgccgtgtcccgggggacggctaaactccggtggttcgtcgagcgcaacttagtaaagccagagggtaaggtgatagacctgggctgcggtcggggcggctggagctactactgtgctggcctcaagaaggtcaccgaagtcaaggggtataccaagggcggccccgggcacgaggaacccatccccatggccacctacggctggaacttagtgaagctccactccgggaaggacgtcttcttcatgcccccggaaaaatgtgatacgctgctctgcgatattggcgagagcagtcccaatccgaccatcgaagaggggcgcaccctgagagtcctgaagatggtggagccctggttacgcggcaatcagttttgtattaagattctgaatccgtatatgcccagcgtcgttgagacgctggagcagatgcagcggaagcatggcggaatgctcgtgcgcaaccccttatcccggaactccacgcacgagatgtactgggtctcctgcggcaccgggaacatcgtatcggccgttaatatgacctcccgcatgctccttaacagattcaccatggcccaccggaaacccacttacgaacgcgatgttgacctgggcgccggcactcggcacgtggcggtcgagccggaggtcgccaacctggacatcatcgggcagcgcatcgaaaatatcaagaacgagcacaagagcacctggcactacgacgaggataacccctataagacctgggcctaccacggctcctacgaagtgaagcctagcgggagtgccagctccatggtgaacggcgttgttcggctcctaacgaaaccttgggatgtaatccccatggtgacccagatcgctatgaccgacaccacacccttcggccagcagcgggtatttaaggaaaaggtggatacccggacacctcgggcaaaacggggcactacacaaatcatggaggtgaccgctaagtggctatggggatttctcagcagaaacaagaagccccggatctgtacccgcgaggagttcacccggaaggtgcgctcgaacgcggccatcggcgctgtatttgtagacgaaaaccagtggaacagcgcgaaagaagccgttgaagacgagcggttttgggacctagtccacagagaacgggaactgcacaagcagggtaagtgcgctacgtgcgtgtacaacatgatggggaagcgcgagaagaagctcggcgagttcgggaaagcaaagggcagccgcgcgatttggtacatgtggctgggcgcccgcttcctggagtttgaggctctcgggttcatgaatgaggatcattggttctcacgggagaacagcctgtccggcgtggaaggggagggcctgcacaagctcgggtacattctgcgagatatcagtaagatccccggcggcaacatgtacgccgatgacaccgcaggatgggacacccgcatcaccgaggacgaccttcagaacgaggcgaagatcacggatattatggaacccgaacacgcgctcctggccacctccatctttaagctgacctatcagaacaaggtagtgcgggtgcaacgacccgcgaagaacggcactgtaatggacgtgatcagccggcgcgaccagcgggggagtggccaggtggggacgtacgggctgaataccttcaccaacatggaggtccagctgatcagacagatggagagcgagggtatcttcttaccgtccgaactagagacccccaacctggccgagcgggtgctggactggctcgagaagcacggggcagagcgcctgaaacggatggctattagcggcgacgactgcgtcgtgaaacccatcgatgaccgcttcgccactgccctgaccgccctcaacgatatggggaaagtccggaaggacataccccaatgggaaccgtcgaaaggctggaacgattggcagcaggtccctttctgctctcatcactttcaccaactcatcatgaaagacggccgcgaaatcgttgtgccctgccggaaccaggacgagctggtgggccgcgcgcgtgtctcccagggcgccgggtggtctcttcgcgagaccgcctgcctgggcaaatcttacgcccagatgtggcagctgatgtacttccatcgtcgcgacctacggttagccgcgaacgccatatgctcagccgtgccagtggactgggtaccgacctcccgcaccacgtggtcgatccatgcacatcaccagtggatgaccaccgaagacatgctgtctgtgtggaaccgagtgtggatcgaggagaacccctggatggaggacaaaacacacgtctccagctgggaggaggtaccatacctcggaaagcgcgaggaccaatggtgtggctccctgatcggtctgacggcgcgtgccacctgggctacgaacatccaggtggctatcaaccaggtacggcgcctcatcggcaacgagaattacctggactacatgactagcatgaagcgtttcaagaatgagtccgaccccgagggcgccctgtggtga

SEQ ID NO: 23947 - RNA, 9879 nt, synthetic construct
  misc_feature 1..9879: note = derived and/or modified CDS sequence (opt11) from DENV-1__FJ024483__SS-prME
  source 1..9879: mol_type = other RNA
agcgtgactatgctgctcatgctcctccccaccgcgctcgcctttcacttgactacccgcggcggtgagccgcacatgatcgtcagcaagcaagagcgggggaagagcctactgttcaagaccagcgcgggagtgaatatgtgcactttaatcgcaatggacctgggggagctctgcgaagacaccatgacatacaagtgcccccagatcacagaggccgaacccgacgatgtggattgctggtgcaacgccaccgacacctgggtcacctacgggacctgcagccagaccggcgagcaccggagagacaagaggtccgtggccctagcgccccatgtaggactgggcctagagacgagaaccgagacttggatgtcatcggagggcgcctggaagcagatccagcgcgtcgaaacgtgggcgctgcggcacccggggtttacggtgattgccctcttcctagctcatgccatcggcaccagcatcacccagaagggaatcatcttcatcctgctgatgttagtgaccccctccatggcaatgcgctgtgtcggcatcggcaaccgggacttcgtggaggggctctccggcgccacctgggtggacgtcgtgctggagcacgggtcctgtgtgaccacgatggccaagaacaagcccaccctagacattgagctgctaaaaacggaggtcaccaaccccgctatccttcgcaaactgtgcatcgaggccaagattagcaataccaccacggattcccggtgtccgacccagggggaggccaccctggtagaggagcaagacgccaacttcgtgtgccgcagaaccttcgtggaccgcgggtgggggaacggctgcggcctcttcggcaaagggtcactgctgacgtgtgccaagttcaagtgcgtgaccaagctcgagggcaaaatcgtccaatacgagaacctgaagtactctgtcatcgtgactgtgcacaccggcgaccagcaccaggtcgggaacgaaacgacagaacacggcaccatcgctaccatcactccccaagcaccaacgtcagagatccaactgaccgattacggtgccctcaccctggattgcagcccccgcaccggcctggactttaacgagatggttctcctgacgatgaaggagaagtcctggctggtccacaagcagtggttcctggacctgccgttaccctggacttccggggccagcaccagccaggaaacctggaaccgccaggacttgctggtcacgttcaagaccgcccacgcgaaaaagcaggaagtggtcgtgctgggttcccaggagggcgcaatgcacaccgcattgactggggccacggagatacagacgagcggcaccaccacgatcttcgccgggcatctgaagtgccggctgaagatggacaagcttaccctcaagggaacttcctacgtgatgtgcacggggagcttcaagctggaaaaggaggtcgcggaaacgcaacacggaaccgtgctggttcaggtcaagtacgagggcaccgatgcaccctgtaagatacccttctcgacgcaggacgagaagggggttacgcagaacgggcgtctcatcacagcgaaccccattgtgaccgacaaggagaagcctgtaaacattgagacagagccgcccttcggggagagctacatcgtggtgggagccggtgagaaggcgctgaagctgtcctggtttaagaaggggagctccatcggcaagatgttcgaagccacggcccgcggggctcgccggatggcaatactaggggacacggcatgggattttgggagcatcgggggcgtcttcaccagcgtgggcaaactggtgcaccaggtgttcgggacggcctacggggtgctgttcagcggcgtctcttggacgatgaagatcgggatcggtatcttactgacttggctgggcctcaactcacgctccacaagcctttccatgacctgcatagcagtgggaatggtcacgctgtacctcggcgtgatggttcaggcagatagcgggtgcgtcatcaactggaagggccgcgaactgaagtgcgggagtggcatcttcgtgacgaacgaggtacacacctggaccgagcagtacaagttccaggccgattcaccgaagcgtctgagcgcggcgatcggcaaggcctgggaggagggggtgtgcggcatccgctccgccacccggctcgagaacatcatgtggaagcagatcagcaatgaattaaaccatatcctgctcgagaacgacatgaaatttacggtcgtcgtgggggacgccaacggcattctagcacaggggaagaagatgatacgcccgcagcccatggagcacaaatactcatggaagtcctggggtaaggctaaaatcatcggtgctgacatccagaacaccacattcatcatcgacgggcccgacactccggagtgccccgacaaccagcgggcctggaacatctgggaggtggaagactatggattcgggatcttcacgaccaacatctggctgaagctccgcgactcctacacccagatgtgtgaccaccggctgatgtcggcggctatcaaggactccaaagcggtccacgccgacatgggctactggatcgaaagcgaaaaaaacgaaacgtggaagttagcccgtgcgtcctttatagaggtgaagacgtgcacctggcccaagtcacacaccctatggtccaacggggtgctggagagcgagatgattatccccaagatctacgggggcccgatctcccagcacaattaccggcccgggtactacacccagacggccggaccctggcacctggggaaattggagctggattttgacctgtgcgagggaactacagtcgtggtggacgagcactgcggcaaccgcgggccaagccttcggactacgacggtcaccgggaagatcattcacgagtggtgctgccgctcctgcaccctaccgccgttgcggttccgaggggaggacggctgttggtacgggatggagatccggcctgtgaaggaaaaggaggagaacctagtgcgctctatggtctccgcaggcagcggcgaggtggactctttctccctgggaatcctctgcgccagcattatgatagaggaggtaatgagaagtcgctggagccggaagatgctcatgactggcaccttggcagtgttcctactcctgatcatggggcagctaacctggaacgacttaatacgcctgtgcatcatggtgggcgccaacgccagcgaccgaatggggatgggtaccacgtacctggcacttatggctaccttcaagatgcggccgatgtttgccgtggggctgctgttccgccggctaaccagccgcgaggtcctgttgctcaccatcgggttgtccctggtggcgtcagtggagctccccaactccctggaggaactgggagacgggctcgcgatgggtatcatgatgctgaagttgctaacggagttccagcctcaccagctgtggaccacccttctctctctcactttcatcaagacgaccctgtcactcgactacgcctggaagaccaccgccatggcgttgagcatcgtctcactgttccccctttgcctcagtacgacctcccagaagaccacgtggctgcccgtgctcctgggcagctttggctgcaagccactgaccatgttccttataaccgagaacaagatctggggccgaaagagttggcccttgaacgagggaatcatggccatcggcatagtcagcattctattgtcaagtctgctgaagaacgacgtgcccctggccggacccctgattgccggcggcatgctgatcgcctgctacgtgattagcgggtccagcgcggacttgtccctggagaaggcagccgaggtcagctgggagcaggaggccgaacactccggaaccagccacaatatactcgtggaggtgcaagacgacgggactatgaagattaaggacgaggagcgcgacgacaccttaaccattctcctgaaggccacactcctggcggtctccggcgtgtaccctatgagcatccccgccaccctattcgtgtggtatttctggcagaaaaagaagcagcgttccggtgtcctctgggacacccccagcccgcccgaggtcgagagagcggtgctggacgacggcatctaccggatcctgcagcgcggcctgctcgggcggtcccaggtgggcgtcggggtcttccaagatggcgttttccacacgatgtggcacgtgaccaggggggcggttctgatgtaccagggaaagcggttagagccaagctgggcctccgtaaagaaggatctgatctcctatggcgggggctggaggttccaggggtcctggaacaccggggaggaagtgcaggtcatcgcagtcgaacccgggaagaatccgaagaatgtgcagaccacgccgggcaccttcaagacccctgagggcgaggtgggagccatcgcgctggacttcaagcccgggaccagcgggtccccgatcgtcaaccgcgagggtaagatcgtgggcctgtacggcaacggggtggtcacgactagcgggacctatgtgtcagccatcgcccaggcgaaggccagccaggagggccctctccccgaaatcgaggacgaagtgttcaagaagcgcaacctgacaatcatggacctgcaccctgggtcaggcaagacacggagatacctcccggccatcgtccgggaggccatcaagcgcaaactccggacacttatactggcgcccacccgagtcgtggcctccgagatggccgaggcgctgaagggcatgcccatcagataccagaccactgccgtcaagagcgagcacaccgggcgggagatcgtggatctgatgtgccacgcgaccttcaccatgcgcctcctatcccctgtgcgggtccccaattacaacatgatcatcatggacgaggcccacttcacggaccctgcctctatcgctgcccgcggctatatatccacccgcgtggggatgggcgaagccgccgctatcttcatgacagctacgcccccggggagcgtggaggcattcccccagtcgaacgcggtcatccaagacgaggagcgcgacatacccgagcggagctggaactccggctacgactggatcacggatttccccggcaagacagtttggtttgtgccaagcatcaaatccgggaacgatatcgctaattgcctgaggaagaacgggaagcgggtcatccagttaagccgcaagaccttcgacaccgagtaccaaaaaacaaagaacaacgactgggactacgttgtcaccaccgacatctccgagatgggggcaaacttccgggccgaccgcgtcatcgaccccaggaggtgcctgaagcccgtgattctaaaggatggccccgaacgggtgatccttgcgggcccgatgccggtcacagtcgccagcgccgcccagcgccggggccgcatcgggcggaaccaaaacaaggaaggcgaccagtacgtgtacatggggcagcccctcaataacgacgaggaccacgcccactggacggaggctaaaatgctgctcgacaacatcaacacccccgagggcatcatcccggccctgttcgagcccgagcgcgagaaatccgccgccatcgacggcgagtaccgtctgcgcggggaggctcggaaaaccttcgtcgagcttatgcgccgcggcgatctcccggtgtggctcagctacaaagtcgcgtcggagggctttcagtatagcgaccggcgttggtgcttcgacggggagcggaacaaccaggtcctcgaagaaaacatggacgtagagatctggaccaaggagggtgagcgcaagaagttacgaccccgttggctagacgcccggacctattccgaccctctcgctctgcgcgagttcaaagagtttgccgcgggccggcgctcagtcagcggagatctgatcctcgagatcggtaagctgccccagcacctgactctacgggctcagaacgctctcgacaatctcgtgatgctccataattccgaacagggcgggaaagcataccgccacgcaatggaggagctgcccgacacgatcgagacccttatgctcctagccctgatcgccgtgctcaccgggggcgtcacgttattcttcctgagcgggaagggcctcggcaaaacctccatcgggctgctgtgcgtgacggcgtcctccgccctcctgtggatggccagcgtggagcctcactggatcgctgcgtccatcatcctggagttcttcctcatggtgctgttgatacccgagcccgaccggcagcgtacgccccaggacaaccagcttgcctacgtggtgataggactgctgttcatgatcctaacggtcgccgctaacgagatggggctgctggagacgaccaaaaaagacttaggcatcgggcacgtggcggcagaaaatcaccagcacgccacgatgttagacgtggacctgcggccggcgagcgcctggacgctctacgcggtagccaccaccgtcattactcccatgatgcgccatacaatcgaaaacaccacggccaacatctccctgaccgctatcgccaatcaggcagccattctgatgggtctcgataagggttggcccatcagcaagatggacatcggggtgccgctcctggccctgggatgctacagccaggtcaacccactgacgctgacggccgcggtgctcatgctagtggcccactacgccatcatcggtccgggcctgcaggccaaggcaacccgggaggcgcaaaagcgaacggcagctgggattatgaagaatcccacggtcgacggcatcgtggccattgacctcgaccccgtggtatatgacgccaaattcgagaagcagctgggccagataatgctgcttattctgtgcacctcccagatcctgctcatgcgcaccacgtgggcgctgtgcgaatctatcacgctggccaccgggccgctcactaccctttgggagggatctcccgggaagttctggaacacgaccatagccgtatccatggccaacatcttccggggcagctatctggctggagcagggcttgccttttccctaatgaagtccctgggtgggggccgacgtgggactggcgcacagggagagaccctcggggagaaatggaagcgccagttgaaccagctctccaagagcgaattcaacacgtacaagcggagcggcatcatggaggtcgatcggtccgaagctaaggaagggctcaagcggggcgagaccaccaaacatgcggtatcgcgcgggaccgcaaaactgcggtggttcgtggaacgcaacctggtaaagcccgagggcaaagtgatcgacttgggctgcgggcggggcggctggtcctactactgcgcagggttgaagaaggtcaccgaggtgaaggggtacacaaagggcggccccgggcatgaggagccgatacccatggctacctatggttggaaccttgttaagctgcacagcgggaaggacgttttcttcatgccgcctgagaagtgcgatacactactgtgcgacataggagaatccagcccgaaccccaccatcgaagaggggcgcacattgcgggtgctcaagatggtcgagccgtggctgcgcggcaaccagttctgtatcaagatcctgaacccctatatgccgtcggtggttgagactctcgaacagatgcagcggaagcacggggggatgctggttcgcaatcccctgagccggaacagcactcatgagatgtattgggtgagctgcggcaccgggaacatcgtgtccgccgtgaatatgactagccgcatgctcctgaaccggtttaccatggcacaccgcaagccgacatacgaacgcgacgtggacctgggcgccggcacacggcatgtggccgtcgagcccgaggtggccaacctcgacatcatcgggcagcggatcgaaaacatcaagaacgagcacaagtccacgtggcattacgacgaggataacccgtacaaaacctgggcctaccacggcagctacgaggtgaagccttcgggtagcgcgtccagcatggtcaatggcgtggtgcggcttttaaccaagccctgggacgtcatccctatggtgacccagatcgccatgacggacacaaccccgttcggacagcagcgcgtattcaaggagaaggtggataccaggacgcccagggccaagcggggcaccacccagataatggaggtgaccgctaagtggctttggggcttcttatcccgcaacaaaaagccccggatctgcacccgcgaggagttcacccggaaggtccgcagcaacgccgcaatcggggcggtgttcgtggacgagaatcagtggaactccgcgaaggaggccgtggaggacgagcgtttctgggacctggtgcaccgcgagcgggagctccacaaacagggcaagtgcgcgacctgcgtgtacaacatgatggggaaacgcgagaagaagctaggcgagttcgggaaggccaagggctctcgggccatctggtacatgtggctaggcgcccgattcctggaattcgaggccttagggttcatgaacgaggaccactggttcagccgggagaatagtttcagcggcgtcgagggggagggcctacacaagttgggatacatactgcgcgacatctcgaagatcccgggcgggaacatgtacgccgatgacacggccgggtgggacacgcggatcaccgaggacgacctgcagaacgaggccaagataaccgacataatggagcccgagcacgctctgctggccacatcgatcttcaaactgacgtaccagaacaaggtggtgcgcgtccagcgccccgcgaagaacggcactgtgatggatgtaatctccagacgcgaccagcgtgggagcggccaggtcggcacctacggattaaacacttttaccaacatggaggtgcagctgattcgtcagatggagtccgagggcattttcctgcccagcgagctggagaccccgaacctggccgagcgggtgttagattggctcgagaagcacggggccgagcgcctaaagcggatggccatttccggggacgactgcgtcgtgaagcccatagacgatcgattcgccaccgcgctgactgctctcaacgacatggggaaggtgagaaaggatattccacaatgggagccaagcaagggctggaacgattggcaacaagtcccgttctgctcgcaccactttcaccagctcatcatgaaggacggccgcgagattgtcgtgccctgcaggaaccaagacgagctggtcgggcgcgcccgggtgagccagggcgcagggtggtccctcagagagacagcctgcctcggcaagagctatgcgcagatgtggcagctaatgtacttccatcggcgcgacctcaggctggcggccaacgccatctgctctgcagtgccagtcgattgggtgccaacaagcaggactacctggtcgatccacgcccatcaccagtggatgaccacggaagatatgctgtccgtgtggaatcgggtctggatcgaggagaacccgtggatggaggacaagacccatgtgagctcctgggaggaagttccctacctagggaagcgcgaggaccagtggtgcggcagtttgatcggcttgaccgcccgcgccacgtgggccacgaacatccaggtggcaatcaaccaggtgcggaggctcatcgggaacgagaactacctggactacatgacttccatgaagcggttcaagaacgagagcgaccccgagggcgccctgtggtga

SEQ ID NO: 23948 - RNA, 9879 nt, synthetic construct
  misc_feature 1..9879: note = derived and/or modified CDS sequence (opt11) from DENV-1__EU596504__SS-prME
  source 1..9879: mol_type = other RNA
agcgtcacaatgttgttaatgctgctccccacagcattagcctttcacctgactacgcgaggtggagaaccgcacatgatagtcagcaaacaagaacgtgggaaatccctgttattcaaaacttccgcgggagtgaatatgtgtacactcatcgcaatggatctgggagaattatgcgaagacacaatgacatacaaatgcccacaaatcaccgaagccgaacccgacgacgtagactgctggtgcaatgcaacggatacgtgggtcacctacggaacctgcagccaaaccggcgaacatcgtagagacaaacggtccgtagcgttagctccccacgtcggtctagggcttgaaacacgaacagaaacctggatgagctccgaaggagcctggaaacaaatccaacgcgtagaaacttgggccctacgccaccccggatttacggtaatagccctgttccttgctcacgcaatagggacgtccatcacccagaaaggcattatcttcatactactgatgcttgtaaccccgtctatggcaatgcgctgcgtcggcatagggaaccgtgacttcgtcgaagggctgagtggcgcaacctgggtagacgtggtcctagaacatggttcgtgcgtgaccacaatggccaaaaacaagccaactttagacattgagctcctgaagacagaggtcacaaatcccgcaatactacgaaagttatgcatagaggccaaaatatccaacacgaccacagacagtcgatgcccaactcagggggaagcgactttagtcgaggagcaggatgcaaattttgtgtgcaggagaacattcgtcgaccgaggatggggcaacgggtgcggactgttcggcaaggggtcactcctaacgtgcgcaaaattcaaatgcgtcaccaaactcgaaggcaaaatcgtacaatacgaaaacctgaaatacagcgtgattgtcacagtacataccggtgatcagcatcaggtaggcaacgaaaccaccgaacacggtaccatagctaccataaccccgcaagcacctacctcagagatacaactgacagactacggggcactcacacttgactgctcgcctagaaccggactagatttcaacgagatggtactattgaccatgaaagaaaaatcatggctcgtccacaagcagtggttcctagacctcccccttccctggacgtccggagcgagcacatcccaagaaacatggaacagacaagacctcctcgttacattcaaaaccgcccacgcaaagaaacaggaagtagtagtcttgggctcccaggagggagcaatgcatacggcgctcaccggagctaccgaaatccagacttcgggaaccacgacaatcttcgcaggacatctgaaatgccggctaaagatggacaagctcaccctcaagggaacaagctacgtcatgtgtacaggctctttcaaattggagaaagaagtggccgaaactcaacatgggacagtcctcgtccaggttaaatatgaaggaacagacgcgccatgcaagattccctttagcacacaagacgagaagggggtgactcaaaacgggaggctaataacggcaaatcctattgtgacagacaaagagaagcccgttaacatagagacggagccgccattcggggaaagctacatcgtagtaggagcaggagaaaaagcactcaagctcagctggtttaagaaaggaagttccatcgggaaaatgttcgaagccacagcacgcggggcgcgacgcatggcaatcctcggggacaccgcatgggatttcggtagtatcggaggggtgttcacctccgttggaaagctcgtgcaccaggtttttggtaccgcctacggcgtgcttttctcgggcgtatcgtggacaatgaagattggaattggcattctgctgacttggctcggactcaacagcaggagtacatcccttagtatgacctgcttcgccgtggggatggtgactctctacctgggcgtgatggtacaagcggactccgggtgcgtgatcaattggaaaggacgggagctgaagtgcggaagcggaatcttcgtaaccaacgaagtgcacacatggacggaacaatacaaattccaagcagatagcccgaagcggttaagcgccgcgataggcaaagcatgggaagaaggtgtctgcggcattcgaagcgctacaaggctcgagaacataatgtggaaacaaatatccaacgagctaaaccacatcttgctagaaaacgacatgaagtttaccgtcgtagtgggcgatgccaacgggattctcgcgcaaggcaagaaaatgatcaggccgcaacccatggaacacaaatacagctggaaatcatggggaaaagcgaaaatcataggagcggacatccaaaacacgacctttattatagacgggcccgacacaccagaatgcccggacaatcaacgagcgtggaacatttgggaagtggaagactatggcttcggcatatttaccacaaacatctggttgaagttacgtgatagctacacacaaatgtgcgaccatcggctgatgtcggccgcgataaaagacagcaaagccgtacatgcggacatgggatattggattgagtcggagaaaaatgagacatggaagctcgctagagctagctttatagaagtaaaaacgtgtacatggccaaaaagccacaccctctggtccaacggcgttctcgagtccgaaatgataataccgaaaatctacggcggaccaatcagccaacacaattaccggccggggtactttacgcagacagcaggaccatggcacttaggcaagttggaactggactttgatctgtgcgaggggacaaccgtagtcgtagacgagcactgcgggaaccgaggaccgtcgctaagaacaacaaccgtcactggaaagattatacacgagtggtgctgccgaagctgtaccttgccgcccctcagatttcgaggagaggatggctgctggtatggaatggagataaggcccgtcaaggaaaaggaggaaaacctggtgcgatccatggtgagtgcgggatcaggcgaggtcgattccttctctctaggcatcctatgcgcaagcataatgatcgaggaggtaatgcggagccgctggagtagaaagatgctaatgacaggaactttggcagtcttccttttactaatcatgggacagctaacttggaacgacctgataagactgtgcattatggtcggagcaaacgcatccgataggatggggatgggtaccacgtacctggccctgatggcaacattcaagatgagaccgatgttcgccgtcggtctactgttccgaaggttgacatcacgtgaggttctgttgctaaccatagggctcagcctggtggcttctgtggaactaccgaatagccttgaagaactaggggacggactagcaatgggaatcatgatgctaaaactcctaacggagttccagccccaccaactttggacgacactactatccctcaccttcataaagactacactgtcactagattacgcatggaaaacgacagccatggccctgtccatcgtaagcctcttcccactgtgcttaagtacaacgtcacagaagacaacttggttgcctgtactgctcggatcattcgggtgcaaacctctcacaatgttcctaataacggagaataaaatatggggtcgaaagagctggccgctaaacgagggcatcatggcgataggcatcgtatcgatactactcagttcactcctcaagaacgatgtccccttggcaggccccctaatcgcaggcggaatgctaatcgcatgttacgtcataagcggatcctccgcagacctctcactggagaaggcggcagaggtctcctgggaacaggaagccgaacattccggaacatcacataacatattagtcgaagtacaggatgatggaacgatgaagattaaagacgaagaacgagacgacaccctaaccatccttctaaaggccacactactcgccgtatctggcgtataccccatgagcataccggctaccctgttcgtctggtacttctggcagaaaaagaaacaacgatctggtgtcctatgggacacccctagcccaccggaagtagaacgggcggtattagacgatggaatctaccgcatcctccaacgcggattgctcggcaggtcccaggtaggagtcggggtcttccaggacggggttttccacactatgtggcacgtgacccggggtgcggtcctaatgtatcagggtaaaagattggaaccttcatgggcgagcgtaaagaaagatctaataagctacggtggaggatggcgcttccagggctcttggaacaccggcgaagaagtgcaagtgatagcagtcgaaccaggaaagaaccccaagaacgtgcaaaccacaccgggtaccttcaaaacgcccgaaggggaggtcggggcaatcgccctcgacttcaagcctgggacctctggcagtcccattgtgaacagagaaggaaaaattgtcggcctgtacgggaacggtgtcgtaacaacctcagggacctacgtcagcgcgattgcccaggctaaggcatcacaggaagggccactacccgagatagaagacgaagtgtttaagaaacgaaacctaacgataatggacctacatcccggaagcggcaaaacacgacgctaccttccagctatagtacgagaagcgataaagaggaagttacgaacactaatactagcccccacaagggtggtcgcatcagaaatggccgaggccctcaagggcatgccgattcgataccaaacaaccgcggttaaaagcgaacacacaggccgagaaatcgttgacctaatgtgccacgccacatttacgatgcgacttctaagcccagtgagagtaccaaactacaacatgattataatggacgaagcacacttcactgatcccgcaagcatcgcagcacgtggttacatctcgaccagagtggggatgggggaggcggcagctattttcatgactgcaacgccacccggatccgtagaagcgttcccacaatccaacgctgtcatacaagacgaagagagagacatacctgaaagatcgtggaactcaggctacgattggatcactgattttccgggaaagaccgtatggtttgtacccagtataaaaagcgggaatgatatagccaactgccttcgtaagaatggcaaaagagtaattcaattaagccgcaaaacctttgataccgaatatcagaaaacaaagaacaacgactgggactatgtagtgacaacggatatctcggagatgggagcaaatttccgggcagatcgagtcatcgaccctagacggtgcctaaaacccgtaatactcaaagacggtccggaacgcgtaattctcgcaggacctatgccggtcaccgtggcatcagccgcacagcggaggggccgaattggacgaaaccaaaacaaggagggagaccagtatgtatacatgggtcaaccactgaacaacgatgaagaccatgctcactggactgaagccaagatgctactcgataacatcaacacacccgaaggaataataccagcgctgttcgaaccggaacgggaaaagtcggcggcaatcgatggtgagtacagactgcgcggagaagctagaaagacattcgttgagctaatgagaaggggcgatttgccggtttggctgtcctacaaggtagcatcagaggggtttcaatactcagacaggcgatggtgcttcgacggagagcggaacaaccaggtattggaggagaacatggacgttgaaatctggaccaaggaaggagaaaggaaaaagctgaggccccgctggctagacgcacgcacttacagtgatccactggctctccgcgagtttaaggagttcgcggcgggcagacgaagcgtgtccggtgatctaatcctcgagattggcaaactcccacagcatttaacgcttcgcgcgcaaaatgcgttagataacctggtaatgttacacaacagcgaacaagggggtaaggcctatcgacatgcgatggaagaactcccagatacgatagagacacttatgctactggcacttatcgccgtactcacaggcggtgttaccctcttcttcctaagcggaaaaggattaggcaaaacgtcgatcggcctgctgtgcgtaaccgcaagctccgccctgctatggatggcgagcgtagagccgcactggatagcagctagcataatattagagtttttcctgatggtcttgcttataccagagcctgatcgccagcgaacaccccaagataatcaactagcgtacgtggtaataggtctattattcatgatcctcaccgtagccgcgaacgaaatgggccttcttgaaactaccaagaaagacctagggataggccatgtagcagcagagaaccaccagcacgcaacaatgctagacgtcgatctaagaccagcttccgcatggaccttatatgccgtggccaccaccgtaataactccaatgatgagacacacgatcgaaaatacaaccgctaacataagtctgaccgctatcgccaatcaagcggcaatcctgatgggtctagacaaaggatggcccatatccaaaatggacataggcgtcccactactggcacttggatgctactcccaggtaaacccacttactctgacagcagccgtcttgatgctcgtagcgcattacgcaatcatcgggcccgggctccaggccaaagccacccgcgaggcacaaaagaggacagctgccggcatcatgaaaaatccaacggtcgacggcatagtcgcaattgatttggaccccgtcgtatacgacgccaaattcgagaagcaacttggacagatcatgctcctaatactgtgcacgtcacaaatcctgctcatgcgcacgacatgggccctttgcgaaagcatcacgctagcgacaggtcccctcaccacgttgtgggagggttcgcccggaaaattctggaacactacgatcgcggtaagcatggctaacatattcagaggctcctacctagcaggagccggcctcgccttcagcttaatgaaaagtctcggaggagggaggcgaggcaccggcgcacagggcgagaccctaggcgagaaatggaaaagacaactaaaccaactaagtaagagcgagttcaacacgtacaagcgctctgggattatggaggtcgaccgatcggaagcgaaagagggcctaaagaggggcgaaacgaccaaacacgccgtaagccgaggcaccgcaaaactccgatggttcgtcgagcgcaacttagtgaagccagaaggcaaagtaatcgaccttggctgcggacggggcgggtggagctactactgtgccgggctcaagaaagtaactgaggtgaaggggtacacaaagggcggccccggccacgaagaacccattccgatggcgacatacgggtggaatcttgttaaactgtacagcgggaaagacgttttctttatgccacccgaaaagtgcgacacgctactatgcgacataggggaaagtagccctaatccaacaatagaagaagggcgaactctccgcattctaaaaatggtcgagccatggctaagagggaaccaattctgcatcaagatactgaacccatacatgccttcagtggtagaaactctggagcagatgcaacgaaaacatggcgggatgttggtcaggaacccgctatcccggaacagcacccacgagatgtattgggtatcatgcggtacgggtaacattgtctccgccgtaaacatgacctcacgaatgctcctaaatcgctttactatggcgcaccgaaagccgacatacgagcgggacgtagacctaggggctggcacacgtcatgtcgccgtcgaacccgaagtagccaacctggatatcattggccagagaatcgaaaacatcaaaaacgaacacaaatcgacatggcactacgacgaggacaatccctacaagacctgggcgtatcacgggtcctacgaagtgaagccctccgggagtgcctcatccatggtaaatggggtcgtacgcctgctaaccaagccatgggacgtcatccccatggtaacccagatcgccatgaccgacacgacccccttcggacagcaacgggtttttaaagaaaaagtagacactcggacaccacgagcaaaacgcggcaccacgcaaatcatggaagtaaccgcgaaatggctatggggattcctatcaagaaataagaaaccgcgcatctgtacacgggaggagttcacccgtaaagtacgatcaaacgcggctatcggagccgttttcgtggacgaaaaccagtggaactcagccaaagaagcggtggaagatgagaggttctgggatctcgtccaccgcgaacgggagctccacaagcagggcaagtgcgcaacatgtgtttacaatatgatgggcaagagggagaagaaattaggagaatttggaaaagcgaaaggcagtcgagccatatggtatatgtggcttggagcgcgattcctcgagttcgaggccttagggttcatgaatgaggaccactggttttcaagagaaaattcattatcgggggtggaaggtgaaggactgcacaaactaggctacatacttcgcgacatttccaagatccccggtggcaacatgtatgccgatgacacggccggatgggacacccggatcaccgaagacgacctccaaaacgaagccaaaattacagatataatggaacccgaacacgccctactcgcgaccagtatcttcaaacttacataccaaaataaggtcgtgcgggtacaacgcccagccaagaacggaacagtgatggatgtcatatcacgacgcgaccagagaggcagcggtcaagtaggcacctacggcctcaacactttcaccaatatggaagtacagctaatccgacaaatggagtccgaaggaatcttcctaccgtccgagctcgagacaccaaacttagccgagcgagtacttgattggcttgaaaaacatggtgctgaaagactgaaacggatggccatatccggagacgattgcgtggtgaagccaatagacgaccgttttgcaaccgccctgacagcgttgaacgacatgggcaaagtccgaaaagatatcccccaatgggagcccagcaagggatggaacgactggcaacaagtccccttctgctcccaccatttccatcaattgataatgaaagatggcagagaaatagtcgtaccgtgtagaaaccaggacgagctggtaggcagagctcgcgtgagccagggcgccgggtggagtctacgagaaaccgcatgtttaggaaagtcgtacgctcagatgtggcagctaatgtattttcatcgcagagacctgcgcctggcagctaacgccatatgcagcgcagtgccagtagactgggtcccgacgtcccgcacaacttggagcatacacgcccatcaccagtggatgacgacggaggacatgttaagcgtatggaaccgagtctggatagaagaaaacccgtggatggaggacaagactcacgtatcatcatgggaagaggtgccgtaccttggcaaaagggaagaccagtggtgcggatcccttatcggacttaccgcccgagctacgtgggcaaccaacattcaagtagctatcaatcaggtccgccgcttaatagggaatgaaaactatctcgattacatgacgagcatgaaacgattcaaaaacgaatcagatccggaaggcgcactttggtag

SEQ ID NO: 23949 - RNA, 9879 nt, synthetic construct
  misc_feature 1..9879: note = derived and/or modified CDS sequence (opt11) from DENV-1__FJ024481__SS-prME
  source 1..9879: mol_type = other RNA
agcgttacgatgttactcatgctgctgccaaccgccctcgcgttccacctgaccacccgtggcggggagccccacatgatcgtgagcaagcaagagcggggcaagagcctcctgtttaagaccagcgctggtgtgaacatgtgcacactgatcgccatggaccttggtgagctctgcgaggacaccatgacctacaagtgcccgcagatcacagaagccgagccagacgatgtagactgctggtgcaacgccaccgacacctgggtgacctatggtacctgctctcaaaccggtgaacacagaagagacaagcgctccgtcgcgctggcaccacacgtggggctggggctcgagacgcggacggagacctggatgagctcggagggggcatggaagcagattcagcgcgtcgagacctgggccttacgtcatcccggattcactgtgatcgccttgttcctggcccacgccatcggaaccagcatcacccagaaggggataatctttatcctgctgatgctcgtgacaccatccatggccatgcgctgtgtcgggatcggaaaccgtgacttcgtggaggggctgagcggtgccacgtgggtggacgtcgtgctggagcacggttcctgtgtgacgacaatggccaagaacaagcccaccctcgatattgagctgctaaagacagaggtcaccaaccccgcgattctccggaagctctgcatcgaggcaaagatcagcaacacaacaacggactcaagatgcccgacccagggcgaggccaccctggtggaggagcaggacgccaatttcgtgtgccgccggaccttcgtcgaccgcggatgggggaacggctgcgggctattcgggaaggggagcctgctgacttgcgccaagttcaagtgtgtgaccaagctcgagggcaagatcgtacagtacgagaacctgaagtactccgtaatcgtgacagtgcacaccggtgaccagcaccaagttgggaacgagacaactgagcacggcaccatcgctacaatcaccccccaagccccgacaagcgagatccagctaaccgactacggtgccctcaccctggactgtagcccacgcaccggcctggacttcaatgaaatggttctattgacgatgaaagaaaagtcctggctggtccacaagcagtggttcctcgacctgcctctgccatggactagcggggcaagcacaagccaggagacctggaatcgccaagacctactggtgacgttcaagaccgcccacgcgaagaagcaggaagtggtagtcttggggtcccaagaaggcgcgatgcacaccgcactcaccggggcaacggagatccagaccagcgggaccaccaccatcttcgcaggtcatttaaagtgtcggctgaagatggacaagctcacgctgaaaggtaccagttacgtgatgtgcaccgggagctttaagctggagaaggaagtcgcggagacgcagcacggcaccgtgctggtgcaggtcaagtacgaaggaactgacgccccctgtaagatccccttttccacacaggacgagaaaggggtgacgcagaacggccgcctcatcaccgccaacccgatcgtcaccgacaaggagaagcccgtaaacatcgagacggagccgccgttcggggagagctacatcgtggtgggggccggcgaaaaagcgcttaagctgagttggtttaagaagggaagctctatcggcaagatgttcgaagcaaccgcccgcggggctcgtcggatggccatactcggcgacaccgcgtgggacttcgggagcatcggcggggtcttcacctccgtgggtaagctggtgcatcaggttttcggaaccgcctatggggtgctgttcagcggggtgtcgtggacgatgaaaatcggcatcggcattctactgacctggctgggtcttaacagccgctccacctccctctccatgacctgcatcgcggttggcatggtcacgctctacctcggcgtgatggtccaagcggacagcgggtgcgttatcaactggaagggccgagagctgaaatgtgggtccggcatcttcgtaaccaacgaagttcacacctggaccgagcagtacaagttccaggccgatagcccaaaacggctgagcgcggcaatcggaaaggcctgggaggaaggggtgtgcggcatccgctcggctacgaggctcgagaacatcatgtggaaacaaatcagcaacgagctgaaccacatactgctcgagaacgacatgaaattcacggtagtggtgggagatgccaacggcatcctggctcaggggaagaaaatgatccgcccccagccaatggagcacaaatactcctggaagagttggggtaaggccaaaatcatcggggcggatatccaaaacaccaccttcatcattgacgggccagacaccccggagtgtcctgacaaccaacgggcctggaatatctgggaagtggaggactacggcttcgggatcttcacgaccaatatctggctgaaactcagagactcatacacccaaatgtgcgatcaccggctgatgagcgcggctatcaaggactcgaaggccgtccacgccgacatgggctactggatcgagagcgagaagaacgagacctggaagctggcccgcgcgtcctttatagaggtgaaaacgtgcacctggccaaagtctcacaccctctggtccaacggcgtgcttgagagcgagatgatcatccccaagatctacggcggtccgatctcgcagcacaactacagaccggggtacttcacccagacggccggaccatggcatttggggaaactcgagttagactttgatctgtgtgagggcaccaccgtcgtggtggacgagcactgcggaaaccgaggtccgagtctacggacgaccaccgtcaccggcaagatcattcacgagtggtgttgccgatcctgcaccttgccgcctctccggttccgcggtgaggacggctgctggtatgggatggagatcagacccgtaaaagagaaggaggagaacctcgttcgcagcatggtctccgccggcagcggcgaggtggacagcttcagtctgggcatactatgcgccagcatcatgatagaggaggtgatgcggagccgctggagccggaaaatgctcatgacgggcacactggccgtatttttgctcctcatcatggggcagctgacgtggaatgacttgatccgcctctgcatcatggtcggcgcgaacgcctcggacagaatggggatgggcaccacgtacctggccctcatggccactttcaaaatgcggccgatgtttgccgttgggctactgttccgccggctgaccagccgcgaggtcctgctgctcaccatcggactgtcccttgtggcgtctgtggagctacccaactcgctcgaggagttgggcgacgggttagcaatggggattatgatgctgaagttgttgacggagttccagccccatcagctgtggaccaccctgctgagcctgaccttcatcaagacgaccttatccctcgactacgcctggaagacaacagccatggctctaagcatcgtttcactgtttcccctctgcctttcaacgacgtcccagaaaaccacgtggctgccggtgctcctgggctcttttgggtgcaagcctctgaccatgttcctcatcactgagaacaaaatctgggggcggaagagctggcccctgaacgagggcatcatggccataggcattgtctctattctgctctccagcctactgaagaacgacgtccccctcgccgggccacttatcgccggaggcatgctcatcgcctgctacgtgatttcagggtccagcgcagacctctcactagagaaggccgccgaggtcagctgggaacaggaagccgagcactccggcacgagccataatatcctggtggaggttcaggacgacgggaccatgaagataaaggacgaggaacgagacgacaccttgacgatactgttaaaggctacactcctggctgtctcgggcgtgtacccaatgtcgatccccgccaccctgttcgtgtggtacttctggcagaagaagaagcagcggtccggagtactctgggacacccccagcccgccagaggtggaacgcgctgtcctggacgacggcatctaccggatcctccaacgcggcctgctagggcggtcccaggtgggtgtcggtgtgttccaggatggagtgttccatacgatgtggcacgtgacaagaggggccgtactgatgtatcaggggaagcggctggagcccagctgggcatccgtaaagaaggacctcatctcttacggagggggctggcgcttccaagggtcatggaacaccggtgaggaggtccaggtgatcgcggtggaacccggcaagaacccgaagaacgtgcagaccacgccgggcacctttaagacccccgagggcgaggtgggggcaatcgccctagacttcaagcccgggacctcggggtcccctatcgttaaccgggaggggaagatcgtgggcctctacgggaacggtgtggttacgaccagtggcacctacgtgtccgccatagcccaagccaaggcatctcaggagggcccccttcccgagatcgaggacgaggtttttaagaaacgcaacctgaccattatggatctacatccggggagcggcaaaacacggcgctatctacccgcgatcgtccgagaggccataaagcgcaagctccggacactgatccttgcccccacccgcgtagtggcgtccgagatggccgaggccttaaagggcatgcccattcgctaccagacaacggccgtcaaaagcgagcataccgggagggaaatagtagacctgatgtgccacgcaacattcaccatgaggctcttatccccagtccgggttcctaattacaacatgatcatcatggacgaggcccatttcacggaccctgccagtatcgccgctcggggctacatcagcacccgcgtggggatgggcgaggcggctgccatattcatgacagcgacaccgcctgggagcgtggaggcatttccccaaagtaatgcggtcatccaggatgaggagcgcgatatcccagagagatcttggaattccggatatgactggatcacggacttccccggaaagaccgtctggttcgtcccgagcatcaagtccggaaatgacatcgccaattgcctgagaaaaaacggcaaacgggtcattcaactaagccgcaagaccttcgacaccgaataccagaagacaaagaataacgactgggactacgtggtcaccacggacatctccgagatgggggccaacttccgggccgatcgcgtcatcgacccccggaggtgcctcaaacccgtcatcctaaaggatggccctgagcgggtcatactcgcggggccgatgcccgtcaccgtggcaagcgccgcccagcgccggggccgaatcggccggaaccagaacaaggaaggggaccagtacgtgtatatgggccagcctctgaataacgacgaggaccacgcgcactggacggaggcgaagatgctgctagacaatattaatactcccgaggggatcatcccggcgctattcgaaccggagcgcgaaaagtccgccgccatcgacggggaatatcgtctacgcggggaggcgcgaaagacgttcgtcgagctgatgcggcgcggggacctgcccgtgtggctgtcatacaaggtcgcgtccgagggttttcagtatagcgacaggcgttggtgcttcgacggggagcggaataatcaggtgctcgaggagaacatggacgtggagatctggacgaaagagggcgagcgcaagaagttacggccgaggtggctggatgcgcggacgtactcagacccgttggcactgcgggagttcaaagagttcgccgccggtagacgctcagtgagcggcgacctgatccttgagatcggcaagctgccccaacacctaacccttcgggcccagaatgccctagacaacctggtgatgctccacaactccgagcagggcggtaaagcctacaggcacgccatggaggagctgcccgacactatcgaaaccctaatgcttttggcgctaatcgccgtgttaacgggaggcgtaacgctgttctttttaagcggaaagggtctcggaaagaccagtatcggtctgctgtgcgtaaccgcaagctcggccctattgtggatggccagcgtagagccccactggatcgcggccagcatcattttagaattcttcctaatggtgcttctgatcccggaaccagaccgccagcgcaccccccaagacaaccagctcgcctacgtagtgataggcctgttgttcatgatcctcacggtcgcagccaacgagatgggtctactagagaccaccaagaaggacctcggcatcgggcacgtagccgctgagaaccaccagcacgccacaatgctcgatgtggacttaaggccagctagcgcttggacgctctatgcagtcgccaccacagtgatcacacctatgatgcgccacacgatcgagaataccaccgccaacatctccctgaccgccatcgccaatcaggctgccatcctgatgggcctcgacaagggttggcccatcagcaagatggacattggtgtacccctgctggccctgggttgctattcccaggttaatccgctgacgctgaccgccgcggtactcatgctggtggcccactacgccatcataggtcccggattacaggccaaagccacccgggaggcccagaagaggaccgccgccggaataatgaagaatcccactgttgacgggattgtggccatagatcttgaccccgtggtctatgacgccaaatttgagaaacagttaggccagatcatgttgctgatcctgtgcaccagccagatactgctcatgcgtaccacgtgggcgctatgcgagagcatcacgctggccaccgggccgctcaccactctgtgggaaggaagccctgggaaattctggaacaccaccatcgccgtgtccatggccaacatattccgaggaagctacctggctggcgcggggctcgccttctccctgatgaagtcgttaggcgggggccgccggggaaccggcgcccagggcgagaccctgggggaaaagtggaagcgccagctgaatcagctgtccaagagcgaattcaacacgtacaagcgcagcggcatcatggaggtggaccggtccgaggccaaggagggacttaagcggggcgagaccaccaagcacgccgtcagcagagggaccgccaagctgcggtggttcgtggagcgcaacctagtgaagccagagggcaaggtcatcgatctgggatgcgggcgtggcgggtggagctactattgcgccggtctcaaaaaggtgacggaggtgaaggggtatacgaagggcggccccggccacgaggagccgatccccatggccacttacggctggaaccttgtcaagctgtacagtggaaaggacgtgttcttcatgccgcctgagaaatgtgacaccctcctgtgcgacatcggagagtcaagcccgaaccccactatcgaggagggacggacgctcagaatcctcaagatggtggaaccttggttgcgcggcaaccagttctgcatcaagatcctgaatccatatatgccttccgtcgtggagaccctcgagcagatgcagagaaagcatggcggaatgttagtgcgcaaccccctaagccgtaactccacccacgaaatgtattgggtctcatgcggcaccggcaacattgtttccgccgtgaacatgaccagccgtatgttgctaaaccggttcaccatggcgcatcgtaagccaacctacgagcgtgacgtcgacctcggcgccggaacccggcacgtggccgtggagcccgaagtcgccaacctcgacatcattgggcagcgaatcgagaacatcaagaacgaacacaagtccacgtggcactacgacgaagataacccatataagacctgggcctaccacggcagctacgaggtgaaaccgtccgggtctgcgtcgagcatggtgaacggggtcgtgcggctgctgaccaaaccctgggacgtgattcccatggtgacccaaatcgccatgaccgataccacaccgtttgggcagcagcgcgtgttcaaggagaaggtcgacacccggacgccaagagccaagcgtggaacgactcagatcatggaggtcacggccaagtggttgtggggcttcctgagccgcaacaagaagccccggatctgcacgcgtgaagagtttacgcggaaggtccgcagcaacgccgcgataggggcggttttcgtggatgagaaccagtggaattccgccaaggaggccgtggaggacgaacggttctgggacctggttcatcgcgagcgcgaactccacaagcagggcaagtgtgcgacttgcgtgtacaacatgatggggaagcgcgagaagaagctgggcgagttcgggaaggcaaagggctcccgcgccatctggtacatgtggctgggcgccagattcctcgaattcgaagcactagggttcatgaacgaggaccactggttcagccgggagaacagtctgagcggagtggagggggagggcctccacaagctggggtacatactcagggacatctccaaaatcccgggcggcaatatgtacgccgacgacaccgccgggtgggatacgcggattaccgaagacgacctacagaacgaggctaagataaccgatatcatggagccggagcatgccctattagctacttcgatattcaagctcacttatcaaaacaaggtggtgcgcgtgcagcgccccgcaaagaacggtaccgtcatggatgtgatctcccggcgcgaccaacgggggagcggccaagtgggcacctacgggctgaacacgttcacgaatatggaggtacagttaatccgacagatggaatccgaggggatcttcctccccagcgaacttgagacccccaacctggccgagcgcgtgctcgactggctggagaagcatggcgcagagagattaaagcggatggccatatccggcgacgactgcgtggtcaagcccatcgacgaccgcttcgcgaccgcgctcaccgctctgaacgacatgggcaaggtgcggaaggacataccccaatgggagccctctaagggctggaacgattggcagcaagtaccgttctgcagtcatcacttccaccaactgataatgaaggatggccgcgaaatcgtcgtgccctgtcggaatcaggacgagcttgtggggcgagcccgggtctcacagggcgccgggtggtccctgcgcgagaccgcatgcctgggcaaaagctatgcacaaatgtggcagttaatgtacttccaccgacgcgacctgaggctggctgcgaacgccatttgttctgcggtgcccgtggactgggtcccgacctctcgaaccacatggagcatccacgctcaccaccagtggatgaccacggaagacatgttgtccgtgtggaaccgggtgtggattgaggaaaacccgtggatggaggacaagacccacgtgagctcctgggaggaggtgccatatctggggaagcgcgaagaccagtggtgcggcagcctgatcggactcaccgcaagggccacctgggccacaaacattcaggtggcgattaatcaggtccggcgcctgatcggtaacgagaactacctggactacatgacatccatgaagcgcttcaagaacgagtcagaccccgagggcgccctctggtga

SEQ ID NO: 23950 - RNA, 9879 nt, synthetic construct
  misc_feature 1..9879: note = derived and/or modified CDS sequence (opt11) from DENV-1__GQ199872__SS-prME
  source 1..9879: mol_type = other RNA
agcgtaaccatgctgttgatgctgctacccacagcgctcgccttccacctgacaacccggggcggggagccccacatgatcgtgagcaagcaggaacggggcaagtctctcttattcaagacctcggctggggttaacatgtgcaccctaatcgccatggaccttggcgaactatgcgaggacactatgacctacaagtgcccccaaatcaccgaggccgaacccgacgacgttgattgctggtgtaacgcaacagacacctgggtaacctacggcacctgtagccagaccggggagcatagacgggacaagcgctcagttgccctggcgccccatgttggtctcgggctcgaaacccggaccgagacatggatgagctccgagggcgcctggaagcagattcagcgggtcgagacctgggcccttcgacaccccggattcacggtgattgccctattcctcgcgcacgcaatcggtaccagcatcacccaaaaggggattatcttcatcctactgatgttggttaccccttcgatggccatgcgctgtgtgggcatcgggaaccgtgacttcgtggagggccttagcggcgcgacgtgggtggacgtcgttctcgagcacgggtcgtgcgtcacgacgatggcaaagaacaagcccaccctcgacattgagctgttaaagacggaagttacaaaccctgcgatcttacgtaagctgtgcatagaagccaagatctctaacaccaccacggactcccggtgcccgacccagggcgaggccaccctggtggaggaacaagacgccaacttcgtgtgccgccgaacctttgtagaccgcgggtggggcaacggctgcggcctcttcggcaaggggagcctgctgacgtgcgcgaaattcaagtgcgtcactaagctagaaggcaaaatcgtgcagtacgagaatctaaagtattccgtcatcgtgaccgtccacaccggcgaccaacaccaggtcgggaatgagacgaccgagcacgggaccatagcgaccatcaccccccaggcccccacgtctgagatccagttaaccgactacggtgccctcaccctggactgtagcccccgaacaggcctggacttcaatgagatggttctgctgaccatgaaggagaagtcttggctggtccataagcaatggtttctcgacctgccgcttccttggacctcaggggcctcaacaagccaggagacctggaaccgccaggacttgctggtgaccttcaagaccgctcacgccaagaagcaggaggtggtggtgttaggctcccaggagggcgccatgcacaccgctctaaccggtgccacagagatacagaccagcgggacaaccacgatctttgccgggcacctgaagtgtaggttgaagatggacaagctcaccctcaaggggacctcttacgtgatgtgtaccggtagctttaagctggaaaaagaggtagcggaaacgcagcacggcactgtgctggtgcaggtcaagtacgagggaaccgacgccccctgcaagatcccgttctccacccaagacgagaaaggggtgacgcagaacggccgcctcatcaccgctaacccaatcgtaaccgacaaggaaaagcccgtcaacatagagacagagccgcccttcggggagtcgtatatcgtagtgggcgccggcgagaaagcgcttaagctctcctggttcaaaaaggggagctccattggcaagatgttcgaggccacggccagaggggcgcgccggatggccatcttaggagacaccgcgtgggacttcggaagcattggcggcgtattcacttccgtggggaagctggttcaccaagtattcggcactgcttacggagttctgttcagcggcgtgtcctggacaatgaagatcgggatcgggatcctcctgacctggctgggcctgaacagtagaagtaccagcctttccatgacctgcatcgcagtcgggatggtcacgctgtatcttggcgtgatggtccaggccgacagcggatgcgtgataaactggaaaggtcgggaactgaagtgcgggagcggcatcttcgtaacaaacgaggtccacacctggaccgagcagtacaagttccaggccgacagcccgaagagactgagcgcagcgatcggcaaggcctgggaagagggggtgtgcggcatcaggtcagccacccgactcgagaacataatgtggaagcagatttctaacgagctgaaccacatcctgctcgaaaacgatatgaagttcacagtagtagtgggcgatgccaatggcatcctggctcaggggaagaaaatgatccgcccgcagcccatggagcacaagtactcctggaagtcctggggaaaggccaaaatcatcggcgccgacatccaaaacaccaccttcatcatcgacgggccggacaccccggagtgccccgataaccagagggcatggaacatatgggaggtggaagattacggctttggcatcttcacaacaaacatctggttgaaattgcgtgactcatacacccagatgtgtgaccaccgcctcatgtctgcggcaatcaaggattcgaaggccgtccatgccgacatgggctactggatcgagagcgagaagaacgaaacctggaagctggcccgcgcgtccttcatcgaggtgaagacgtgcacctggcccaagagccacaccctctggagtaacggagtgctcgaatctgaaatgataatccctaagatatatgggggcccgatctcacaacacaactaccggcccggttacttcacccagaccgccggcccgtggcacctggggaagctcgagctggacttcgacctgtgcgagggcaccacagttgtggtggacgagcactgcggcaaccgcgggccgagcctccggaccacgaccgtaacaggaaagatcatacatgagtggtgctgccgatcctgcacccttccgcccctgcggttcagaggggaggatggatgctggtacgggatggaaatacggccagtcaaggaaaaagaggagaacctagtgcgcagcatggtctccgccggcagcggtgaggtggacagcttctccctaggaatcctgtgcgcatcaataatgatcgaggaggtcatgagatcccgctggagccggaagatgcttatgacgggtaccctggcggtcttcctgctccttatcatggggcagcttacctggaacgacctcatacgcttgtgtatcatggttggcgcgaatgcctccgatcgcatgggtatgggcaccacgtacctagccctcatggctacatttaaaatgcggcctatgttcgcagtgggcctgcttttccgccggctcaccagcagagaggtcctgctgctcaccatcgggctgtccctcgtggctagcgtggagttgccgaactccctggaagaactgggcgacgggttagccatgggcataatgatgcttaaactgttaacggagtttcagccccaccagctgtggactaccctgttaagcctaaccttcatcaagacaaccctgtccctcgactatgcctggaagaccacggccatggcactttctatcgtctccctgttccccttatgccttagcacaacatcacagaagacaacctggctgccggtgcttctgggcagcttcgggtgcaagccccttaccatgtttctcatcacagagaacaagatctggggccggaagtcctggcccctgaacgaaggtataatggccataggcatagtgagcatccttctctccagcctgttgaagaacgacgttccgctcgctggaccgctgatcgccggcgggatgttaatcgcatgctatgtgatcagcgggtcttctgcggacctctcccttgagaaggccgccgaggtctcctgggagcaggaggccgagcattccggcacgagccacaacatcctggttgaggtgcaggacgacggaaccatgaagatcaaggacgaggagagagacgatacactaacgatcctgctgaaggcaaccctcttagcggtctccggcgtgtaccccatgagcatccccgccacactgtttgtgtggtacttttggcagaagaaaaagcagcggtccggggtcctctgggacacccccagcccgcccgaggtggaacgcgccgtgctggacgatgggatctatcggatactgcagcgcggcttgctagggcggtctcaggtcggcgtaggcgtgtttcaggacggcgtgtttcacacaatgtggcacgtgacccgcggggccgttctgatgtaccagggcaagcggctggaaccgagctgggcctccgtgaagaaggatctaatcagctacggggggggttggcgcttccaggggtcctggaacaccggcgaagaggtacaggtgatcgcggtcgagcccgggaagaatccgaagaacgtacagacgacccccggtacctttaagacccccgagggggaagtgggggcgattgcactggatttcaagcccgggaccagcgggtccccgatagttaaccgggagggtaaaatcgtaggcctgtacggtaacggcgtggtaactaccagcgggacatatgtatccgccatcgcgcaggcgaaggccagtcaggaaggcccattgcctgagatcgaagacgaagtcttcaagaagcgcaacctaactatcatggatctgcacccaggtagcggcaagacgcgtcgctatctccccgccatcgtacgggaggccatcaagcgcaagcttcgaacccttatactcgcacccacccgcgtggtggcctccgaaatggccgaagccctgaagggcatgcccatacgctaccaaaccacagcagtaaagagcgaacacaccgggcgggagatcgtggatttgatgtgccacgctacttttaccatgcgcctcctgtccccagtgcgggtccccaactacaatatgatcatcatggatgaggcacacttcacagaccctgcgtctattgcagcccgcggctacatctcgaccagagtggggatgggcgaggcagccgccatttttatgactgcaaccccccccgggtccgtggaggccttccctcaatcaaacgcggtcatacaggacgaggaacgcgacataccagagcggtcatggaacagtggctacgactggatcacggacttccccggcaagacagtctggttcgtcccctctataaagtccgggaatgacatcgccaactgcctgcggaagaacggtaagcgggttatccagctatcacgaaagaccttcgacaccgagtaccagaagacgaagaacaacgactgggactacgtagtgaccaccgacatctccgagatgggagcgaatttccgggccgaccgggtcattgacccccggcgctgcctcaagcccgtgatcctaaaggacggcccggagcgggtcatcttagcgggaccgatgccagtcaccgttgctagcgccgcccagcgccggggccgcatcggccggaatcagaacaaggaaggcgaccagtatgtgtacatggggcagccactaaacaacgatgaggaccacgcccactggacggaggcgaaaatgctgctggacaacatcaatacccccgaggggatcatcccggctctattcgaaccagagcgcgaaaagtccgcagcgatcgatggcgaatatcgactgcgcggcgaggcccgcaagaccttcgtcgagctcatgcgccgcggcgacctgcctgtgtggctgtcgtacaaggtcgcatcggagggcttccagtacagtgaccggaggtggtgcttcgacggtgagcgcaacaatcaagtccttgaggagaacatggacgtggagatctggaccaaggagggcgagcggaagaagctacgtccccgttggctcgacgcacggacctactccgacccgttagccctgcgcgagttcaaggagttcgctgccgggcgccgcagcgtttcgggcgacctgatcctcgagatcggcaagctgccacagcacctgacactgcgggcgcagaacgccttggacaacctggtgatgctccataactccgagcagggcgggaaggcatatcgacacgccatggaggagctgcctgacacgatcgagacccttatgctgctggcgctgatcgccgtgctcacagggggagtgacgctgtttttcttaagcgggaagggtctcggcaagaccagtatcgggctgctgtgcgtgacagcgagctccgcgctcctgtggatggccagcgttgagccccattggattgcggcctcgatcatcctggaattcttcctcatggttctgctgattccggagcccgaccggcagcgcacgccccaggacaatcagcttgcctacgtagttatcggcctgctattcatgatcttgacggtggcggccaacgagatggggctgctggagacaaccaagaaggacctcggaattgggcatgttgcggccgagaaccaccagcacgccaccatgctcgacgtcgacctgcgacctgccagtgcctggacgctctacgcggtggccaccacggtcatcaccccaatgatgcgccacacgatcgaaaacacaaccgctaacatctccctgaccgcgatcgccaaccaggccgccattcttatgggcctcgacaagggctggcccatatcaaaaatggacataggcgtccctctactggccttaggatgttattcccaggtcaatcctctgactctgactgccgcggtgctcatgctggtagcgcattacgccatcattgggcccggcctgcaagccaaagccacccgggaggcacagaaaaggaccgcagccggtattatgaagaaccctactgttgacggcatcgttgctatcgatctcgaccccgtggtctatgatgccaagttcgagaaacagttgggccagatcatgctcctcatcctgtgcacttcgcaaatcttgctcatgcgcaccacttgggcgctgtgtgaatccatcacgctggccaccgggccgttaaccacactgtgggagggctcgcccgggaagttctggaacacaaccatcgcagtgtccatggccaatatctttcgtggcagttacctggcgggcgcagggctcgccttttccctgatgaagtccctgggcggcggtcgcagggggaccggcgcacagggcgaaaccctcggggagaagtggaagcgccagctgaatcagctgtccaaatcagagttcaacacgtacaagcgaagtggcatcatggaggtggaccgctccgaggccaaggaagggttgaagcggggcgaaaccacaaaacacgcggtatcccggggcaccgccaagctgcggtggttcgtggagcgcaacctggtgaagcccgagggcaaggttatcgacttaggctgcggtcggggcgggtggtcctactattgtgcgggcctcaagaaggtgaccgaggttaaggggtacactaagggcggtcccgggcacgaggagccgatccctatggccacctacgggtggaatctagtgaagttacacagcggcaaagacgttttcttcatgccgcccgagaagtgtgacacactcctgtgcgatatcggcgagtccagccccaatcccacgatcgaggaggggcggacgcttcgggtgctcaagatggttgagccttggctacgggggaaccaattctgcatcaaaatcctcaatccctatatgccgagtgttgtggagaccctcgagcagatgcaacggaagcatggcgggatgctggtacgcaaccccctgagcagaaacagcacccatgagatgtactgggtgtcgtgcggaaccgggaacatcgtgtcagctgtcaacatgacgagccggatgctgctgaaccggttcaccatggcgcatcgcaagcccacttacgagcgagacgtggacctgggcgccggcactcggcatgtggccgtagaacccgaggtggcgaaccttgacatcatcggtcagcgcattgaaaacatcaaaaacgagcacaagagtacttggcactacgacgaagacaacccgtacaagacctgggcctatcacgggagctacgaggtgaagccctccggtagcgccagctccatggtcaacggtgtggtacggctccttaccaagccatgggacgtaattcccatggtcacacaaatagccatgacggacaccaccccgtttgggcagcagagggtcttcaaggagaaggtggacacccggacgccccgcgcgaaacggggcaccacccagatcatggaggtaactgccaaatggctctggggcttcctgtcccggaacaagaagccgcggatatgcacgcgcgaggagtttacccgcaaagtccgcagcaacgcagcgatcggtgccgtatttgtggacgagaaccagtggaacagcgccaaagaagccgtcgaggacgaaaggttttgggacttagtgcaccgcgagcgggagttacacaagcaagggaagtgcgcgacctgcgtttataacatgatgggaaagcgcgagaagaagctgggcgagttcgggaaggccaagggctcccgggccatttggtatatgtggctcggtgctcgcttccttgagttcgaggccctggggttcatgaacgaggatcactggttcagccgggagaattccctgtcaggcgtcgaaggggaggggctccacaagctggggtacatcctgcgcgatatcagtaagatacctggggggaacatgtatgcggacgacaccgccgggtgggatacgcggatcaccgaggacgacttacaaaatgaggccaagataacagacattatggagcccgagcacgccctactggctacctcaatctttaagctcacgtatcagaacaaggtggtgcgcgtccagcgccctgctaagaacgggaccgtgatggacgtgatctcccggcgcgaccagagaggatccggccaagtaggcacatatggcctgaacacgtttacgaatatggaggtccagcttatccgccaaatggagtcagagggcatcttcctccccagcgaactggagaccccaaacctagctgagcgggtcctcgactggctagagaagcacggcgccgagcggctgaagaggatggccatatccggcgacgactgtgtcgtgaagccgatcgatgatcgtttcgccaccgcgctcacagccttgaacgacatggggaaagtgcggaaggacatcccacagtgggaacccagcaagggttggaacgactggcaacaggtcccgttttgctcccatcactttcaccagctgatcatgaaggacgggcgcgaaatcgttgttccctgccggaaccaggacgagctagtagggagagccagagtgagccaaggcgccggatggtccctacgcgagaccgcgtgcctgggcaagagctacgcgcagatgtggcagctcatgtacttccaccggcgcgatctgcgattggccgccaacgccatctgctccgcggtgcccgtcgattgggtaccaacgtcgcgcaccacgtggagcatccatgcacaccaccaatggatgaccacggaggacatgctctccgtttggaaccgggtctggatcgaagagaacccgtggatggaggacaagacccacgtgagttcctgggaggaggtgccttacctggggaagcgagaggaccagtggtgcggctctttaatcgggctaaccgcgcgcgcaacttgggccactaacattcaagtcgcgatcaaccaggtgcggcgtctgatcgggaacgagaactacctggaccacatgacctctatgaagcggttcaagaacgagagcgaccccgagggtgccttgtggtga

SEQ ID NO: 23951 - RNA, 9879 nt, synthetic construct
  misc_feature 1..9879: note = derived and/or modified CDS sequence (opt11) from DENV-1__FJ410290__SS-prME
  source 1..9879: mol_type = other RNA
agcgtgactatgctgctcatgctgctgcccaccgccctcgccttccacctgaccacccgagggggtgaaccccacatgatcgtgtccaagcaggaacggggcaagagcctactattcaagacctccgccggggtgaacatgtgcaccttgatcgccatggacctgggggagttgtgcgaggacaccatgacctacaagtgcccccagatcaccgaggcagaacccgacgatgtggactgctggtgcaacgcgaccgatacatgggtcacctacggcacttgcagccagaccggggaacaccggcgggagaagcggtccgtggccttagcgccccacgtgggtctggggctcgagacgcgcaccgagacctggatgagctccgagggcgcctggaagcagatccagcgcgtagagacgtgggctctgcggcaccccgggtttacggtgatagccctgttcctcgcccacgccatcggcaccagcattacccagaagggtatcatcttcatcctgttgatgcttgtgacccccagcatggccatgaggtgcgtcggaatagggaatcgggacttcgtggagggactgtcgggcgccacgtgggtggatgtcgttctggaacacggtagttgcgtgaccaccatggccaagaacaaaccaaccctcgacatcgagctgctgaaaactgaggttactagcccagcgatcctccgcaagctgtgcatcgaagccaagatctccaacaccaccacggactcgcggtgcccaacccagggagaggcaaccttggtggaggagcaggacgccaacttcgtgtgcagaaggacctttgtggaccgcggatgggggaacggctgcggactcttcggcaaagggagcctcctgacgtgcgccaagttcaagtgcgtgacaaaactcgagggcaagattgtgcagtacgagaaccttaagtatagcgtcattgtgaccgtgcacaccggagaccagcaccaggtcgggaacgagacgaccgagcacgggaccatcgctaccatcacgccccaggcccccacgtccgagatacagctgaccgactatggggccctcacactggactgcagcccgcgcacaggcctggacttcaacgagatggtgttactgacaatgaaggagaagagttggctagtccacaagcagtggtttttggacctgccgttaccctggaccagcggggccagtacctcccaggagacctggaaccggcaggacctcttagtgacgttcaagactgcccatgcgaaaaagcaggaagtggtggtattaggctctcaggagggcgccatgcacaccgcactcaccggcgccactgagatacagacctccgggaccaccacgatcttcgccgggcacctaaagtgccgcctgaagatggacaagctcaccctgaagggcactagctacgtaatgtgtacggggtccttcaagctggagaaggaggttgcggaaacgcagcacggtaccgtgctggtgcaagtcaaatacgagggcaccgacgcgccctgtaaaatcccctttagcacccaggatgaaaagggggtgactcagaacggccgcttgattacggccaacccaatagtgaccgacaaagagaagcccgtcaacattgagaccgaaccacccttcggggaaagttacatcgtggtcggggccggcgagaaggcgctgaagctctcgtggttcaaaaagggttccagcattggcaagatgttcgaagccacggcgcgcggggcgcgccgaatggcgatcctcggtgacaccgcctgggactttggttccatcggcggcgtcttcacatctgtggggaagttagtgcaccaggtcttcggaaccgcctacggggtgctgttctccggcgtgagctggacgatgaagatagggatcggcatcctcctgacttggctgggcctcaactcgcgctccacctccctgtcgatgacatgcatcgccgtcgggatggtcaccctgtacctcggcgtgatggtccaggctgactctgggtgcgtgatcaactggaaaggccgcgagctgaagtgcggcagcggcatcttcgtgactaacgaggtccacacctggacagaacagtacaaattccaggccgatagcccgaagagactgtcagcggccatcggcaaggcctgggaggagggggtatgtgggatcagaagcgccacccggctcgagaacatcatgtggaagcagatctccaacgagctgaaccacatactgctcgagaacgacatgaagttcactgtggtcgtgggggacgccaacggaatcttagcgcaagggaagaaaatgattcgcccccagcccatggaacacaaatacagctggaagtcctggggcaaggccaagataattggcgctgacatccagaacacaacctttatcatcgacggaccagacaccccggaatgccccgacaatcagcgggcttggaacatttgggaggtagaggattacggcttcgggatcttcacgaccaacatttggctgaagctccgcgacagctacacccagatgtgcgaccaccggttaatgtccgcggccattaaggactctaaagctgtccacgccgatatgggctattggatcgagtctgagaagaacgagacctggaagctggcccgcgcctcctttatcgaggtgaagacgtgcacctggcccaaatcccacacactctggtcgaacggcgtgctggagtcagagatgatcattcccaaaatatacgggggcccgataagccagcacaattaccggcccgggtactttacccagaccgccggcccctggcacctggggaaactagaattggactttgacctttgcgagggcaccaccgtcgtggtggacgagcactgcggcaaccgcgggccatctctcagaaccacgaccgtcaccggcaaaatcatccacgagtggtgctgtcgcagctgcaccctgccgccactgcggtttcgcggcgaggacggctgctggtacgggatggagatccggcccgtgaaggagaaagaggagaacctcgtgaggtccatggtcagcgccggcagcggcgaggtggactccttttccctgggcatcctgtgcgtaagcatcatgatagaggaggtcatgcggagccgctggtcgcggaaaatgctcatgaccggcaccttagtagtgttcctgctcctgatcatggggcaactgacctggaaggacctcatcagactttgcatcatggtcggcgccaatgccagcgaccgaatggggatgggcaccacgtacctggcactgatggccaccttcaagatgcggccgatgttcgccgttggcctcctgttccgtcgtttgacctctcgcgaggttctgctgttgaccatcggcctgagcctggtcgcctccgtggagctcccgaacagcctggaggagctgggcgacgggctcgccatgggcattatgatgctaaagctgctcacagagttccagccccaccagctgtggaccaccctgctcagcctgaccttcattaagacgacgctgagcctcgactacgcttggaagaccacggccatggccctctcaatagtcagcctgttccccctctgtctgtccacaacctctcagaaaaccacttggctgccagtgttattaggctctttcggatgcaaacccctgacgatgttcctcatcacggaaaataaaatctggggacgcaagagctggcccctgaacgagggcatcatggccatagggattgtgtccatcctgctcagctcgctgctgaagaacgacgtccccctcgcggggcctctgattgccggcgggatgctgatcgcatgctacgtgatctccgggagctctgccgacctcagcctcgaaaaggccgctgaggtgtcttgggagcaggaggcggagcactccggcacctcccacaacatcttagtcgaagtgcaggacgacgggactatgaagatcaaagacgaggagagggacgacaccctcacgatcctgttaaaagccacgctccttgccgtgagcggcgtgtaccccatgtccatcccggccaccttattcgtgtggtacttctggcagaagaagaagcagcggagcggagtactctgggataccccttccccgcccgaggtcgagcgcgcggttctggatgatggcatctaccggatactgcagcgcggcctgctcggccgcagtcaggtgggcgtcggggtgttccaggacggcgtgttccacacaatgtggcacgtcactcgcggggccgttctgatgtaccagggtaagcggctggagccatcctgggccagtgtgaaaaaggacctcatctcctacggcgggggctggcgctttcaggggtcctggaacaccggcgaggaggtacaggttatcgccgtggagccagggaagaatccgaaaaacgtgcaaaccacgcctggcacctttaagacccccgagggggaggtaggggctatcgcgctggattttaagcccggcacctccgggagcccgatcgtaaatcgggagggcaagatcgtaggactgtacgggaacggcgtggtgaccacctccgggacctacgtcagcgccatagcccaggccaaggccagccaagagggccccctccctgagatagaggacgaggtgtttaagaagcgcaacctgaccataatggatctccacccggggtccggcaaaacgcggcgctacttacccgcgatagtgcgggaggcaatcaagcgcaagctgcggacactgatcctcgcccccactagagtcgtggccagcgagatggcagaggcactgaaaggaatgcccatccgctaccaaacgacggccgtgaaatccgagcacacggggcgggagatcgtcgacctcatgtgccacgccacattcaccatgcgcctcctcagcccggtgcgggtacccaattacaacatgatcataatggacgaggcccacttcacggaccctgcctcgatcgccgcacgtgggtacatcagtacccgggtgggtatgggcgaggcggccgcgatattcatgaccgccacgccgcccgggagcgtggaggccttcccccagtctaacgccgttatccaagatgaggagcgcgacattcccgagcgctcctggaactctggctacgactggatcacggacttccctggcaagacggtctggttcgtgccaagcatcaagtccggtaacgatattgcaaactgccttcgcaagaacggtaaacgagttatccagctctctcgcaagaccttcgacaccgagtaccagaaaacgaagaacaatgactgggactacgtcgtgaccaccgacattagcgagatgggggcgaacttcagagccgaccgagtgatcgatccgcggcgctgcctcaagcccgtcatcctaaaagacggccccgagcgggtgatactcgccgggccaatgcccgtgaccgtcgcctccgcggcccagcgccggggcagaattgggcggaaccagaacaaggagggggaccagtacgtgtacatgggccagcccctaaacaacgacgaagaccacgctcactggacggaggctaagatgctgctcgataatatcaacaccccggaggggatcataccggcactgtttgagcccgagcgcgagaagtccgcggcaatcgacggtgagtatcgactgcgcggggaggccagaaaaaccttcgtcgagctcatgcggcgcggcgacttgccggtgtggctatcctataaggttgcgagcgagggcttccagtactccgaccggcgctggtgcttcgacggggagcggaacaatcaagtcctcgaggagaacatggacgtggagatctggaccaaggagggcgagcgcaagaaactgcgcccccgctggctggatgcgagaacctacagcgacccgctcgccctgagggagttcaaggagttcgcggccgggcggcgcagcgtctccggcgacttaattctcgagatcgggaagctgccccagcatctgacgttacgagcccaaaacgccctggacaacttagtcatgttgcacaacagcgagcagggcggtaaggcgtaccgccacgcaatggaagaacttcccgataccatcgagaccctgatgctcctggccctgatcgcagtcctcactgggggcgttacgctgttcttcctgagtgggaaaggtctcggcaagacctcgatcgggttattatgtgtgaccgcgtccagcgccctactgtggatggcctccgtggaaccccattggatcgccgccagcataattttggaatttttcctaatggtgctgctgattcccgagcccgaccggcagcggacaccccaggacaaccagctcgcgtacgttgtgatcggcctgttatttatgattctcacggtggccgccaacgagatggggctcctggagaccaccaagaaagatctcggcatcggacatgtcgccgcggagaaccatcagcacgcgaccatgctagatgtggacctgcggccggcctccgcctggacgctgtacgcggtggccaccaccgtcataacccccatgatgagacacacgatcgagaatacgaccgcgaacatcagcctgaccgccatcgccaaccaggccgccatcctgatgggtctcgacaagggttggcccatctccaagatggacattggggtacccctgctggcgctcggctgttacagccaggttaaccccctgacactgaccgccgccgtcctcatgctggtggcacactacgctatcatcgggcccggcctccaggccaaagccacacgggaggcccagaagcgcacggcagcggggatcatgaagaatccgactgtggacggtatcgtcgctatcgacctcgaccccgtggtgtacgatgctaagtttgagaagcagctgggccagatcatgctgctgatcctctgcacctcccagatcctgctaatgaggaccacatgggccctgtgcgagtcaatcacgctggccactggtccgctcaccaccctctgggagggctcccctgggaagttttggaatacgaccatcgcggtcagcatggccaacattttccggggatcgtatctggccggggccgggctcgcattcagcctgatgaagtcccttggcggtggcagacggggaaccggggcccaaggcgagacgctaggggagaagtggaagcgccaactcaatcaactgtcaaaaagcgagttcaacacgtacaagcggtccggaatcatggaggtggaccgcttcgaagccaaagaggggttaaagcggggcgagaccaccaagcatgcagtgagccgcgggaccgccaagctgagatggttcgtcgagaggaatctggtgaagcccgagggcaaggtgatcgatttgggttgcgggcggggcgggtggagctactattgtgcaggtctaaagaaagtcaccgaggtgaaggggtacacgaagggaggtcccggtcacgaggagccgatccccatggccacctacggctggaacctagtgaagttacacagcgggaaggacgtgttcttcatgccaccggagaaatgcgataccctcctgtgcgacatcggcgagtccagcccgaaccccaccatcgaagaggggcgcacgttacgtgtgttaaagatggtggagccctggctgcgcgggaaccagttctgtatcaaaatcttgaacccctacatgccgtccgttgtggagaccctagagcagatgcaaaggaagcacggcggcatgctggtgcgcaaccccctgtcaagaaattccacccacgagatgtattgggttagctgtggcaccggaaacatagtttccgccgtgaacatgacgagtcgcatgctgttaaaccggttcacaatggctcatcgcaagcccacctacgaacgcgacgtagacctgggcgctggtacccgacatgtggcggtagagcccgaagtcgccaacctcgacatcatcggccaacgcatcgagaacataaagaacgagcacaagtccacctggcactacgatgaagacaacccgtacaagacctgggcctaccacgggtcttacgaggtgaaaccatccgggagcgcatcttcaatggtgaacggcgtagtaaaacttctgaccaagccttgggacgttatccctatggtgactcagatcgccatgacagacaccaccccgtttgggcagcagagagttttcaaggagaaggtcgacacgcgcacgccacgggcgaagcgtggcaccacccagatcatggaggtgaccgctaagtggctctggggcttcctgagtcggaacaaaaagccccgcatatgcacgcgggaggagttcacccgtaaagtgcgttcaaacgccgccatcggggccgtcttcgtagacgagaatcagtggaactcagcgaaagaggcagtcgaggacgagcgtttctgggacctggtccaccgggagcgcgagctccacaagcagggcaaatgcgcgacctgcgtgtacaacatgatggggaagcgtgagaagaaactgggtgagttcgggaaggccaaggggagccgtgcgatctggtacatgtggctgggcgcccggttcctcgagttcgaggccctggggttcatgaatgaggaccactggttcagtcgcgagaactccttaagcggtgtcgagggggagggcttgcataagctgggctacatactgcgggacatctccaagataccgggcggcaacatgtacgcggatgacacagccgggtgggatacccgcatcacagaggacgacctccagaacgaggcgaaaataaccgacatcatggagccagagcacgcactgttagctaccagcattttcaaacttacgtaccagaacaaggtcgtgcgggtacagagacccgccaagaacgggaccgtcatggacgtgatctcgcgccgggatcaacgcgggtctggccaggttggaacctacgggttaaacaccttcacgaacatggaggtccagctgatacggcagatggagagtgagggcatttttctcccctctgagctggagaccccgaacctggctgagcgcgtgctcgactggctggggaaacacggcgctgagagactgaagcgcatggccattagtggtgatgactgcgtggtcaaacccattgacgacaggttcgccaccgccctcaccgcacttaacgacatgggaaaggttcgcaaggacattccacaatgggagccaagcaagggctggaacgactggcagcaggttccgttctgctcccatcacttccaccagctgataatgaaggacgggcgggagatcgttgtgccctgccggaatcaggacgagctcgtgggccgggcgcgagtctcgcagggggccggctggtccctacgggagactgcttgcctcggcaaatcctacgcacagatgtggcaacttatgtatttccaccgccgtgacctgcgcctggccacgaatgcgaagtgctccgccgtgccagtggattgggtcccgactagccggacgacatggtcgatccacgcgcaccatcaatggatgacgaccgaggacatgctctccgtgtggaatcgggtgtggatcgaggaaaacccgtggatggaagacaagacccacgtctcgtcctgggaggaagttccctacctgggcaagcgagaagaccaatggtgcggcagtctaatcgggctcaccgcccgcgcgacatgggccactaacatccaggtggctattaaccaggttcgccggctgatcggtaatgaaaactacctggattatatgacctccatgcgccggtttaagaacgagtccgaccccgagggggccttatggtaa

SEQ ID NO: 23952 - RNA, 9879 nt, synthetic construct
  misc_feature 1..9879: note = derived and/or modified CDS sequence (opt11) from DENV-1__FJ024423__SS-prME
  source 1..9879: mol_type = other RNA
agcgtgaccatgctgcttatgctgctgcccaccgcgttagccttccatctgacaacacggggcggagaaccccacatgatcgtgagcaaacaggagcgaggcaaaagcctcctcttcaagaccagcgcgggggtgaacatgtgcacccttatcgccatggacctgggcgaactctgcgaggacacgatgacttacaagtgcccacagatcaccgaggccgagcccgacgacgtggactgttggtgtaacgctactgatacttgggtcacgtatgggacctgctctcagaccggcgagcatcggcgggacaagcgctccgtggcccttgcaccgcacgtgggcctggggctcgagacccggaccgagacctggatgtcaagcgagggcgcctggaagcagatccagcgcgtcgagacgtgggccctgcggcaccccggatttacggtggtggcgttcttcctggcccatgccattgggaccagcatcacccagaaggggatcatctttattctcctgatgctggtcacaccctccatggccatgcggtgcgtgggcatcggtaaccgggattttgtggaggggctcagcggcgcgacgtgggtcgacgtggttctagagcacgggtcctgcgttaccacgatggccaagaacaagccgaccttggacattgagttgctgaagacggaggtgaccaaccccgcgatcttgcgcaagctctgcatcgaggccaagattagcaacaccaccacggactcccggtgcccgacccagggcgaggccaccttggtagaagagcaggacgccaacttcgtttgccgccgaacttttgtggacagaggctggggtaacggatgcgggctatttggcaagggcagcctcttaacttgcgccaagtttaagtgcgtaaccaagctagaggggaagatcgtccagtacgaaaacctcaagtactccgtcatcgtgaccgtccacactggcgaccagcaccaagtggggaacgagacgacggaacacggcaccatcgcgatcatcacgccgcaggcacccaccagcgaaatacagctgacggactatggggccctgacactcgactgcagcccccggaccggcttagacttcaatgaaatggtcctgctcaccatgaaggagaagtcttggctagtgcacaaacagtggttcctggacctcccactgccttggacgtccggggctagcacttctcaagaaacgtggaaccgacaggacctactcgtaaccttcaagacggcccacgccaagaagcaggaagtcgtggtactgggttcgcaggagggcgcgatgcatacggccctgactggagcaaccgagatccagacgagcggcacgaccaccatctttgccgggcatctcaagtgtcgactgaaaatggacaagctgacgttaaagggcaccagctacgtcatgtgcaccgggtcgttcaagctggaaaaggaggtggcagagacccaacacggcacggtcttagtccaggtgaagtacgagggtaccgacgcaccatgcaaaatccccttttccacacaggacgaaaagggggtgacccagaatggcagactgatcacggccaacccaatcgtcaccgacaaagaaaagcccgtgaacattgagacagagccaccctttggggaaagctacatcgtgattggagccggagagaaagctctcaagcttagttggttcaagaaggggtcgtccattggcaaaatgttcgaggccaccgcccgcggagcccgccggatggcgatcctgggcgacacggcgtgggacttcgggtccatcggtggcgtctttacaagcgtggggaagctagtgcaccaggtcttcggaaccgcatacggggtgctattctcgggcgtgagctggaccatgaagatcgggatcgggattctgctcacttggctgggtctaaatagccgctctaccagcttatcaatgacctgcattgccgtgggtatggttaccctttacctgggggtgatggtccaggcagatagcggctgcgtcattaattggaaaggccgcgagctcaagtgcggttccggcatcttcgtaacgaacgaggtacacacctggaccgaacagtacaagttccaggccgacagccctaagcggctgtcagcggcgatcggcaaggcttgggaggagggggtttgcggcatacgctccgccacccggctggagaacatcatgtggaagcagatcagtaatgagctaaaccacatcttactcgagaacgacatgaagtttaccgtggtcgtgggggacgccaatggcatcttggcgcaggggaagaagatgatacgcccccaaccaatggaacacaagtactcgtggaagtcctggggcaaagccaagatcatcggtgccgacatccagaatacaaccttcatcatcgacgggccagacactcctgagtgccccgatgaccaaagagcctggaacatctgggaggtggaggattacggcttcggcatcttcactaccaacatttggctgaagctgcgagattcctatacccagatgtgtgaccaccgtctcatgtcggcggcaatcaaggactccaaagccgtccatgccgacatgggctactggatagagagcgagaagaacgagacctggaagttggctcgcgcgagtttcatagaggttaagacctgcacgtggcccaagtcccacactttatggtctaacggcgtgctggagagcgagatgatcatccccaaaatctacggaggaccaatctcccagcacaattaccggcccgggtatttcacccagactgccgggccctggcacctggggaaattggagttagactttgacttatgtgagggcacgaccgtcgtagtagacgagcactgcggcaatcgggggccttcacttcggaccaccacggtcacaggcaaaatcattcacgagtggtgctgccgctcctgtaccctaccgcccctgagatttcgtggggaggacggctgctggtacgggatggagatccgtcccgtaaaggagaaggaggagaacctggtgaggagcatggtaagcgccggcagcggcgaggtggatagcttctcgctcggaatcctgtgcgccagcattatgatcgaggaggtgatgcggtcccgctggagccggaagatgctgatgaccggcacactcgccgtcttcctgctgctcatcatggggcagctcacgtggaacgacctgatacgcctctgcatcatggtaggcgccaacgcttctgatcgcatggggatgggcaccacctatctagctctgatggccacgttcaaaatgaggcctatgttcgccgtgggcctcttattccgtcgactaacatcaagagaggttctccttctgaccatcggtctctccctggtggcatcagtggaactgcccaactccctcgaggagctgggcgacggtttggccatgggcatcatgatgctcaagctgctgactgaattccagccccaccagctctggactacactgctgagcctcacctttatcaagaccaccctgtccctggactacgcctggaagaccaccgccatggcgctcagcatcgtctccttattccccctctgcctaagcaccacttcccagaagaccacatggctgccggttctgctcggcagctttgggtgcaagcccctaaccatgttcctgatcaccgaaaacaagatctggggccggaagtcctggccattgaacgagggcattatggcaatcggcatcgtcagcatcctgctgtcctccttgctgaagaatgatgtccccctagcggggccgctcatcgccggcggcatgctgatcgcctgctacgtcatcagcgggtccagcgcggatctaagtttagagaaagccgcggaggtcagctgggagcaggaggccgagcattccggcacctcacacaacatcctggttgaggtgcaggacgacgggacaatgaagatcaaggacgaggagaaggacgacaccctcactatcctcctcaaggccacgctcctagcggtctccggcgtgtaccccatgtctattccagccacgctgttcgtgtggtacttctggcagaagaagaaacagcgctccggggtcctgtgggacaccccatcgccacctgaagtcgagcgggccgtgctagatgacgggatttaccggatcctacagcgggggctgctgggacgctcccaagtcggcgtcggggtgttccaggacggcgtcttccataccatgtggcacgtgacgcgcggggctgttctcatgtaccagggcaagcgcctggagcccagctgggcctccgtcaagaaggaccttatcagctacggcgggggctggcgtttccaggggtcctggaacaccggcgaggaggtccaggtgatcgccgttgagcccgggaagaacccgaagaacgtgcagacgacccccggcacgttcaagactcccgagggcgaggtgggggccatcgccctcgacttcaagccgggcaccagcgggagtccgatagtcaatagggaaggcaagatcgtaggactttacgggaatggcgtggtcaccacgagcgggacctacgtatccgccatcgcacaggcgaaggcgagccaggagggcccactaccggagatcgaggacgaggtgttcaaaaagcggaacctcaccataatggacctgcaccccgggagcggcaagacacgtcgatacttacccgccattgtccgcgaagccattaagcgcaagctccgcacactgatcctggcgccaacccgggtggtggcctccgaaatggcggaggccttaaagggaatgcctatcagataccagaccaccgccgtgaagagtgagcacaccggaagagagatcgtggacttaatgtgccacgcgaccttcaccatgcgactgctctcccctgtacgcgtccccaactacaacatgataatcatggacgaggcgcacttcaccgaccccgctagtatcgcagcccggggctacatcagtacgagagtagggatgggcgaggcggcggcgatattcatgaccgccacgccgccagggagcgtggaggcattcccacagtccaacgctgtcatccaggacgaggaacgggacatccccgagcgctcttggaactcgggctacgattggatcaccgacttccccggcaagacggtgtggttcgtgccctctatcaaatccgggaacgacattgccaattgcctgcgtaaaaatggcaagcgcgtcatacagctgagtaggaagaccttcgacaccgagtaccagaaaaccaagaacaacgactgggactacgtggtgacgaccgacatctccgaaatgggggcgaacttccgcgctgaccgggtcatcgacccccgccgatgtttgaagcccgtcatcctgaaggacggtcccgagcgcgtgatcctcgcggggccgatgcctgtcaccgtggccagcgccgcccaacgccgcggccggatcggccgcaaccagaacaaagagggggaccaatacgtgtacatgggccagcccctcaacaacgatgaggaccacgcccactggaccgaggcgaagatgctgcttgacaacatcaacacgccagaggggatcatcccggccctcttcgagcccgagcgggagaagtccgcagctatcgacggcgagtaccgcctgcgcggcgaggcccggaagacgttcgtagagctgatgagaagaggcgacttacccgtttggcttagttacaaggttgcgtcggagggcttccagtacagcgaccgccgttggtgcttcgatggcgagcgcaacaaccaggtgctcgaagagaacatggacgtagagatctggaccaaagagggcgagcggaagaagcttcgcccccggtggttagacgcgcgcacctactccgaccccctggccctacgggagttcaaggagttcgccgccgggcgccggtcggtcagcggcgatctgatcctggagatcggcaaactcccccagcacctgaccttgagagcacagaacgccctcgacaacctggtgatgttacacaactccgaacagggcgggaaggcctacaggcacgcgatggaggagctccccgacacgatcgagacactgatgctgctcgcgttgatcgccgtgctgaccgggggcgtcaccctcttcttcctaagcgggaagggcttgggaaagacttctatcgggttactgtgtgtaaccgccagctccgccctcctctggatggccagcgtggagccgcactggattgcggcctccattattctggagttcttcttgatggtcctcctgatccccgagcccgaccgccagagaactccccaggataatcagctcgcctacgtagtgatcggactcctgtttatgatactgaccgtcgccgccaacgagatggggctcctggagacgacaaagaaggacctgggcatcggccatgtggcggccgagaaccaccagcacgccaccatgttagacgtggacttacgcccggccagcgcctggaccctgtacgcggtcgcgacgaccgtgattacccctatgatgcggcacactatcgagaacacgaccgccaacatcagcctgaccgccatcgccaaccaagcggccatcttgatgggcctggacaagggatggcccatcagcaaaatggacatcggcgtgcccctcctggcactgggctgctactcccaggtcaacccgctaacgctgacggcggcagtgctgatgctggtggcacactacgctatcatcgggcccggtctgcaagccaaggcgacccgcgaggcgcagaagcggaccgctgccgggatcatgaagaaccccaccgtcgacggtattgtggccatcgatctggatccagtggtctacgacgcgaagttcgagaagcaactcggccagatcatgctgctgattttgtgcaccagccagatcttgctgatgaggactacctgggcgctctgtgagtccatcaccctggccacggggccgctgacaaccctctgggaaggcagccccggcaagttctggaacaccacgatcgccgtgtccatggccaacatcttccgcggcagctacctggccggcgcggggctggcgttctccttgatgaagtccctaggagggggcaggcgggggaccggggcccaaggcgaaaccttaggtgagaagtggaaacggcagctcaaccagttaagtaagagcgagtttaatacctacaagcggagcggaatcatggaggtggaccgtagcgaggccaaggaggggctgaagcgcggggagacgactaagcacgcggtttcgcgggggacggccaagctccgctggttcgtggagcggaatctggtgaagcccgaaggcaaagtcatcgacctgggctgcgggcgcggcggatggtcctactactgcgccggcctgaagaaggtcaccgaggtgaaagggtatacgaagggcggacccgggcacgaggagccgatccccatggccacgtacggctggaacctcgtcaagctgcactcagggaaggatgtcttctttatgccgcccgagaagtgcgacaccctcctctgcgacataggcgagtccagcccgaaccccacgatcgaggaggggagaaccctccgtgtactgaagatggtcgagccctggctccgcggcaaccaattctgcatcaagatcctgaacccttacatgccgtccgtggtggagacgctagagcagatgcagcgcaagcacggcgggatgttagtccgcaacccactgagccgcaactccacacacgagatgtactgggtgagctgcggaaccggaaatatcgtgtcagcggtcaacatgaccagccggatgctactcaaccgctttacgatggcccaccgtaagccaacctacgagcgtgacgtggacttgggtgccggcacccgccacgtggccgtcgaaccggaagtggccaacctagacatcattgggcagagaatcgaaaatatcaagaatgagcacaagtccacctggcattacgatgaagacaatccgtacaagacgtgggcgtaccacggcagctacgaggttaagccctccggtagcgcatcgtcgatggttaacggcgtggtgcgtctcctgaccaagccttgggacgtcatccccatggtaacgcagattgccatgaccgacacgaccccgttcgggcaacagcgggtcttcaaggagaaagtggacactcgcacgccccgggccaagcgcggcacgacccagatcatggaggtgaccgccaagtggctgtggggcttcctcagccggaacaagaagccccgcatttgcacgcgcgaggagttcacgcgcaaagtgcggagcaacgccgcgatcggggccgttttcgtggatgaaaaccaatggaacagcgccaaggaggcggtcgaggacgagcgtttttgggacctggtgcaccgggaacgcgagctgcataagcaaggtaagtgcgcgacctgtgtgtacaacatgatggggaagagagagaagaagctcggcgagtttggcaaggccaagggatcccgcgccatatggtacatgtggctgggggcccggttcctggagttcgaggcgctcgggttcatgaatgaggaccattggttcagtcgcgagaactccctgagcggcgtcgagggggaggggctgcacaagttggggtacatcctacgtgacatctccaagataccgggcggcaacatgtacgcggatgacactgccgggtgggacacgcggattacggaggacgacctgcaaaacgaggccaagataacggacatcatggaacccgagcacgccctactggccaccagcattttcaagctgacctaccagaacaaggtggtccgcgtccagcgccccgcgaagaacggcacggtgatggacgtaatttcacgcagggaccaacgcgggagtggccaggtcgggacctacggtctcaacactttcaccaatatggaggtgcaactgatcaggcagatggagtccgagggcatcttcctgccgtctgagctcgagacgccgaacctggcgaagcgcgtgctggattggttggagaagcacggggccgaacggttaaagcgcatggccatctccggcgacgactgcgtagtgaagcccattgatgaccggtttgccacagcgctgaccgccctcaacgacatggggaaggtgcgaaaagacattccccaatgggagcccagcaaggggtggaacgactggcagcaggtcccgttctgttcccatcacttccaccagctaataatgaaggacggccgggaaatcgtggtgccctgccgtaatcaggacgagttggtcgggcgagccagagtgagccagggcgccgggtggtccctccgggaaaccgcctgcctgggcaaaagctacgcccagatgtggcagctgatgtatttccaccgccgggacctccgcctcgccgccaacgccatctgctccgcggtacccgtcgactgggtgcccacatcgcggacgacgtggtcgatccacgcacatcaccaatggatgaccacagaagacatgctgtccgtgtggaaccgcgtgtggatcgaggagaacccgtggatggaggataagacgcatgtgtcttcctgggaagaagtgccctatctcggtaagcgcgaggaccagtggtgcggatcactgattggccttaccgcccgggccacctgggccaccaacatccaggtcgcaatcaaccaggtccgccggctcatcggcaacgaaaactacctggactatatgacgtccatgaagcgcttcaagaacgagtcggaccccgagggggccctatggtag

SEQ ID NO: 23953 - RNA, 9879 nt, synthetic construct
  misc_feature 1..9879: note = derived and/or modified CDS sequence (opt11) from DENV-1__FJ547089__SS-prME
  source 1..9879: mol_type = other RNA
tccgtgacgatgttgctcatgttgcttcccaccgctctagccttccacctcacgacccggggcggggagccccatatgatcgtatcgaagcaggagaggggcaagtcactcctgttcaaaaccagcgccggggttaatatgtgcacactaatagcgatggatctgggtgagttatgcgaggacacgatgacctacaagtgcccccagataacagaggccgagcccgacgatgtggattgctggtgcaacgcaaccgacacgtgggttacctatgggacgtgcagccaaacaggagagcatagacgggacaagcgctcggtcgccctggctccgcacgtgggactggggctggagacgcggaccgaaacgtggatgagttcggaaggcgcgtggaaacagatacagcgcgtagagacctgggccctgcggcaccccgggttcacagtgatcgccctctttctcgctcacgctatcggcacctcaataacccaaaaaggcatcatcttcatactgctgatgctcgtgaccccctcgatggccatgcgctgcgttggcatcggtaaccgggacttcgtcgaggggctgtcgggcgccacctgggtagatgtggtcttagagcacgggtcctgcgtgaccacaatggctaagaacaagcccacccttgatatagagctgctaaagacggaggtcactaaccctgcgatcctccgcaaactatgcatcgaagcaaaaatttcaaacaccaccacggactcccggtgcccaacacagggcgaggccaccctggtggaggagcaggacgccaacttcgtgtgccgccggacattcgtggaccgcggctgggggaatggctgcggcctattcggcaaggggagcctgctgacgtgtgccaagttcaaatgcgtaactaagctcgagggtaagatcgttcagtatgagaacctgaaatactcagtcatcgtgacggtgcacaccggcgaccagcaccaggtcggtaacgagacgaccgagcacggcactatcgcgacaataacgccccaagctcccacgagcgagatccagctgaccgactacggggcactcaccctggattgttcacctagaacaggcctggactttaatgagatggtgctgctaaccatgaaggagaaaagctggctggtccacaagcaatggtttctagacctgcccctaccttggacatccggggcatctaccagccaggagacctggaatcgccaggacttactggtgacgtttaaaaccgcacacgcaaaaaagcaggaggtggtggtgctagggtcccaggagggggccatgcacaccgccctcacaggagccacagaaatccaaactagcggtaccaccacgattttcgcagggcatctgaagtgtcggctgaagatggacaagcttacactgaaggggacgtcctacgttatgtgcaccggcagcttcaagctggaaaaggaggttgcggagacccagcacggaaccgtgctggtacaggtaaagtatgaaggcaccgacgccccctgcaagatccccttctccacccaagacgagaaaggcgtaacgcagaacggccgcctcatcactgccaatcctatagtgaccgacaaggaaaagcccgtcaatatcgaaaccgaaccgccctttggcgagagctacatcgtggtgggcgccggcgagaaggcgctcaagctgtcctggttcaaaaagggcagctccatcggcaagatgttcgaggccacggcacgtggagcccgcagaatggccattctcggcgacacagcgtgggacttcgggagcatcggcggcgtctttacatcagtagggaagctggtccaccaggtctttggaacagcctacggggtgctgttcagcggtgtgtcctggacgatgaagatcgggataggtatcttactaacgtggctgggactcaacagcaggtccacaagcctgtccatgacttgcatcgcggtcgggatggtgacgttatatctcggcgtgatggtccaggccgatagtgggtgcgtgattaactggaaaggccgcgagctaaagtgcgggtcgggcatcttcgtcaccaacgaggtacacacctggactgagcagtacaagttccaggccgattcaccgaaacggttatcagctgccatcgggaaggcctgggaggagggggtttgcggcatcagatcggcaacccggctggagaatatcatgtggaagcagatctcaaacgagctgaaccacatcctactcgagaacgacatgaagttcactgtggtggtgggcgatgctaacggcattctggcacaaggtaaaaagatgatacgcccacagcccatggaacacaagtacagttggaagagctgggggaaggctaagataatcggcgccgacatccaaaacacgactttcataatcgacgggcccgacacaccggagtgccccgataaccaacgggcctggaacatatgggaggtggaagactacggcttcgggatcttcaccaccaacatctggctgaagctcagagattcctacacccagatgtgcgaccaccgtctgatgagcgcggctattaaggactctaaagcagtccacgccgatatgggctattggatagaaagcgagaagaacgagacttggaaactcgcccgcgcgtccttcatagaggtaaagacgtgcacctggccaaagagccacaccctctggagtaacggggtgctggagagcgaaatgattatccccaaaatctacggtgggccgatctcgcagcacaactaccggcccgggtacttcacccaaacggccggcccctggcacctaggtaagctcgaactggacttcgatctctgcgaagggacgaccgtcgtggtggacgagcactgtggcaacagaggcccaagcctccggaccacgaccgtgacaggcaaaacgattcacgagtggtgttgtcgcagctgcaccctccctcccctacgtttccgcggtgaggatggctgctggtacggaatggagatccggcccgtaaaggagaaggaagaaaatttggttcgtagtatggtttccgctggtagcggcgaggttgacagcttctccctgggaattctatgcgcctcgatcatgatcgaagaagtgatgcgtagtcgctggagccggaaaatgctcatgaccggtactctggccgtctttctgctactgataatggggcagctgacatggaacgatctgattcgcctgtgcatcatggtgggcgcgaacgcttccgaccgcatggggatgggaacgacctacctggccctcatggccaccttcaaaatgagaccgatgttcgcggtgggcttgctattccggcggctcacgagcagagaggtgctgctgctcacgattgggctttccctagtggcgtccgtggagttgcccaactccctggaggaactgggcgatgggctcgctatgggcatcatgatgctaaagcttctaacggagtttcagccgcatcagctgtggaccaccctgctctccctgacgttcataaagacaaccctgtccctggactacgcctggaaaaccaccgccatggctctgagcatcgtttccctgtttccactctgcctgagcacaacttcccagaagaccacctggctgccggtgctcctaggatcattcgggtgcaaacccctgacaatgttcctaatcaccgagaataagatatggggtagaaaatcctggcccctcaacgagggcatcatggccattggcatcgtgtcaatccttctgtcctcgctactaaagaacgacgtgcccctcgccgggccgctgatagccggcggcatgttaatcgcctgctacgtcattagcgggtcatcggcggacttgtcccttgaaaaggccgcagaagtaagctgggagcaggaagccgagcactccggcacgtctcacaacatcctggtcgaggtgcaggatgacggtacgatgaagataaaggacgaggaaagggatgacactttgaccatcctccttaaggccaccctcttggcagtctccggcgtgtatcccatgagcatccccgcaacactgtttgtgtggtacttctggcagaagaagaagcagcggagcggggtcctctgggacactccaagcccgcccgaagttgaacgcgccgtgctggacgacggcatctaccgtatactacagcgtggcctgctcgggcggagtcaggttggcgtgggggtattccaggacggcgtattccacaccatgtggcacgtgaccagaggggcagtgctgatgtaccagggcaagcgtctcgagcccagctgggcatccgtcaaaaaggacctcatcagctacggtggaggctggcgtttccagggctcctggaacaccggcgaagaggtccaggtgatcgcagtcgagcctggtaagaacccgaaaaacgtccagacgacgcccggaaccttcaagacccccgaaggggaggtgggggccatcgctttagacttcaagcccggtacatcagggagcccgatcgtcaaccgggagggcaagatcgtggggctgtacggtaacggcgtggtcaccaccagcgggacctacgtgtccgcaatcgcccaggccaaggctagccaggagggccccctccccgagatcgaggacgaagtgttcaagaagcgaaacctgacgatcatggacctccaccctggtagcggaaagacgcggcggtacctccccgccattgtccgcgaggccatcaagcgcaagctacggactttaatactcgcgcctacacgcgttgtagccagtgaaatggcagaggccctaaaaggcatgcccatccgctaccaaacgaccgctgtcaagtcggaacacaccgggagagagatcgtcgacctgatgtgccatgcaacgttcactatgcgcctcctgtccccggttcgggtccccaactacaatatgatcattatggacgaggcccacttcaccgatcccgctagcatcgcggcaaggggatacatctccacccgggtgggtatgggcgaggcggccgcgatcttcatgactgcaacgcccccggggtccgttgaggccttcccccaatccaacgcggtcattcaagacgaggagcgggacatccccgagcggtcgtggaatagtggatacgactggattactgacttccccggcaagaccgtctggttcgtgccgtcaatcaagtccgggaatgacatcgctaattgcttgcgcaagaacggcaagcgggtgatccagttgagcagaaagacgttcgatacggagtaccagaagaccaaaaacaacgattgggactacgtggtgaccaccgacatctctgaaatgggagccaacttccgggcggacagagtcatcgacccccggcgctgcctgaaaccagtgatcttgaaagacggccccgagcgggtgattctcgccgggccgatgcccgtgacggtggcaagcgccgctcagagacggggccgcatcgggcggaaccagaataaagaaggggaccagtacgtgtatatgggacagccactgaataacgatgaggaccacgcccactggaccgaggcgaagatgctgcttgacaacatcaatacccctgaagggatcatcccggctctgttcgagccggaacgcgagaagtccgccgccatcgacggagagtaccgcctgcgcggtgaggcccgtaagacatttgttgagctcatgcggcgtggggatctgcccgtgtggctgagctataaggtcgcgtccgagggattccagtactccgaccgacgttggtgcttcgacggggagcggaacaaccaggtgcttgaagagaacatggacgtggaaatttggaccaaggagggtgaacgtaagaagctgaggcctagatggctggacgcccggacctattccgaccctcttgccttgcgcgaattcaaagaattcgcagccggcaggcgcagcgtgagcggagacctgattctcgaaatcggaaagctgccccaacacctgaccctccgggcgcaaaacgcgcttgataacctggtgatgctccacaacagtgaacagggtggtaaggcctaccgccacgccatggaggaactgccggatactatcgagaccctgatgctgctggcgctaatcgcagtgttgacgggcggggttactttgttcttcctaagcgggaagggtctgggcaagacctccatcgggctgctctgtgttaccgctagctccgcgctcttgtggatggcctcggtggagccgcactggatagcggcgagcatcatcctagaattctttctcatggtgttactcatcccggagcccgaccggcagcgcacgccccaagacaatcagctcgcttacgtggtgatcgggcttctattcatgatcctcaccgtcgctgccaacgagatgggcctgctggaaacaaccaagaaggatttgggcatcgggcacgtggccgccgagaaccaccagcacgccacaatgctagacgtggacctgcgcccggcgtcggcgtggaccttatatgcggtcgccaccaccgtgatcacgcctatgatgcggcacaccatcgagaacacgaccgcgaacatctccctgactgccatagctaatcaggcggccatcctgatgggcctcgacaaaggctggcccatctctaaaatggacatcggggtgccactactggccctgggctgttactctcaggtcaaccccttaactctcaccgcagcggtgctcatgctggtggcccattatgcgattatcgggcctggcctgcaggccaaagctacccgggaggcgcagaagcgcacggctgccgggataatgaagaatccgacggtagacggcatcgtggcgatcgacctcgaccccgtggtctacgacgccaagttcgagaagcagctgggacagataatgctgttaatcttatgcaccagccagatcttactcatgcgcacgacctgggccctgtgcgaatcaatcaccctggccacgggcccgctcacaacgttgtgggaaggaagcccagggaagttttggaacacaaccatcgccgtgtcaatggccaacatattccggggcagctacctggccggcgcagggttagccttctccctaatgaagtccctgggcggcggcagacgcggtaccggtgcccagggcgaaacgctcggggagaagtggaagcgccagctgaaccagcttagcaagagcgagttcaacacctataagcggagcggcattatggaggtcgaccgctccgaggccaaggaaggcctcaaacggggcgagaccacgaagcatgcagtctcacgcggtactgccaagctgcggtggttcgtggagaggaatctggtaaagcccgaaggtaaggtcatagatctgggctgcggcaggggcggatggtcatactactgcgccggcctcaagaaggttactgaggtcaagggttacaccaagggcgtgcccgctcgtgaggaacctatccccatggccacctacggctggaacctggtaaagttgcacagtgggaaggacgtatttttcatgccgccagaaaagtgcgacactctcctttgtgacataggggagtcctcgcctaaccccacgatcgaagaaggacgaacactgcgcgtcctcaagatggtggagccttggctccggggcaatcaattctgcatcaaaattttaaacccctacatgccgtcagtggtcgagacattggagcagatgcagcgcaaacacgggggtatgctggtgcgtaaccccttaagccgcaactccacccatgaaatgtactgggtgagctgtggaaccgggaacatcgtctccgcggtaaatatgacctctcggatgctcctgaaccgctttaccatggcacaccgcaagcccacctacgagcgggatgtggacctcggcgccgggacgcgccacgtcgccgtcgagcccgaggtggcgaaccttgacatcatcggacaacggatcgaaaacataaagaatgaacacaaatccacatggcactatgacgaggacaatccgtataaaacatgggcctatcacggttcctacgaggtaaagccctcaggttcagcgtccagcatggtgaatggggttgttaggctgttgacgaagccttgggacgtgatcccgatggtcacgcaaatcgccatgaccgacaccaccccgttcgggcaacagcgggtgttcaaggagaaggtggacacgcgcactccccgtgcaaagcgggggaccacccagatcatggaggtcacggccaagtggctctgggggtttctgtcacggaataagaagccccgcatatgtacacgggaagagttcacgcgcaaggtacggagcaacgcggcaatcggcgccgtgttcattgacgaaaaccagtggaactccgcaaaggaggcggtcgaggacgaaaggttttgggaccttgtgcaccgggagagagaactccataagcagggcaagtgcgctacctgtgtgtataacatgatgggaaagcgtgagaaaaagctaggggagtttgggaaagccaagggctcgcgagccatctggtacatgtggctgggggctcggtttctagagttcgaggcgctgggcttcatgaacgaagaccattggtttagccgcgagaactccctttcaggcgtcgagggggagggtcttcataagctggggtacatactccgggacatctcaaagatcccgggcggcaacatgtatgctgatgacacggccggctgggatacgcgcgtgaccgaagacgacctccagaacgaggccaagatcaccgacatcatggaaccggagcatgccctcctggcgactagcatctttaagctcacttaccagaacaaggtggtacgcgtgcaacggcccgcgaaaaacggcaccgtgatggatgttatttcacggcgggaccagcgcgggagcggccaggtgggaacctacggcctgaacacattcactaacatggaggtgcagcttatccgacaaatggaatccgagggcatttttctaccttcagaactggaaaccccaaatctggccgagcgcgttctcgattggctggagaaacatggggcagaacggctgagacggatggccatctctggcgatgattgcgttgtgaagcccattgacgataggttcgcgaccgcactcaccgccttgaacgacatgggtaaggtccgtaaagacatcccccagtgggagcccagtaagggatggaacgactggcagcaggtcccgttctgttcccaccacttccaccagctgatcatgaaagacggccgcgagatagtagttccctgccggaaccaggacgagttagtgggccgcgccagggtgtctcagggggccggatggtctctgagagaaacggcctgcctgggtaagagctacgcacagatgtggcagcttatgtacttccaccgtcgcgatctgcgcctggccgccaacgccatctgttccgccgtccccgtagactgggtgcctacctcacgcaccacctggtcgattcacgcccaccatcaatggatgacgaccgaggacatgctatcggtctggaaccgcgtctggatcgaggagaacccgtggatggaggataagacccatgtgtcatcctgggaggaggtcccttatctggggaaacgcgaggaccagtggtgcggcagcctgatcggtctcactgcccgcgccacgtgggcaaccaacatacaggtggccataaatcaggttcggcgtctgatcggcaatgaaaattacctggactacatgactagtatgaagcggttcaagaacgagagcgaccctgagggcgccctgtggtga

SEQ ID NO: 23954 - RNA, 9879 nt, synthetic construct
  misc_feature 1..9879: note = derived and/or modified CDS sequence (opt11) from DENV-1__FJ024484__SS-prME
  source 1..9879: mol_type = other RNA
tcagtaacgatgctgctcatgttgctccctaccgccctcgccttccatctgacaacgcgaggcggggagccccatatgatcgtgagcaagcaggagcgtggcaaaagcctcctattcaagacaagcgccggggtgaacatgtgcaccctgatcgccatggaccttggtgaactttgcgaagacaccatgacatacaagtgcccccaaatcactgaagccgagccggacgacgtggactgctggtgcaacgccaccgacacttgggtgacctacgggacatgcagccagaccggcgagcaccggcgggacaagcgctcggtggccctggctccccacgttggcctggggctggaaacgcggaccgagacctggatgagtagtgaaggcgcgtggaagcagatccagcgcgtcgaaacctgggcgctgcggcatccggggttcactgtggtggcattcttcctagcacacgcgattggcacctctatcacacagaaggggataatcttcatcctcctgatgctggttaccccctccatggccatgcgctgcgttggcatcggcaaccgagatttcgttgaagggctgagtggcgcaacgtgggtggacgtggtgctggagcacggttcctgcgtcaccacgatggcgaagaacaagcccacgttagacattgagctcctgaaaaccgaagtgaccaaccccgcgatcctccggaagttgtgcatcgaggcgaagatcagcaacacgactacagattcccggtgcccgacccagggcgaagccacgctggtggaggaacaggacgccaacttcgtatgcaggcggaccttcgtggaccgcggctgggggaacggatgtggactgttcggcaaaggttccctcctaacgtgcgccaagttcaagtgcgttaccaaacttgaaggcaagatcgttcagtacgagaacctcaagtactcagtgatcgtcaccgtccacaccggcgaccagcaccaggtggggaatgagacgacagagcacggcaccatcgcaacgatcaccccccaggccccgacatctgagatccaattaactgactacggagccctgaccctggactgcagtccacggaccgggctggactttaacgaaatggttctccttacgatgaaggagaagtcctggctggtacacaaacagtggttcctggacctcccgctgccctggacgtccggggccagcacctcacaggagacatggaacagacaggatttgttggtgacgttcaagaccgcccatgcaaagaagcaagaggtcgtggtgctgggttctcaggagggcgccatgcacaccgccttgaccggggcaacggaaatccagacctctggcaccaccactatctttgccgggcacctaaagtgccggctgaagatggacaaactgaccctcaagggcaccagctacgtcatgtgcaccggtagcttcaaactggagaaggaggtggcggagacacaacacggcaccgtgctggttcaggtgaagtatgagggcaccgacgccccttgcaaaatccccttttccacccaggacgaaaagggggtgacgcagaacggccgcctaatcactgccaaccccatagtcaccgacaaggaaaagcccgtgaatatcgagaccgagccgccctttggcgagagctacatagtgatcggcgcaggagaaaaagccctgaagttatcctggttcaagaaaggcagctccataggcaagatgtttgaggctaccgcccgcggggcccgcagaatggccattctgggcgacaccgcgtgggacttcgggagtatcggcggtgttttcacctccgtgggcaagttggtccaccaagtattcggcacagcctacggggtgctgtttagcggggtgtcctggacgatgaagatcgggataggcattcttctaacctggctcggcctgaactcccgctcaaccagcctcagcatgacctgtatcgcagttgggatggtgacgctgtatctcggggtgatggtgcaggccgacagcgggtgcgtcattaattggaaagggcgcgagctcaagtgcgggtccggcatattcgtcaccaacgaggtccacacatggaccgagcagtacaagttccaagccgactccccgaagcggctgagtgcggccatcggcaaggcttgggaggagggggtatgtggcatccgctccgccacccggctggagaacatcatgtggaagcagatcagcaacgagctcaaccatatcttactggagaacgatatgaagttcacggtggttgtaggggacgccaacggcatcttagcgcagggaaagaagatgatcaggcctcagcccatggagcacaaatactcgtggaagtcgtggggaaaagccaagatcatcggcgcagacattcagaacaccaccttcatcatcgacgggcccgataccccggagtgccctgacgatcagcgtgcctggaacatctgggaggtggaggactacgggttcgggatcttcacgaccaacatctggctgaaactgcgcgactcctacacccaaatgtgcgatcatcggctaatgagcgcagctattaaggactccaaggcagtccacgccgacatgggctactggatcgaaagcgagaagaatgagacttggaagctggcacgcgcttccttcatagaggtcaagacgtgtacctggcctaagagtcacaccctgtggtccaacggcgtgctcgagtcagagatgatcatccccaaaatctacgggggccctatttcccagcacaactacagacccgggtacttcacacaaacggccggtccctggcaccttggcaaactggagcttgactttgacctgtgtgagggcacgaccgtcgtggtggacgaacactgcggtaaccgggggcctagtctgcgaactacgaccgtcaccggcaagatcatccacgagtggtgctgtcggtcctgtacactaccgcctttgcggttccgcggggaagacggctgctggtacggaatggagattcggcccgtgaaggagaaggaagaaaacctggtgcgcagcatggtctccgccgggagcggcgaagtggactccttctctctcgggatcctgtgcgccagcattatgatcgaggaggtgatgcggtctcgctggagccggaagatgctgatgactggcaccctcgccgttttcttactgttaattatgggacaattaacctggaacgacctgatccgcctctgcatcatggtaggcgcgaacgcgtccgaccgcatggggatgggcaccacatacctggccttaatggcaaccttcaagatgcgtccaatgtttgccgtaggcctcctgtttagacggctgacaagcagggaagtcctactactgaccatcggcctgtcattagtggccagcgtggagctgccgaattccctcgaggagctcggagacgggcttgccatgggcataatgatgctcaagctgttaacggagttccagccccaccagctctggacgaccctgctgtcgctcacctttataaagacgaccctgtcccttgattacgcctggaagactaccgccatggcgctcagcatcgtgtcgctgttccctctgtgcctcagcacgacctcccagaagaccacatggctgccggtcctgctcggctctttcggatgtaagcccctgaccatgttcctgatcacggagaataagatctggggcaggaaatcctggcccctcaacgaggggatcatggccatcggaatagtgagtatcctgctgagtagcctcctcaagaacgacgtcccgcttgccgggccgttaatcgccggtggcatgctgatcgcctgctatgtgatcagcgggtcaagcgcggacctgtccctcgagaaggccgccgaagttagctgggagcaggaggccgaacactccggcacctcgcataatatcctggtagaagtgcaagacgacgggaccatgaagataaaggatgaggagaaagacgacaccctgactatcctcctgaaggccaccttactcgcggtctccggagtgtacccgatgagcatcccagccaccctatttgtgtggtacttctggcagaagaagaagcagcgcagcggcgtcctgtgggacaccccctctccgcccgaagtggaacgggcagtgctcgacgacggcatctaccgcatcctacagcggggcttgttagggcgctcccaggtcggggtgggggtgttccaagacggtgtgtttcacacgatgtggcatgtgacccgcggagccgtgctcatgtatcagggcaagcggctagagcccagctgggcaagcgtgaaaaaggatctgatctcatacggtggcggctggcggttccagggatcctggaacaccggcgaagaggtccaggttattgcggtggagcccgggaagaacccgaagaacgtgcagaccacgccggggacctttaaaacccccgagggcgaggtgggggcaatcgccctcgattttaagcccggaaccagtgggtccccgatcgtcaaccgcgagggaaaaatcgttgggttgtatgggaacggcgtagtaacgaccagtggcacgtacgtgtcagccatcgcccaggcaaaagccagccaggagggccccctgccggagattgaagatgaggtgttcaagaaacggaacctcaccattatggacttgcacccggggagtggcaaaacccgccggtacctgcctgccatcgtcagagaggccataaagcggaagctccgaacgctgatactggcgcccacccgggtggtggcatccgagatggccgaggccctcaagggcatgccaatccgctaccagaccacggccgttaagtcggagcacactggccgcgagattgtggacttgatgtgccacgcgaccttcaccatgcggttgttgtccccggtgcgggtccccaattacaatatgatcatcatggacgaggcacacttcacggaccccgcctctatagccgcccgcggttacatttctacgcgcgtcgggatgggcgaagcggcggctatcttcatgactgctactccgccgggtagcgtggaggccttcccacagtccaacgcggttatacaggacgaggagagagacatccccgagcgtagctggaactccggctacgactggatcacggactttcccggcaagaccgtgtggttcgtgccgagcatcaagtccgggaacgacatcgccaactgcctgcggaaaaacggtaaacgcgtaatccagttgagccggaagaccttcgacaccgagtaccagaagacgaagaacaacgactgggactacgtggtgactaccgacatatccgagatgggggctaacttccgagccgcgcgggtcatcgacccacgacggtgcctcaagcccgtgattctgaaagacggcccagaacgcgtgatcctggccgggccgatgcccgtcaccgtcgcctctgccgcacagcggcgtggcaggatcgggcgcaatcagaacaaggagggggaccaatacgtgtacatgggacagcccctaaacaacgacgaggaccacgcgcactggacggaggccaaaatgctgctggacaacatcaacacccccgaggggatcatacccgccctcttcgaacccgaacgggaaaagtccgccgccatagacggcgaataccgtctacggggggaagcgaggaagaccttcgttgagttaatgcgacgcggcgatctcccggtatggctgagctacaaggtcgcatccgagggcttccagtattctgaccgacgatggtgtttcgacggggagcgcaacaatcaggtgctggaggagaacatggatgttgagatctggacgaaggagggcgagcggaagaagttgaggccccggtggctggacgccaggacctacagcgacccgctggcactccgagagttcaaagagtttgccgcgggccgccggagcgtctcgggggacctgatactggagatcggcaagttgccccaacacctcacgctgcgcgcccaaaacgcgctcgacaacctggtgatgttacacaactccgagcaaggcgggaaggcctaccggcatgcgatggaggagctccccgacacaatcgagaccctgatgctcctcgccctgatagccgttctgacagggggcgtcactctcttcttcctcagcggcaagggcctcggcaaaacaagcatcgggctcctgtgcgtgaccgcaagctccgcactgctctggatggcgagcgtggagccccactggatcgccgcctccatcatcctggagtttttcttgatggtcttgctgatcccggagcccgaccgccaacggacaccacaggacaaccagctggcctacgtggtgatcggcctcctgttcatgatcctgacggtcgccgcgaacgagatgggactcctagagaccaccaagaaggaccttggcatcgggcacgtggccgccgagaaccatcagcacgccacaatgctcgacgtggaccttcgaccggcctcagcctggacgctgtacgccgtcgcgaccacagtgatcacccccatgatgaggcatacgatcgagaacacgaccgccaacatctcccttacggccatcgcgaaccaggccgctatactaatgggattggacaagggctggcccatcagcaaaatggatataggcgtgccactcctggcgctgggatgctactcccaggtcaacccgctcaccttaaccgcagcagtgcttatgctcgtggcacattacgccataattggtccaggcctccaagccaaggcgacccgcgaagcccagaagcgaacggcggccgggataatgaaaaaccccaccgttgacggcatcgtcgcaattgacctggaccctgtcgtctacgatgcgaaattcgagaaacagctcggccagatcatgctgctgatcttatgcacgtcccagatcctgctgatgcgcacaacttgggccctctgtgagtccatcacgctggccactgggccgttaacaacgctctgggaaggcagccccgggaaattctggaacacgaccatagccgtgtctatggcgaacatcttccgcggcagctacctggcgggcgcgggcctggcattcagcttgatgaagagcctgggcgggggccggcgcgggaccggagctcagggcgagaccctgggcgagaagtggaaacgccaactgaatcagttaaccaaatccgagttcaacacatataagagaagcggcatcatggaagttgaccgatctgaggcgaaagaggggctaaagcgcggcgagaccaccaagcacgcagtctcccgcgggaccgcgaagcttaggtggttcgttgagcgcaacctagtgaagcccgagggaaaggtcatcgaccttggctgcgggcgcggcggctggagctactactgcgcaggcctgaagaaggtgacggaagtgaaggggtacaccaagggcggcccggggcatgaggagccgatccccatggcgacgtacggctggaacctggtaaagctacactccgggaaggacgggttctttatgccgcccgaaaagtgtgggactttgctctgcgatatcggagagagctccccgaaccccacaattgaggagggccgaaccctccgtgtgctgaaaatggtagaaccctggctccgcggtaaccagttctgcataaagatcctgaacccctacatgccgagcgtggtagagacactggagcagatgcagcgcaagcatggcggaatgttggtgcggaacccgctgtcacgtaacagcacccacgaaatgtattgggtatcctgcgggacaggcaatatcgtatccgcggttaacatgacgtcacgaatgctgctcaatcgcttcacgatggcccaccggaaaccgacgtacgaaagggacgtcgacttgggcgccggcacgcgccatgtggccgtggagcccgaggtcgccaacttggatattataggccagcggatcgaaaacatcaagaacgaacataagagcacctggcactacgacgaggacaacccctacaagacctgggcttaccatggatcctacgaggtgaagccctctgggtcggcgagctctatggtgaacggagtcgtgcggctcctgaccaagccttgggatgtcatccccatggtcacgcagatcgcgatgaccgacacgacaccgttcggacaacagcgggtgttcaaggagaaggtcgacacgcgcacgccccgggccaagcgcgggactactcagatcatggaagtgacagccaagtggctctggggcttcctctcacggaacaagaagccccgcatctgtacccgggaggaattcacacgtaaagttcgatcaaacgcagctattggggccgtcttcgtggatgagaatcagtggaactcagctaaggaagcagtggaggacgagcgtttctgggacctggtacatcgagagagagagctacataagcagggcaaatgcgcgacctgcgtatacaacatgatggggaaacgcgagaagaagttgggcgagttcggtaaggccaaggggagccgcgccatctggtacatgtggctgggcgcgcggttcttggagttcgaggctcttgggttcatgaacgaggaccactggttctcacgcgagaactcgctgagtggcgtggaaggggagggcctgcacaagctcggatacatcctacgggacataagcaagattcctggcgggaacatgtacgccgacgacacggccgggtgggacacccgcataactgaggatgatctgcagaacgaagctaaaatcaccgacatcatggagcccgaacacgccctcctggcgacgagtatcttcaagctgacttaccagaacaaggtagttcgggtccagcgacccgccaaaaacggcaccgtcatggacgtcatcagccgccgagaccagcgcggctcgggacaggtaggcacgtacggtctcaatacgtttactaacatggaagtccagttgatccggcagatggaatcagagggtatcttcctgccctccgagctcgagacccctaacttagccaagcgcgtgctggactggctcgaaaagcacggggccgagcggctgaaacgaatggccatctctggcgacgactgcgttgtaaagcccatcgacgaccgattcgcgaccgccctgaccgccctcaatgacatgggaaaggtgcgtaaagacatcccccagtgggagcctagcaaggggtggaacgactggcagcaggtcccgttttgcagccatcatttccatcagctgattatgaaggacggccgggagatagttgtgccatgccgcaaccaagacgagctggtgggtcgggcccgcgtctcccagggcgccggatggagcttgcgggaaacggcatgcctggggaagtcatatgcccagatgtggcagctgatgtacttccaccgccgggaccttcgcctggccgccaacgctatttgcagcgcggtgccagtggactgggtccccacctcgcgtaccacctggagtatccacgcccaccaccaatggatgacgaccgaagacatgctgtccgtttggaaccgcgtttggatcgaggaaaacccgtggatggaggacaagacacacgtctccagctgggaggaggttccctacttaggcaagcgggaggaccagtggtgcggctcattaatcggccttaccgctcgcgctacgtgggccacaaacatccaggtggccattaaccaggtacgccgtctgatcgggaacgagaattatcttgattacatgacgagcatgaagcgcttcaagaacgagtccgaccccgaaggcgcgctgtggtga

SEQ ID NO: 23955 - RNA, 9879 nt, synthetic construct
  misc_feature 1..9879: note = derived and/or modified CDS sequence (opt11) from DENV-1__EU596503__SS-prME
  source 1..9879: mol_type = other RNA
agcgtgaccatgctcctcatgttactgcccactgccctcgcctttcacctgaccaccagaggcggggagccccacatgatcgtaagcaagcaggagcggggcaagagcctcctgttcaagaccagcgcgggggtgaacatgtgcaccttaatcgccatggacctaggcgaactttgcgaggacaccatgacctataagtgcccccagattacggaagccgagcccgatgacgtcgactgctggtgcaatgccaccgacacctgggtgacctacgggacctgcagccagacgggcgagcaccggcgagacaagcgctccgtggccctggccccccacgtgggcctaggcctcgagacgcggacagagacctggatgagctccgagggcgcctggaagcagatacagcgcgtcgagacctgggccctgcggcaccccgggtttacggtgatcgccttgttcctcgcgcacgccatcggcaccagcatcacccagaaggggatcatctttattctgctgatgcttgtgaccccctccatggccatgcgctgcgtcggcattggcaacagagacttcgtggaggggctgagcggcgccacgtgggtggacgtcgtgctagagcacgggtcctgcgtgacaaccatggccaagaacaagcccaccctcgacatcgagctgctgaagacggaggtcaccaatcccgcgatcctcagaaagctgtgcatcgaggccaagatcagcaacaccaccacagactcccgatgcccgacccagggagaggccacccttgtggaggagcaggacgccaacttcgtgtgccgccggaccttcgtcgaccgcggctgggggaacggctgtggcctcttcggcaaggggagcctgctgacgtgtgccaagttcaagtgcgtgaccaaactcgaagggaagatagtgcaatacgagaacctgaagtacagtgtcatcgttaccgtgcacaccggcgaccaacaccaggtcgggaacgagacgaccgagcacggcaccatagcgaccatcacgccacaggcccccacctcagagatacagctgaccgactatggggccctcaccctggactgtagccccagaaccggcctggacttcaacgaaatggtactcctgacgatgaaggagaagtcctggctggttcacaagcagtggtttctcgacctgccgctgccctggacctccggggccagcaccagtcaggagacctggaaccgccaggacctcctggtgacgttcaagacggcccacgctaagaagcaggaggtggtcgtgctgggtagtcaggaaggcgccatgcacaccgctctcaccggggccacggagatccagaccagcggcaccaccaccatcttcgccgggcacctgaaatgccgcttaaagatggataagttgaccctgaagggcaccagctatgtgatgtgcatagggtctttcaagctcgaaaaggaggtcgcggaaacccagcacggcacggtgctggtgcaggtcaagtacgagggcaccgacgccccttgcaagattcccttctccacccaggacgagaagggggtgactcagaacggccgccttatcacggccaacccgatagtgaccgacaaagagaagcccgtcaacatcgagaccgagccgcccttcggtgagagctatatcgttgtgggcgccggcgagaaggcgctgaagctgtcctggttcaaaaaggggtcttccatcggtaaaatgttcgaggccaccgcccgcggcgcccgccggatggccatactcggcgacactgcgtgggacttcgggagcatcggaggcatgttcacctccgtcgggaagctggtgcaccaggtgttcggcaccgcttacggggtcctgttcagcggcgtgtcctggacaatgaagatcgggatcggcatcctcctgacgtggctgggcctcaacagcaggtccaccagtttgtccatgacctgtatcgctgtgggcatggtcaccctgtacctcggcgtgatggtgcaggctgacagcgggtgcgtcattaactggaagggtcgcgagctgaaatgcgggtccgggatcttcgtcacgaacgaggtgcacacctggaccgagcagtacaagttccaggccgacagcccgaaacgtctgagtgcggcgatcggcaaggcatgggaggagggggtgtgcggcatccgctccgccacccggctcgagaacataatgtggaagcagatttccaacgagctgaatcacatactgttagaaaacgacatgaagtttaccgtggtggtcggggacgccaacgggattctggcgcaggggaaaaagatgatccgcccccaacccatggaacacaagtactcctggaagtcctggggtaaggctaagatcatcggtgccgacatccagaacacgacgttcatcatcgacgggcccgacaccccggagtgccccgataaccagcgggcatggaacatctgggaagtggaggattacggcttcgggatcttcaccacgaacatctggctgaagttgcgcgactcctacacccagatgtgcgaccaccggctgatgagcgcggccatcaaggattcgaaagccgtgcacgccgacatgggctactggatcgagagcgagaagaacgagacctggaagctggcacgagcttcattcatcgaggtcaagacctgcacgtggcccaagtctcacaccttatggtccaacggtgtgctggagtcagagatgataatccccaagatctacgggggccctatctcgcagcacaactacaggcccgggtacttcacacaaactgccggcccctggcacctgggtaagctcgagctggacttcgacctgtgcgagggcactaccgtggtcgtcgacgagcactgtggcaaccgcgggccgagccttcggaccaccacggtgaccggcaagatcatccatgaatggtgctgccgctcctgtaccctgccgcccctgcggttccgcggggaggacggctgctggtacgggatggagatccggcccgtcaaggagaaggaagagaacctcgtgcgcagcatggtgtcggccgggagcggcgaggtcgactcgttctccttaggcatactgtgcgctagcatcatgatcgaggaggtgatgcggtcccgctggagccggaagatgctcatgaccggcacactggccgtgttcctgctccttataaccgggcagctgacgtggaacgacctcatccgcctgtgcatcatggttggcgcgaacgcctccgaccgcatggggatgggcacgacatacctggcgctgatggcgacctttaagatgcggccgatgttcgccgtgggactgctgttccgccggctcacctcacgcgaggtgctgctgctcaccatcgggctgtccctggtcgccagcgttgagctccccaactccctagaggagctgggcgacgggctcgcgatgggcatcatgatgctcaagctgctcacggagttccaacctcaccaactttggaccaccctgctcagcctgaccttcataaagacgaccctgtccctcgactacgcctggaagactaccgccatggcgctgtcgattgtgtccctgttccccttgtgcctaagcacgacctcccagaaaaccacatggctgcctgtgctccttggcagctttggatgcaagcccctgaccatgttcctcatcacggagaacaagatttggggccggaaatcctggcccctgaatgaggggatcatggcaatcggcattgtgtcgatcctgctgtcgtcgctgctgaagaacgacgtccccctcgccggaccgctgatcgctggcggcatgcttatcgcctgctacgtgatcagcgggtccagcgcggacctctccctggagaaggccgccgaagtgagctgggagcaggaggccgagcactccggcaccagccacaacatcctagtcgaggtacaggacgacgggaccatgaagatcaaggacgaggagcgcgacgacaccctcacgatccttctgaaggccaccctcctggcggtgagtggcgtctaccccatgagcatccccgcgacccttttcgtgtggtacttctggcagaagaagaaacagcgttccggggtcctctgggacacccccagcccgcctgaggtcgagcgcgccgtgcttgacgatggcatctaccggatcctgcagcgcggcctgctcgggcggtcccaagttggcgtcggggtgttccaggacggcgtgttccacacgatgtggcacgtcacgcgcggggccgtgctaatgtaccagggcaagcggctggaacccagctgggcgtccgtgaagaaggatctcattagctacggcgggggctggcgcttccaggggagctggaacacgggcgaagaggttcaggtgatcgcggtggagcccggtaagaacccgaagaatgtccagaccacgcccggtaccttcaaaacccccgagggcgaggtgggggccatcgccctagacttcaagcccggcaccagcgggtcgccgatcgtgaatcgggagggcaaaatcgtcggcctgtacgggaacggagtggtaacgaccagcgggacttacgtctccgccatcgcccaggcgaaggccagccaggagggccccctccccgagatcgaggacgaggtgttcaagaagcgcaacctgaccatcatggacctgcacccggggagcggcaagacacggcgctacctcccagccatcgtgcgggaggccatcaaacgcaagctgcggaccctgatcctagcgcccacccgcgtcgtagcctccgagatggcagaggccctaaagggcatgcccatccgttatcagaccacggcggtcaagtcggaacacaccgggcgggagatcgtcgatctgatgtgccacgcgacctttacaatgaggctcctgtccccggtgcgggtgccaaactacaacatgatcatcatggacgaagcccacttcacggaccccgccagcatcgcagcccgcggctatatctccacccgggtcgggatgggcgaagcggctgcgatcttcatgaccgccacgccgcccgggagcgtggaggccttcccccagtccaacgcggttatccaggacgaggagcgagacatacccgagcggagctggaactccggttacgactggatcactgacttccccggcaagaccgtctggttcgtgcccagcatcaaatccgggaacgacatcgccaactgcctgcgcaaaaacggtaagcgggtgatccagttgagccgcaagacattcgacaccgagtaccagaagacgaagaacaacgactgggactacgtagtaaccactgacatcagcgagatgggggccaacttccgggccgaccgcgtgatcgacccccgccgctgcctgaagcccgtaatcttaaaggacggcccagagcgggtgatcctcgcggggccgatgcccgtgaccgtcgccagcgccgcccagagacggggccgcataggcagaaaccagaacaaggagggggaccagtacgtgtacatgggccagcccttaaacaatgacgaagaccacgcccactggaccgaggcgaagatgctgctggacaacatcaacactcccgaggggatcatcccggccctgttcgagcccgagcgcgagaagtccgccgccatcgacggcgagtaccgcctccgcggggaggcccgtaagaccttcgtggagctcatgcgccgcggcgacctgccagtctggctgagctacaaagtggcgtccgagggcttccagtactcagatcggcgatggtgcttcgacggggagcggaacaaccaggtcctcgaagagaacatggacgtcgagatctggaccaaggagggagagcgcaagaagctccggccccgctggctggacgcccggacctactccgacccgttagccctgagagagttcaaggagttcgcggccgggcggcgtagcgtgagcggcgacctgatcctggagatcggcaagctgcctcagcacctgacgctccgggcgcagaacgccctggacaaccttgtgatgctccacaactccgaacagggcgggaaggcttaccgccacgccatggaggagctgcccgacaccatcgaaacccttatgctcctggctctgatcgccgtgctcaccgggggcgttacgctgttctttctgagcgggaagggtctcggcaagacctccatcgggttgttgtgcgtgaccgccagctccgccctcctgtggatggcctctgtggaaccccactggattgcggcctccatcatcctggagttcttcctcatggtgctgctgataccggagcccgaccggcagcggacgccccaggacaatcaactcgcctacgtcgtgattggcctgctgtttatgattctcacggtggccgccaacgaaatggggctgctggagaccaccaagaaggacctcggcatcgggcatgtcgcggcggagaaccaccagcacgccaccatgctggacgtggacctccggccggccagcgcctggaccctttacgctgtggccaccaccgtgatcacccctatgatgcgccacacgatcgaaaacacgacggccaatatctccctaacagccatcgcaaaccaagccgccatcctgatgggcctcgacaaggggtggcccatcagcaagatggacataggggtgcctctgctggcgttgggctgctactcccaggtgaacccgctcacgctgaccgccgcggtcctcatgctggtggcccactatgcaatcatcgggcctggactccaggccaaggctacccgggaggcgcaaaaacgcaccgcggccggtatcatgaagaaccccacggtggacggcatcgtggccatcgatctcgatccagtggtgtacgacgccaagttcgagaaacagctgggccagatcatgttgcttatcctgtgcaccagccagatcttgctcatgcgcactacctgggcactgtgcgagtccatcactctggccacggggccgctcacgaccttatgggagggaagccccgggaagttctggaacacgaccatcgccgtctccatggccaacatcttccggggcagctacctggcaggcgcggggctcgccttctccctgatgaagtccctcggcggaggccgccgggggaccggagcccagggcgaaaccctcggggagaaatggaagcgccaactgaaccagctgtccaaaagcgagttcaatacgtacaagcggtctggcatcatggaggtggaccgctccgaggctaaggaggggctcaagagaggcgaaacaaccaagcacgctgtcagccgcgggaccgccaagcttcggtggtttgtcgagcgaaacctggttaaacccgagggcaaggtgatcgacctcggatgtgggcggggcgggtggtcctactactgcgccggcctcaagaaggtcactgaggtgaaagggtacacgaagggcggccccggccacgaggagccgattcccatggccacctacgggtggaacctggtgaaactgcacagcgggaaggacgtcttcttcatgccgccggagaagtgcgacaccctcctgtgcgacatcggcgaatccagcccgaaccccaccatagaggaggggcgcacgctacgggtgctcaagatggtggaaccgtggctgcgcggcaatcagttctgcatcaagatcctaaacccctacatgccgtccgtcgtggagaccttagagcagatgcagcggaagcacggtgggatgctggtgcgcaaccccctgagccggaactccactcacgagatgtactgggtcagctgcggcaccggcaacatcgtgtccgccgtgaacatgacgagtcgcatgttgctaaaccggttcactatggcgcaccgcaagcccacctacgagcgcgacgtcgacctgggagcgggcacaagacacgtggccgtggagcccgaggtggcaaacctcgacatcatcggtcagcgcatcgaaaacatcaagaacgagcacaagtccacgtggcactacgatgaggacaacccgtataaaacctgggcctaccacggctcttacgaggtgaagccctccggtagcgcgagtagcatggtgaacggcgtcgtacggctgctgaccaagccctgggacgtgatccccatggtcacccagatcgccatgacggacaccaccccgttcgggcagcagcgcgttttcaaggaaaaggtcgacacccggacgccccgcgccaaacggggcaccacccaaatcatggaggtaaccgccaagtggctctggggcttcctgtcccgcaacaagaagccccggatatgtacgagggaggaattcacccggaaggtgagaagcaatgccgctatcggggccgtctttgtggacgagaaccagtggaacagcgccaaggaggccgtcgaggatgagcggttctgggacctggtccaccgcgagcgggagctccacaagcaaggcaagtgcgcgacctgcgtgtacaacatgatgggaaagcgcgaaaagaagctgggcgaatttgggaaggccaagggctcacgtgccatctggtacatgtggctgggcgccagattcctcgagttcgaggccctggggttcatgaacgaggatcactggttcagccgggagaactccctgagcggcgtggagggggagggcttgcataagctagggtacatactacgcgacatctccaagataccggggggtaacatgtacgccgatgacaccgccgggtgggacacgcggatcaccgaggacgacttacagaatgaggccaagataaccgacataatggagcccgagcacgccctgttagctacctcgatcttcaagctcacgtaccagaacaaggtcgttcgcgtgcagcgccccgcgaagaacggcaccgtcatggatgtgatctcccggcgcgatcagcgcgggagcggacaggtgggcacctacggactgaacaccttcacgaacatggaggtccagctaatacgccaaatggaatccgagggcatcttccttcccagcgagctggaaacccctaatctggccgaacgggtgctggactggttagagaagcacggggccgaaaggttaaagcggatggccatctccggcgacgactgcgtcgtcaagcccatcgacgaccgctttgccaccgcactaaccgctctgaacgacatggggaaggtccggaaggacatcccccaatgggagcccagcaagggctggaacgactggcagcaggtcccgttctgctcccaccacttccaccagctgatcatgaaggacggacgcgagatcgtcgtgccctgccgtaaccaagacgaactcgtgggccgcgcacgtgtctcccagggcgccgggtggtcgctgcgcgagaccgcctgcctgggcaagagctacgcccagatgtggcagttgatgtacttccatcgtcgcgacctgcggctggccgccaacgccatctgctccgcggtgcccgtggattgggtccctacgagccgcaccacctggagcatccacgcccaccaccaatggatgaccacggaggatatgctttccgtatggaaccgggtgtggatcgaggagaacccttggatggaggacaagacccacgtcagctcgtgggaagaggtgccctacctggggaagcgcgaggaccagtggtgtggcagtctgatcggcctcacggcccgcgcgacctgggccacgaatatccaggtggcgattaaccaggtgcggcgcctgatcgggaacgagaactacctggactacatgaccagcatgaagcggttcaagaacgagtccgaccctgagggcgccctctggtaa

SEQ ID NO: 23956 - RNA, 9879 nt, synthetic construct
  misc_feature 1..9879: note = derived and/or modified CDS sequence (opt11) from DENV-1__FJ024479__SS-prME
  source 1..9879: mol_type = other RNA
agcgtaacgatgctccttatgttgctcccgaccgcactggcattccacctgaccacacgcgggggagaaccccatatgattgtgagcaagcaggaaagaggcaaatcgctgctctttaagacaagcgcaggagtcaacatgtgcacactcattgcgatggatctcggggaactatgcgaagacacaatgacctacaagtgcccacaaatcacagaagccgaaccggacgatgtcgactgctggtgcaacgctacggatacctgggtgacctacgggacatgtagccaaaccggagaacaccggcgggacaagaggtcggtagccctagcgccacatgtagggctgggactcgaaacgcgaaccgaaacatggatgagctcggaaggcgcctggaaacaaatccaacgagtagaaacctgggccctccggcatccggggttcacggtgatcgccctgttcttagcccatgcaatcggaacgagcataacacaaaagggaatcattttcatcctcctcatgttggtcacgcccagtatggcaatgaggtgtgtggggatagggaaccgcgatttcgttgaaggcctgtcaggagcaacatgggtagatgtcgtactggaacacggctcatgcgtgactacgatggccaaaaacaaaccaactctcgacatagaattattgaaaacggaagtcacaaacccagcaattttacgcaaactatgtatagaagccaaaatatcaaacaccaccaccgacagccgttgtcccacacaaggggaagcgaccctcgtagaagaacaagacgccaacttcgtctgccgtcgaacattcgtagatcgcggctgggggaatgggtgcgggctattcggaaaggggagcctactaacctgcgccaaattcaagtgcgtaaccaagctagaagggaagatagtccaatacgaaaacctaaagtactccgtaatagtaaccgtacatactggagatcaacaccaggtgggtaacgaaacaacagagcacggcaccatcgcaacaatcaccccgcaagctcccacctcggagattcaactgactgattacggagccctaacgcttgactgctctccaagaaccgggttagactttaacgagatggtactgctgacgatgaaagaaaagagttggctagtccataaacaatggttcctcgacctacccctcccgtggacgagcggagcgtcaacctcacaagaaacgtggaaccgccaagacctgctggtcacttttaaaacagcccatgctaagaaacaggaagtggtagtactaggatcccaagaaggtgccatgcacactgcgctcacgggggcgaccgaaatccaaacctcgggcacgactacaatcttcgccggacacctgaagtgccgtttaaaaatggacaagctaacactgaaaggcacctcgtacgtgatgtgcaccggctcgtttaaactggagaaagaagtcgccgagactcaacacggtaccgtactcgtccaagttaagtacgagggcactgacgcaccgtgcaaaatacctttctcaactcaggacgaaaagggggtcacgcagaatgggcggctcatcacagcaaaccctattgtcacagacaaggagaaaccggtcaacatcgaaaccgaaccgccgtttggcgagtcatacatagtggtgggcgcaggagaaaaagcgctcaaactttcatggttcaaaaagggctccagcatagggaaaatgttcgaagcaacagcacggggagcacgaaggatggccatactgggtgatacagcgtgggacttcggcagtattggcggagtattcacaagcgtgggcaagctggttcaccaagtcttcggaaccgcatacggagtactcttctcgggggtgagctggacaatgaaaatcggcatcggtatactcctaacgtggctaggactgaactccagaagcacgtccctgagcatgacatgcattgccgtaggcatggtaaccctatatctcggagtgatggtccaggccgacagtggatgcgtgattaattggaaaggcagggagctcaaatgtggctcaggaattttcgtcacgaacgaagttcacacgtggacagaacaatacaagttccaggccgacagcccgaagagactctccgccgcaattggaaaagcgtgggaggagggcgtatgcgggatacgaagcgcaactagactcgagaacatcatgtggaaacaaataagcaacgaactgaaccacatattacttgaaaacgacatgaagttcacagtcgtagtaggggatgcaaacggcatactagcccaaggcaagaaaatgattagaccacaacctatggaacataaatacagttggaaaagctggggaaaagcaaaaatcataggtgcagacatccagaacactaccttcatcatcgacggaccagacactccggagtgcccggacaatcagcgagcatggaatatctgggaggtggaagactacgggttcggattctttaccacgaacatctggctaaagctgcgtgacagctacactcaaatgtgcgatcatcgacttatgagtgcggcaatcaaagacagcaaggccgtgcacgctgacatgggatattggatcgaatcagagaaaaacgagacttggaaattagcacgagcgagtttcatcgaggtgaagacgtgtacctggcctaaatcccacaccttatggtcgaacggggtactcgaatcggagatgataatccccaaaatatacgggggaccgatatctcagcataactaccgccctggttacttcacccagacagcaggcccatggcatctaggcaaactcgagctagatttcgatctgtgcgaaggaacaactgtcgtagtagatgaacattgtggaaatcggggcccatcactcagaacaacgaccgtcacaggaaagattatacacgaatggtgttgccgttcttgcaccttgcctccactccgtttccgcggagaagacggctgttggtacggtatggagataagacccgtcaaggaaaaagaggaaaatctcgtgcgatcaatggtgagcgcgggcagcggagaagttgattctttcagcctcggaatactatgcgctagtatcatgatcgaggaagtcatgcgatcacgctggtctcggaaaatgctgatgaccggcacactggccgtatttctccttcttataatgggacaactgacatggaacgaccttatcaggctatgcattatggtcggcgccaacgcaagcgaccgaatggggatgggcaccacttacctcgcacttatggcgaccttcaagatgcggccgatgttcgcggtgggcttacttttccgacgacttacctcgcgggaagtactcctcctaaccatcggtctgtccctcgtcgcatccgtcgagctaccaaacagtctcgaagaactcggcgacggactagcaatgggaataatgatgcttaagctactcacggagtttcagccgcaccaattatggacaaccctgttgtcactcaccttcatcaaaacgacattgtccctagactatgcatggaagaccgcggcgatggctctgagcatagtatcactgttcccactatgcctctcaaccacatcgcagaaaacgacctggctgccagtattattaggctcattcggctgcaagccattgaccatgttcctgattacagaaaacaaaatttggggcaggaagagttggccgctaaacgaagggatcatggcaatcgggatcgtaagcatactactgtcttctctcctgaagaacgacgtgcctttagctggacccctaatcgctgggggcatgctgatagcctgctatgtaatcagcggctcaagtgcggacttaagcctcgaaaaagccgcggaagtctcgtgggaacaggaggcggaacacagcggcacaagtcataacatactcgtggaggtgcaagacgacggcacaatgaagatcaaagacgaggagcgagatgatacactaaccatacttctcaaagctactttacttgccgtctccggcgtctatccgatgagcatcccagccacgctattcgtatggtacttctggcagaagaaaaagcaaaggagcggcgtactgtgggacacccccagtccaccagaagtagaacgagccgtcctagacgacggaatctataggatccttcagcgaggcctactggggagaagccaagtcggcgtcggggttttccaggacggggtgtttcacacaatgtggcatgtaactcgcggcgcagttctcatgtatcaagggaagcgactcgaaccgagctgggccagcgtcaaaaaggacctaatttcctacggtggtggttggcgattccaaggatcctggaacaccggagaagaggtacaagtaatagcagtagaacccggcaaaaacccgaagaacgtccagacgacaccagggacgttcaaaacccccgaaggggaggttggagccatcgcgctcgacttcaaaccgggtaccagtggttcgcctatcgtcaaccgcgagggaaaaattgtcggcctgtatggaaacggggtcgtaactacttctggaacatacgtgagcgcgatcgcacaggcaaaggcgagccaggaaggaccactccccgaaattgaagacgaggtatttaagaaaagaaacctgacaatcatggacctccaccccggatcaggcaaaacacgtcgatatctacccgccatcgtcagagaagcaataaaacgaaagctcagaacgctcatactagcccctacgcgagtcgtagcatcggaaatggctgaggcgcttaaaggcatgcctataaggtaccagactaccgcagtgaagtccgaacacactggaagagaaatagtggatttgatgtgccacgccaccttcacgatgcgcctcctgagcccagtccgcgtgcccaactacaacatgataatcatggacgaagcacacttcacagaccccgcaagcatagctgcacgcggctacatatctacccgagtaggaatgggcgaggctgccgccatatttatgaccgccacccctccgggcagtgtggaggcattccctcaaagtaacgcagtaatccaagacgaggagcgcgatatcccagagcgcagctggaactcaggctacgactggattactgatttccctggcaagaccgtgtggttcgttccatccatcaaaagtggaaacgatatagccaattgtctcaggaaaaacgggaaacgcgtcattcaactaagcagaaaaacgttcgacaccgagtatcagaaaaccaaaaacaacgactgggactacgtagttacaacggacatctccgaaatgggtgcaaacttcagagccgcgagagtcatcgacccgcgacgctgcctgaaaccggtaatcctcaaggatgggccggaaagggtgatattagcgggcccaatgccagtaacagtagcgtcggcagcgcaacgacgaggaagaattggaagaaaccaaaataaagaaggtgaccagtacgtctacatgggtcaaccgcttaacaacgacgaagaccatgcccactggaccgaagcaaaaatgctcctcgacaacatcaccacaccagaagggattattccggcgctgttcgaaccagaacgggaaaaatcagccgcgatcgacggtgaaagccgcttacgcggagaaccaagaaagactttcgtagaactcatgcgccgcggggacctgccagtgtggctaagctacaaagtggcaagcgaggggttccaatactccgatagacgatggtgctttgacggagaacgaaacaaccaagtgctagaagagaacatggatgtcgaaatatggccgaaggaaggcgagaggaagaagctacgaccaagatggctagacgcacgcacctacagtgatccgctagcgctaggggagtttaaagagttcggagccgggcggagaagcggctcgggagccctgatcctcgagataggaaaactcccccaacacctcccgctacgggcacagaacggccttgacaacctagtcatggttcacaacagcgaacaaggcggaaaggcttaccgacacgccatggaggaactccctgacaccatagagacactcatgttgctagcgttaatcgcggtcttaacaggaggcgttaccctgttcttcctgtccggaaaaggactaggcaagacgtccatagggctcctatgcgtaaccgcaagttcagcccttctatggatggccagcgtagaaccccactggatagcggcctcgataatacttgagttctttctaatggtactactaatcccagagcccgaccggcaacgtacaccccaagataatcagctggcctacgtggtaataggtctacttttcatgatcctgacggttgccgcgaatgagatgggactccttgaaacaacgaagaaagacctcggtataggtcacgtagctgcagaaaaccaccaacacgcaaccatgctggacgtagacctaagacctgcgagtgcgtggaccctatatgcggtggcaacgacggtcatcactccaatgatgcgacatacaatagaaaacaccacagccaacatatcgctcacggcgatagcaaaccaagcggccatactgatgggcctagcgaagggctggccaatctcaaaaatggacataggagtaccactgcttgcattgggatgctatagccaggtaaacccactgacactgacagccgcagtactgatgttagtagcacactatgctataatcggacccggactccaggcaaaggcgacaagggaagcccaaaaacggaccgctgcaggcattatgaaaaaccccacagttgacggaatcgtcgcgatagacttagacccagttgtctatgatgcaaaattcgaaaagcagctgggacagatcatgctactgattctgtggacaagccaaatattgcttatgcgaaccacatgggccctcggggagagcatcacgctggcgactggccctttaactactctgtgggaaggcagcccggggaagttctggaacacgacaattgcggtgagcatggccaatatcttccgtggtagctacctggcgggagccgggttggctttctctcttatgaaaagcctagggggcggacgcagaggaacaggggcacagggagaaacgctcggcgaaaaatggaaaaggcaattaaaccaactgtcgaagtcggagttcaatacgtacaagcgcagcggcatcatggaagtcgataggtcggaggccaaagaaggacttaaacggggagagacaacaaagcatgccgtgtcccgaggaacggccaaactccggtggttcgttgagagaaatctagtaaatcctgaaggcaaggtgatcgatctaggctgcgggagaggcggatggagttattattgtgcaggactcaaaaaggtcaccgaagtgaaagggtatacaaaaggcggtccaggacacgaggaaccaattccgatggccacctacggatggaaccttgtcaaactccattccggcaaagacgtcttcttcatcccacccgaaaaatgcgacaccctcctatgcgatataggagaatcaagcccaaaccccacgattgaggaaggccgcaccctacgcggcctcaaaatggtggagccctggctccggggcaaccagttctgcattaaaatcctaaacccatatatgccaagcgttgtagagacattagaacaaatgcaacgtaagcacggcgggatgctcgtaaggaacccgctgagccgaaactcaacacacgagatggactgggtctcctgcggtaccggtaacatagttagtgccgtgaacatgacatcacgcatgctactcaaccggttcacaatggcgcatagaaaacctacgtacgaacgggacgtcgacctaggagctggtacccgccatgtggccgtggagccggaggtggccaatctagacatcatcggccagcgaatcgagaacataaagaacgagcataaatcaacctggcactacgatgaggacaatccatacaagacctgggcttaccacggcagctacgaagttaagccttcagggtcggccagctccatggtgaacggagtggtccgactcctaacgaaaccatgggacgttatacctatggtaacacagatcgcaatgacggacacgacgccattcggacaacaaagggttttcaaggaaaaagttgacacccgaactcccagagcaaaacgaggcacaacacagataatggaggtaacagcaaagtggctgtggggattcctctctcgaaataagaaaccacgcatctgcactcgcgaagaatttacccgaaaagtccgctctaacgcggctattggcgcggttgtagtcgatgaaaaccaatggaacagtgccaaagaagcaggggaggacgaaagagtatgggacctgggcgacagagagcgcgagctgcataagcaagggaaatgcgcaacatgcgggtataacatgatgggcaagagggagaagaaactcggcgagttcggcaaagcaaaagggtcgcgcgccatttggtacatgtggctgggcgcacgatttctggagttcgaagcgctagggttcatgaatgaagatcattggttctcgagagagaatagcctctccggggtcgaaggagaaggcctacacaaattgggatacatattaagggatatctcaaagatccccggcgggaacatgtatgccgatgacacagcgggctgggacacacggattacggaagatgacctacaaaacgaggccaagataacagatatcatggaacctgaacacgccctccttgctacatccatattcaaactgacgtaccagaacaaggttgtgcgcgtccaacgaccagcaaagaatggtacagtgatggacgtaatcagcagacgtgctcaaagaggcagcggccaggtcgggacgtatggccttaatactttcaccaatatggaggtacaactcatccggcagatggagtcggagggcatctttctaccgtcagaacttgagaccccgaatctagcggaacgggtactcgactggctcgaaaaacacggagcagagaggctaaagcgcatggcgatatcaggggacgactgcgtcgtaaagcccatcgacgataggttcgcaaccgccctaaccgccctgaacgacatgggaaaagtgagaaaggacattccccaatgggagcccagcaaagggtggaatgattggcaacaagtggcattttggtcacatcattttcaccaactaataatgaaggacgggcgggaaattgtagtcccatgtagaaaccaagacgagctagggggaagggcccgcgtgtctcaaggcgcaggctggtccctacgagaaacggcatgcctcggaaaatcctatgcacagatgtggcaattaatgtacttccaccgaagagacctccgcctagcagccaatgcaatatgctcagccgtcccagtggactgggtcccaacgagccgcaccacctggagcatacatgcgcaccaccagtggatgacgacagaagacatgctctccgtctggaaccgagtgtggattgaagagaatccatggatggaagataaaacgcatgtgagcagctgggaagaagtaccatatcttgggaagcgcgaagaccaatggtgtggctcacttataggtttaacggcacgcgccacatgggccacaaacatccaagtcgcgataaaccaagtccggagacttattgggaatgaaaactacctcgactacatgacgtcaatgaaacgattcaaaaacgagtcagatcccgaaggagcgctctggtaa

SEQ ID NO: 23957 - RNA, 9879 nt, synthetic construct
  misc_feature 1..9879: note = derived and/or modified CDS sequence (opt11) from DENV-1__FJ182002__SS-prME
  source 1..9879: mol_type = other RNA
tcggtcactatgctattaatgctgctccccacggcgctggcattccatcttacaactcgaggcggtgaaccccatatgatagtatccaaacaagaacgtgggaaaagcctacttttcaaaacatccgcgggggtaaacatgtgcacactaatagccatggacctaggcgaactatgcgaagacaccatgacttacaaatgcccccagataacagaagcagaacctgacgacgtagactgttggtgcaatgcgactgatacctgggttacctacggcacatgcagtcagacgggggaacaccgccgggacaaaaggagcgtagctttagcaccccacgtaggcctggggctggaaacacgaacggaaacatggatgagcagcgaaggcgcgtggaagcaaatacagcgagtagaaacttgggcactgcgtcaccctggcttcacggtgatagctctattcctggcacatgctatcggcacctcaattacacaaaaagggatcatattcatcttattaatgttggtaacacccagcatggcgatgcgatgcgtcgggatcgggaaccgcgactttgtagagggactgagtggggctacatgggtggacgtggtattggagcacggaagctgcgtcacaacaatggccaaaaataaacccaccctagatatagaattactaaaaaccgaagtgacaaacccggcaattttaaggaagctgtgtatcgaagcaaaaatatcgaacaccaccaccgactctagatgccccacccaaggcgaggcgaccctagtggaagaacaggacgcaaactttgtgtgccgacggactttcgtagaccggggatggggaaacggttgtggattatttgggaaaggcagcttactaacttgcgccaaattcaagtgcgtcacaaaactagagggcaagattgttcagtacgaaaacctaaaatacagcgtaatcgtgacagtccacacaggcgaccaacaccaagtagggaatgaaaccaccgaacacggaacgatcgccacgataacacctcaggcaccaacctcggagatccaactcacggattacggagcgctcacactagactgctcaccgaggaccggactggactttaacgagatggtattgcttaccatgaaagaaaaatcctggctggtacataagcaatggtttcttgacctaccgttaccctggacaagcggcgccagcacctcccaagagacgtggaaccggcaagatctacttgtaacctttaaaacggcacacgctaagaaacaggaagtggtggtactggggagtcaagaaggagcaatgcatacggctctaacaggcgccacagaaatacagaccagtgggaccacaaccatatttgcgggacacctaaagtgccgactaaaaatggacaaactaactctcaaaggaactagctacgttatgtgcacgggcagtttcaagctagagaaggaagtggcggaaacccagcacggcacggtgctcgttcaggtaaaatatgaaggcacagatgccccatgtaagatccccttctctacgcaggacgaaaagggagtaacacaaaatgggcgcctcattaccgccaacccgatcgtaacggacaaagaaaaacccgtaaacattgaaacagagccacccttcggagagagttacattgtcgtaggtgccggagagaaggcactgaagctcagctggttcaagaagggcagttccataggcaagatgttcgaagcaaccgcccgaggggcaagacgcatggccattctaggtgatacagcgtgggacttcgggtccatcggaggggtattcacttcagtgggaaagctagtacaccaggtgtttgggaccgcttacggggtgctattctctggcgtgtcgtggacaatgaaaatcggaattgggattttgctcacttggctcggtttaaactcccgcagcaccagcctgagcatgacatgcatcgcggtaggaatggtaaccctatacctcggagtaatggtacaagccgactctgggtgcgtaatcaactggaagggaagagaattgaaatgtggttctgggatctttgttactaacgaggtacatacgtggacggagcaatacaaattccaagccgactcgccaaaacgcctgagtgccgccataggcaaggcatgggaggaaggggtatgcggaatacgatccgcgacgaggctggaaaacataatgtggaaacaaatctctaatgagctcaaccatatcctgctggaaaacgacatgaaattcaccgtagtggttggtgacgcgaacggaatcctcgcccagggcaaaaagatgatacgcccacagccaatggaacacaaatattcgtggaaaagctgggggaaagcaaaaataataggcgctgacatacagaacacaacattcattattgatggcccggatacgccagaatgtccggacaatcaacgggcatggaacatatgggaggtcgaggattacggctttgggatattcacgacgaatatttggctcaaactgcgagactcctacacacaaatgtgcgatcataggctcatgagcgcggccatcaaggacagcaaagcagtacacgccgacatgggatactggatagagtccgaaaagaatgaaacttggaagctggctcgggcgagcttcatagaggtaaagacctgcacatggccaaagtcacacaccctatggagcaatggagtactggaaagcgaaatgataatacccaagatatatggcggacccatctctcagcacaattatagacctggctacttcacgcaaactgcgggcccctggcacctcggaaagctggagctagacttcgacctttgcgagggaaccaccgtagtagttgacgaacattgcgggaatcgcgggcccagtctaaggacgacgacagtgacaggtaaaataatacacgagtggtgctgtcgcagctgcaccttaccgcccctacgattccgaggcgaggacggctgctggtatggcatggagatacgtcccgtcaaagaaaaggaggaaaacttggtacgatcaatggtgagcgcaggaagcggggaagtagacagcttctcgttggggatactgtgtgcatcgataatgattgaagaagtgatgcgtagccgatggtcaagaaagatgctcatgacaggcacactagccgtattcttgttactaattaccggacaacttacttggaacgacctgatacgtctatgtataatggtgggggccaacgcaagcgataggatgggcatgggtacaacgtacctggcactaatggcaacgttcaaaatgaggccaatgtttgccgtgggactgttattccggcggctcacctccagggaggtactgcttctaacaattggtttgagcctagtggcctccgtagaactaccaaattcactagaggaattaggcgacggtcttgccatgggcatcatgatgttaaaactcctcacagaatttcagccccatcagttatggacgaccctacttagcctgacttttattaagacgaccctaagcctggactacgcgtggaaaacaactgcaatggccctcagtatcgttagcctttttcccctttgtctgtccactacatcacaaaagacaacatggctgccggtcctcctaggatcttttggatgcaagcccttaacaatgttcctaatcacggaaaacaaaatttgggggcgaaaatcttggcccttaaacgaaggcataatggcgataggaatcgtctccatactcttatcgagtctcctcaagaacgacgtaccgttagctggaccgctaatagcgggagggatgctaatagcatgttacgtaatctcgggaagctcggccgacctaagcctagaaaaagccgccgaggtgtcatgggaacaagaggcagagcattccggaaccagccataacatcctcgtcgaggtacaagacgatgggaccatgaaaataaaggatgaggaacgagacgacacgctgacaatactgcttaaagcaacactactcgcagtgtcaggagtataccccatgtctatccccgcgaccctatttgtgtggtatttctggcagaagaagaaacagcgttccggggtactctgggacacgcctagcccacccgaagtagaacgcgcagtcttggacgatggcatataccggatcctccaacggggactactaggccgaagccaggtaggagtaggagttttccaagacggcgtgttccacacaatgtggcatgtcacccgaggcgccgtactcatgtaccaggggaaacgtttggaacccagctgggcgagcgtcaagaaagaccttatctcttatggagggggctggagatttcaaggcagctggaacacgggcgaagaagtacaagtaatagcggtcgagcccggcaaaaaccccaaaaacgtccaaacgacgccgggcaccttcaaaactccagagggcgaggtgggagcaatcgcactagactttaagccaggcacctcgggatcgccaatcgtcaaccgcgagggtaagatcgtgggactgtacggaaacggcgtggtgacaacctcgggcacatacgtaagtgcaatcgcacaggcgaaagccagtcaagaaggtccactacccgaaatcgaagatgaagtgttcaagaaaagaaatttaacgataatggacctacaccccggctccgggaaaacaagaagatacttgccagccatcgttagagaagccataaaacgcaaactacggacccttatcctggcccccacaagggtcgtcgccagcgagatggcagaagctctaaagggaatgcccatccgataccaaacgacggcggtgaagtcggaacacaccggcagagagatagtggacctaatgtgtcacgcgacattcacgatgagactcctgtcaccagtgagggtaccgaactacaatatgattatcatggacgaggcacacttcacagacccggcatccattgcagccagaggttacatatctacacgagtaggaatgggtgaagccgcggcaatattcatgacggcaactccgcccggctcagtcgaggcctttccgcagagcaacgcagtgatacaagacgaagaaagagacatccccgagcgaagttggaacagcggctacgactggatcaccgatttcccagggaaaactgtctggttcgtcccaagcattaaaagcgggaacgacatagccaactgcctccgcaagaacgggaaaagggtgatccaactgtcaaggaaaacctttgacacagagtaccagaaaaccaaaaataacgactgggactacgtagtaaccaccgacatcagcgaaatgggagccaacttcagggcagatcgggtcatcgacccgagaagatgcctcaagcccgtgatcctcaaggacgggccggagcgagtcatactagcgggcccgatgcccgtgaccgttgcgagcgccgcgcagagacgggggagaatcggacgaacccagaccaaagaaggggaccaatatgtatacatgggccaacccctaaacaatgatgaggatcatgcacattggactgaggctaagatgctcctagccaacattaatacccccgaggggatcatcccggccctgttcgagcccgaacgagaaaagtctccagccatcgatggagaatacagactccggggtgaagcacgcaagacatttgtagaactcatgcgacgaggagacctacccgtctggctgagctacaaggtcgccagcgaaggatttcaatattcagatcgaaggtggtggttcgatggggaacgtaataatcaagtactcgaagaaaacatggacgttgaaatttggaccaaggagggcgaacgaaagaaacttagaccgagatggctggacgcacgtacatacagtgacccgctggctttaggcgagttcaaagagttcggagctggtcgccgatctggtagcggcgatctaattttggagatcggaaaattaccgcagcacctcactctacgagcacaaaacggcctggataatctcgtcatggtacataacagcgaacaaggaggcaaggcctaccgtcacgctatggaggaactgccggacaccatagaaacattaatgttgttagcgctgatagctgtcctcacagggggcgtaaccctgttctttctctccggaaaggggctcggcaagaccagtataggattactatgcgttactgcctcttctgcgctactctggatggcgtccgtagagccccactggattgcagcgagcataattctggagttctttttgatggtgctgctaatacccgaacccgacaggcaacggacaccccaagacaatcagctcgcttacgtcgttatcggcttgctgttcatgatactgaccgttgcagcaaacgaaatgggcctcctggagacgaccaagaaagacctcggcatagggcacgtggcggcagaaaaccaccaacacgcaaccatgctggacgtcgatctccggcccgcaagtgcttggacgctatacgctgtagcaacgaccgtcataacacccatgatgcgccacaccatagagaatacgacagcaaacatttccctaacggctatcgccaaccaagccgcgatcttaatggggctggacaaaggctggccaataagtaaaatggacataggagtcccactactagcactaggatgctactcccaggtaaacccactcactttaaccgccgcggtattgatgctcgtagcacactatgcgataattggaccagggctacaagcaaaggcgaccagagaggcccagaagaggacagcagcagggattatgaagaacccaacggttgacggaatagtggccatcgatttagacccggttgtctatgacgcgaagttcgaaaagcaactaggccagatcatgctactaatactgtgcacaagccaaatactcctcatgcggaccacatgggccctttgtgaatcaatcacacttgcaacagggcccctcacaacattatgggaaggtagcccaggaaagttctggaacaccacgatagcggtctcgatggccaatatcttcagaggctcgtacttagcaggggcaggcctagccttctccctcatgaaatccttgggaggaggacgccgaggaactggggcccaaggcgaaactctcggggagaagtggaaacgccaactcaaccaattaagcaaatcagagttcaacacttacaaacggagcggaatcatggaagttgatcgtagcgaggccaaggagggtttaaagcgtggagaaaccaccaaacatgctgtgtctcgaggaaccgccaaactgcgttggttcgtcgagaggaatctagtaaagcccgaaggcaaagtaatagatctcgggtgcggcagaggcggatggtcgtattattgcgcaggcctcaagaaagtaaccgaggtaaagggatacactaaaggtggcccgggtcatgaagaaccaatccccatggcgacctacgggtggaacctcgtaaaacttcacagcggcaaggacgtattctttatgcccccggagaaatgcgacacgctcctctgtgatattggagaaagtagcccaaaccccaccatagaggaggggcgcactcttcgggtactaaaaatggtagaaccctggttacgcgggaaccaattctgcatcaagatactcaacccgtacatgccaagtgtggtcgaaacactggaacaaatgcaacgtaaacacggcggaatgctagtcagaaacccattgagccgcaatagcacccacgaaatgtattgggtgtcatgtggaaccgggaacatagttagtgccgtaaatatgacatcaaggatgttgctcaatagattcactatggcccatagaaaaccgacatacgagcgagatgtcgacctcggcgcaggaacaagacacgtagctgtcgagcccgaagtagctaacctagacatcatcggccaacgcatcgaaaacatcaaaaacgaacataagtcaacgtggcactatgatgaggacaacccctacaagacctgggcctaccacggaagctatgaggtcaaacccagcgggtccgcctcttcgatggtgaacggggtcgtacgtcttctaacaaaaccctgggacgtgatacccatggtgactcaaatcgctatgaccgacacaacgccattcggacagcagcgggtcttcaaagagaaagtagatacacgcacaccaagggccaaacgtggaacaacccaaattatggaagtcactgcaaaatggctgtggggattcctttcccgcaacaaaaagccgcgtatctgcacgagagaggagttcacacgaaaagtgcgctctaacgccgcgatcggagctgtcttcgtagacgagaaccaatggaactccgccaaggaagccggtgaagacgagagagtgtgggaccttgttgatcgagaaagagagttgcacaaacaaggtaagtggggcactggaggttacaacatgatgggtaaacgagagaagaaactcggagagttcggcaaagccaaggggtcacgcggcatctggtacatgtggctaggcgcaaggttcctagagttcgaagcgctagggttcatgaacgaagaccactggttcagcagggaaaactcgttgtctggagtagaaggggaaggactgcacaaacttgggtacattctccgcgacatcagcaaaatacctgggggcaacatgtacgcagacgacacggcaggttgggacacaaggataaccgaggatgacctccaaaacgaagcaaaaataacagacataatggaaccggaacacgccttgcttgcaacgagcatcttcaagctaacataccaaaacaaagtagtaagagtgcagcgacccgcgaaaaatggaaccgtcatggacgtaatatcaagaagggaccaaagggggtccggccaagtcgggacatacggccttaacactttcaccaacatggaagtgcaacttatacgacaaatggagtccgagggcatcttcctcccgagcgaactcgagaccccgaatctcgctgaacgcgtcttagactggctggaaaaacacggagcagaaaggttgaagcgcatgccaatcagcggggatgactgcgtagtaaaaccgatagacgacagattcgcaacagcgcttaccgcattaaacgacatgggtaaagtacgtaaagacataccccaatgggagccatctaaagggtggaacgattggcaacaagtcccattctggtcacatcatttccaccaactcataatgaaggatggcagagagatagtggtaccgtgccgcaaccaggacgaattagtaggcagagccagagtgagccagggagcaggctggtcattaagggaaaccgcatggctaggtaagtcgtacgcacagatgggtcagctcatgtacttccaccggcgggatcttagactagcagccaacgccatatggagtgcaggaccaggcgattgggtccccaccagtaggactacatggtctatccacgcgcaccatcaatggatgacgactgaggacatgctgtcggtatggaaccgagtctggatagaagagaacccgtggatggaggacaagacccatgtatcaagctgggaagaagtcccatacctcggcaaacgcgaggaccaatggtgcgggagcctcattggcctaacggcgagagcaacatgggcaacgaacatccaggtggcaataaaccaagtgcgcaggctcataggaaacgagaattatctcgactacatgactagcatgaagcgcttcaaaaatgagagcgatcccgaaggagctctgtggtaa

SEQ ID NO: 23958 - RNA, 9879 nt, synthetic construct
  misc_feature 1..9879: note = derived and/or modified CDS sequence (opt11) from DENV-1__FJ024482__SS-prME
  source 1..9879: mol_type = other RNA
tcagtgaccatgctgctgatgctgctgcccaccgccctcgccttccacctgactaccagaggcggggaaccccacatgattgtgtcaaagcaggagcgaggcaagagcctcctgttcaaaacttccgccggggtaaatatgtgcaccttgatcgccatggatcttggcgagttatgcgaagacaccatgacctataagtgtccccagatcaccgaggctgagcccgacgatgtggattgctggtgcaacgccaccgacacgtgggtgacatatgggacttgcagccagacaggtgaacacaggcgggacaagcgctctgtggctctggcaccacatgtgggcctcgggctagagacgcggaccgagacctggatgagctccgaaggcgcttggaagcagatccaacgtgtggagacttgggccctgcggcaccccgggttcacggtgatcgctctgttcctcgctcacgccatcgggacctcaatcacgcaaaaggggatcatcttcatcctgcttatgctcgtcacccccagcatggccatgcgctgtgtcggcatcgggaaccgcgatttcgtggaggggcttagcggcgccacttgggtggacgtcgttttagagcacggatcatgcgtgaccaccatggcaaagaacaagccaaccttggacatcgagttactgaagacggaagtcaccaacccagcgatcctacgcaagctgtgcatcgaagccaagataagcaacacgaccacggattccagatgcccgacccagggagaggccaccctggtggaggagcaagacgctaacttcgtgtgccgccggacctttgtcgaccgcggctggggtaacggctgcggactgttcggcaaggggagcctgctgacgtgcgccaagttcaagtgcgtgacaaagctcgaaggcaagatcgtgcagtacgagaacctgaagtactccgtcatcgtgaccgtgcacaccggggaccagcatcaggttgggaacgagacgaccgagcacggcacgatcgctaccatcacgccccaagcccccacgagcgagattcagctgaccgactacggggccctcactctggactgcagtcccagaaccggcctggacttcaacgagatggtgttactgacgatgaaggagaagtcctggctggtccataagcagtggttcctcgacctgcccttaccctggaccagtggcgccagcaccagccaagagacctggaaccgtcaggacctcctggtgacgttcaagaccgcacacgcgaagaagcaggaggtggttgttctgggcagccaggagggcgccatgcacaccgcgcttaccggggccacggagatccagacgagcggcaccaccacgatcttcgcggggcatttaaagtgtcggctgaagatggacaagctcaccctgaagggtacctcttacgtaatgtgcaccgggagcttcaagctggagaaagaggttgcggagacgcagcacggcacagtgctggtgcaggtcaagtacgaaggaaccgacgccccctgcaagatccccttcttgacgcaggatgagaaaggtgtgacgcagaacgggcgcctgatcacggccaacccgatagtgaccgacaaggaaaagcctgtgaacatcgaaaccgagccacccttcggggagtcctacatcgtggtgggggcaggagagaaggcgctgaagctctcatggttcaagaaggggtccagcatcggcaagatgttcgaggccacggcgcgcggggcccgccggatggccattctaggggacaccgcttgggactttgggtccatcggcggcgtcttcacgagcgtggggaaactggtgcaccaggtctttggcaccgcctacggggtcctcttctccggggtaagctggacaatgaaaatcgggattgggatcctgctgacctggcttggcctaaattcccgcagcacctccctgagcatgacctgtattgccgtcgggatggttacgttgtacctgggcgtaatggtccaggccgactccgggtgcgtgataaactggaagggccgagagctcaagtgtgggtctggcatcttcgtgaccaacgaggtacatacctggacagagcagtacaagttccaggccgactccccgaagcggctcagcgcggccataggcaaggcctgggaggagggggtctgcggcatccgcagcgccacccggctggaaaacattatgtggaagcagatttccaacgagctgaaccacatcctccttgagaacgatatgaagttcactgttgttgtgggggacgcaaatggtatcctggctcaaggcaagaagatgatcaggccgcagccgatggagcataagtatagctggaagtcctggggcaaagccaagatcataggcgccgacatccagaacaccaccttcatcatcgatgggcccgacacacccgagtgccccgacaaccagcgggcctggaacatctgggaggtggaggactacggcttcggtatttttacaacgaacatctggctcaaactgcgagacagttacacacaaatgtgcgaccaccgtctgatgagcgcagccataaaggacagcaaggccgtccacgccgacatgggttactggatagaatccgagaagaatgaaacctggaagctcgcccgcgccagcttcattgaggtgaagacttgcacctggcccaagtcccacaccctgtggagcaacggcgtgctggagagtgagatgattattcctaagatctacggcggcccgatcagccagcacaattaccggcccggttactttacccagactgccggcccctggcacctcgggaagctggagctagacttcgacctctgcgagggaaccaccgtcgtcgtggacgagcactgtggcaaccgcgggccgtcactgcggactacaaccgtcactggaaagataatccacgagtggtgctgtcgctcgtgcaccctgccgcccctccggtttcgaggggaggacggctgttggtacgggatggagattcggcccgtgaaggagaaggaggaaaacctggtgaggtcgatggtcagcgcaggctccggcgaggttgatagcttcagcctcgggattctctgcgccagcatcatgatcgaggaggttatgcggtcgcgctggagccggaaaatgctgatgacgggcaccctggctgtcttcctcctgctgattatggggcagctaacttggaatgatctgatacgtctgtgcataatggtgggtgccaacgcaagcgaccgcatggggatgggcaccacgtacctagcgctgatggccactttcaaaatgcggccgatgtttgctgtggggctactcttccgccggttaacctcccgggaggttcttctgctcaccatagggctgtcactcgtcgcctccgtggagcttcccaactcacttgaggaactcggtgacggtctggccatgggcatcatgatgttaaagttgttaacggagttccaaccccaccaactgtggaccaccttactaagtctgaccttcatcaaaactaccctcagcctggactacgcctggaagaccaccgccatggccctgtccatcgtcagcctcttccccctgtgcctttccacgacctctcaaaagaccacctggctccccgtactgctgggctccttcgggtgcaaacccctcacaatgtttctgatcacggaaaacaagatctggggccgcaagtcgtggccgctaaacgagggaatcatggctatcggcatcgtctcaatcttactcagctcactgctcaagaacgatgtgcccctggccggcccgctgatcgccggtggcatgctcatcgcctgctacgtgatctcggggagctccgcggacctttcactggagaaagccgcggaggtctcctgggaacaagaggcagagcacagtggcacatcgcacaatatcctcgtggaggtccaggacgacggcaccatgaagattaaggacgaggagcgcgatgacaccctgaccatattgctcaaggccaccttgctggcggtcagcggggtgtaccccatgtcgatccccgcgaccctctttgtgtggtacttctggcagaagaagaaacagcggagcggggtcctgtgggacacgccctccccgcccgaggtggagcgcgctgtgcttgacgatggcatttacagaatcctgcagcgtggtctcctggggcggagccaggtcggcgtgggggttttccaggacggtgtcttccacacgatgtggcacgtgacacgcggggccgtgctcatgtaccagggaaagcggctcgagccttcctgggcctcggtcaagaaggacttgatttcctacggcgggggatggcgcttccaggggagctggaacaccggcgaggaggttcaggtgatcgcggtcgagcccggaaagaacccgaaaaacgtgcagaccacgccaggcacctttaagacccccgagggagaggtgggcgcgatcgccctggacttcaagccgggcaccagcgggtccccgatcgttaaccgggaaggcaagatcgttggtctctacggaaatggcgtggttacgacctcgggaacgtacgtgagcgcaatcgcccaggcgaaggccagccaggagggccccctgcccgaaattgaggacgaagtgttcaagaagcgcaatctcaccatcatggatcttcacccggggagtggcaagacgcggcgctacctgcctgcaatcgtccgagaagcaattaagcgcaagctgagaactctcattctggcccccacccgcgtggtggcatcggaaatggctgaggccctgaagggcatgccgatcagataccaaaccacggcggtcaagtccgagcacaccggtcgggaaattgttgacctcatgtgccacgcgaccttcacaatgcgcctgctgagccctgtgcgtgtcccaaactacaacatgataatcatggacgaagcacacttcacggaccccgcctcgatcgccgcccgcggctacatttcaactcgggtagggatgggcgaggctgcagccatcttcatgaccgccacgccgcccgggtccgtggaagccttcccccagagcaacgcagtcatccaggacgaggagagggacatccccgagcggtcctggaactctggttacgactggataacggacttccccggtaagaccgtgtggttcgtgccctccatcaagagcgggaacgacattgccaactgcctccgcaagaacgggaaacgggttatccagctctcccgcaagacgtttgacaccgagtaccagaaaacgaagaacaacgattgggactacgtggtgaccaccgacatcagcgagatgggcgccaacttccgggccgaccgcgtaatcgacccgcggcgctgcctgaagcccgtgatcctgaaggatgggcccgagcgggtgatcctggcggggccgatgcctgtcaccgtagcatccgctgcccagcgccggggccgaatcggccggaaccagaacaaggagggggaccaatacgtttatatgggacagcccctgaacaatgacgaggatcacgcccactggacggaagcgaagatgctcctggacaacatcaacacccccgaaggaatcatcccggcgctgttcgagcccgagcgcgagaagtccgccgccatagacggcgagtaccgcctcaggggcgaagcccgcaagaccttcgtcgagctgatgcggcgcggcgatctgcccgtctggctctcctacaaggtcgctagcgaggggttccagtactccgaccgacgctggtgcttcgacggggagcggaacaaccaggtcctggaggaaaacatggatgtcgaaatctggcccaaagagggcgagcgcaaaaagctgcggccgcgctggctcgacgcccggacctatagcgaccccctggccctgcgggagttcaaagagttcgcggcagggcggcgatccgtcagcggtgacttaatcctggagatcgggaagctgccgcagcatctcacgctaagggcgcagaatgccctggacaacctcgtgatggtgcacaacagcgaacagggagggaaggcctaccgccatgccatggaggaactgcccgacacgatcgagaccctgatgctcctcgccctgatcgccgtccttactggaggagtgaccctgtttttcctgtccgggaaaggcctcggaaagacgtcaattgggctactgtgcgtgaccgccagtagcgccctactgtggatggcctccgtcgaaccgcactggatcgcggcctccatcatcctggagtttttcctcatggtgttgctgattcccgagcccgaccggcagcgtacccctcaggacaaccagctagcatacgtggtcattggcctgctgttcctcatactgaccgtggccgccaacgagatggggctgctagaaacgactaagaaggacctgggcatcggccacgtggcggccgagaaccaccagcacgccacgatgttagacgtcgacctccggcctgcctcagcatggacactatacgcggtggccacgacggtcatcacccctatgatgagacataccatcgagaacacgaccgccaacatcagcctgaccgcgatagcgaaccaggcagcaatcttgatgggcctggataagggctggcccatatcgaagatggacataggggtcccgcttctagccctgggttgttacagccaggtgaaccccctgacgctcacggccgcagtgctaatgttggtcgcccactacgcaatcatcggacccggtctgcaggccaaggccacacgggaggcgcagaagcgcaccgccgccgggataatgaaaaaccccacggtagacggcatcgtggcaatagacctggacccagtagtgtacgacactaagttcgagaagcaactgggccagatcatgctcctgatcctgtgcaccagccagattctcctaatgcgcaccacctgggcactgtgcgagtccatcacgcttgccactgggccgctgaccaccctgtgggagggatcccccggtaagttctggaatacgaccatcgcggtgtccatggcgaacatcttccggggatcttacctcgccggcgccggactggcgttcagcctgatgaagtccctcggaggagggcgccgggggactggcgcccagggcgagaccctgggggagaagtggaagcgccaattgaatcagctcagcaagtccgagtttaacacttacaagcggtccggcatcatggaggtcgaccgcagcgaggccaaggagggcctgaagcggggtgaaaccaccaagcacgcggtgagtcgcgggaccgcgaaactacggtggttcgtggaacgcaacctggttaaacccgagggaaaggtgatcgacctaggctgcgggcgcggtggctggagctactactgcgccggcttaaagaaggtgaccgaggtcaagggctacacaaagggcggcccgggccacgaagaacctatccccatggcaacctatggctggaacttggtgaagctccattccgggaaagacgtgtttttcatgcccccggagaagtgcgataccctgctgtgcgacatcggcgagagctcccccaacccgactatcgaagaggggagaacgctccgggtcctgaagatggtggagccctggttacgcggcaatcagttctgcatcaagatcctcaatccatacatgcccagcgtggtcgagaccctggagcaaatgcagcggaagcacggcgggatgctggttaggaaccccttaagtcggaacagcacacatgaaatgtattgggtctcctgtggcaccggtaacattgtctccgccgtgaacatgacgtcccgcatgctgctgaaccggttcaccatggcgcaccgcaagcccacctacgagcgagatgtggacctgggtgcgggcactcgtcatgtagccgtggagccggaggtggccaacctggatattattgggcagcgcatcgagaacatcaagaacgagcacaagtctacgtggcactacgatgaagacaacccttacaagacctgggcctaccacggctcctacgaggtgaagccctccggcagcgccagctccatggtgaacggagtagtaaggctactcaccaaaccgtgggacgtgatccctatggtaacccagatcgcgatgacggacaccacccccttcggccaacagcgcgtgttcaaggaaaaggttgacacacgtacgccacgggccaagcggggcacgacccaaatcatggaagtcacagccaagtggctgtggggcttcctgagccgcaacaagaagccgcgaatctgcacgagggaggagttcacccggaaggtgagatccaacgccgccatcggtgcggtgtttgtcgatgagaaccagtggaactcagccaaggaggccgtggaggacgagcgtttctgggacctggtgcatcgcgaacgggagctgcacaagcagggcaagtgcgcgacctgcgtgtacaacatgatggggaaaagagagaagaaacttggcgagttcgggaaagccaagggcagccgtgccatctggtacatgtggctcggcgcccgcttcctggagttcgaggccctggggtttatgaacgaggaccattggttctcccgagagaactctttctccggcgtggagggggaaggcttgcacaagctcgggtacatactgcgcgacatcagcaagatccccggtggcaatatgtacgccgacgacacagccgggtgggacacgcggatcacagaggacgacctccaaaatgaagcgaaaatcacagacatcatggagcccgagcacgccctccttgccacctccatcttcaagctcacgtatcagaacaaggtggtccgcgtgcaacgccccgccaagaatggaactgtgatggacgtcatcagcaggcgcgctcagcggggttcgggccaggttggcacctatgggttgaacacttttacaaacatggaagtgcagctgatacgccaaatggagagcgagggcatcttcctcccgtccgagctggagacccctaacctggcggagcgagtcttagactggctggagaagcatggggcagagcggctgaagcggatggccattagcggtgacgactgcgtggtgaagcccatcgacgaccgcttcgccaccgcgttaacggccctgaacgccatggggaaggtccggaaggatatcccccagtgggaaccgtcgaagggctggaacgattggcagcaagtccccttctgcagccaccacttccaccagcttatcatgaaggacggccgcgagatcgttgtcccatgccgtaaccaagacgagctcgtgggacgcgcccgggtatcccaaggcgccgggtggagcctacgcgagaccgcgtgccttggcaagtcctacgcccagatgtggcagctcatgtacttccaccgccgcgatctgaggttggccgcgaacgcgatctgtagcgctgtccccgttgactgggttccgacgtctcgcaccacctggtcgatccacgcccatcaccagtggatgactacagaggatatgctcagcgtgtggaaccgggtgtggatcgaggaaaacccatggatggaggacaagacccacgtgtcctcgtgggaagaggttccatacctggggaagcgcgaggaccagtggtgcggctccctaatcggcctcaccgcccgagccacctgggcgacgaatatccaggtggccatcaaccaagtgcggcgcctgatcggtaacgagaattacttggactacatgactagcatgaaacggttcaaaaacgagtctgacccggagggcgccctctggtga

SEQ ID NO: 23959 - RNA, 9879 nt, synthetic construct
  misc_feature 1..9879: note = derived and/or modified CDS sequence (opt11) from DENV-1__EU596501__SS-prME
  source 1..9879: mol_type = other RNA
agtgtgaccatgttactcatgctgttgcccaccgccctcgcctttcatctgaccacccggggtggggaaccccatatgatagtgagcaagcaggaacggggcaagagcttactgttcaaaaccagtgcgggggtgaacatgtgcaccctgattgccatggacctgggtgagctctgtgaagataccatgacctataagtgccctcagataacagaggcagagcccgatgacgtagactgctggtgcaacgccaccgacacctgggtcacttacgggacgtgcagccagacaggggagcaccggcgggacaagcgctccgtagccctagcgccccacgtgggcctggggcttgagacgcgcaccgaaacctggatgagctccgagggcgcctggaaacagatccagcgcgtcgagacttgggccctgcggcaccccggtttcacggttatcgccttattcttggcgcatgccatcggcacttcgatcacccagaagggtatcattttcatccttctaatgctcgtgaccccgtctatggcaatgagatgtgtcggtataggcaaccgggacttcgtggagggactgagtggcgctacgtgggtggatgtcgtgctggagcacgggtcctgcgtcacgaccatggccaagaacaagcccacactcgacattgagctgctgaagacggaggtcacaaaccccgccattctccgcaagttgtgcatagaggccaagatcagcaataccaccaccgactccaggtgcccgacccagggtgaggccaccctggtagaggaacaggatgccaacttcgtgtgccgccgaacattcgtcgaccgaggctgggggaatggatgtggcctttttggcaaggggagcctactgacgtgtgccaagttcaagtgcgtgactaagttagagggcaagatcgtgcagtacgaaaacctgaagtattccgtcatagtcactgtgcacaccggcgatcaacaccaggtagggaacgaaacgacagagcacggcaccatcgcgacgatcacgccacaggcccccacgtctgagatacagttgaccgactacggggccctcaccctggactgctctccccggaccggcctggacttcaacgagatggtcttactgacgatgaaagagaaatcctggcttgtccacaagcagtggttcttggacttgcccctaccctggacctcgggggctagcacctcccaggagacctggaaccgtcaggacctcctagttacgttcaaaactgcacacgcgaagaagcaggaggtggtcgtactgggctcccaggagggggccatgcacaccgccttgaccggggccacggagatccagaccagcggcaccaccacgatcttcgccggacacctgaagtgccggctgaaaatggacaagttgaccctaaagggcacctcctacgtgatgtgcacagggagcttcaagctggagaaggaggtagctgaaacgcagcacggcaccgtgttagtgcaggtcaagtatgagggaaccgacgccccctgcaagatccccttttcaacccaggatgagaagggggtgacgcagaacggccgcctcattaccgccaatccgatcgtgaccgacaaggaaaagcccgttaacatcgagaccgagccgcccttcggggagagctatatcgtggtgggcgccggggagaaggcgttaaaactgtcctggttcaagaaggggtcatctatcggcaagatgttcgaggccacggcccgcggggcccgccggatggcaatcctcggcgataccgcgtgggacttcggtagtatcggtggcgtcttcacttccgtggggaaacttgtgcaccaggtcttcggcaccgcgtacggggtgttgttctcgggcgtgtcttggacgatgaagatcgggatcggcatcctcctgacctggctgggcctcaatagccgctctaccagcctgtctatgacctgcatagcagtcgggatggtgacgctgtacttaggcgtgatggtccaggccgactcagggtgcgtgatcaactggaagggccgtgagcttaaatgcgggtccggtatatttgtgacaaacgaggtccacacctggaccgagcagtacaagttccaggcggacagccctaagcggctgtccgcggccatcggcaaggcctgggaggagggggtgtgcggcatccgctccgccacacggctcgagaacatcatgtggaagcagatcagcaacgaactgaaccacatcctactcgagaacgatatgaagttcacggtggtcgttggcgacgccaatggaatcctggcgcaggggaagaagatgatccgccctcagcctatggagcacaaatactcctggaagtcctggggcaaggccaagatcattggcgccgatatccagaatacaactttcatcatcgacgggccagacacaccggagtgtcccgataaccagcgggcttggaacatctgggaagtggaggattacggctttgggatcttcacgaccaacatctggctgaagctccgtgactcgtatacgcaaatgtgcgaccaccggctgatgagcgccgccattaaagactccaaggccgtccacgccgacatgggctactggattgagtctgagaagaatgagacctggaagctggcccgcgcatcattcatcgaggtgaagacgtgcacctggccgaaaagccataccttatggtccaacggcgtgttagagagcgaaatgataatccccaaaatctacgggggcccgatttcccagcacaattaccggcccggatacttcactcagacggccggcccctggcatctgggtaagctcgagctggacttcgatctatgcgagggcaccaccgtagtggtggacgagcactgcggcaaccgcggtccgagcttacggaccacgaccgtcaccggcaagattatccatgaatggtgctgccgctcctgtaccctcccgcccttgcggttccgcggggaggacggatgctggtacggtatggagatccggccagtcaaggagaaggaggaaaacctcgtgcgcagtatggtctccgctggaagcggcgaggttgacagcttctccctggggatactgtgtgcaagcataatgattgaagaggtgatgcggtcccgctggagccggaagatgctcatgacgggaaccctggccgtcttcctgttgctgatcatggggcaactgacatggaacgaccttatccgcctgtgcatcatggtgggcgctaatgcgtccgaccgcatggggatgggcaccacgtacctggcattaatggcaaccttcaagatgaggccgatgttcgccgtgggcttactgttcagacggcttacctctcgcgaggtcttgctgctcaccatcgggctgagcctggtggcgagcgtggagctccccaacagcctggaggagctgggggacgggctcgccatgggtattatgatgctgaagctgcttactgagttccaaccccatcagctgtggaccactctgttaagcctgaccttcatcaagacaaccctgtccctcgactacgcctggaaaaccaccgccatggcactatctatcgtatccctgctccccctatgcttgtcgacgacctcccagaagaccacctggctccctgtgttgctgggcagcttcggatgcaagcccttgaccatgttcctgatcacggagaataagatctggggccggaaatcctggccactgaacgaaggtatcatggccataggcatcgtcagcatcctgctatccagcctgctcaagaatgatgtgcccctcgccggcccgctgattgccggcgggatgttgatcgcttgctacgtgatttcaggttccagcgcggacctatccctggagaaggccgccgaggtctcgtgggaacaggaggcagagcactccggaaccagccataacatcctcgtcgaggtgcaggacgatggcaccatgaagattaaggacgaggaaagagatgacaccctgacgattctgctcaaggccaccctgctggcggtctccggcgtgtacccgatgagcatcccggccacgcttttcgtgtggtacttctggcaaaagaagaagcagcgcagtggagtcctttgggacacccccagcccccccgaggtggaacgcgccgttctcgatgatggcatataccggatcatgcaacgcggcctgctcgggcggagccaggtcggcgtgggggtgttccaggacggggtgttccacactatgtggcacgtgacccggggggccgtgctgatgtatcaggggaagcggctggagccgagctgggcctccgttaagaaggacctcatcagctacggagggggctggcgcttccagggttcctggaacaccggcgaggaagtccaggtgatcgcggtcgagcccggaaaaaacccgaagaacgtccagaccaccccgggaaccttcaagacgctggagggcgaggtaggagccatcgccctcgactttaaaccaggcacatcagggtcccccatcgtaaaccgtgaagggaagatcgtgggcctctacgggaatggcgtagtcacgaccagcgggacgtacgtgtctgccatagcccaggcgaaggcctcccaggaaggaccgctgcccgagatcgaggatgaggtgtttaagaagcgcaacctgaccatcatggacctccaccccgggagcggaaagacgcggcgctacctgccggccatcgtccgggaagccatcaagcgcaagctgcgtacgcttatccttgcgcccactcgggtagtagcctcggagatggccgaggccctgaagggtatgccgatccgctatcagacgacggctgtcaagagcgagcacaccgggagggagatcgtggacctcatgtgccacgcaacgtttaccatgcgcctcctatccccagtccgggtccccaactacaacatgatcatcatggacgaggcccacttcacggaccccgccagcattgccgcccgcggctacatttccacgcgggtgggcatgggagaagccgccgctatctttatgaccgccactccgcccgggagcgttgaggccttcccgcagtccaatgcggtcatccaggacgaggagcgcgatataccagagcgcagctggaactccggctacgactggatcactgacttccccggcaagactgtgtggttcgtcccctcaatcaagtccgggaatgatatcgccaactgcctccgcaagaacggcaaacgggtaatccaactgagccgaaaaaccttcgatacggagtaccagaagacaaagaacaatgactgggattacgtagtgactaccgacatttccgagatgggcgcgaacttccgagctgaccgcgtcatcgacccgcggagatgcctgaagcccgtgatcctcaaggatggccccgagcgggtgatcctggcgggacccatgccggtcactgtggcctctgccgcccagcgccggggccgcattggccgcaaccagaacaaggagggggaccagtacgtatacatgggccaacccctgaacaacgacgaggatcatgcccactggacagaggcgaagatgctcctggacaacatcaacacccccgaagggataataccggccctgtttgagccagagcgcgaaaagagcgcggctatcgacggagagtaccgcctccgcggggaggcccgcaaaaccttcgtcgagctgatgcgacgcggagacctgcccgtctggctaagctacaaggtcgcgtcagaaggcttccagtacagcgaccgccgctggtgctttgacggagagcggaacaatcaggttcttgaggagaacatggacgtagagatctggaccaaggaaggagagcgcaaaaagttgaggccacgctggttggacgcacggacctactccgacccactggcccttcgggagttcaaagagttcgccgcagggcggcgcagcgtctccggcgaccttatcctggagatcggaaaactgccgcagcacttgacactgagggctcagaacgccctggacaacctggtcatgctgcacaactccgagcagggtggcaaggcctaccgccacgccatggaggagttgcccgacaccatcgagacccttatgctgctggcgctaatcgctgtgctgaccgggggcgtcacgctgttcttcctcagtgggaaaggcctgggcaagacctccatcggactgctatgtgtaaccgcctcttccgccctgttatggatggccagcgtggagccccactggatcgcggcttcaatcatactcgaattcttcttaatggtcctgctcatccccgagccggacagacagcgcacgccccaggacaaccagctggcctacgtggtgatcggcttactcttcatgatcctgacggtcgcagccaacgagatggggctgttggaaaccaccaagaaggaccttggcatcgggcacgtggcggccgaaaaccaccagcacgccactatgctggacgtggacctccgacccgccagcgcgtggacgctgtacgcggtcgccaccaccgtgatcaccccgatgatgcgccacacgattgagaacacgaccgccaacatttccctgacagccatagccaaccaggcggcgatcctcatgggcttggacaagggctggcccatcagcaagatggatatcggggtgcccctactcgccctggggtgttactcccaggtcaaccccttgacactcaccgccgcggtgctgatgctggtggcccactacgccatcattggcccgggactacaagctaaggctacccgggaggctcagaagcgtaccgccgccgggatcatgaagaacccaacggtcgacggcatagtggccatagacctggatcccgtggtctacgacgccaagttcgagaagcagctgggccagatcatgctcctgatcctgtgcaccagccaaatactcctgatgcgcacgacctgggcgttgtgcgagtcgatcacgttggcgacgggcccgctgaccaccctgtgggaaggaagcccggggaagttttggaacacgaccatcgcagtgtccatggctaacatcttccggggcagctaccttgccggcgcggggctggcattctccctgatgaagtctctgggaggtggccgccgggggacaggagcccagggcgagaccctgggggagaagtggaagcgccagctgaaccagctctccaaaagcgagttcaacacttacaaacggagcggcatcatggaggtggaccgctccgaggccaaggaggggctgaaacggggggagacaacaaagcatgcagtcagccgggggactgccaagttgcggtggtttgtggaacgcaatctggtgaagcccgaaggcaaggttatcgacctcggatgcgggaggggcgggtggtcctactactgcgcgggcctgaagaaagtgaccgaagtaaaggggtacacgaagggaggtcccgggcacgaagagcccatcccgatggccacctacggctggaacctggtcaaactacattccgggaaggacgtattcttcatgccgcccgagaagtgcgacactctgctatgcgatatcggcgagtcgagccctaacccgaccatcgaggaaggacgcacgttacgggtgctcaagatggtcgagccctggctgcgcggaaaccagttctgtataaagatcctcaacccatatatgccctccgttgtggaaaccctggagcagatgcagcggaaacacggcgggatgttggtccgcaacccgttgagccgtaactccagccacgagatgtattgggtgtcctgcggcaccgggaacatcgtgagcgccgtcaacatgacctctcgcatgctgttaaaccggtttacgatggcgcaccgcaagccgacatacgagcgcgatgtggacttaggcgctggaactagacacgtggccgtcgaacccgaggtggccaatctggacatcatcgggcagcggatcgagaatatcaagaacgaacacaagagtacctggcactacgacgaggacaatccatacaagacgtgggcctaccacggctcctacgaggtgaagccgtccggttccgcgagtagcatggtaaacggcgtagtgagactattaacgaagccctgggacgtcatccccatggtaacccagatagccatgaccgacacaacccccttcggacagcaacgcgtattcaaggagaaggtggacacacggaccccgcgcgccaaacgggggacgacccagatcatggaagtaacagccaagtggctgtggggcttcctgagtcgcaataagaaaccccggatatgcacccgcgaggagtttacgcggaaagttcgcagcaatgccgcgatcggagctgtattcgttgacgagaaccaatggaactcggccaaggaggcagtcgaggacgagcggttttgggacctagtgcaccgcgagagggagcttcacaagcaggggaagtgcgcgacctgcgtgtacaatatgatggggaaacgcgagaagaagttaggcgaattcggtaaggccaagggcagccgtgccatctggtatatgtggctcggtgcccgattcctggagttcgaggctttagggttcatgaacgaggaccactggttctcccgggagaacagcctctccggggttgagggagagggccttcacaagctggggtacatccttcgcgacatcagcaagatccccggaggaaatatgtacgccgacgacactgccggctgggacacccgcatcaccgaagacgacctgcagaacgaagcgaagatcaccgacataatggagccggagcacgccctgctcgcaacctcaatcttcaaacttacctaccaaaacaaggtggtgagagtccagcgccccgcgaagaacggcacggtgatggacgtgatcagccggagggatcagcgggggtccggtcaggtcggcacctacggtctgaatacctttacgaacatggaggtgcagctcatacgccaaatggagagcgagggcatattcttaccatcagaactggagacgcccaatctcgccgagagggtgctcgattggctggagaagcatggggctgagcgcctcaagaggatggccatctcaggcgatgactgcgttgtgaagcccatcgacgaccgctttgcgaccgccctgaccgcccttaacgacatgggcaaggtgcggaaggacatcccccagtgggagccctccaagggctggaacgactggcagcaggtccccttttgtagccaccacttccatcagctcatcatgaaggatggccgcgagatcgtggtgccgtgccggaaccaggacgagctggtcgggcgtgccagagtgtcccaaggagccgggtggtccctgagggagaccgcttgcctcggcaaaagttacgctcaaatgtggcagctgatgtacttccaccggcgcgacctgcggctcgcggcaaacgccatctgcagtgcggtgccagtcgactgggtgcccacctcgcgaacgacttggtccatccatgctcaccaccagtggatgaccacggaggacatgctgagcgtgtggaaccgggtctggatcgaggagaacccctggatggaggacaaaactcacgtgtccagctgggaggaggtgccgtacctggggaagcgcgaggaccagtggtgcggctccctcatcggtctgaccgcccgcgccacctgggcaaccaacatccaggtcgcgattaaccaggtgcggcgcctgatcggcaatgagaactacctcgactacatgactagcatgaagcgctttaagaacgaatccgaccctgaaggcgccctgtggtga

SEQ ID NO: 23960 - RNA, 9879 nt, synthetic construct
  misc_feature 1..9879: note = derived and/or modified CDS sequence (opt11) from DENV-1__FJ898437__SS-prME
  source 1..9879: mol_type = other RNA
agcgtgacgatgctgctcatgctactgcccaccgccctggccttccatctgaccactagaggcggggaaccccacatgatcgtctctaagcaggagagaggcaagagcttgctcttcaaaacgtcagcaggagtaaatatgtgcacactgatagccatggacctgggcgagctctgcgaagacacaatgacatacaagtgtccacaaataacggaggcagaacccgatgacgtcgactgttggtgcaacgcaaccgatacctgggtgacttacggcacgtgcagccagaccggcgagcaccggcgggacaagcgctcagtggccctggcgccgcatgtggggctggggctcgagacccggaccgaaacctggatgagcagcgaaggtgcgtggaagcagattcagagggtcgagacctgggccctgcgccacccggggtttaccgtgatcgcactgtttctcgcccacgccatcggaacgtcaatcacccaaaaggggatcatcttcatattattaatgttggtgacccctagcatggccatgcgctgtgtgggtatcggcaaccgtgatttcgttgaggggctgtcaggcgcaacgtgggtggacgttgtactggaacacgggtcctgcgtaaccaccatggcaaagaacaagcccaccctcgacatcgagctgctgaaaacggaggttaccaacccagcgatcttgcgcaagctgtgtattgaggcaaaaatcagtaataccaccacggacagtcgttgtccgacccagggcgaggccaccctggtggaggagcaggatgcgaactttgtatgccgccggaccttcgtcgaccgcggctgggggaatggctgtggcttattcggcaagggaagcctgctcacgtgcgcgaagttcaagtgcgtgaccaaactcgaaggcaagatcgtgcagtacgagaacctgaaatactccgtcatcgttaccgtgcacaccggcgaccaacaccaggtcgggaacgagacaaccgaacacggcaccattgcgacaataacgccccaggcccctacgtctgagatccaactgacagactacggggccttgacccttgactgctcgcccaggaccggcctagacttcaacgaaatggtgctactcacgatgaaggagaagtcctggctggtccacaagcagtggtttctcgatcttccgctgccctggacctccggggccagcaccagccaagaaacatggaatcgccaggacctcctggtgacctttaagacagcccacgcgaagaaacaggaggtggttgtactggggtcccaggagggcgctatgcacaccgccctcacgggcgccacggagatacagaccagcggaacaaccacgatcttcgccgggcacctaaagtgccgcctgaagatggataaactcacgcttaagggcacctcctacgtcatgtgcaccggtagctttaagctggagaaggaggtcgcggagacgcagcatggcaccgtgttggtccaggtcaagtacgaggggaccgacgccccctgcaagatccccttctcaacccaggacgagaagggagtcacgcaaaacggccgtctcattaccgcaaacccgatagtgaccgacaaggagaaacccgtgaacatcgagaccgaaccaccctttggtgagagctacatagtggtcggcgccggagagaaagcactcaagctgtcttggttcaaaaaggggtcgagtatcggcaagatgttcgaggcaactgcccgcggggcgcgccggatggcgatcctcggcgacaccgcttgggatttcggcagcataggcggcgtctttacttcggtcgggaagctggtgcaccaggtcttcgggaccgcctatggcgtgctgttcagcggcgtttcttggacgatgaaaatcggtatcggtatcctccttacctggctcgggttaaactctcgtagtaccagcctatccatgacctgcatagccgtcggaatggttacactgtatctcggcgtgatggtacaggcagactccggctgcgtgatcaactggaaaggccgcgagctgaagtgcggatccggcatctttgtgaccaacgaggtccacacctggaccgaacaatataagttccaggctgattctccaaagaggctgagcgcagcgattgggaaggcttgggaagaaggggtgtgcggcatacgcagtgccacccggctcgaaaacatcatgtggaagcagatcagcaatgagctgaaccacatcctgttggagaacgacatgaaatttactgtggtcgtaggcgatgccaacggcatcttagcgcaggggaaaaagatgatccgcccccagcccatggagcataagtacagttggaaatcgtggggcaaagccaagatcatcggcgcagacatccagaacaccacttttatcatcgacgggccagacacccctgagtgccccgacaaccagcgggcttggaacatctgggaggtggaagattacggcttcggaatcttcactacaaacatctggctgaagctccgcgacagttacacacagatgtgcgaccacagactaatgagcgcagccattaaggactccaaggccgtccacgcggacatgggctattggatagagagcgagaagaacgagacctggaagctagcccgcgcgagtttcatcgaggtgaaaacatgcacctggcccaagagccacaccctctggtccaacggtgtgcttgagtccgagatgattatccccaagatctacgggggacctatctcccaacacaactaccggccggggtactttacccagacggcaggcccctggcatttaggcaaactggagttggactttgacctgtgcgagggcaccaccgtagtggtggacgaacactgcggtaaccgcgggccgagcctccggacgaccaccgtcaccggtaagattatccacgagtggtgctgccgctcctgtacacttccgcccctgcggttccgcggggaagatggctgctggtacggtatggagatacggcctgtgaaagagaaagaggaaaacctggttcggagcatggtctccgctggcagcggcgaggtcgatagcttctccctagggatcttgtgcgcatccatcatgatcgaggaggtgatgcggtcccgctggtccagaaagatgttgatgaccggcaccttggccgttttcctgctcctgatcatggggcagctaacctggaacgacctcatccgcctatgcatcatggtgggcgcgaatgcctctgaccgcatgggtatgggcaccacgtaccttgcccttatggctaccttcaagatgcggccaatgttcgccgtggggctgttattccgccgcctcacctcgcgcgaggtcctgctgctcactatcgggctgtccctggtggcaagcgtggagctacccaactccctggaggagctgggcgacgggctcgcaatgggcatcatgatgctgaagctactcacggagttccagccccaccaactgtggaccaccctgctcagcctaacattcatcaagactaccctatccctcgattacgcttggaagaccacggccatggcactgtcgatcgtctccctgttcccgctatgcttaagcacgacctcccagaagacaacttggctgccggtgctcttaggctctttcgggtgcaaacccctgaccatgttcctaatcacagagaataagatctggggccggaaatcctggccgctcaacgaagggatcatggccatcggcatagtcagcatcttgctatcctcgctgctgaagaacgatgtgccgctcgcagggccgctgatagccggcggcatgttgatcgcctgctacgttatctccggatcaagcgcggacctctccctggagaaggccgccgaggtgagctgggaacaggaggccgaacactcaggcaccagccataacatcttggtggaggtgcaggatgacggtaccatgaagattaaggacgaggagcgcgacgacaccctcacaatcttgttgaaggccacactcctcgcggtctccggcgtgtaccccatgtcgatcccggctaccctcttcgtgtggtacttctggcaaaagaagaagcagcgatccggggtcctctgggataccccctcgccccccgaagtggagcgcgccgtgctggacgacggcatctaccgcatcctgcagcggggcctgttagggcggtcccaggtcggagtgggggtgtttcaggacggagtcttccacacgatgtggcacgtgacccgcggggccgtactgatgtatcagggaaagagactggagcccagttgggcctccgtcaagaaggacctcatcagctatggcgggggctggcgcttccaaggctcctggaacaccggtgaggaagtccaggttatcgctgtcgagcccgggaagaatccgaaaaacgtccagactacgcccgggactttcaagacccccgagggcgaggtcggagccatcgccctcgactttaagcccggcacgagcgggtccccgatcgtcaaccgggagggaaagatcgttgggctgtacgggaacggcgtcgtcacgacctctgggacctacgtttccgctattgcccaggcgaaggcctcacaggagggcccgctccccgagatcgaggacgaagtgtttaagaagcgcaacctgaccatcatggacctgcacccggggtctggaaagacgcggcgttatctccccgcgatcgtcagggaggccatcaagcgcaaacttcgaacgctgatcctcgcgcccactcgcgtggtggcttccgagatggccgaagccctaaaagggatgccaatacgctaccagaccaccgccgtcaaaagcgaacacaccgggagagagatcgtggatctgatgtgccacgcgacctttacaatgcggttgttgtcccccgtgcgggtcccgaactacaacatgatcatcatggacgaagcccactttactgacccagcgagcattgccgctcgaggctatatcagtacccgcgtagggatgggcgaggcggcggccatcttcatgactgccaccccgcctgggagcgtggaggcattcccccagagcaacgctgtcatacaggacgaagagagagacatccccgaacggtcttggaactccggctacgattggataacggacttccccggcaagaccgtgtggttcgtgccctcgatcaaatccgggaacgatatcgccaactgcctgcgcaagaacggcaagcgggttatccagctctcacggaagaccttcgataccgagtaccagaaaaccaagaacaacgactgggactatgtcgtgaccacagacatctccgagatgggtgccaatttccgggccgaccgcgtcattgacccccggcgctgcctaaagcccgtgatcctgaaggatggccccgagcgagtgatcctcgcggggccgatgccggtgaccgtggccagcgcagcccagagacggggccgcattggtcggaaccagaacaaggagggggaccagtacgtgtatatgggccaaccgcttaacaacgacgaggatcacgcccactggacggaggcaaaaatgcttctagacaacatcaacacccccgagggaattattccggcgctgttcgagcctgagcgggagaagagcgccgctatcgacggagagtaccgcctgcgcggggaggcccgcaagaccttcgtcgagctcatgcggcgcggagacctgcctgtgtggctaagttacaaggtggcgtcagaagggtttcaatacagcgacagacggtggtgcttcgacggggaacggaacaaccaggtcctggaggaaaacatggacgtcgaaatctggaccaaagagggcgagcgaaaaaagttacggccccggtggctggacgctcggacctactccgacccgctcgccctgcgcgagttcaaggagtttgctgccggacggcgcagcgttagtggcgatctaatcctcgagataggtaagcttccccagcacctgaccctccgagcgcagaacgctctggacaacctggtgatgctccacaattccgagcagggtggtaaggcttaccgtcatgcgatggaggagctgcccgacacgatcgagactctgatgctcctggcgctgatcgccgtgctcaccgggggcgtgacgttgttttttctgtccggcaagggcctcggcaaaacctctattggcttactctgcgtgaccgccagctccgccctcttgtggatggcgagcgtggagcctcactggatcgctgcctctatcatcttagagttcttcctcatggtgcttctaataccggagcccgatcggcagcgcacgccccaagacaatcaattagcctatgtggttatcggcctgctgttcatgatcctgacggtcgccgctaacgagatggggctccttgaaacgaccaagaaggacctcggcatcgggcacgtggcggccgagaaccaccagcacgtgaccatgctggatgtcgacctgagaccggccagtgcatggactttatacgccgtggcaaccacggtgatcacaccaatgatgcgtcacactatcgaaaacaccaccgccaacatctcactgaccgctatcgccaatcaggccgcgatactgatgggcctcgacaagggctggcccattagcaagatggacatcggggtccccctgttggccttgggctgctactcgcaagtgaacccgctgacgctgaccgccgcagtgttaatgctggtcgcgcactacgctatcatcgggccaggcctgcaggccaaggccacccgggaggcgcaaaagcgcacagcggccgggatcatgaagaacccgacggtggacggcatagtggccatcgacctcgacccggtagtgtacgacgcgaagttcgaaaagcagctgggccagataatgctgctcatactgtgtaccagccagattctgctgatgcgcaccacctgggcgctgtgtgaatccataacactggcgactggcccgctcaccaccctgtgggaaggcagcccaggcaagttctggaacacgacaatcgcagtgtccatggccaacatcttccgggggagctatctggcaggcgcggggctcgcgttctcgctaatgaagagtcttggagggggcaggcgcgggaccggcgcccagggggagactctgggggagaagtggaagcgccagctgaaccagctgtccaagagcgaatttaacacgtacaagcgaagtggtatcatggaagtcgaccgttcagaggccaaggaggggctcaagcggggtgagaccaccaagcacgcagtgagccgcggcaccgcgaagctgcggtggtttgtggagcgaaatctggtcaagcccgagggaaaggtaatcgacctgggctgcggaagaggcgggtggtcttactactgcgcgggcctcaagaaggtgaccgaagtcaaaggatacaccaaaggcggccccggacacgaggagccgattcccatggcgacgtacggctggaacctcgtgaagctgcacagcgggaaggacgtgttctttatgccacccgaaaagtgtgacaccctcctgtgtgacattggggagtcctctcctaaccccaccatcgaagagggacgcacgctgcgggtgctcaagatggtggagccctggttgcggggcaaccagttctgtattaaaattctgaatccatacatgccctccgtggttgagaccctcgaacaaatgcagcgtaaacatggaggtatgctggtgcgtaaccccctgagccgcaattccactcacgaaatgtactgggtgagctgtggcaccgggaacatcgtcagcgccgtgaacatgacgagccgcatgctcctgaaccgtttcactatggcacatcgcaagcccacctacgagagggacgtggatttaggcgcgggcacccggcacgtcgccgtggagcccgaggtggccaacctcgacatcatcggtcagaggatcgagaacatcaaaaacgagcacaagtccacgtggcattatgacgaggacaacccctacaaaacctgggcatatcacggctcctacgaggtcaagccttccgggagcgcctcatccatggtgaacggcgtggtccggctattgaccaagccctgggacgtgataccaatggtgacccagatcgcaatgacggataccaccccgttcgggcagcagcgtgtattcaaggaaaaggtcgatacccggacaccgcgcgccaagcggggcaccacccagatcatggaggtcaccgccaagtggttatggggcttcctgagccgcaacaaaaaaccccgaatctgcacgcgcgaggagttcacccgtaaggttcgctcaaacgcagccatcggtgctgtgttcatcgacgaaaaccagtggaatagtgcaaaggaagccgtcgaagacgaacggttctgggatttggtacaccgcgagcgggagctccacaagcagggaaaatgcgcgacctgcgtgtacaacatgatggggaagcgcgagaaaaagctgggcgagttcggaaaggcgaaggggtcccgggccatatggtacatgtggctaggcgcccgcttcctcgagttcgaggctctggggttcatgaacgaggaccactggttcagccgggaaaattctctgagcggcgtcgagggggaagggctccataagctcggctacattcttcgcgatataagcaagataccaggtggtaacatgtacgccgacgacaccgcggggtgggacacacgcgtgaccgaagacgaccttcagaacgaggccaaaataaccgacatcatggagcccgagcacgccctgctcgccacgagcatcttcaagctcacgtaccagaataaggtggtacgcgtgcagcgcccagccaaaaacgggaccgtaatggacgtcatctcgcgccgcgatcagcgggggagcggccaagtgggcacgtacggtttaaacaccttcacgaacatggaggtgcagctcatccgccagatggagtccgagggaatctttctccccagcgagctggagacaccgaacctggctgagcgggtcctagactggctggagaagcacggggcggaacgcctgcgccgaatggcgatctccggcgacgactgcgtggtgaagccaattgacgatcggttcgctacagccctcactgcgcttaacgacatggggaaagtaaggaaggacatcccccagtgggagcccagcaagggttggaacgattggcagcaggtcccgttctgttcccaccacttccaccaactaatcatgaaggacgggcgggaaatcgtggtaccttgccgcaaccaggacgaactcgtggggcgggcacgcgtaagccagggcgccgggtggagcctgcgagaaaccgcctgcctcggcaagagctatgcccagatgtggcagttaatgtatttccatcgcagggacctgcgcttagcggcaaacgcaatctgttccgctgtccccgtggactgggtgcccacgagccggaccacctggagtatacacgcccaccaccagtggatgaccacggaggatatgctctccgtctggaaccgcgtgtggatcgaggagaacccgtggatggaggacaagacccacgtgagcagctgggaagaggtcccctacctggggaaacgagaggatcagtggtgtggctcactgatcggcctcaccgcccgggctacctgggccactaatatccaggtggctatcaaccaagtgcgccggctgatcggaaatgaaaactacttagattacatgaccagcatgaagcgcttcaaaaatgagagcgacccagagggcgcgctctggtag

SEQ ID NO: 23961 - RNA, 9879 nt, synthetic construct
  misc_feature 1..9879: note = derived and/or modified CDS sequence (opt11) from DENV-1__FJ024480__SS-prME
  source 1..9879: mol_type = other RNA
tccgtgacgatgctgctcatgctattaccaaccgccctcgccttccacctgacgacccgaggcggggagccccacatgattgtgagcaagcaggagcggggcaagagcctcctgttcaagaccagcgcgggggttaacatgtgcacgctgattgccatggacttaggagaactctgcgaagacacaatgacctacaagtgcccccagattactgaggccgagcccgacgatgtggactgctggtgcaacgccaccgacacctgggtgacctacggtacatgctctcagaccggggagcaccggcgagacaagaggtccgtggccctggcgccccacgtgggactgggattggagacgagaacggagacgtggatgagttccgaaggggcctggaagcagatccagcgagtcgagacctgggccctgaggcacccagggttcacggtgatagccctgttcctcgcgcacgctataggcacctcgatcacccagaaggggatcatcttcatcttactcatgttagtcaccccctccatggctatgcgctgcgtcggcatcggaaaccgggacttcgtggagggtctgagcggcgcgacgtgggtcgacgtcgtgctggagcacgggtcctgcgtaaccaccatggccaagaataaacccaccctcgatatagagctgcttaagacggaggtcacaaaccccgctatcctccgcaagctgtgcattgaggccaagataagcaataccaccacggactcccggtgccccacccaaggagaggccacattggtggaggagcaggacgccaacttcgtgtgtcggcggacgttcgtcgaccggggctgggggaacggctgcggcctcttcggaaaaggtagcttgctgacgtgcgccaaattcaaatgtgtgaccaaactcgagggcaagatcgtacagtacgagaacctgaagtacagcgtaatcgtaacagtgcataccggtgaccagcaccaggtcgggaacgagacaaccgagcacggcaccatcgcgaccatcaccccccaggcaccaactagcgagatccagctgaccgactacggtgccctcacccttgactgcagcccccgtaccggcctcgacttcaacgaaatggtgctccttacgatgaaggagaagtcctggctggtgcacaagcagtggtttctcgacctgccgctgccgtggacctccggagccagcacaagccaagagacgtggaaccgccaggaccttttggtgaccttcaagaccgcacacgcgaagaagcaggaggtggtagtgctaggatcccaggagggcgctatgcacaccgccctcaccggggccactgagatccaaactagcggcaccaccacgattttcgcggggcatctgaaatgccggctgaagatggacaagctcacactgaaaggcacctcgtacgttatgtgcaccgggagctttaagctggagaaggaggtcgcggagacgcagcacggtaccgttctggtgcaggtcaagtatgagggcacggacgcaccttgcaaaatacctttctccacgcaggatgagaagggggtcacgcagaacggtcgcctgattaccgccaacccaatcgtcaccgacaaggagaagccggtaaatatcgagaccgagccgcctttcggggagagctacatagttgtgggcgcgggtgagaaggctttgaagctgtcctggttcaaaaagggcagctccatcggtaagatgttcgaggccaccgcacgcggggcccgccggatggccatcctcggcgacacagcgtgggacttcgggagtatcggcggcgtgttcacctccgtgggcaaactggtgcaccaggtgtttggaaccgcctacggcgtgttattttcaggcgtgtcatggactatgaagatcgggatcggcatcctcctgacttggctgggcctcaactcacgctccaccagcttatccatgacctgtatcgcagtcgggatggtgactctgtacctcggcgtcatggtccaggccgacagcggctgtgtgatcaactggaagggccgcgaattgaagtgcggctccggcattttcgtgaccaacgaggttcacacatggaccgagcagtacaaattccaggccgactcaccaaagcggctgtcggcggccatcggcaaggcctgggaggagggcgtctgcggcatccggtccgccactcggctcgaaaacataatgtggaaacagatcagcaatgagttaaaccacatcctgctcgagaacgacatgaagttcacggtggtcgtgggtgacgccaacggaatcctcgcgcaggggaagaaaatgatacgccctcagcccatggagcataagtattcctggaaaagctggggcaaggccaaaataattggtgccgacatacagaacaccacctttatcatcgacgggcccgacacgccggagtgccccgacaaccagagggcctggaatatctgggaggtggaggattatgggttcgggatattcacgaccaacatctggctgaagctccgcgatagttatacccagatgtgcgaccacaggctgatgtcagcggccatcaaggactccaaggctgtccatgcggacatgggttattggattgaaagcgagaaaaacgagacgtggaaactggcccgcgcgagtttcatcgaggtgaagacatgcacttggcccaagagccacacactctggagtaacggcgtgctggagagcgagatgatcatccccaagatatacgggggaccgatttcccagcacaactaccggcccgggtacttcacgcagacggccggcccctggcatctggggaagttggagttggactttgacctgtgcgaagggacaaccgtcgtggtggatgagcactgtggcaaccgcgggccgagcctgaggacaacgaccgtaaccggcaagataatccatgagtggtgctgccgatcatgcaccctgccgcccctgaggttcagaggggaggatgggtgttggtatgggatggagatccggcccgtgaaggaaaaggaggagaacctcgtgcgcagcatggtcagtgccggcagcggcgaggtagactcgttctcattaggcatcctgtgtgccagcatcatgatcgaggaagtaatgcggtcccgttggagccggaagatgctcatgacgggcaccctggccgtcttcctgctcctaatcatggggcaactgacgtggaacgatctcatacgcctgtgcatcatggtgggcgcgaacgcctcggaccgcatgggcatgggcaccacgtacctagccctcatggccactttcaagatgcggccgatgttcgctgtggggctgctcttccgaaggcttaccagccgcgaggtcttactcctcacgatcggcctgtccctgatggcaagcgtcgagctccccaacagtctggaagagctgggtgacggtctcgccatgggcatcatgatgctcaagctgctcacggagttccagcctcaccagttgtggaccaccctcctcagcctcaccttcatcaaaacaactctgtccctcgactacgcctggaaaaccactgcaatggcgctgtctattgtatccttgtttcccctctgcctaagcacgacctcccagaagaccacatggctgccggtgctcctgggctctttcgggtgcaagcctctgaccatgttcctgattacggagaacaagatctggggccggaagtcctggcctctgaacgaagggataatggctattggaattgttagcattctgctctcctcgctgctgaagaacgacgtccccctcgcggggccgctgatcgcaggcggcatgctgatagcttgctatgtaatcagcgggtccagcgcggacctctccctggaaaaagccgccgaggtgagctgggaacaggaggccgagcactcgggcactagccacaacatcctggtcgaggttcaggacgacggtacgatgaagatcaaggacgaggagcgagacgataccctgacgatcctgctgaaagcgacactcctggcggtgtccggcgtctaccccatgtctatacccgccaccctgttcgtgtggtacttctggcagaaaaaaaaacagcggtccggggttctctgggacacgccctccccgcccgaggttgagcgcgccgtgctggacgacggcatctacagaatactccagcgcggcctgctcggccggtcccaagtgggggtcggggtgtttcaggacggcgtgttccacacgatgtggcacgtcacccgtggggccgtgcttatgtaccaggggaaacggctagagccctcatgggcctcggtcaagaaggacttaatcagttatgggggcggatggcgctttcaggggtcttggaacacaggcgaggaggtccaggtaatcgcagtggagcccggcaagaacccgaagaacgtacaaaccactcccggcaccttcaagacccccgagggcgaagtgggggccatcgccctggatttcaagcctggtaccagcgggtctccgatcgtgaacagagagggcaagatcgtcggcctgtacgggaacggcgtggtcacgaccagcgggacgtacgtctccgccattgcacaggccaaggccagccaggagggccccctgcctgagatcgaggacgaggtgttcaaaaagcgcaacctgaccatcatggacctgcaccccgggtccggcaagacgcggcgctacctgcccgccatcgtgcgggaggctatcaagcgcaagctgcggaccctgatcctcgcgcccaccagagtcgtggcatccgagatggccgaggccctgaaaggtatgcccatccgctaccagactacggccgttaaaagcgagcacaccggtagagagatcgtggatctcatgtgccacgcgacctttaccatgcgcctcctgtccccggtgcgggtgcctaactacaacatgatcatcatggacgaggcccatttcactgaccccgccagcatcgcggcccgcggctacatctccacgcgggtcgggatgggtgaggcggccgccatcttcatgaccgccactccgccgggcagcgtggaggcctttccgcagtccaacgcagtgatccaggatgaagaaagggatatacccgaacggtcgtggaactccggctacgactggatcacggacttccccggcaagacggtctggttcgtccctagcatcaagtccgggaacgacatagccaactgcctgcgcaagaacggcaaacgagtgatccagctctcgagaaagacgttcgataccgaataccagaagacgaagaataatgattgggactacgtcgtgaccaccgacatatcggagatgggggccaacttcagggccgaccgcgtgattgatccaagaagatgtcttaagcccgtcatcctcaaagacggccccgagcgtgtgatcctcgccgggcctatgcccgttacggtcgcgtctgccgcccagcgccggggccgtatcggccgaaaccagaacaaggagggagatcagtacgtatacatgggccagcccctgaacaatgatgaggaccacgctcactggacggaggcgaagatgctgctagacaatatcaacaccccggaggggattatcccggcccttttcgagcccgagcgcgaaaagtccgccgctatcgatggcgagtaccgcctgcgcggggaagcccgcaagactttcgtggagctcatgcggcgaggcgacctacccgtctggctgagttacaaggtcgcgtcggaaggattccagtacagcgaccggcgctggtgcttcgacggggagcggaacaaccaggtactagaggagaatatggacgtagagatatggacaaaggagggtgagcgcaagaaactccggccccgctggctagacgcccggacttactccgacccgctcgccttacgcgagttcaaggaatttgccgcaggacggcgaagcgttagcggtgacctgatactagagatcggcaaactgccccagcatctcacgctccgggcgcagaatgcactggacaacctggtcatgctccacaattccgaacagggcgggaaagcctaccgccacgccatggaggagctgcccgataccatcgaaaccctgatgctcctggcgcttatcgccgtgctcaccggaggcgtgacgctgttcttcctgtccggtaagggcctcggcaagaccagtatcgggctgctgtgcgtcaccgccagctccgccctcctatggatggctagcgtagagccccactggatcgcagcctccatcatcctcgagttctttctcatggttttactgatcccggagcctgaccggcagcgcacgccccaggataaccagctcgcctatgtcgtaattgggctgctgttcatgattctcacggtggccgccaacgagatgggactgctggagaccaccaagaaagacctgggaatcgggcacgtcgcggccgagaatcaccagcacgccaccatgctggacgtggacctgcggccggccagcgcctggacgctctacgcggtggccaccaccgtcataaccccaatgatgcgtcatacgatcgagaatacgacggcgaacatctcccttaccgccatcgccaatcaggcggccattctgatgggcctcgacaaaggctggcccatctctaagatggacatcggggtgcccctgctggctttaggctgctattcccaggtgaatccgctgacgctgaccgccgcggtcctcatgctcgtggcccactatgccatcatcgggcccggactgcaggccaaggccacccgcgaggcgcaaaagcgcaccgccgcaggaatcatgaagaaccccacggtggacggaatcgtcgccatcgacctcgaccccgtggtgtatgacgccaaattcgagaagcagctgggccagatcatgctgctcatcctgtgcactagccagatattgctaatgagaaccacctgggcgttgtgtgagtccatcacgctggccacaggccccctaaccaccctttgggaaggttcgcccgggaaattttggaacaccacaatcgccgtctccatggcgaacattttccggggaagctatctggccggtgctgggctagccttctcccttatgaagtccctaggcgggggccgtcgaggcaccggcgcgcagggcgaaacgctaggagagaagtggaagcgccagctgaaccaactgtccaagtctgagttcaatacgtacaaacggtcaggcatcatggaggtggaccgctctgaagccaaggagggtctcaagaggggcgagaccaccaagcacgccgtgagccgcggaaccgccaagctgcggtggttcgtggagcgaaacctggtgaagcctgagggtaaggtgatcgatctggggtgcgggcggggtgggtggtcatactactgcgccggcctcaagaaggttacagaggtgaagggatacacgaaagggggcccggggcacgaggagccgatccccatggcaacctacggctggaacctagtgaaactgcacagtggcaaggacgtcttcttcatgccgccggaaaagtgcgataccttgctgtgcgatatcggcgagtcaagcccgaaccccacaatcgaggagggacgcacgctacgggtgctcaagatggtggaaccctggctgaggggcaaccagttctgcattaaaatcctgaacccctacatgccatccgttgtggagacgctggagcagatgcaacggaaacacggcgggatgctggtgcggaaccccctgtcccggaactccacccacgagatgtactgggtcagctgcggcacagggaacatcgtgtcagccgtgaacatgacgagccgcatgctattaaaccgattcacgatggctcaccgcaagcccacgtatgagcgcgacgtcgacctgggcgccggcacccggcacgtggccgtggagccggaggttgccaacctcgacatcatcgggcagcgcatcgagaacatcaagaacgagcacaagagtacgtggcactacgacgaggataacccgtacaagacctgggcctatcatggcagctacgaggtgaaaccatcagggagcgcgtcctccatggtgaatggcgtagtaaagctgttgaccaaaccttgggacgttatccccatggtcacccagatcgccatgacggacacaaccccgttcgggcagcagcgcgtgttcaaggagaaggtcgacacccgcactccccgggcgaagcgcggtaccacccagatcatggaagtgaccgccaagtggttatggggcttcttaagtcgcaacaagaagcccaggatctgcactcgggaggagttcactcgcaaagtgcggagcaacgccgcgataggggccgtcttcgtcgacgagaatcagtggaacagcgccaaggaagccgttgaggacgagcgattctgggacttggtgcaccgagagagggaactacacaaacagggcaagtgcgcgacctgtgtgtacaacatgatggggaagcgggagaagaagctgggcgagttcgggaaagccaagggctccagggcaatatggtacatgtggttaggcgcccggttcctcgagttcgaggcgctcgggttcatgaatgaggaccactggttcagccgcgagaactccttgagcggcgtggagggggagggccttcacaagctgggctatatcctgcgggacatctccaagatcccgggcggcaatatgtacgcggacgacaccgctggttgggacacgcgcatcactgaggacgatctacagaacgaagccaaaatcaccgacataatggagcccgagcacgccctgcttgccaccagcatcttcaagctcacataccagaacaaggtagtccgggtgcaaaggcccgcgaaaaatggcacggtcatggacgtaatctcccgccgggaccagcgaggtagcggccaggtgggcacctacgggctgaacacctttacgaacatggaggtccagctaatccggcaaatggagtccgaaggtatctttctccccagcgagctggagacccctaacctggccgagagagttctcgactggctggagaaacatggggccgagcgcctgaagcgaatggccatctccggcgacgattgcgtggtcaagcccatcgacgaccggttcgccaccgccctcaccgccttgaacgacatggggaaagtgaggaaggacataccccagtgggagccctctaagggctggaacgattggcagcaggtcccattctgctcccaccacttccaccaactgatcatgaaggacggccgggagatcgttgtgccctgccgcaaccaggacgaactggtggggcgggcgagggtcagccagggcgccgggtggtccttaagagagaccgcatgtctgggaaaaagttatgcgcagatgtggcagctcatgtacttccaccgccgtgacctgcgcctggccgcgaacgccatatgctccgccgttcccgtggactgggtccccacgagccggaccacctggagtatccacgcccaccaccagtggatgaccacggaggacatgctcagcgtgtggaaccgggtctggatcgaggagaacccgtggatggaggataagactcacgtcagcagctgggaggaggtgccttacttagggaagcgggaggaccagtggtgcggctcattaatcggcttgaccgcccgcgccacctgggccacgaacatccaagtagccatcaaccaagtccgccggctcatcggcaatgagaactacctggactacatgacctcaatgaagcgcttcaagaacgagagcgacccggagggagccctttggtga

SEQ ID NO: 23962 - RNA, 9879 nt, synthetic construct
  misc_feature 1..9879: note = derived and/or modified CDS sequence (opt11) from DENV-1__FJ873814__SS-prME
  source 1..9879: mol_type = other RNA
agcgtgactatgcttctcatgctgctaccaaccgccctcgccttccacctcaccactcgaggcggggagccgcacatgatcgtgagcaagcaggagcggggcaagagcttgctcttcaagacgtccgcgggggtgaacatgtgcaccctgattgccatggatcttggcgagctctgcgaggacaccatgacctacaagtgcccccaaatcaccgaggccgagcccgacgacgtggactgctggtgcaacgcgacggacacctgggtgacctatgggacctgcagccagactggcgaacaccgacgggacaagcgatccgtggccctggcgccccacgtgggcctagggctggagacgcggacagaaacctggatgagctccgagggcgcgtggaagcagatccagcgcgttgagacctgggccctacggcaccccgggtttacggtggtggccttcttccttgcgcacgccatcgggacaagcatcactcagaaagggatcatcttcatcctactaatgctggtaaccccctccatggccatgcggtgcgtgggcataggcaaccgcgactttgtggaggggctcagcggcgctacgtgggtcgacgtggtgctggaacacgggtcctgtgtcaccaccatggccaagaacaagcccaccctggacatcgagttgctgaagacggaggtgaccaacccggcgatcctgcgcaagctctgcatcgaggctaagatctcgaacaccaccacggactcccggtgcccgacccagggcgaggctactctggtggaggagcaggacgccaatttcgtctgccgcagaaccttcgtggaccgcggctgggggaacggatgcgggctgttcggcaaaggtagcctcctgacatgcgccaagtttaagtgcgtgacaaagctagagggcaagattgtccaatacgagaatctgaaatattccgtgatagtcacggtccacaccggcgaccagcaccaggtcggtaacgagacgacagagcacggcaccatcgccatcatcacgccacaggcccccaccagtgagatccaactaacggactatggggccttaaccctcgactgtagcccacggacgggcctggacttcaacgaaatggtcctgctcaccatgaaggagaagtcctggctggtgcacaagcaatggttcctggacctcccgctgccctggacgtctggtgccagcaccagtcaggagacctggaaccgacaggacctgctcgtgaccttcaagactgcccacgcgaagaagcaagaggtcgttgtgctcggctcgcaggagggcgccatgcacaccgccctgaccggggccaccgaaatccagacatcaggcaccaccaccatcttcgcagggcacttaaagtgccgtctgaagatggacaagctgacgctcaagggcacctcctatgtcatgtgcaccgggtcgttcaagctggaaaaggaggttgcggaaacccagcacggcacagtgctggtgcaggtaaaatatgaaggtaccgacgccccctgcaagatcccgttctccacccaggacgagaagggggtgacccagaacggccgcctgatcacggccaacccgatcgtcacagacaaagagaagcccgtgaacatcgagaccgagccgcccttcggggagagttacatagtgataggcgccggcgaaaaagcgctcaagctgtcctggttcaaaaaggggtcgtccattggcaagatgttcgaagccaccgcccgcggggcccgccggatggccatccttggcgacacggcgtgggacttcgggtcaatcggcggcgtcttcacgtccgtggggaagttggtgcaccaggtcttcggaactgcctacggcgtgctgttttcgggcgtgtcctggacgatgaagatcggcatcggcatcctgctcacgtggctaggcctcaatagccgctctacctcgttgtctatgacatgcatcgccgtcgggatggtaacgctttacctgggggtgatggtccaggccgacagtgggtgtgtaatcaattggaagggccgcgagctcaagtgtggttccggcatctttgtgacaaacgaggtccacacctggaccgagcagtacaagtttcaggccgactcgccgaaacggctgagtgcggcgattggcaaggcctgggaggagggggtgtgcggcattagatccgccaccagattagagaacataatgtggaagcaaatcagtaacgagctcaaccacattttgctggaaaacgacatgaagttcaccgtggtcgtgggggacgccaacggcatcttagcgcaggggaagaagatgatacgtccccagccgatggagcacaagtactcctggaagtcctggggcaaagccaaaatcatcggtgcagacatacagaacactaccttcatcatagacgggcccgataccccagaatgccctgatgatcagcgggcgtggaacatctgggaggtggaggactacggtttcggcatcttcacgacgaatatctggctgaaactgagggactcctatacccagatgtgcgatcaccggctcatgagcgcggccataaaggactcaaaggccgtccacgccgacatgggatactggatcgagagcgagaagaatgagacctggaagctggcccgcgcgagcttcatcgaggtgaagacctgtacctggccaaagagccacaccctctggtccaacggggttctcgagagcgagatgatcattcccaagatctacgggggcccgatctcccagcacaactaccggcccggatacttcactcaaactgccggcccctggcacctggggaagctggaactagacttcgacctgtgcgaggggacgaccgtagtggttgacgagcactgcggtaaccgcggaccgtctctgcgaaccaccactgtcaccggtaagatcatccacgagtggtgctgccggtcctgcaccctgccccccctgcggttccgcggggaggacggatgctggtacgggatggaaatccggcccgtgaaagagaaggaggagaatctggtgcgcagcatggtctccgcaggaagcggcgaggtggacagcttctccctcggtatcctgtgcgccagcatcatgattgaagaggtgatgagatcccgctggagcaggaagatgctgatgaccggtacgctcgccgtcttcctgctgctcataatgggccagctgacatggaacgacctgatcagactgtgcatcatggtgggtgctaatgcctccgatcgcatgggcatgggcaccacctacctggcgctcatggccaccttcaagatgcggccgatgttcgcggtcggcctcctttttcgccggctgaccagccgcgaggtcctcctgctgaccatagggctctccctggtcgcgagcgtggagctgcctaactccctcgaggagctaggagacgggttagctatgggtatcatgatgctcaagctcctgaccgaattccagccccaccagctctggacgaccttgctcagtttaacattcatcaagaccacgctgtctttagactacgcctggaagactaccgcaatggcgctcagcatcgtttccttgttccccttgtgcctcagcaccacgtcccagaagacgacctggcttccggtgctcctcggtagtttcggatgtaagccactgaccatgttcctgatcaccgagaacaagatttggggccggaagtcctggcccttgaacgaggggatcatggccataggcattgtcagcattctgctgtcgtcgctactgaagaacgatgtgcccctggctggcccgctcatcgccggtggcatgctgatcgcttgctacgtgatcagcgggtccagcgcggacctgtccctagagaaagccgccgaggtcagctgggagcaggaggccgagcactctggcaccagccacaacatcctggtggaggtgcaggacgatgggaccatgaagatcaaggacgaggagaaggacgataccctgaccatcctactgaaggcaacgctgctcgcggtctccggcgtatacccaatgagcatccccgccaccctgttcgtgtggtacttctggcagaagaagaaacagagatccggggtcctgtgggacacccccagcccgcccgaggtggagcgggccgtcttggacgacggcatctaccgcatcctgcagcggggcctgctggggcgctcccaggtcggcgtgggggtgttccaggatggcgtcttccacaccatgtggcacgtgacacgcggggccgtgctcatgtaccagggcaagcgactggagcccagctgggcgagtgtcaagaaggacttgatcagctacggcgggggctggcggttccagggctcctggaacaccggggaagaggtccaggttatcgcggtagagcccgggaagaaccccaagaacgtgcagaccacccccggcacgttcaaaacccccgagggcgaagtgggggccatcgccttagatttcaagcccggtaccagcggttccccgattgttaatcgcgaggggaagatcgtgggcctgtacgggaacggggtggtcaccacgagcgggacctacgtgtcggccatcgcccaggcgaaggcaagccaggagggtcccctgcccgagatagaggacgaggtgttcaagaagcggaacctcacaatcatggacctgcacccggggagcggcaagacccgacggtacctgcccgccattgtccgcgaagcgatcaagagaaagctccgaacgctgatcctggcgcccacccgcgtggtggcctccgagatggcagaggccctcaaaggcatgccgatccgctaccagaccaccgccgtcaagagcgagcacacggggcgcgagatcgttgacctaatgtgccacgctaccttcacgatgcggctgctctccccagtgcgcgtccccaactacaacatgatcatcatggacgaggcccactttaccgaccccgcaagcatcgcggcccgggggtacatctccacccgtgttggtatgggcgaagcggcagctatcttcatgaccgcgacgccgccggggagcgtcgaggcctttccccagtctaacgcggtcatccaggacgaggaacgggacatacccgagagaagctggaactcgggctacgactggatcaccgacttccccggcaagacggtgtggtttgtgcccagcatcaagtccgggaacgacatcgccaactgcctgcgcaagaacggcaagagggtaattcagctgagccggaagaccttcgatactgaataccaaaagaccaagaacaacgactgggactatgtggtgacgaccgacatctccgagatgggagccaacttccgcgccgaccgggtcatcgatccacgccggtgcctcaaacccgtgattcttaaggacggccccgagcgcgtgatcctggcggggccgatgcccgtcaccgtggccagcgccgcccaaagacgcggccgaatcggccgcaaccagaacaaagaaggtgaccagtacgtgtacatgggccagcccctcaacaatgacgaggaccacgcccactggaccgaggcgaaaatgctcctggacaacatcaacacgcccgaggggatcatcccggccctcttcgagcccgaacgcgagaagtccgcagccatcgacggcgagtataggctgcgcggtgaggcccggaagaccttcgtcgaactgatgcgtcggggcgacctccccgtgtggctgagttacaaggtagcgtccgagggattccagtacagtgatcgccgatggtgtttcgacggggagcgcaacaaccaggtgctggaggagaacatggacgtggagatctggaccaaggagggcgaacggaaaaagctccgtccacggtggctggacgccaggacttactcggatcctctggccctccgggaattcaaggagtttgctgccgggaggcggagcgtcagcggcgaccttatcttagagatcggcaagctcccccagcaccttaccctgcgcgcgcagaacgccctcgacaacctggtgatgctgcacaactccgagcaggggggaaaggcttatcgacacgcaatggaagaactccccgacacgatcgagaccctgatgctgctcgcactgatcgccgtgctgaccgggggcgtgaccctcttcttccttagcgggaagggcctcggcaagacgtccatcggcctattatgcgtgaccgccagcagcgccctgctctggatggccagcgtggaaccccattggatcgcggcctccatcatcctggagttctttctgatggtattgctgatccctgagcccgaccgccagcggacgccccaggataaccagctggcctacgttgtgatcgggctcctgttcatgatactgacagtcgccgctaacgaaatggggctcctggagacgaccaaaaaggacctgggcatagggcacgtggcggccgagaaccaccagcatgctaccatgctcgacgtggacctgcgaccggccagcgcctggaccctctacgcggtcgcaacgaccgtgattacgcccatgatgagacacaccatcgaaaacacgaccgccaacatctcactcaccgccatcgccaatcaggcggccatcctgatgggccttgacaagggctggcccatcagcaagatggacatcggtgtgcctctcttagccctgggctgctattcccaggtaaacccgctcaccctcacggccgcggtactcatgctcgttgcccactacgccatcatcgggccgggcctgcaggcgaaggccacccgggaggcgcagaagcggactgccgccggtatcatgaagaaccctaccgtcgacggcatcgtggccatcgatctggaccccgtggtatacgacgcgaagttcgagaagcagctcggccagattatgctgctgattctctgtacgagccagatactgctgatgcgcaccacctgggcgctttgcgagtccattaccctggccactggaccgctgaccaccctctgggagggcagccccgggaaattctggaataccacgatcgccgtttccatggccaacatcttccggggcagctacctggccggcgcggggctggccttctccctcatgaagtcactgggcgggggccggcgcgggaccggcgcccaaggagagaccctgggggagaaatggaagcgacagctcaaccagctatccaagagcgagtttaacacctacaagagatcaggcattatggaggtggaccggagcgaggccaaagaggggctgaagcgcggcgagacgaccaagcatgcggtcagccgggggaccgcaaagctccgctggttcgtggagcgcaatctggtgaagcccgagggcaaggtcatcgacttaggatgtgggcgcggcgggtggtcatactattgcgccggcctcaaaaaggtgaccgaagtgaaaggatacaccaaggggggtcccggccatgaggaaagcatacccatggccacgtatgcttggaacctcgttaagctacactcgggcaaggatgtgtttttcatgccgccagaaaagtgtgacaccctgctctgcgacatcggggagtccagtcccaacccgaccatcgaggaaggccggaccctgcgcgtgctgaagatggtcgagccctggttacgggggaaccaattctgcatcaaaatcctgaacccctacatgcctagcgtggtagaaacgctggagcagatgcagcgcaagcacgggggcatgcttgtccggaacccgctgtcccgcaacagcacccatgagatgtactgggtgtcctgcgggaccggaaacatcgttagcgcggtcaatatgacctcccggatgctgctcaaccgcttcacgatggcccaccggaagccaacatacgagcgagatgtggatctgggggccggcacccgccacgtggccgtcgagcccgaggttgcaaacctggacattatcggccagcggatcgaaaacatcaagaatgagcacaaaagcacctggcactacgacgaagacaacccttacaagacgtgggcgtaccacgggtcctacgaggtgaagccgagcggctcagccagctccatggtcaacggggtggtgcgtctgctgacaaagccttgggacgttataccaatggtgacccaaattgccatgaccgacacgaccccgttcggccaacagcgggtcttcaaagagaaggtggacacccgcactccgcgggccaagcgcgggacgacccagatcatggaggtgaccgccaagtggctgtggggcttcctcagccggaacaagaaaccgcgcatctgcaccagagaagaattcacgcgcaaggtccggagcaacgctgccatcggcgccgtgttcgtggacgagaaccagtggaactccgccaaggaggcggtggaagacgagcgcttctgggatctcgtgcatcgggagcgcgagctgcataaacaggggaaatgcgcgacatgcgtatacaacatgatgggcaagcgggagaaaaaactcggggagttcggcaaggcgaaagggagccgcgccatctggtacatgtggctgggcgctcgtttcctggagtttgaagcgctgggcttcatgaacgaggaccactggttctcccgagagaacagcctgagtggcgtcgagggcgagggtttacacaagctcggctacatcctccgggacattagcaagatacccgggggcaacatgtacgcagacgacaccgccggctgggacacccgcatcacggaggacgatctgcagaatgaggccaaaatcaccgatattatggagccggagcacgccctcctggcgacgtccatattcaagctgacctaccagaacaaggttgtgcgggtccagaggcctgccaagaacggtacagtgatggatgtgatctctcgcagggaccagcgtggctccgggcaagtcggtacctacggtctgaacacgttcaccaacatggaggttcagctcatccggcagatggagagcgagggcatcttcctgccgtccgagctcgagacgcccaacctggcaaagcgcgtgctggactggctcgagaagcacggcgccgaacggctgaagcgcatggccatcagcggggatgactgcgtagtgaagcctatcgacgacaggttcgcgaccgctctgacagcactcaacgacatgggcaaagtgcggaaggacatcccccagtgggagcccagcaagggttggaatgactggcagcaggtccccttctgcagccatcacttccaccaactgatcatgaaggacggcagggagatcgtggtgccctgcaggaaccaggacgagttggtcggacgggcccgcgtgtcccagggggccggctggagcctccgggagacagcttgcttggggaagtcctacgcccagatgtggcagctaatgtacttccaccgccgggacctccgcctggccgcgaacgcgatctgcagcgccgtgcctgtcgactgggtgcccactagcaggactacctggagtatccacgcccaccaccagtggatgaccaccgaggacatgctgagcgtgtggaaccgcgtctggatcgaggagaacccatggatggaggacaagacgcacgtgtcctcatgggaagaggttccgtacctcggcaagagagaagatcagtggtgcgggtcactgatcggcctgacagcccgcgccacctgggcgaccaacatccaagtcgccatcaaccaagtgcggcggcttatcggaaacgagaactacctggattacatgacgtctatgaagcgcttcaagaacgagtccgaccccgagggggccctgtggtga

SEQ ID NO: 23963 - RNA, 9879 nt, synthetic construct
  misc_feature 1..9879: note = derived and/or modified CDS sequence (opt11) from DENV-1__JN819403__SS-prME
  source 1..9879: mol_type = other RNA
agcgttaccatgctcctcatgctcctccccactgctctcgcttttcatctcacgacccggggtggggaaccccacatgatcgtaagcaaacaggaacggggtaaatccttgttattcaagaccagcgcaggggtgaacatgtgcacccttatcgccatggacttaggggagctctgcgaggacactatgacctacaaatgcccccagatcaccgaggccgagcctgatgacgtggattgctggtgcaatgctacagacacctgggtcacctacgggacatgcagccagacgggcgagcatcgccgggacaagcgctctgtcgccttagcgccccacgtgggtctggggctcgagacccgcacagagacctggatgtcctccgagggcgcgtggaagcagatccaacgcgttgagacctgggccctgcgccaccccggttttacagtcattgccttattcttagcacacgccatcggcactagcataacgcaaaaggggattatcttcatcctgctgatgctcgtaaccccgtccatggccatgcgctgtgtaggcatcggcaaccgggacttcgtggaaggcctcagcggggcgacttgggtggacgtcgtacttgagcacgggtcttgcgtgactaccatggccaagaacaaacccaccctcgatatcgagctgctgaagacggaagtaaccaaccccgcgatcttacgcaaactctgcatagaagcgaaaattagcaacacaactacagacagtcggtgcccgacccagggcgaagccaccctggttgaggaacaagacgccaactttgtgtgcagacgcactttcgtcgatcgcggctgggggaacggctgcggcctcttcggcaaagggagtctgctcacgtgcgccaagttcaaatgtgtgaccaagctcgagggcaagatcgtgcagtacgaaaatctgaagtattcagtcatagtgaccgttcacaccggcgaccagcaccaggtcgggaacgagaccaccgagcacggcaccatagctacaattacaccccaggcccctacgagcgagatacaattgacggactacggggccctgaccctggactgctcaccccggaccggcctggactttaacgagatggtactcctgacgatgaaggagaagtcctggctggtacacaagcagtggttcctcgacctgccattgccctggacttcaggggccagtaccagtcaagagacatggaaccgccaggatctcctcgtgacttttaagaccgcccacgcgaagaaacaagaggtggtagtgctggggagccaggagggcgccatgcacactgccttaaccggagccacagagattcaaactagcggcaccaccaccatattcgccgggcacctgaaatgccggttaaagatggataagctcacgctaaaggggacatcatacgtgatgtgtaccggatctttcaaactggagaaagaggtcgcagagacgcagcacggtaccgtactggtgcaggtcaagtatgaaggtaccgatgccccctgtaagataccattctccactcaggacgagaagggggtaacccaaaacggtaggttgatcacagccaatccgatcgtgacggacaaagaaaagcccgttaacattgagaccgaacctcccttcggggagtcctacatagtagtgggggccggtgaaaaagccctgaagctgtcctggttcaaaaagggaagctccatcggtaagatgtttgaggcaacggcaagaggggcacgccgcatggccatcctcggggacaccgcgtgggacttcgggagcatcggcggtgtttttacctccgtagggaaactggtgcaccaagtcttcggcacggcctacggtgtactgttcagcggcgtgtcctggacaatgaagatcggtatcggcatattgctgacgtggctggggctgaactcccgcagtacctctttaagcatgacttgtattgctgtagggatggtaacgctgtacctcggcgtgatggtacaggccgatagcgggtgtgttatcaactggaagggccgcgagttaaagtgcggttccggcatcttcgtgacaaacgaagtacacacctggaccgagcagtataagttccaggcggattccccgaagcggctttcggctgcaatcggtaaagcctgggaagaaggcgtgtgcggtatccgctccgccacccgtctcgagaacattatgtggaagcaaatctctaacgaactgaaccacatcctgttagagaacgacatgaagttcacggtggtcgtgggagatgccaacggcattctggcccaggggaagaaaatgatccgaccacaaccaatggagcacaaatattcctggaaaagttggggtaaggccaagatcattggcgccgacatccaaaataccaccttcattatcgatggccccgacaccccggaatgccccgacaatcaacgagcttggaacatctgggaggtggaggactacggcttcgggatcttcactaccaacatctggctgaagctcagggacagttacacccaaatgtgtgaccacagactgatgagcgcggccataaaggattcaaaggccgtgcatgccgacatgggttactggattgagtctgaaaagaacgagacttggaaactggctcgcgcgagcttcattgaggtgaagacgtgtacctggccaaagtcacacacactgtggtcaaatggcgtgttggagagcgagatgataataccaaagatctacgggggaccgatctcccagcacaactaccgacccgggtacttcacccaaacggccggtccctggcacctcgggaaactagagctggatttcgatctgtgcgaaggcaccaccgtcgttgtagacgaacactgcggcaatcgcggtccgagcctccgcaccacaacggttaccggcaagatcatacacgagtggtgctgtcgctcatgcactctaccgcccttacgattccgcggggaagatggctgctggtatgggatggaaattcgtcccgtaaaggagaaggaggagaatctcgtgcgctcgatggtctccgccgggagcggcgaggtagattcgttcagtctggggatcctgtgcgccagtattatgatcgaagaggtgatgaggtctcgatggagcaggaagatgctcatgacaggtacgctggccgtatttctgctcctaataatggggcagctgacctggaacgacctcatacgcctatgtatcatggtgggcgcgaatgcctccgatcgcatgggaatgggcactacgtatctggccctgatggccactttcaagatgcggccaatgtttgcggtgggtctcctttttcgccgattgacgagccgagaggtcctgctcttaactattgggctctccctggtggcgagtgtggagctgcccaactccctcgaggagctgggagacggtctcgccatgggcatcatgatgctgaagttgctcaccgagttccagccgcaccagctctggaccaccctgttgtcgctgaccttcatcaagacgactctatccctcgactacgcctggaagaccaccgcaatggcgttgtccatcgtctcacttttccccctgtgccttagcacgacctcccagaaaacgacctggctgccggtgcttctgggctcgtttggctgcaaaccgttaacaatgtttttaataacggagaacaagatatggggtagaaagtcctggcccctgaacgagggcatcatggccattggcatcgtcagcattctgctctcatcgcttctcaaaaacgacgttcccctagccgggccgttgatcgcaggcggcatgctgatagcctgctacgtgatcagtgggagtagcgcggacttaagtttggagaaagcagccgaggtctcttgggaacaagaggcagagcacagtggcactagccacaacatcctggtggaggtgcaagatgacgggacgatgaagatcaaggacgaggagcgtgacgacaccttgacgattttactgaaggctaccctcctcgcggtgtcgggcgtgtatcctatgagcatcccagccactctgtttgtgtggtatttctggcagaagaagaagcaacggtccggagtcctctgggacaccccctcaccgccagaagtagagcgcgccgtgctagacgatggcatttatcgtattctgcagcgcggcctgctcggccgatcccaggtcggagtgggcgtgttccaagacggcgttttccacacgatgtggcacgtgacccgcggggccgtgttaatgtatcagggcaaacggctggagccttcctgggcttccgtcaagaaagatcttatcagttacgggggaggctggaggttccaggggagctggaataccggcgaagaggtccaggttatcgcggtcgagccaggaaagaacccgaagaacgtgcaaaccacaccaggcacattcaaaacccccgagggcgaggtgggggccatcgctcttgacttcaagcctggcacatccgggtcccccatcgttaacagggagggcaaaatcgtgggcctctatggaaacggcgtggtgacaacctctgggacctacgtgtcagccatcgcccaggcgaaggcctcgcaggagggccccctacccgagatcgaggacgaggtatttaagaaacgcaatctgaccattatggaccttcatccagggagcggtaaaacgcgtcgctacctccccgcgatcgtccgagaggctatcaagcggaagctgcggacacttatcttggcgcccacgcgcgtcgtcgcctccgagatggccgaggccctgaagggtatgcctatccgatatcagactaccgctgttaagagcgagcacactgggcgagagatagtggacttaatgtgccatgcgaccttcaccatgcgcctactgtccccggtgagagttcccaactacaacatgattatcatggacgaggcgcacttcacggatcccgcaagcatcgcagcacgaggttacattagcacccgcgtggggatgggtgaggcggccgccatcttcatgactgccacgcctcccgggtcagtggaggccttcccccagtccaatgcggtcatccaggacgaggagcgcgatatccccgagcggagctggaacagtggctatgactggataacggacttccccgggaagacggtgtggttcgtgccttccatcaagtccggcaacgacatagcgaattgcctacgcaagaacggcaagcgggtcatccagttatcgcgaaaaaccttcgacacagaatatcagaagactaagaacaacgactgggactacgtggtgaccaccgatatctcggagatgggtgccaacttccgggccgaccgagtcatcgacccccgtaggtgtctgaagccagtcatacttaaggatggacccgagagagtgatcctggcaggtcccatgcccgtcaccgtggcgtctgccgcccagagacggggccgcattggccggaaccaaaacaaggaaggggatcagtatgtatatatgggccagcccctgaacaacgatgaggatcacgcccactggacggaggccaagatgctgctcgacaacatcaatacccccgaaggtatcatccctgccttattcgagcccgaacgcgagaagtcggccgcgatcgacggcgagtatcgcctgcgcggagaggcacgcaagaccttcgtagagctaatgaggcgcggtgacctgcctgtttggctgtcctacaaagttgcatccgagggcttccagtatagcgaccggcgttggtgcttcgacggtgagcgtaacaaccaagtgctcgaggagaatatggatgtggaaatctggaccaaagagggtgagcgtaagaaattgcggcccagatggctggacgcccgaacgtactctgacccgttagcactgcgcgagttcaaagagttcgccgcagggcggagatccgtcagtggtgacctgatcctagagattgggaagttaccccaacaccttacgttgcgggcgcaaaacgcactggacaacctggtgatgctacataactccgagcagggcggaaaagcctaccgccacgcaatggaagaattacccgacaccatcgaaaccctgatgttgctcgcgttgatagccgttttaacagggggcgtcacgctatttttcctttcagggaaaggcctcgggaagacctcgatcgggctactgtgtgtgaccgccagtagtgcgttattatggatggcatcagtcgagccgcactggatagcggcgagtattattctagagttcttccttatggtattgctgattccggagcccgaccgccagcgtacaccgcaggacaaccagctggcctacgtggtaatcgggctgttatttatgatccttaccgtcgctgcgaacgagatgggattactggaaaccaccaagaaggacttaggaatagggcacgtggctgccgagaaccaccaacacgccacgatgctggatgtcgacctgcggccggcctctgcctggacactctatgcggtcgccaccacagtgatcactcccatgatgcgtcacacgattgagaacaccacggcaaacatcagcctgaccgccatcgccaatcaggcagcgatcttaatgggactcgacaagggctggcccataagcaaaatggacatcggagtgcccctgctggccctcgggtgctactcccaagtcaacccgctgaccctgacagcggcggtgctcatgttagtcgcccattacgccataatagggcccggcttacaggctaaggccacccgtgaggcacagaagcgcaccgccgctggaatcatgaagaatcccacagtcgacggcatcgtggcgatcgaccttgaccctgtagtgtatgacaccaagtttgagaagcagttaggccagatcatgcttctcatactatgcacaagtcagatccttctaatgcgcaccacgtgggccctgtgcgaatccataacactggcgaccgggcccctcactacgttatgggagggcagtcccgggaaattttggaataccaccatagcggtttccatggcaaacattttccggggcagctacctggccggcgcaggcttagcgttctccttgatgaagtccctagggggaggccggaggggaaccggggctcaaggcgagacactcggcgagaagtggaagcgtcagttgaatcagctgtccaaaagcgagttcaacacctacaagcggtccggcatcatggaggtggacaggtccgaggccaaggagggcctcaagcggggcgagaccaccaagcacgccgtttctcgcggcaccgcgaagctacgatggtttgtagagcggaacctagtgaagcccgagggcaaagttatagatcttggctgcggacgtggcgggtggtcatactactgcgccggcctgaagaaggtgaccgaagtgaaggggtataccaaaggcggtcccggacacgagggcccgatccccatggcgacctacggctggaatttagtaaaattacattctggcaaggatgtcttcttcatgccgccggagaaatgcgatactctcctgtgcgacataggggagtccagcccaaatcctacgatcgaggagggccgcactctacgcgtgctcaagatggtcgagccctggctgagaggcaaccaattttgcataaaaattttaaatccctacatgccgtccgtggtcgagaccctcgaacaaatgcagcgcaagtatggcggtatgttagtgcgcaatcctctgtcccgcaattccacccacgaaatgtactgggtgtcttgcggtactgggaacatcgtatccgctgtaaatatgaccagtcgcatgcttctgaaccggtttacaatggcgcatcgcaagccaacatacgaacgcgacgtggaccttggcgccgggaccaggcacgtagcagtcgagccagaggtggccaatttagacatcattggtcagcgcatcgagaacataaagaacgagcataagtcgacttggcactatgatgaggacaacccgtacaagacctgggcttatcacggctcgtacgaggtgaaacccagtgggagcgcttccagcatggtcaacggcgtagtgcggctgctgaccaagccgtgggacgtcattccgatggtgacccagatcgcgatgaccgacaccaccccctttggccagcagcgggtgttcaaggaaaaggtggatacgcgaacgccacgggcgaagagaggcactacccagatcatggaagtgacagccaagtggttgtggggattcttgtcaagaaataagaaaccacggatctgcacccgcgaggagttcacaagaaaagtccggagcaacgccgccatcggagcggtgttcgtggacgaaaaccagtggaacagcgcgaaggaggccgtcgaggacgagcggttctgggatttggtgcaccgggaacgggaactccacaagcaaggcaagtgtgcaacctgcgtctataacatgatgggtaagcgcgagaagaagctgggggagttcggcaaggctaaggggtcgagagccatctggtacatgtggctgggggcccgctttttggagttcgaagccttagggttcatgaacgaggaccactggttcagtcgggagaactccctgtccggtgtcgagggcgaggggctccataagctggggtacatcctacgcgacatctcgaagatcccgggcggaaacatgtatgccgatgacaccgcgggctgggacacccggatcaccgaggacgatctccagaatgaagcgaagatcactgatattatggaaccggagcacgccctcctggccacgagcatcttcaagctaacataccaaaacaaagttgttagagtccagcgcccagcgaaaaacggaaccgttatggacgtcatctcccgacgcgaccagcgcggctcagggcaggtagggacctatggtctgaatacgttcaccaacatggaggtgcagctgatacgccagatggaatccgaagggattttcttgccctctgagcttgagacccccaaccttgcggagcgggtgcttgactggcttgagaagcacggggcagagcgcctgaagcggatggcaatctccggtgacgactgcgttgttaagcccatcgacgaccgcttcgccactgcccttaccgcgcttaatgacatgggcaaagtgcggaaagatatcccacaatgggagcccagcaaggggtggaacgattggcaacaagtcccgttctgctcccaccatttccatcagctgatcatgaaggatggtagggagatcgtggtgccttgtagaaaccaggatgaattggtcgggcgcgcccgggtgagccaaggagccggctggtccctgagggaaacagcatgccttggcaaatcatacgcgcagatgtggcagctcatgtacttccatcgtcgcgacctccggttggctgcgaacgccatctgttccgccgtgccggtagactgggttcccaccagccgcaccacctggagcatccacgcgcaccaccagtggatgacgaccgaggatatgctctctgtgtggaaccgggtgtggatcgaggagaacccctggatggaagacaagacccacgtgagctcgtgggaggaggtgccctacctaggaaagcgcgaggaccaatggtgcggctctctaatcgggctcaccgcccgcgccacgtgggcgaccaacatccaggtcgccatcaatcaggttcggcgcttaatcggcaacgagaactacctggattacatgacctctatgaagcggttcaaaaacgagtctgacccggagggggcgctctggtag

SEQ ID NO: 23964 - RNA, 9879 nt, synthetic construct
  misc_feature 1..9879: note = derived and/or modified CDS sequence (opt11) from DENV-1__KF973453__SS-prME
  source 1..9879: mol_type = other RNA
agcgtgacgatgctgctgatgctgttacccaccgcgcttgccttccacctgaccacccggggtggcgagccccacatgatagtgagcaagcaggagcggggcaagagcctcctgttcaagacctcggctggggtgaacatgtgcactctcatagccatggatctgggcgaactctgtgaggataccatgacgtataagtgtcctcaaatcaccgaggccgagcccgacgacgtggactgctggtgcaacgcgaccgacacctgggtgacctacgggacctgcagccaaaccggcgagcaccgccgggacaagcgctccgtggctttggcgccccacgtgggcctggggctcgaaacgcggacggagacctggatgagctccgaaggcgcctggaagcagatccagcgcgtcgagacctgggccctgcggcaccccgggttcacagtgattgcccttttcctcgcgcatgccatcggcaccagtattacccagaaagggatcattttcatcctgcttatgctcgtgaccccctccatggccatgcggtgcgtaggcataggcaaccgggacttcgtggaggggctgagcggcgccacttgggtggacgtagtgctggagcacgggtcctgcgttaccaccatggccaagaacaagcccaccctagacatagagctgctgaaaacggaggtcaccaacccggctattctcagaaagctgtgcattgaggccaagatctccaacactaccacggattcccggtgcccgacccagggcgaggcgaccctggtagaggaacaggacgccaacttcgtgtgccgccgaacctttgtcgaccgcggctggggtaacggctgcggcctcttcggcaagggtagcctgctgacgtgcgccaagttcaaatgcgtcaccaagctcgagggcaagatcgtgcagtacgagaatttaaagtactccgtcatagtaaccgtgcacaccggcgaccagcaccaggttgggaacgaaaccaccgagcacggtaccatcgcgaccatcacgccccaagcccctacgagcgaaatccagcttaccgactacggagctctgaccctggactgtagcccccgtaccggcttggacttcaacgagatggtgctcctgacgatgaaggagaagtcctggctggtccacaaacaatggtttctcgacctgcccctgccctggaccagtggggccagcacctctcaggagacctggaatagacaggatttgctggtgacttttaagaccgcccacgcgaagaagcaggaggtcgttgtcttagggagccaggagggcgccatgcacacagccctcactggggccacggagatccaaaccagcggcactaccacgatcttcgccggacacctgaagtgccgcctgaagatggacaagctgaccctgaaaggaacatcctacgtcatgtgcaccgggagcttcaaactggagaaggaggtcgcagagacgcagcacggcactgtgctggttcaggtcaagtacgaaggcaccgacgcaccctgcaaaattcccttctctacccaggacgagaagggggttacgcagaacggcaggctgatcaccgcgaacccgatcgtgaccgacaaggagaagcccgtcaacatcgaaaccgagccgcctttcggggagagctacatcgtggttggcgcaggggaaaaggccctgaaactttcatggttcaaaaagggcagcagtatcggaaagatgtttgaggccacagcccgcggcgcccgccggatggcgatactcggcgacactgcgtgggacttcgggagcataggcggcgtcttcacctccgtggggaagctggtacaccaggtcttcggtaccgcctatggggtgctgttcagcggcgtatcctggacgatgaagatcgggatcggtatcctgctaacctggctcggcttgaacagccgttccaccagcctctccatgacctgcatcgcagtcggaatggtgacgttgtacctcggagtgatggtccaggccgacagcgggtgtgtgataaactggaaaggccgcgagctgaaatgcgggtcaggtattttcgtgaccaacgaggtccacacgtggaccgagcagtacaagttccaggccgacagcccgaagcggctgagcgcggctataggcaaagcctgggaggaaggggtgtgcggtatccgcagcgccacccggcttgagaacatcatgtggaagcagatcagtaacgaactgaatcacatcctgctcgaaaatgacatgaagttcacagtggtggtcggggacgcgaacggcatcctggcccaagggaagaagatgatccgcccccagcctatggaacataagtatagctggaagagttggggaaaggccaagatcatcggcgccgacatccagaacaccacgttcatcatcgacgggcctgacacccctgagtgtcccgacaaccagcgggcatggaacatctgggaggtggaggactacggcttcgggatctttacgaccaacatctggctgaagctccgcgactcgtacacccagatgtgcgaccaccgactgatgtcggcggccatcaaggactccaaggcagtccacgccgatatgggctactggatcgagagcgagaagaacgagacgtggaaactcgcacgcgcgtccttcattgaggtgaagacgtgcacctggccaaagagccacaccctctggtcaaacggtgtgctggagtccgagatgatcatccccaagatctacgggggcccgatctcccagcacaactaccggcccgggtacttcacccaaacggccggcccctggcatctggggaagttagagcttgacttcgacctttgcgagggcactaccgtcgtggtggacgagcactgcggcaatcgcgggccaagtctccggacgaccacggtcactggcaagatcatccacgagtggtgctgccgctcctgcaccctcccgcccctgcggttccgcggggaggacggctgctggtacgggatggagatccggcccgtaaaggaaaaggaagagaacctcgtgaggagcatggtctcggccggctcaggcgaggttgatagcttctccctgggaatcctgtgcgcgagcatcatgatcgaggaggtgatgcggagccgctggagccggaagatgctcatgacgggcaccttggccgtcttccttctccttatcatggggcagctgacctggaacgatctcatccgcctgtgcatcatggtgggcgcgaacgcctccgacagaatggggatgggaaccacttacctggccctcatggccaccttcaagatgcggccgatgttcgccgtggggctgctgttccgccggttgacatctcgcgaggtcctgctgctcactatagggctgtccttggtggcgagcgtggagctccctaattccttagaggagctgggcgacgggttggccatgggcattatgatgctgaagctgcttacggagttccagccccaccagttgtggacgaccctgctaagcctgaccttcatcaagacgaccctctctttggactacgcctggaagaccaccgccatggcgctgtcaatcatctccctgttccccctctgcttaagcacgacctcccagaagaccacatggctgccggtcctcctgggcagcttcggatgcaagccgctgaccatgttcctcattacggagaacaagatctggggacggaagtcgtggcccctgaacgaggggatcatggctattggcatcgtcagtatcctgctctccagcctgctgaagaacgacgtccccctcgcagggccgctgatcgctggcggcatgctaattgcctgctacgtaatctcaggctcctccgcggacctctccctggagaaagccgctgaggtaagctgggagcaagaggcagagcactccggcaccagccacaacatcctggtcgaggtgcaggacgacgggaccatgaagatcaaggacgaggagcgcgacgacaccctgactatcctgctgaaggccaccttgctggcggtgtccggtgtctatccaatgagcatccccgccaccctgtttgtgtggtacttttggcagaagaagaagcagcggtccggggtgctgtgggacacccccagccctcccgaagtcgagcgcgccgttctggacgatggcatataccgtatcctgcagcgcggactgctcgggcggagccaggtgggcgtcggggtgtttcaggacggcgtgttccacacgatgtggcacgtcactcgcggggctgtgctgatgtatcaaggcaagcggttggaacccagctgggcttcagtgaagaaggacctaatcagctacggcgggggctggcgcttccaggggtcctggaacaccggcgaggaggtccaggtgatcgcggtggagcccgggaagaaccccaagaacgtccagacgacgcccggcacgtttaagacacccgagggcgaggtgggggccatcgccttggacttcaagcccgggacaagcggttccccgatcgtgaaccgggagggtaagatcgtcggcctctatggaaacggcgtcgtcacgaccagcggcacctacgtctccgccatcgcccaggcgaaagccagccaggagggccctttgcccgagatcgaggatgaggtgttcaagaagaggaaccttaccatcatggacctgcacccggggagcggcaagacccggcgctacctccccgcgatcgtccgggaggccatcaagagaaagctccggacactaatactcgcgcccacccgtgtcgtagcttcggagatggccgaggccctgaagggcatgcccatccggtatcagaccacggccgtcaagtcggagcacaccgggcgggagattgtcgatctgatgtgtcacgccacctttaccatgcgcctcctgagccctgtgcgggtgccgaactacaacatgatcatcatggacgaggcccacttcacggatccggccagtatcgccgcccgcggctatataagcacccgggtcgggatgggcgaggcggcggccatcttcatgaccgccacgccacccgggagtgtggaagccttcccccagtccaacgcggtgatccaggacgaggagcgcgacatccccgagcgttcttggaactctgggtacgactggatcaccgacttcccaggcaagaccgtatggttcgttcccagcatcaagtccgggaatgacatagccaactgcctgcgcaaaaacgggaagcgggtgatccaactcagccgcaagaccttcgacacggagtatcagaagacgaagaacaacgactgggactacgtcgtgaccaccgacatcagtgagatgggggccaacttccgggccgacagggtgatcgacccacggcgctgcttaaaacccgtcatcctgaaggacggccccgagcgggttattttggcggggccgatgcccgtcacggtcgccagcgcagcccagcgccggggccgcatcggccgcaaccaaaacaaggagggggatcagtacgtgtacatgggccagcctctgaacaacgatgaggatcacgcccactggaccgaggcgaagatgctgcttgacaacataaacacccccgaggggatcatcccggcactgttcgagccagagcgcgagaagagtgccgccatcgacggagagtaccgtctccgcggggaggcccgcaagaccttcgttgaactcatgcggcgcggtgacttgcccgtgtggttgtcgtacaaggtcgcgtccgagggcttccagtacagcgaccggcgctggtgcttcgatggggagcggaacaaccaggttctcgaagagaatatggacgtggagatatggaccaaggaaggagagagaaagaaactgaggcccaggtggctggacgcccggacatacagtgacccgctcgccctgcgtgagttcaaggagttcgctgctgggcggcgctccgtaagcggcgacctaattctcgaaatcggcaagctgccccagcacctgacgctccgggcgcagaacgccctagacaacttggtcatgctccacaactccgagcagggcggtaaggcctaccgccacgccatggaggagctgcccgataccatcgagactctgatgttactggcgctgattgccgtgctcaccgggggcgtgacgctgttcttcctgagcgggaagggcttaggcaagacctccatcgggttactgtgcgtcacggccagctccgctctcctgtggatggccagcgtagagccccactggatcgctgcctccatcatcctggagttcttcctcatggtgctgctcatccccgagcccgatcggcagcgcacaccccaggacaaccagctagcctacgtcgttatcggcctcctgtttatgatcctaacggtggccgccaacgagatgggcctgctcgagaccaccaagaaggacctcggcatcgggcacgtagcggcggagaaccaccagcacgccaccatgctggacgtggacttgcggcctgctagcgcctggacgctctacgcggtggcaaccacagtcattacccccatgatgagacacacgatcgagaacaccacggccaacatctcacttaccgccatagcgaaccaagcggccatcctgatgggactggacaaggggtggcctatcagtaagatggacatcggtgtcccgctgctggccctcggctgctattcccaggtcaatccactgactcttaccgccgcggtcctcatgttggtggcacactacgcgataatcggaccaggactgcaggctaaggccacccgggaggcgcagaagaggaccgccgccggcatcatgaagaaccccacagtggacggcatcgtcgccatcgacctcgaccccgtggtatacgacaccaagttcgagaagcagctgggccagatcatgctgctcatcctctgtacctcccagatcctgctcatgcgcacgacgtgggccctgtgcgagtccatcaccctggcgaccgggccgctcaccacgctgtgggaaggttctccggggaagttctggaacaccacaatagccgtctccatggccaacatattccgcggcagctacctggccggcgccgggctcgcgttctccctgatgaagtccctgggagggggcagacgggggaccggcgcccagggcgagacacttggggaaaaatggaagcgtcagttaaaccaactgtccaagtccgagttcaacatctacaagagaagcggcattatggaggtggaccgctccgaggccaaggagggtctcaagcggggcgagaccaccaagcatgccgtgagccgcgggacggcgaagctccggtggttcgttgagcgcaacctagtgaagcccgagggcaaagtaatcgatctcggctgcgggcggggcgggtggtcctactactgtgccggcctcaagaaagtcacagaggtgaaggggtacacgaagggcggccccgggcacgaggaaccgatccccatggccacttacggctggaacctggtaaagttgcacagcgggaaagacgtcttcttcatgccccctgagaaatgcgacaccttactgtgtgacatcggagagtccagcccgaaccccaccatcgaagaggggcgcactctgcgtgtactcaagatggtggagccctggctccgcggcaaccaattctgcatcaagattcttaacccgtacatgccatccgtcgtggagaccctcgagcaaatgcaacggaagtacggcgggatgctggtgcgcaaccccctgagccggaactccacccacgagatgtactgggtgtcgtgcggcaccgggaacattgtatcggccgtgaacatgacgtctaggatgctcctgaaccggtttaccatggcccaccgcaagcccacatacgagcgcgacgtcgaccttggggctggcacccggcacgtggccgtggagcccgaagtcgccaacctggacatcatcgggcagcgcatcgagaacatcaaaaatgagcacaagtcgacgtggcactacgacgaggacaatccgtataagacttgggcctaccacggctcctacgaagtgaagccctccgggtcggcctcaagcatggtgaacggggtagtgcgtctgctgactaagccatgggacgttattcccatggtcacccagatcgcgatgactgacactactcccttcgggcagcagcgcgtgttcaaggagaaggtagacacccggacaccccgcgcgaaaaggggcaccacccagatcatggaggtgaccgccaagtggctctggggcttcctttcccgtaacaagaagccacggatctgcacgcgcgaggagttcacccgcaaggtgaggtcaaacgccgcgataggggcagtcttcgtggatgagaaccagtggaacagcgctaaggaagccgtggaagacgagcgattctgggacctagtccaccgagagcgggagctccacaaacagggtaagtgcgcgacatgcgtttacaacatgatggggaagcgagagaagaagctgggcgagttcgggaaggctaagggttctcgggctatttggtatatgtggctgggcgcccgctttctggagttcgaggccctgggtttcatgaatgaggatcactggttcagccgggagaactccctgagcggcgtggagggggaaggcctccataaattagggtacatcctcagagacatctcgaagatcccgggcggcaacatgtacgctgacgacaccgcgggctgggacacacggatcaccgaggacgacctccagaacgaggccaagatcaccgacatcatggagcccgaacacgccctgctagccaccagtatcttcaagctgacgtatcaaaacaaggtcgtgcgcgtgcagcggcccgccaagaacggcaccgtcatggacgtgatctccagacgtgaccaacgggggtcaggccaagtgggcacctacgggctaaacacctttaccaacatggaggtccagctgattcgccagatggagtccgaaggcatcttcctccccagcgagctggagaccccgaacctggctgagcgagtgctcgactggctggagaagcacggagccgaaaggctgaagcggatggccatatccggcgacgactgcgtggtgaagcctatcgacgatcgcttcgccacagccctaacagcgctgaatgacatggggaaggtgcggaaggacatcccccagtgggagcccagcaagggctggaacgactggcaacaggtcccgttttgttcccaccacttccaccagcttataatgaaagatgggcgcgagatcgtcgttccctgccgcaatcaggacgagctcgtggggcgcgcccgggtcagccaaggcgccgggtggtcccttcgagagaccgcctgcctgggaaagagctacgcccagatgtggcagcttatgtacttccaccggcgcgaccttcggttagcggccaacgcgatctgctccgctgtgcctgttgactgggtccccacgagcaggaccacctggtctatccacgcccatcaccagtggatgaccaccgaagacatgctgtccgtgtggaaccgggtgtggatcgaggagaacccgtggatggaggacaagacacacgtcagctcctgggaagaggtcccctacttaggcaagcgcgaggaccagtggtgcggcagcttgatcggcctgaccgcccgagccacctgggccacgaacatccaggtggcgataaaccaggtccggcgcctcatcgggaacgaaaactacttggattacatgactagcatgaagcggttcaagaatgagagcgatcccgagggggcgctctggtaa

SEQ ID NO: 23965 - RNA, 9879 nt, synthetic construct
  misc_feature 1..9879: note = derived and/or modified CDS sequence (opt11) from DENV-1__KF973454__SS-prME
  source 1..9879: mol_type = other RNA
agcgtcaccatgctcttgatgcttctgcccacagccctcgcttttcacctgacaaccagaggtggggagccgcacatgatcgtgagcaagcacgagcggggcaagagcctgctgtttaaaacctcgaccggggtgaacatgtgcaccctgatcgcaatggatcttggcgagctctgcgaggacacaatgacctacaagtgcccccgcatcacagaagccgagcccgacgacgtggactgctggtgcaacgccacggatacctgggtgacttacgggacgtgtagccagacgggagagcaccggcgcgataagcggtccgtagccctggctccccacgtgggtctggggctcgaaacacgcaccgagacctggatgtcctccgagggcgcgtggaagcaaatccaacgggtggagacgtgggccctgcgccatcccgggttcaccgtgatcgccctgttcctcgcccatgcgataggcactagtatcacccagaaggggattatatttatcctgttgatgctcgttacgccctcaatggccatgcgttgcgttggcatcggcaaccgcgacttcgtggaggggcttagcggcgcaacctgggtggacgttgtgctggaacatgggtcctgcgtgaccaccatggctaagaacaaacccacgctagacatcgagctgctgaagaccgaggtcaccaaccccgccgtgctccggaagctgtgcatcgaggctaagatcagcaacaccacgaccgactcacggtgcccaacccaaggcgaggccacccttgtggaggagcaggacgccaacttcgtctgccggcgcacgctcgtggaccggggctggggtaacgggtgcgggctgttcggcaaggggagcctgctaacgtgcgccaagttcaagtgcgtcaccaagcttgagggcaagatcgtccagtacgagaacctcaaatactccgtaatagtcaccgtccacacgggcgaccaacaccaggtggggaacgagaccaccgagcacggcaccatagctaccatcacgccccaggctcctaccagtgagatccaacttaccgactacggggccctggccctggattgctcaccgcggaccggtctggacttcaacgaaatggtcctgcttacgatgaaggagaagtcctggctcgttcataagcagtggttcctggacctacccctgccctggaccagcggagcgagcaccagccaggagacctggaaccggcaagacctgctggtgacgtttaagaccgcacacgcgaagaagcaggaggtcgtggtcctcggcagccaggagggtgccatgcacactgctcttaccggggccacggagattcagaccagcgggaccaccaccatttttgccgggcacctaaagtgccgcttaaaaatggacaagctaaccctgaagggtacctcttatgtcatgtgcaccgggagcttcaaactggagaaggaagtggcggagacgcagcacggcaccgttctcgtacaggtgaagtacgagggtactgatgccccctgcaaaataccgttctcgacccaggacgagaagggggtgacgcaaaacggccgtctgatcaccgccaacccgatcgtcaccgacaaggagaaacctgtcaacatcgagactgagcctcctttcggtgagagctacatagtagtcggcgcgggcgaaaaggcgttgaagctgtcctggttcaagaaggggagcagcatcggcaaaatgttcgaggccactgctcgcggggcccgacgcatggcaatcctgggggataccgcgtgggacttcggaagcatcgggggagtcttcacctccgtggggaagctggtccaccaagttttcggtaccgcctacggagtcctattcagcggcgtctcctggactatgaagatagggatcggcatcctactgacctggctcggcctgaattctcgatccaccagcctgtcaatgacatgcatcgcagtggggatggtgacgctctacctcggcgtcatggtgcaggccgacagcggatgcgtcataaactggaagggtcgtgagctgaagtgcgggtcaggcatctttgtcaccaacgaggttcacacctggaccgagcaatacaaattccaagcagacagcccgaagcgcctcagcgcggccatcggtaaggcctgggaggagggcgtttgcggtatccggtccgccacgcgcctggagaacattatgtggaagcagattagcaacgagctcaaccacatccttttagaaaacgacatgaagttcacggtcgtggtaggagacgccaacggaatcctggcgcaggggaaaaagatgatccggccccaacccatggaacacaagtattcctggaaatcctgggggaaggcaaagatcatcggcgctgacatacagaacaccaccttcatcatcgatgggcccgacaccccggagtgccctgacgaccagcgcgcctggaacatctgggaggtcgaggactacggcttcgggattttcacgaccaacatctggctcaagctgcgggactcctacacccagatgtgcgatcaccgcttaatgagcgcagccatcaaggactccaaggccgtgcacgctgacatgggctactggatcgagagcgagaagaacgagacctggaagctcgcgagagcgtccttcatcgaggtgaagacgtgcacctggcccaagagccacaccctgtggtccaatggcgtccttgagagcgagatgataataccaaagatttacgggggtccgatttcccagcacaactaccgccccgggtacttcacccagacggccggaccctggcatctggggaagttagagctggacttcgacctctgtgaaggcaccaccgtggtggtcgacgagcactgcggcaaccggggaccgagcctacgcaccacgaccgtgaccggcaagattatacacgaatggtgctgtcggagctgtaccctgccgcccctccgcttccgaggggaggacggctgctggtacgggatggagatacgccccgtgaaggaaaaagaggaaaacctagtccgatccatggtgtccgcgggcagcggagaggtagactcattctccctggggatcctctgtgtcagcatcatgatagaagaggttatgcgctcccggtggtcgcgcaagatgctgatgacgggcaccctggcagtgttcctactgctgatcatgggacagctcacctggaacgacctgatacgtctgtgcatcatggttggcgccaacgcctccgaccgaatggggatgggcacgacgtacctcgcattgatggccacatttaagctgcgcccgatgtttgccgtaggcatcctcttccggcgtctgacgagccgggaagtgctgctcttaaccatcggtctgagcctcgttgccagcgtagaattacccaactccctggaggagctaggggacggtcttgcaatgggtattatgatgcttaagctcctgacggaattccagccacaccagctgtggaccaccctcctgagcctcacttttatcaagacgacgttatccttggactacgcctggaagactaccgccatggccctgagcatcgtctccctcttccctatatgcctgagcacgacgtcccagaagaccacgtggctgccggtgctcctgggctcttttgggtgtaagcccctgaccatgtacctcatcaccgagaacaaaatctggggccgcaagtcctggcccatcaacgaggggatcatggccatcggcatcgtgagcatcctgctgtccagcctcctgaagaacgacgtccccctggccggtccgctcatcgctggcggcatgctgatagcctgctacgttatctctgggtccagcgcagatctgtccctcgagaaggcggctgaggtgagctgggagcaagaggccgagcactccggcaccagccacaacatcttggtcgaagtccaagatgatgggaccatgcggattaaggacgaggagaaggacgacaccctgaccatcctcctcaaggccaccctgctagccgtctccggcgtctaccccatgagcatacccgctaccctgttcgtgtggtacttctggcagaagaagaagcagcggtcgggggttctgtgggacaccccgagcccgcccgaagtcgagagagccgtgttagacgacgggatctacaggatcctgcagcggggcctgctgggacgcagccaagtaggcgtcggggtgttccaggacggcgtgtttcacaccatgtggcacgttacccggggggcggtgctcatgtaccagggcaaacgcctggaacctagctgggcctccgtgaagaaggacctgataagctacggcgggggctggcgcttccaggggtcctggaacaccggcgaggaggtccaggtcatcgcagtggagcccgggaagaatcccaaaaacgtacagaccacaccgggcactttcaagaccccggaaggcgaagtgggggcgatcgccctagacttcaaacccggcaccagcggaagcccaattgtgaaccgcgagggcaagatagtcggcctttacggtaacggcgtggtaaccaccagtgggacatacgtctccgctatcgcccaggccaaggcaagccaggagggccccctgcccgagatcgaagacgaggtattcaagaagcggaacctcaccatcatggacctgcacccgggcagcggcaagacgagacggtacttaccagcaatcgtgcgcgaggccatcaagagaaaactcagaaccttgatcctggccccgacccgcgtcgtggcgtccgaaatggcggaggcccttaagggcatgcccatccgctaccagactacggctgtcaagagcgaacatactgggcgcgagatcgtcgacctgatgtgtcacgcaaccttcaccatgcggttactcagcccggtgcgcgttcccaactacaacatgatcattatggatgaggcgcacttcaccgatcctgccagcatcgccgcccgtggctacatatccacccgcgtcgggatgggcgaggctgcggctatcttcatgaccgccacgcctcccgggtctgttgaagctttcccccagtccaacgccgttatccaggacgaggagcgggacatccccgagcgcagctggaattccggctacgattggataacggacttccccggtaagaccgtctggttcgttcctagcatcaagtccgggaacgacattgcgaactgcctgcggaagaacggaaagagggtgattcagctgagccgcaagaccttcgataccgagtatcagaagacaaagaataacgactgggactacgtcgtgaccaccgacatctccgaaatgggggccaactttcgcgccgaccgggtcatcgacccccgccggtgtttaaagcccgtcattctgaaggacggcccagagcgcgtgatcctcgcaggccctatgccagtcaccgtcgcaagcgccgcccagaggaggggacggatcggccgcaaccagaacaaagaaggtgaccagtacgtgtacatgggccaacccctaaacaatgacgaggatcacgcacattggacggaggccaagatgctgcttgacaacatcaacactcccgagggaatcatcccggcccttttcgagcccgaacgcgagaagtccgccgccatcgacggcgagtaccgactgcgcggggaggcccggaagaccttcgtcgagctgatgcgccggggcgatctgcccgtgtggctgagctataaggtggcgtccgagggcttccagtacagcgaccggcggtggtgcttcgacggggagcgcaacaatcaagtcctggaggaaaacatggatgtggagatctggacaaaggaaggggaacgaaagaaactccgcccgcgatggctggacgcgcgaacctatagcgaccccctggccctcagagagtttaaagaattcgccgcggggcgccggagcgtgagcggcgatctgatcctggagatcggcaagctcccccagcatttgacgctgcgcgcgcaatcagcgctcgataacctggtcatgctgcacaacagcgagcaaggcggaaaggcctatcgtcacgccatggaggagctccccgacaccatcgagaccctgatgttgctcgccctgatcgcggtcctgaccgggggcgtcatgctgttcttcctgagcgggaaaggcctaggaaaaacgtcgattgggctcctctgcgtcaccgcctccagcgcgcttctctggatggcctctgtggagccacattggatcgccgcgtcgatcatcctcgagttcttcctgatggtgctcctgataccggagccggaccgccagcgcacgccccaagacaaccaactggcttacgtcgttatcggcctccttttcatgatcctgaccgtggccgcgaacgagatgggactcctggagacaacaaagcgagatctgggcatcgggcacgtcgcagcggagaaccatcaacacgccaccatgttagacgtcgatctgcggccagcctccgcctggaccctgtacgccgttgccacgaccgtcatcacccctatgatgcgccacaccatcgagaacacgaccgcgaacatcagcctcaccgcgatcgccaatcaggcggcgatcctgatgggcctggacaagggatggcccatatctaagatggacatcggggtgccgttgctggctctgggatgctacagccaggttaacccgctcaccctgactgccgccgtcctgatgttagtggcgcactacgccatcatcgggcccggcctgcaggctaaggccacccgcgaagcccagaaacggaccgcggctgggatcatgaagaaccccaccgttgatggaatcgtcgccatagacctggaccccgtagtatacgacgccaagttcgagaagcagttaggtcagataatgttgctgatcctttgcacaagtcagattctgctcatgcgtaccacttgggccctctgtgagagcatcacgctggcgacgggccccctgaccactctgtgggagggctcccccgggaagttctggaataccacgattgccgtcagcatggccaacatcttccgggggtcctatctggccggcgccgggctggctttcagcctcatgaagtccctgggcggagggcgcagagggaccggcgcccagggcgagaccttgggggaaaaatggaagcgtcagctcaaccaattaagcaagcccgaattcaatacctacaaacggtcgggtatcatggaggtggaccgctccgaggccaaggaggggctgaaacggggcgagacgaccaagcatgcggtgagccgggggaccgcgaagctccggtggtttgtcgagcgcaacctggtgaagcccgagggtaaggtgatcgacttgggctgtgggcggggggggtggtcctactattgtgccggcctaaagaaggtcaccgaagtgaaagggtatacaaagggcggccctggtcacgaggagcctatcccaatggccacgtacggctggaacctcgtgaagttacatagcgggaaggacgtgtttttcatgcccccggagaagtgcgacaccctgctctgcgacatcggcgagtccagcccgaatccaacaattgaggaggggagaacgctgcgggtgcttaagatggtcgagccctggctccgaggcaaccagttctgcatcaagatcctgaatccgtatatgccctccgtcgtggagacgctagagcagatgcagcggaagcacggcggcatgctcgtgcggaaccccctttcaagaaacagtacccacgagatgtattgggtcagctgtggcaccgggaacatcgtgtccgctgtgaacatgacctcaagaatgctgctcaaccgcttcacgatggcccaccgcaaacccacctacgagcgcgacgtcgacctgggcgcggggacccggcacgttaccgtagagccggaagtcgctaaccttgacatcatcgggcaacgcattgaaaacatcaagaacgagcacaagtccacgtggcattacgacgaggacaacccctacaaaacctgggcttaccacggctcatacgaggtaaagcccagcgggtctgcatcctctatggtcaatggtgtagtgcggctcctgaccaaaccctgggacgtcatcccgatggtcacacagatcgcgatgacggacaccacgcccttcgggcaacagcgcgtgttcaaggagaaggtagacacccgcacgccccgtgcgaagcggggcaccacccagatcatggaggttaccgccaagtggctgtggggattcctctcccgcaataagaagccgcggatctgcacgagggaggagttcacgaggaaagtgaggagcaatgccgctattggtgccgtcttcgtggacgaaaaccagtggaacagcgctaaggaggccgtagaagatgagcggttctgggacctggtccatcgcgagcgggagctgcataagcaaggcaagtgcgcgacctgcgtatacaacatgatggggaagagagagaagaagctcggcgagttcggcaaggccaagggctcccgggcgatctggtatatgtggctgggtgcacgcttcctggagttcgaagccctcgggttcatgaacgaggaccactggttcagccgggagaactccctaagcggtgtcgagggggagggcctgcacaagctcgggtacatcctgcgtgatatctccaagatccccggaggcaacatgtatgcggatgacaccgccgggtgggacactagaatcaccgaagatgatctgcagaacgaggcaaagatcacggatattatggagcccgagcacgccctcctggccacaagcatcttcaagttgacgtaccagaacaaggtcgtgagagtgcagcgccccgcgaagaatggcaccgtcatggacgtgatcagtcgccgcgaccagcgggggagcggccaggtgggcacctacgggctgaacacattcacgaacatggaggtccagttaatcagacagatggaatccgagggcatcttcctgccttctgagctcgagaccccaaacctggccgagcgggtgctggactggctggagaagcacggggctgagcgtcttaaaaggatggccatcagcggcgatgactgcgtcgtcaagcccatcgacgatcgcttcgccaccgcgctgacggccttgaacgacatggggaaggtgcggaaagacattccccagtgggaaccgagtaagggctggaacgactggcagcaggtcccgttttgctcccaccacttccaccaactaataatgaaggacggtcgcgagatcgtcgtgccctgccggaatcaagacgagctggtggggcgcgcgcgggtcagccagggcgccgggtggagcctccgggagacggcatgtctgggtaagagctacgcccagatgtggcagttgatgtacttccaccgccgcgatctccggctggccgcgaacgccatctgctccgccgtacccgtcgactgggttccgaccagccgtactacctggtcgatccacgcccaccatcagtggatgaccaccgaggacatgctgtccgtttggaaccgcgtgtggatcgaggagaacccttggatggaggataagacccacgtcagctcctgggaggaggtgccctaccttgggaagagggaggatcagtggtgcggcagcctgatcgggctgaccgctcgcgccacctgggccaccaacattcaagtggccattaaccaggtccggcgcttaatcggtaacgagaattacctggactacatgacctccatgaagcggttcaaaaacgaatccgacccggagggcgtgctgtggtga

SEQ ID NO: 23966 - RNA, 9879 nt, synthetic construct
  misc_feature 1..9879: note = derived and/or modified CDS sequence (opt11) from DENV-1__KF973455__SS-prME
  source 1..9879: mol_type = other RNA
agtgtcacaatgcttctcatgctcctacccacggcattagcatttcacctcacaactcgcggaggggaacctcacatgattgtctcaaaacacgaacgcggcaaatctctgctatttaaaacatcgaccggcgtaaacatgtgtacactaatcgcaatggacttaggagaactgtgcgaagacacgatgacctacaaatgcccacggatcacggaagccgagccggatgacgtagactgctggtgcaacgctacagacacctgggtcacgtacgggacatgcagccaaaccggcgaacacagaagggataaacgaagcgtcgcactcgcgccccacgtaggtctggggctagagactagaaccgagacgtggatgtcgtcggagggggcgtggaaacaaatccaaagagtcgagacgtgggcattacggcatccaggcttcacagtcatagcgttatttctagcgcacgccataggcacaagcataacgcagaaagggatcatatttattttactgatgctcgtgaccccaagtatggcaatgagatgtgtgggcatcggcaacagagacttcgtggaggggctaagtggagcaacctgggtcgacgtcgtcctagagcacggctcgtgcgtgacaaccatggccaaaaataaaccgactttagacatcgagctcctaaaaaccgaagtaactaaccctgcagtactcagaaaattatgcatcgaggccaaaatcagcaatacaacgacagatagtaggtgccccactcaaggcgaagcgaccctagttgaagaacaagacgccaattttgtctgtaggcgaaccctcgtcgaccgcggctggggaaacggatgtgggctattcggcaaaggatcgctactaacatgcgcaaaattcaaatgcgtaactaagctggaagggaaaatcgtgcaatacgaaaacctcaaatatagtgtgatagtaacggtccacaccggagatcaacaccaagttggtaatgaaacaactgaacacggaacgatagccacgatcacacctcaggcaccaacatcagagatacaactaacagattacggtgctctcgcgctcgattgtagcccgcgaacaggactcgacttcaatgaaatggtgctcctcaccatgaaagagaagtcatggctggtccataaacaatggttcctagatctaccccttccctggacgtcgggggctagcacctcccaagaaacatggaaccggcaagacctacttgtcacgtttaaaaccgcccacgcgaagaaacaagaagtcgtagtcctcgggagccaggagggcgcaatgcatactgccctaaccggcgcaacggagatccagacatcgggaacgaccacaatcttcgccggccatctaaagtgccgcttgaagatggataaactcacactaaaaggcacaagctacgtcatgtgcacagggagtttcaagctagagaaggaggtggcagaaacacaacacggcactgtgctggtccaagtaaagtacgagggaacagacgcgccctgcaagataccattcagcacccaagacgaaaaaggtgtaacacaaaacggccggctaataacagcgaacccaatagtgaccgacaaggagaagccagtgaacatagaaaccgagcctcccttcggggaatcctatattgtcgtcggcgcgggggagaaagcactaaaactctcgtggttcaagaaaggctcaagcataggaaaaatgttcgaggcaacagcaagaggtgcgcgcaggatggccatcctcggcgatacggcctgggactttggatccatcgggggcgtcttcacctcagtagggaaattggtccaccaagtgttcggcacagcatatggagtactcttttcgggcgtcagctggacaatgaaaatcgggatcggaatccttctcacgtggctcgggctaaacagcaggagcacaagccttagcatgacatgtattgctgtaggaatggtaacactataccttggcgtgatggtccaagccgactcagggtgcgtaatcaactggaaaggcagagaacttaaatgcggcagcggcattttcgtgaccaacgaagtacacacctggacagagcaatataaattccaggcagattccccaaaaaggctctcagcagctattgggaaggcctgggaagaaggtgtctgcggaatccgaagcgcaacccgactcgaaaatataatgtggaagcaaatatccaatgagctcaatcacatactcctcgaaaacgatatgaaattcaccgtggttgtaggcgatgctaacggaatactagctcaaggtaagaaaatgatacgcccacagcccatggaacacaaatacagttggaaaagctggggtaaggctaagatcatcggagcagacatccagaataccaccttcataatagatggcccagatacgcctgagtgcccggacgaccaacgcgcatggaacatatgggaagtagaggactacgggtttgggatctttactacaaatatatggctaaaactgcgagactcgtatacacaaatgtgcgaccaccggctgatgtccgctgcaatcaaagactctaaggctgtgcacgcagatatggggtactggatcgaatccgagaaaaacgaaacttggaagctggcacgtgcttcttttatagaggttaaaacatgcacctggccaaaatcgcatactctttggtccaacggtgtactcgaaagtgagatgatcataccgaagatttacggagggcctatatcacaacacaactacagacccggatacttcacccagacagccggcccctggcatctaggaaagctagagttagatttcgacctatgcgaaggcacaacagttgtagtagatgagcattgtggtaatcgcggcccctcactacgaactacaaccgtaaccggcaagataatacacgagtggtgttgcagaagctgcacgttacccccgctaagattccgcggagaagatgggtgctggtatgggatggaaatccgtccggtaaaagagaaggaggaaaacctcgtaagatcaatggtaagtgcgggctccggagaagtagactcgttttccttaggtattctctgcgtctcgatcatgatcgaagaggtgatgcgctcaaggtggtctcggaaaatgcttatgacaggaacattggccgtcttcctcttactcatcatgggacagctcacgtggaacgatctcatccgcctgtgcatcatggtgggagctaacgcctcggaccgaatgggcatgggcacaacctacttggccctcatggctacatttaagctaaggccgatgttcgcggttggcatactgttccgccgtctcacgagcagagaggtgctgctcctgaccatcgggctgagcttagtagctagtgttgaactaccgaacagcctagaagaactaggagatggcctagccatgggaatcatgatgctcaaattgctcacggaatttcagcctcatcaattatggactacgctactctctctgacgttcatcaagaccacactctcccttgattacgcatggaagaccactgcaatggctctgagcatcgtgtccctattcccgatatgcttaagtaccaccagccagaaaacgacctggttacccgtcctcctcggtagctttgggtgcaaaccactaaccatgtacctgatcacggagaataagatctggggccggaaatcctggccgatcaatgaaggcataatggccataggcatcgtctccatactactttcgtccctcctcaaaaacgatgtcccgctggcaggacccctcattgccggcggcatgctcatagcatgctacgtaatctccgggtcatcggcagacttgtccctcgaaaaggcggccgaagtctcatgggaacaagaagctgaacatagcggcaccagccataatatcttggtagaagtccaggacgacgggaccatgcgcataaaggacgaggaaaaggacgacacgctcacaatccttctcaaagccacattgctcgccgtgtccggagtctaccctatgagcattcccgcaactctcttcgtctggtacttctggcagaagaagaaacaacgatcgggcgtactctgggacacaccatccccgcccgaggtcgaacgggcagtcctcgacgatggaatataccgaatcctacagcgaggcctactcggaagaagtcaagtcggcgtaggcgtctttcaagacggagtgttccacactatgtggcacgttactcggggcgccgttctcatgtaccaaggaaagaggctcgaaccctcctgggcctcagtgaaaaaggatttgatttcatacgggggcggatggcggtttcaaggaagctggaacacaggcgaggaggtacaagtgatcgcggtcgaaccaggcaaaaaccccaagaatgttcagaccacaccaggcaccttcaaaaccccggagggggaggtgggcgccatcgccctagatttcaaacccggtacatccggcagccccatagtaaaccgtgaaggaaaaattgtaggcttgtacgggaacggagtagttacaacatcagggacgtacgtcagcgcaatagcacaagcgaaagcgtcgcaagagggaccactgccagaaatcgaggacgaagtcttcaagaaacgcaatcttaccatcatggacctacatccaggatccggcaaaactcgtcgatatctgccggcaatagtaagggaagccattaaaagaaagctaagaacattgatactagcaccaacccgagtggtcgccagcgagatggcggaggcattaaaaggaatgccaatacgctaccaaaccaccgccgtgaaaagcgaacacacaggtcgagagatagtagacctcatgtgccacgcaacgttcaccatgcgacttctatccccggtaagagttccaaattacaacatgattatcatggatgaagcacacttcacagacccggccagcatagcagcaagagggtacatatccacgcgagtgggaatgggagaagccgctgcaatatttatgactgcgactcccccgggctcagtggaggcatttccgcaatctaacgcagtaatacaggacgaggaacgcgacattcccgaacgatcatggaacagtggatacgattggataacggactttccgggcaaaacggtttggttcgtaccgtcaataaagagcggcaacgacatagcaaactgcttacgcaaaaatgggaagagagttatccaactgtcgagaaaaacgttcgacacagaataccagaaaactaaaaataacgactgggattacgtggttaccactgatatcagtgagatgggcgccaacttccgagcggacagagtaatagacccaagacgatgcttaaagccggtcatacttaaagacggaccggaacgcgtcatccttgcgggtccgatgccggtaaccgtggcgagtgctgcgcagcgtcgaggtaggataggacgaaatcagaacaaggaaggggaccaatacgtatatatgggacagcccctgaataacgacgaggaccatgcccattggacggaagcaaagatgttactcgacaacatcaacacgcccgaaggcatcatccccgcgctatttgaacccgaacgggaaaagagcgccgcgattgacggagagtacagacttcgtggagaagccagaaaaactttcgtggagctcatgcgacggggcgacctaccggtgtggctgtcgtataaagtggccagcgagggcttccagtatagcgatcgaaggtggtgtttcgacggggaaaggaataaccaagtactcgaggagaatatggacgtcgaaatctggacaaaggaaggggagcgcaaaaagctgcggccccggtggctagatgctcgaacttattcggaccctttggcactccgggagttcaaagaatttgccgccggtcgtcgctcagtatctggggacctgatcctagagatcggcaaattgccacaacacctcacactacgtgcgcaaaacgcgcttgacaacctagtgatgcttcacaacagcgaacaaggcggaaaagcatatcgacatgcaatggaagaactacccgacacgatcgaaaccctcatgctcctagcgctgatcgctgtcctaacaggtggagtaatgctattcttcctctcgggcaagggtttaggtaaaaccagtatcggtctactctgcgtaactgcctcatcagccctactgtggatggcctcagtagagcctcactggatcgcagcgtcaatcattctagagttctttctgatggtactcctaatacctgaaccagatcgacaacgaacgccgcaagacaaccaactagcatacgtagtcataggactcttgttcatgatcctcactgtcgcagccaacgaaatggggttattagaaaccaccaaacgggacctaggcatagggcatgttgccgccgaaaaccaccagcacgcgacaatgctagacgtagaccttcatccagcaagcgcctggacgctgtatgcagtcgcaacaaccgtgatcacgcctatgatgaggcatacaatcgagaatacaactgcaaacataagccttacagcaatagcgaatcaagcagcaatactcatgggcctagacaaaggttggcctatcagcaaaatggacataggggtacccttattggcgctcggatgctatagccaagtcaacccattaacactgaccgccgcggtcctgatgctcgtagcacactacgcaatcataggtccaggcctccaggcgaaggccaccagagaagcccagaagaggaccgcagcaggcatcatgaagaatcccacggttgacggaattgtagctatagacctcgacccggtggtctacgacgccaaattcgaaaaacaactcgggcagatcatgctactcatactgtgtacatcccaaatcttacttatgaggaccacctgggccctgtgcgaatccataaccctggcgaccggaccactgactaccctctgggaaggttcgccgggaaaattctggaacaccacaatagccgtaagcatggccaacatattccgcggcagctacctcgccggagcaggcctcgccttttctttaatgaaatcactaggaggaggcaggcggggcacgggcgcgcaaggggaaaccctcggtgagaagtggaaacggcaattaaaccaactctcgaagccggagttcaatacatacaagcgatcggggataatggaagtcgatcgcagcgaagcgaaagaaggcctaaagcgtggagagacgaccaaacatgcggtctcgcgcggcacagcgaaacttcgttggttcgtcgaaagaaacttggtaaagccggaaggaaaagtaatagacttgggatgcggacgcggcggatggagctactattgcgcaggactcaagaaagtaacagaagtcaaaggctacacgaagggcggtccgggacacgaagaaccaattccaatggcaacctatggatggaacctcgtcaagctgcactcggggaaagacgtattctttatgccgccggaaaagtgcgacacgttactatgtgatataggtgagtcatcgcccaacccgaccatagaggaaggcaggaccctaagagtcttgaaaatggttgaaccctggctacgcggaaatcaattctgcattaaaatattaaacccctatatgccatcggtcgtcgaaacactcgaacagatgcaacgaaaacacggagggatgctggtgagaaatccactctcacgcaactctacccacgaaatgtattgggtgtcctgcggcacaggaaatatagtctccgcagtcaacatgaccagccgaatgctgctaaaccgattcactatggcacaccgaaaacccacctatgaacgagacgtggacttaggcgcaggaacgagacacgtcaccgtggagcccgaggttgcaaacttggacatcataggtcaacgcatcgaaaacatcaaaaatgagcataaaagtacttggcactatgacgaggacaatccctacaagacctgggcctaccacgggtcttacgaggtaaaaccgtccggctccgcttcgagcatggtgaacggcgttgtgcgattgctaaccaaaccatgggatgtcataccgatggtcacccagatagccatgaccgatacaacgcctttcggacagcagcgagttttcaaggaaaaagtggacacaagaacaccccgcgccaagcggggaaccacccagatcatggaagtaaccgcaaagtggctgtggggattcctttcacgcaataaaaagcccaggatctgcacccgcgaagagtttaccaggaaggtacgatcaaacgccgctattggcgctgtgtttgtagacgaaaatcagtggaactcggccaaggaagccgtagaggacgagcgcttctgggacttagtgcaccgcgaacgcgagctacacaaacaaggtaagtgcgcaacctgcgtctacaatatgatggggaaacgcgaaaagaaactaggagagttcggcaaagccaaaggaagtagagccatctggtatatgtggttaggggcgagattcctagaatttgaagcactagggttcatgaacgaggaccactggttctccagggaaaactcccttagtggcgtggagggcgaaggattgcacaagttgggttacatcctgagagatataagcaagatcccgggcggaaacatgtacgccgacgatacggcgggctgggacaccaggataacagaagatgacctacagaacgaggcgaagattaccgacatcatggagccagaacacgccctcttagccacctcaatcttcaaactaacatatcaaaacaaagtcgtacgagtacagcggcccgccaaaaacggcaccgtcatggacgtaatatcacgcagagaccagaggggctccggccaggtgggcacatatggcctcaatacgttcacaaacatggaagtacagctcatcaggcaaatggaatcagaagggatcttcctgcccagtgaactagaaacacccaacttagcagagcgggtattggattggctagagaagcacggggccgagcgattgaaaagaatggcaatcagcggcgacgactgcgtggttaaacccattgacgacagattcgccactgcactaaccgcgcttaatgatatgggaaaggtgcggaaagacataccacagtgggaaccctcgaaaggttggaacgactggcagcaagtccccttttgttcacaccactttcaccagctgataatgaaggacggccgagagatagtcgtcccgtgtagaaaccaggacgaattggtaggcagggcgagagtgtcgcagggagcaggctggtcactgcgagagacagcctgcctggggaaaagttacgcccaaatgtggcaactcatgtacttccatcgccgggatctccgcctagcagctaacgccatttgctctgccgtgcccgtcgactgggtgccaacgagcaggaccacctggtccatccatgcccaccaccaatggatgactaccgaagacatgctatcggtgtggaaccgtgtatggatagaggagaatccatggatggaagacaaaacgcatgtcagcagctgggaagaggtgccatacctaggaaaaagagaggaccagtggtgcggaagcctaatcggactcacagcaagggcaacctgggcaaccaatatacaagtggcgataaaccaagtccggcgcctaatcggcaacgaaaactatttagactacatgacaagcatgaagaggttcaagaacgagtcagacccagaaggcgcactttggtag

SEQ ID NO: 23967 - RNA, 9879 nt, synthetic construct
  misc_feature 1..9879: note = derived and/or modified CDS sequence (opt11) from DENV-1__KF973456__SS-prME
  source 1..9879: mol_type = other RNA
agtgtgacaatgctcctcatgctcctgccaaccgccctggcgttccatctaaccacgagggggggagagccgcacatgatcgtgagcaagcacgaacggggcaagtctctcctcttcaagaccagcaccggggtgaatatgtgcaccttgatcgccatggacctgggcgagctttgtgaggacaccatgacttacaaatgtccccgcatcaccgaagccgagccagacgacgtggactgctggtgtaacgcgacggacacctgggtcacctacgggacctgctcacagacgggcgagcaccggagagacaagcggtccgtggccctggcgccccacgtgggcctggggctcgagaccagaaccgagacttggatgagctccgaaggcgcgtggaagcagatccagcgcgtggagacttgggcccttcgtcacccagggttcaccgttatcgccctgttcctcgcccacgcgatcgggaccagcatcacccagaaggggatcatctttatcctgctgatgctcgtgacgccttccatggctatgcggtgtgtcgggatcggaaaccgggacttcgtggaggggctgagcggtgccacctgggtggacgtagtgctggagcacgggtcctgcgtgaccactatggccaagaacaagcctacactcgacatcgagctgctgaaaaccgaggtaaccaatcccgccgttctccggaagttgtgcatcgaggcgaagatcagcaacaccacgaccgactcccgctgcccgacccagggcgaggccacccttgtggaggaacaggacgccaacttcgtatgccgtcgtaccctcgtggaccgcgggtgggggaacggctgtggattattcgggaaaggcagcctgctgacctgcgccaagtttaaatgcgtgacaaaactggagggtaaaatcgtccagtacgaaaacctgaaatactccgtgatcgtgaccgtccacacgggtgaccagcaccaggtggggaatgagaccaccgagcacggaaccatcgccaccatcacgccccaggcccccaccagcgagatccagctcaccgactacggggccctggcccttgactgtagccccaggaccggcctcgacttcaacgaaatggtccttctgacaatgaaggagaagtcctggctcgtgcacaagcagtggttcctcgacctgccgcttccctggacctctggtgctagcaccagccaggagacctggaaccggcaagatctgctggtgacgttcaagacagcccacgccaagaagcaggaggtcgtggtgctcggctcccaggagggcgcaatgcacacagccctgaccggggccacggagatccaaaccagcggcacgaccacgatctttgccggccacctgaagtgccgcctcaagatggataagctgaccctgaaaggcacttcctacgtcatgtgcaccgggtcgttcaagctggagaaggaggtggctgagacgcagcacggcacggtgctcgtccaagttaaatacgagggcaccgatgccccctgcaagatccccttctcgacccaggacgagaagggggtgacgcagaacggccggctgatcaccgccaacccgatcgtcacggacaaggagaagcccgtcaatatcgaaaccgaaccgcctttcggtgaatcgtatatcgtggtcggcgcgggagagaaggcgctgaaactatcctggttcaagaaggggtccagtatcggcaagatgttcgaggccactgctcgcggggcccgaagaatggccatcctgggcgacacggcgtgggactttgggagtatcggcggcgttttcacctcggtggggaagctggtacaccaggtgttcggcaccgcctacggggtcctcttcagcggcgtttcctggactatgaagatcgggatcggcatccttctgacctggctcggtctgaatagccgctccacctcgctgtccatgacctgcatcgcggtgggaatggtaacgttgtacctaggcgtcatggtgcaggcggacagtgggtgcgtgattaactggaagggccgggagctgaagtgcggttccggcatcttcgttaccaacgaggttcacacctggactgaacagtacaagttccaggcggacagcccgaagcgcctcagcgccgccatcggcaaggcctgggaggagggggtgtgcggcatccggtccgcgactcgcctggagaacatcatgtggaagcagatcagcaacgagctgaaccacatcctcctggagaatgacatgaagttcacggttgtggtgggggacgccaacggcatcctagctcaggggaagaagatgatccggccccagcccatggaacacaagtactcctggaagtcctggggcaaggccaaaatcatcggcgccgacatccaaaacaccaccttcatcatcgatgggcccgacacccccgagtgccccgatgaccagcgcgcgtggaacatctgggaggtcgaggactacggcttcgggatcttcacgaccaacatctggttaaagctgcgggactcgtacacccagatgtgcgaccatcgcctaatgagcgcggccatcaaggacagcaaggccgtgcatgccgatatgggctactggatcgagagcgagaagaacgaaacctggaagctcgcccgggcgtccttcattgaggtcaagacgtgcacctggcccaagagccacaccctgtggtcaaacggcgtcctggagagcgagatgatcatccctaagatatacggaggcccgatctcccaacacaactatcgccccggatacttcacccagacggccggcccctggcacctcggaaagctggagctggacttcgacctctgcgaaggcaccaccgtagtggtcgacgagcactgtggtaaccgggggccgagccttcgcacgacgaccgtgaccggcaagatcatccacgagtggtgctgccgctcctgcaccctcccgcccctgcgcttccgcggcgaggacgggtgctggtacggtatggaaatccgccccgttaaggagaaggaggagaacctggtccggagcatggtgtccgccggcagcggggaggtcgacagcttctccctggggattctctgcgtctcaatcatgattgaggaagtgatgcgctcacggtggagccgcaagatgctgatgacgggtaccctggctgttttcctcctgctgattatgggccaactcacctggaatgatctgatacgcctgtgtatcatggtgggcgccaacgcttccgaccggatgggcatgggcaccacgtacctcgccctgatggccacgttcaagctgcgccccatgttcgccgtgggcatcctcttccgccgcttgacgagccgggaggtactgctcctgaccatcgggctgtccctcgtcgcctcagtggagctgcccaattccctggaggagctcggcgacggactggcgatgggcatcatgatgctcaagctcctgacggaattccagccccaccagctatggacgacgctcctaagcctgacctttatcaaaactaccctctccctggactacgcttggaagaccaccgccatggcccttagcatagtcagcctcttccccatttgcctgagcacaacctcccagaagaccacgtggctgccggtgcttctgggctcttttgggtgcaaacccctgaccatgtacctcatcacggaaaacaagatctggggtcgcaagtcctggcccatcaacgaggggatcatggcgattggcatcgtcagcatcctgctgtcaagccttctgaagaacgacgtccccctggccgggccgctaatcgccggcggcatgctgatagcctgctacgtgatcagcgggtcctcagccgacctgtcccttgagaaggcggccgaggtgagctgggagcaagaggccgagcactcgggcacaagccacaacatcctggtcgaggtacaagacgacggcaccatgcgtataaaggatgaggagaaagacgacaccctgacgatcctcttaaaggccaccctgctcgccgtctccggcgtctaccccatgagcataccggcgaccctcttcgtgtggtacttctggcagaagaagaagcagcgcagcggagtgctatgggacaccccctcaccgcccgaggtcgagcgggccgtgctcgacgacgggatctaccgcatcctgcagcggggcctgctggggagaagccaagtgggcgtcggggtgttccaagacggcgtctttcacacgatgtggcatgtcaccagaggggctgtgctcatgtaccaaggcaaacgcctggagccaagctgggcctcggttaagaaggacttgatcagttacggcggcggctggcggttccaagggtcttggaacacaggagaggaagtccaggtgatcgccgtggaacccgggaagaaccccaagaacgtgcaaactacgccaggcacctttaaaacacccgagggagaggtgggggcgatcgcgctcgactttaagcccggcacctctgggtcccctatagtgaaccgcgaggggaagatcgtcggcctgtacgggaacggcgtggtgacaaccagcgggacctacgtctccgccatcgcccaggccaaggccagccaggaggggccgctgcccgagatcgaggatgaggtgttcaaaaagcggaatctcaccatcatggacttgcaccctggtagcggcaagacgcgccgatatctgccggcgatcgtgcgcgaggccatcaagagaaagctccgcaccttgatcctggcgcccacccgcgtcgtggcctccgagatggcggaggccctcaaggggatgcccatcagataccagaccacggccgtcaagagcgagcataccggtcgcgagatcgtagacttaatgtgccatgccaccttcactatgcggctgctctccccggtgagagtgcccaactacaacatgatcatcatggacgaggcgcatttcacggaccctgcctccatcgccgcccgggggtatatttccacgcgagtcgggatgggcgaggctgcggccatcttcatgactgccactccgcccgggagcgtggaggccttcccccagtccaacgccgtgatccaggatgaggagcgggacatcccagagcgctcatggaactccggctacgactggataacggatttccccgggaagacagtatggtttgtgcccagcattaaatccgggaacgacatcgcgaactgcctgcggaaaaacggcaagagagtgatccagctgagccgaaagaccttcgacaccgaataccagaagactaagaataatgactgggactacgtcgtgaccacggacattagcgaaatgggggccaacttccgcgccgaccgggtaatcgacccccgccggtgtctgaaaccagtcatcctaaaggatggccccgaacgcgtgatccttgccggcccgatgcccgtcaccgttgccagcgccgcccagcgacgcggccggatcggccgcaatcagaataaggaaggcgaccagtacgtctatatgggccagcccctcaacaacgacgaggaccacgcacactggacagaggcaaaaatgcttctggacaacatcaacacccccgaagggatcattccggccctcttcgagcccgagcgcgaaaaatcggctgctatcgacggcgaataccgcctgcgcggggaggcccggaagaccttcgtcgagctgatgcgccgaggcgatctccccgtttggctgtcatacaaggtggcctccgagggcttccagtactccgaccgtcggtggtgcttcgacggggagcgcaacaatcaggtactggaggaaaacatggacgtggagatctggacaaaagagggagagcggaagaagctccgaccacggtggctggacgcgcgcacctactccgacccgctagccctcagagagttcaaggaattcgccgccgggagacgcagcgtgtcgggcgacctgatcctggagatcgggaagctcccccagcacctgacgctgcgtgcccagaacgcgctcgataacctggtcatgctgcacaactctgagcagggcggtaaagcctaccggcacgccatggaggagctccccgacaccatcgagaccttaatgctgttagccctgatcgcggtgctgaccgggggcgtcatgctgttctttctgtctgggaagggcctgggtaagacgtccatcgggctgttatgcgtgaccgccagctccgccctgctctggatggcgagcgtggagccccattggatagctgcgtctatcatcttagaattctttctgatggtgctcctgatcccggagcccgaccgccagcggacgccccaagacaatcagctcgcctacgtcgtgattggcctcctgttcatgatcctgacagtggcggccaacgaaatggggctcctggagactaccaagcgcgacctggggatcggccacgtcgccgcggagaaccaccagcacgccaccatgctggacgtggatctgcggccggccagcgcgtggaccttatatgccgtggcgacgaccgtcatcactcccatgatgcgccacactatcgagaacactaccgccaacatctctctcacagccatcgccaaccaggccgcgatcctgatgggcctggacaagggctggcccatcagcaagatggacatcggtgtacccttactcgccctggggtgctattcccaggtgaatccgctcaccctgacggccgccgtcctgatgctagtggcacactacgccatcatcgggcccggcctgcaggccaaggccacccgtgaggctcaaaagcggaccgcagcggggatcatgaaaaaccccaccgtggacggtatcgtggccattgacttagaccccgtcgtgtacgatgcgaagttcgagaagcagctcggtcagatcatgctgctgattctctgcacgagccagatcctgctcatgcgcactacctgggccttgtgcgagtccataaccctggcgacggggccgctgaccactctttgggagggaagccccgggaaattctggaatacgactatcgccgtctccatggccaatatattcaggggcagctacctggccggtgctgggctggcgttctccctcatgaagtccctgggcgggggcagacgggggaccggcgcccagggcgagaccctgggggagaagtggaagcgccagctcaaccaactgtccaagcccgagttcaacacctacaagcggtccggaattatggaggtagaccgcagcgaggccaaggaaggcctgaagcggggggagactaccaagcacgccgtatcccgcgggacagccaagctccggtggtttgtcgagcgcaatctggtgaagcccgaaggcaaggtgatcgacctgggctgtggtaggggcggctggagctactactgcgccggtctgaagaaggtgaccgaggtgaaggggtacaccaagggcggcccggggcacgaggagcccatccccatggccacatacggatggaaccttgtgaagctgcactccgggaaggatgtcttcttcatgcccccggagaaatgcgacaccctgctctgcgatatcggcgagagcagccccaaccctaccattgaggagggacgcaccctgcgggtgcttaagatggtggagccctggctccgcgggaatcagttctgcatcaagatcttaaacccgtacatgccgagcgtcgtggaaacactagagcaaatgcaacggaagcacggcgggatgctcgtgcgcaaccccctgtcccggaacagcacgcatgagatgtactgggtgtcctgtggcaccgggaacatcgtgagcgccgtgaacatgacgtccaggatgctgctcaaccggttcacgatggcccaccggaagcccacatatgagcgcgacgtagacctgggggcgggcacccggcacgtgaccgtagaacccgaggtcgccaatctagacataattggccaacgcatcgagaacatcaaaaatgagcacaaaagcacgtggcactacgacgaggataacccctacaagacctgggcataccacggcagctacgaggtgaagccgagcgggtccgccagctccatggttaatggggtcgtgcgtctcctgaccaagccgtgggacgtcataccgatggtgacccagatcgccatgaccgataccacccccttcgggcagcagcgcgtattcaaggagaaagtcgacaccaggacaccccgagcgaagcggggcaccacccagatcatggaagtgacagccaagtggctgtgggggtttctcagccggaacaagaagcctcggatctgcacgcgcgaggagtttacccggaaggtgcgcagcaacgccgccatcggcgccgtcttcgtggacgaaaaccaatggaactcagcgaaggaagccgttgaggacgagcggttctgggatctcgtccaccgcgagcgggagctgcacaagcagggcaagtgcgcgacctgcgtttacaacatgatgggaaagcgcgagaagaagctcggcgagttcgggaaggccaagggtagccgggcaatctggtacatgtggctgggcgcccgcttcctggagttcgaggccctcggtttcatgaacgaagaccactggttctccagagagaacagcctaagcggtgtggagggggagggcctgcacaagctcgggtacatcctgagggacatcagcaagatccccggcgggaacatgtacgccgacgacaccgccgggtgggacacgcgcatcacagaggatgacctgcagaacgaagcaaagatcaccgacatcatggaacccgagcacgccctcttggccacctccatcttcaagttaacctaccagaataaagtcgtgcgggtgcagcgccccgccaagaacggcaccgtcatggacgtaatcagccggcgcgaccagcgtgggtccggccaggtcggcacctacgggctcaacaccttcacgaacatggaggtccaattgatccgtcagatggagtcagagggcattttcttgccgtccgagttagagacgcccaacctggccgagcgggtgctggattggctcgagaagcacggggcggagcgcttgaaacggatggccatctcaggcgacgactgcgtggtcaagcccatagacgaccgcttcgccaccgccctgaccgccttgaacgacatggggaaggtgcggaaggacatcccccaatgggagccatccaagggctggaacgactggcagcaggtgcccttttgctcacaccatttccaccagctgatcatgaaagacggccgcgagatcgtcgtgccctgccggaaccaggatgagctagtggggcgcgcgcgagtctcccagggggccgggtggagtctccgcgagaccgcctgcttaggcaaatcctatgctcagatgtggcaactaatgtacttccaccggcgagacctacggctcgccgcgaacgccatatgtagcgccgtgcccgtggattgggtcccgacgtcccggaccacctggtcgatccacgcccaccaccagtggatgaccaccgaggacatgctgagcgtatggaacagggtgtggatcgaggaaaacccgtggatggaggataaaacccacgtgtccagctgggaggaggtaccctacctcgggaagcgggaggaccagtggtgcggcagtttaatcggcctgaccgcccgtgcgacgtgggcaacgaacatacaggtggccatcaaccaggtccggcggctcatcggtaatgagaattacctggattacatgaccagcatgaagcggtttaagaacgagtctgatcccgagggggcgctgtggtga

SEQ ID NO: 23968 - RNA, 9879 nt, synthetic construct
  misc_feature 1..9879: note = derived and/or modified CDS sequence (opt11) from DENV-1__KF973459__SS-prME
  source 1..9879: mol_type = other RNA
agcgtgaccatgctgctcatgctgctgcccacggccctcgcgttccacctgactacccggggaggggagccccacatgatcgtgagcaagcaggaacggggcaaatcgctcctgttcaagaccagcgccggggtaaatatgtgcaccctgatcgccatggacctgggcgagctctgcgaagacaccctgacctacaagtgcccccagattaccgaggccgagcccgacgacgtggactgctggtgcaatgccaccgacacgtgggttacctacgggacctgctctcagaccggcgagcaccggcgggataagcgctccgtggccctggcaccccacgtgggcctcgggctggagacgcgtaccgaaacctggatgagctccgagggcgcctggaagcagatccagcgcgtggagacctgggccctgcggcaccccgggttcacggtcatcgctctcttcctggcgcacgccatcggaacctccatcacccagaaggggatcatcttcatcctgctcatgctggtgaccccctccatggcaatgcgatgcgtgggcattggcaatcgggacttcgttgaggggctgtccggcgcaacgtgggtcgacgtcgtgctcgagcacggctcctgcgtgaccaccatggcaaagaataagcccacccttgacattgagctgctgaagacggaagtgaccaatcccgcgatcctgcgcaagctgtgcatcgaggccaagataagcaacacaaccacggactcccgttgcccgacccagggcgaggccaccttagtagaggagcaggacgccaatttcgtgtgccgccggacctttgtcgaccgcggctgggggaacggctgcgggctgttcggtaagggaagcctactcacatgcgccaagttcaagtgcgtgaccaagctggagggcaagatcgttcaatacgagaacctgaagtactccgtgatcgttacagtgcacaccggcgaccagcaccaggtcgggaatgagacgaccgagcacggcaccatcgcgaccattacgccgcaggcccccacgagcgagatccagctaactgactacggcgccctgaccctggattgcagcccccggaccggactcgacttcaacgagatggtcctactgacgatgaaggagaagtcctggctggtccacaagcagtggttcctggacctgccgttgccctggacctccggggcgagcaccagccaggaaacctggaatcgccaggacctgctagtgacgtttaagaccgctcacgcgaagaagcaggaggtggtcgtgctcgggtcccaggagggcgccatgcataccgccctgaccggggccacggagatccagacaagcggtacgaccacgatcttcgccggacacctgaagtgccggctcaaaatggacaagctgaccctgaagggcacgtcctacgtgatgtgcaccgggagcttcaagctggagaaggaagtcgcggagacgcaacacggcaccgtgctcgtgcaggtcaagtacgaaggcaccgacgccccctgcaagatccccttctccacccaggacgagaagggggtgacacagaacggccgcctgatcaccgcaaacccgatcgtgaccgacaaggaaaagcccgtcaacatcgagaccgagcctcctttcggggaaagctacatcgtggtcggcgctggcgagaaggcgctgaagctctcctggtttaagaaaggcagctcgatcggtaagatgttcgaggccacggcccgaggtgcgcgccggatggccatactgggcgacactgcgtgggacttcgggagtatcggcggagtcttcacctccgtggggaagttagtgcatcaggtcttcggcaccgcctatggggtcctcttcagcggcgtgtcctggacgatgaagatcgggatcggcatcctgctgacatggctcggcctgaacagccgcagtactagcctctccatgacatgcatcgccgtcgggatggtgacgctctacctgggcgtcatggtgcaggccgacagcgggtgcgtgatcaactggaagggtcgcgagctgaagtgcggttccgggatattcgtgaccaacgaagtccacacctggaccgagcagtataagttccaagccgacagcccgaagcggctcagcgcggccatcgggaaagcctgggaggagggggtgtgtggcattcggtctgccacccggctggagaacatcatgtggaagcagatcagcaacgagctgaaccatatcctcctggagaacgacatgaaattcactgtggtcgtgggcgacgccaacggcattctggcccagggtaagaagatgatccgtccccagcccatggagcacaagtactcctggaagtcttggggcaaggccaagatcatcggcgccgatatccagaatactacgttcatcatcgacgggcccgataccccggagtgcccggacaaccaacgagcctggaacatctgggaggtggaggactacggcttcggtatcttcaccacgaacatttggctcaagctgcgcgactcctacacacaggtgtgtgaccaccgactcatgagcgctgccataaaggacagcaaggccgtgcacgccgacatgggctattggatcgagagcgagaaaaacgagacctggaagctcgcccgcgcttccttcatcgaggtgaagacgtgcacctggcccaagagccacaccctgtggtccaacggcgtcctggaaagcgagatgatcattcccaagatctacgggggcccgatctcccagcacaactacagacccgggtattttacccagacggccggcccctggcacctcggcaagctggaactggacttcgacctctgcgagggtaccaccgtggtcgtcgacgagcactgcggaaatcgcgggccgagcctgcggaccacgaccgtgaccggcaagatcatccacgaatggtgctgtcgctcctgcaccctgccgcccttacggttccgcggtgaggacggatgctggtatgggatggagatccggcccgtgaaggagaaggaggagaacctggtccgcagcatggtatccgccggcagcggcgaggtggacagcctgtccttagggatactgtgcgccagcatcatgatagaggaggtgatgcggtcccgttggagccggaagatgctgatgacgggcacgctcgccgtgttcctcctgctcatcatgggacagctgacctggaacgatctgatccgcctctgcatcatggtaggagccaacgcctcggaccgcatggggatgggcaccacgtacctggccctgatggccaccttcaagatgcggccgatgttcgctgtcggcctcctgttccgccggctgaccagcagagaggtgctccttctgacgattgggctctcgctcgtcgcgagcgtcgagctgcccaactccctcgaagagttaggcgacgggctggccatgggcatcatgatgctcaagctgctgacggagttccagccccaccaattgtggaccaccctgctgtctctcaccttcatcaagacgactctgtccctggactacgcctggaaaaccacggccatggcgctcagcatcatcagcctgttccccctgtgtctcagcacgaccagtcagaagactacctggttgccggtgctgctcggcagcttcgggtgcaagcccctgaccatgttcctgatcacagagaacaagatctggggccggaagtcgtggcccttaaatgaagggatcatggccatcggcatcgtcagcatactgctgtccagcctgctgaagaacgacgtgcccctggccgggcccttaatcgctggcggtatgctgatcgcctgctacgttatctcggggtccagcgcggacctgtcactcgagaaggcggccgaggtcagctgggagcaggaggccgagcactctgggacgagccacaacatcctggtggaggtgcaggacgacgggaccatgaagatcaaggacgaggagcgcgacgacaccctgacgatcctcctcaaggccaccttactcgcggtctccggcgtgtatccgatgagcatccccgccaccctgttcgtgtggtacttctggcagaagaaaaagcagcggtccggggtcctgtgggacacccccagtccacccgaggtagagcgcgccgtgctggacgatggcatctaccggatactccagcgcggactgctggggcggtcccaagtcggcgtgggggtctttcaggacggcgttttccatacgatgtggcacgtgacccgcggggccgtactcatgtaccagggcaaacggctggagcccagctgggcctccgtcaagaaagacttgatcagctacggcggcgggtggagattccaggggtcctggaacaccggggaggaggtacaggtgatcgcagtcgaacccgggaagaacccgaagaacgtgcagaccacgcccggcaccttcaagacccccgagggcgaggtgggggccatcgccctcgactttaagcccggtacaagcggttccccgatcgtcaaccgggaaggcaagatcgtgggcctgtacgggaatggcgtggtcacgactagcgggacctatgtgtccgccatcgcccaggcgaaggtgagccaggagggccccctgcccgagatcgaggatgaggtctttaagaaacgcaacctcacgatcatggacctgcacccagggagcggcaagacgagacgctaccttcccgccatagtgcgggaggccatcaagagaaagctccggaccctgatcctggcccccactcgcgtggtcgcgtccgagatggccgaggccctcaagggtatgcccatcagataccagaccacggccgtcaagagcgagcacaccggtagggagatcgtggacctgatgtgccacgccaccttcaccatgcgcctgctctccccggtccgggtgcccaactacaacatgatcatcatggacgaggcgcacttcaccgaccccgccagcattgccgcccgcggctacatctccacccgggtgggcatgggcgaggccgcggccatcttcatgaccgccacgccgccagggagcgtcgaggccttcccccaatcgaacgccgtgatacaggacgaggagcgcgacatccccgagcggagctggaactccgggtacgattggatcacggacttccccggcaagaccgtgtggttcgtccccagcatcaagtccggaaacgacatcgcgaattgcttgcgcaagaacggcaagcgggtaatacagctgagccgcaagaccttcgataccgagtaccagaagacgaaaaacaacgactgggactacgtagtcaccaccgacatctccgagatgggggccaacttccgtgccgaccgcgttatcgacccccggcgatgcctcaagcccgtgatcttaaaggatggcccggagcgggtcatcctggccgggccgatgcccgttaccgtggcgtcagccgcccagcgcaggggccgcatcggccggaatcagaataaggagggggaccaatacgtctacatgggccagcccctcaacaacgacgaggaccacgcccactggacggaggccaagatgctgttagacaacataaacacccccgagggaatcatcccggccctcttcgagcccgagcgcgaaaagagcgcggccatcgacggcgagtacaggctgcgtggggaggcccgcaagaccttcgtagagttaatgcggcgcggcgacctccccgtctggctgagctacaaagtggccagcgagggcttccagtatagtgaccggcgttggtgcttcgatggggaacggaacaaccaggtactggaagagaacatggatgtagagatctggaccaaggagggcgagcgtaagaagctccggccccgttggctggacgcgcggacctactccgatccgctagccctgcgcgaatttaaggagttcgccgccggtcggcgctcggtgagcggcgacctgatcctggagatcggcaagctcccccagcacctgacgctgcgggcccagaacgcgctcgacaatctggtgatgctgcacaactccgagcagggagggaaggcctacaggcacgcgatggaagaactccccgacaccatcgagaccctaatgctgttagccctgatcgcggtcctgaccgggggcgtgacccttttcttcctgtccgggaaaggcctgggcaagacctccatcgggctactgtgcgtgaccgctagctccgctctgctctggatggccagcgtggagccccattggatcgccgcgtccatcatccttgagttctttctgatggtgctcctgatccctgagcccgaccggcagcgcacgccgcaggacaaccagcttgcctacgtggtcatcggcctcctattcatgatcctgacggtggccgccaacgaaatgggactcttagagaccactaagaaagacctgggcatcgggcacgtggccgcggagaaccaccagcacgccaccatgctcgacgtcgacctgcggccggccagcgcgtggacgctgtacgccgtggcgaccaccgtgatcacccccatgatgcgccacacgatcgagaacaccacagccaacatcagcttaaccgccatcgccaaccaggccgcaatactgatgggcctggacaagggttggcccatcagcaagatggacatcggagtcccccttctggccctggggtgctactcccaggtgaaccccctgacgctcaccgccgccgtgctgatgctcgtcgcccactacgctatcatcgggcccggcctacaggcaaaggccacccgggaggcccagaagaggaccgcggccgggataatgaagaaccccacggtagacggcatcgtggccatcgacctggatcccgtcgtgtacgacaccaagttcgagaagcagctcggccagatcatgctgctgatcctctgtacctctcagatcctgctgatgcgcacaacatgggccctctgcgagtccatcaccctggccaccggtccgctgaccacgctctgggagggctcccctgggaagttctggaataccaccatcgcggtttccatggccaacatcttccggggcagctacttggccggcgccgggctggccttctccctcatgaagtccctaggagggggccgccgggggaccggcgcgcagggcgagacgctgggagagaagtggaagagacagctcaaccagctgtctaagagcgagttcaacatctataaacggagcggtatcatggaggtcgaccgcagcgaggcgaaagaggggctgaagcgaggcgagaccaccaagcacgccgtttctcgcgggaccgccaagctgaggtggttcgtggagcgcaacctcgtcaagcccgagggcaaggttatcgacctgggatgtgggagagggggctggtcctattactgcgcgggcctgaagaaggtgaccgaagtaaaggggtacacgaagggcggcccaggacacgaggaaccgatccccatggccacctacggctggaacctcgtcaagctgcacagcgggaaggacgtattcttcatgccgcccgagaagtgcgacaccctgctctgcgacatcggcgagtccagccctaaccccaccatcgaggaggggcgtacgttgcgggtactcaagatggtggagccctggctccgcggcaaccagttctgcatcaagatcctgaacccctacatgccgtccgtggtcgaaaccctggagcagatgcagcggaagtacggcgggatgctcgtgcgcaaccccctcagcagaaattccacccacgagatgtactgggtgagctgcggcaccgggaacattgtgtccgccgtgaacatgacgagccgcatgctgctcaaccggttcaccatggcccaccgcaagcccacctacgagcgtgacgtcgacctgggggccggcacccggcacgtcgcggttgagcccgaggtggccaacctggacatcattggacagcgcatcgagaacatcaagaacgagcacaagtccacgtggcactacgacgaagacaacccgtacaagacatgggcctaccacggaagctacgaggtcaagccttccgggagcgcctccagcatggtgaatggtgtggtccggctcctgaccaagccctgggacgtgatccccatggtcacccagatcgctatgacggacactaccccattcgggcagcagcgcgtgttcaaagagaaggtcgacacccggacgccccgcgcaaaacggggcaccacccagataatggaggtcactgcaaagtggctgtggggcttcctctcccgcaacaagaaaccccggatctgcacccgcgaggagttcacccgaaaggtgcgaagcaacgccgccatcggggccgtgttcgtggatgagaaccagtggaactcggcgaaggaggccgtcgaggacgagcggttctgggacctggttcacagagagcgagaactgcacaagcagggcaagtgcgcgacctgcgtctataacatgatggggaagcgcgagaagaagctcggcgagttcggcaaggccaagggctcccgggcgatctggtacatgtggctgggcgcccgcttcctggagttcgaggccttagggttcatgaatgaggatcactggttcagcagagaaaacagcctgagcggagtggagggggagggcctgcacaagctcgggtacattctgcgcgacatctccaaaatccccggcggcaacatgtacgccgacgacaccgccgggtgggacacgcggatcaccgaggacgacttgcagaacgaggcgaagatcaccgacataatggagcccgagcacgcactcctggccacgagcattttcaaactgacctaccagaacaaagtcgtccgcgtgcagcgccccgctaagaacggaacagtgatggatgtcatctcccggcgcgaccagcgggggtctggccaggtgggcacctacgggctcaacaccttcacgaacatggaggtgcagctaatccgccagatggagtccgagggcatcttcctgccctcggagctcgagaccccgaacctggcaaagcgggtcctggactggctggagaaacacggcgcggagcgactaaagcggatggccatctccggcgacgactgcgtggtgaagcccatcgatgatcgcttcgccaccgcactgaccgccctcaatgacatggggaaggttcggaaggacatcccccagtgggagcccagcaagggctggaacgactggcaacaggtgccgttctgctcccaccatttccaccagctgatcatgaaggacggtcgcgagatcgtggtcccgtgccggaaccaggacgagctcgtggggcgcgcgcgggtgagccagggtgccgggtggtcgctccgcgaaaccgcgtgcttaggcaagagctacgcccagatgtggcagcttatgtacttccaccgtcgggacctccgcctggctgctaacgctatttgctccgccgtccccgtagactgggtgcccacgagccgcaccacttggagcatccacgcccaccaccagtggatgaccacggaggacatgctgtccgtatggaaccgggtgtggatcgaggagaacccctggatggaggacaagacccacgtgagctcatgggaggaggtcccctacctcgggaagcgcgaggaccagtggtgcggcagcctgatcggcctgaccgcacgcgccacctgggccaccaacatccaggtggccatcaaccaggttcggcgtctcatcggcaatgagaactacttagactacatgaccagcatgaagcggttcaagaacgagagcgaccccgagggcgctctgtggtga

SEQ ID NO: 23969 - RNA, 9879 nt, synthetic construct
  misc_feature 1..9879: note = derived and/or modified CDS sequence (opt11) from DENV-1__KF973460__SS-prME
  source 1..9879: mol_type = other RNA
tcagtaaccatgctactaatgctactccccacggctctagcattccacctcacaacaagagggggagaaccccacatgattgtatcgaagcacgaacgagggaaatcgcttctctttaaaacatcaacaggagtaaatatgtgtaccctaatagctatggacctaggcgagctctgcgaagacacgatgacatacaagtgcccgcgaattacggaagcagaaccggacgacgtcgattgctggtgcaatgccactgatacttgggtgacctacggaacctgtagccaaaccggggaacacagacgggacaaacgatcggtagccctcgccccacatgtgggcctcggattggaaacgagaacggaaacctggatgtcatccgaaggggcttggaaacaaatacaacgggtcgagacatgggcactaaggcaccccgggttcaccgtaatagccctgtttttagcacatgcaatcgggacaagtataacccaaaagggaatcatattcatactcttaatgttagtcacacccagcatggcaatgcgttgcgttggaataggaaacagagatttcgtcgagggactcagcggcgctacgtgggtcgacgttgtgctagaacacggctcatgtgtcacgaccatggccaaaaacaagccgacgctcgacatagagctactcaaaacagaggtaaccaatccagcagtcttaaggaagctctgcatagaggcaaagattagtaacactaccacggactcgaggtgccccactcaaggggaagcgaccctagtagaagaacaagatgccaatttcgtctgcaggcgcacccttgtcgatcggggatggggcaacggatgtggcctatttggcaagggctcactactaacctgcgctaaattcaaatgcgtcacaaagctcgaaggcaaaatcgtccagtacgaaaacctcaagtactccgttatagtaaccgtccatacaggagaccaacaccaagtgggtaacgaaacgactgaacatggaaccattgctacaatcacaccacaggcccccacgtccgaaattcaactcactgactacggcgcgctcgcgctagactgttcaccccgcaccggcctggacttcaatgaaatggttctcctcaccatgaaggaaaaatcatggctcgtccacaaacaatggttcctagacctacctctgccgtggaccagcggggcctcaacgtcccaagaaacttggaacagacaagacttgctcgttacgttcaaaaccgcgcacgcgaagaagcaagaagtagtcgtgctaggaagtcaggaaggagcaatgcacacagccctaaccggagccacagagatacagacaagcggcacaacaaccatcttcgcgggacatctcaaatgtagactgaagatggacaagctaaccctcaaaggtacatcgtacgtaatgtgtacgggatccttcaagctcgaaaaggaagtcgctgagacacaacatgggacggtcctagttcaggttaagtacgagggaaccgacgcgccatgcaaaataccattcagcactcaggacgaaaaaggcgtcacgcaaaacggtagactcatcacagcgaaccccatcgtgacggacaaagagaaaccagtaaacatcgaaacggagccacccttcggcgaatcttacatagtggtcggagctggagaaaaagccttgaagctatcttggttcaagaagggctcaagcatcgggaagatgttcgaagcgacggcgcgtggagcaagacgaatggctatcctcggtgacaccgcctgggattttgggagcatcggaggcgtgtttacaagtgttgggaaactcgtccaccaagtattcgggactgcctacggggtactcttcagtggcgtgtcgtggacgatgaagataggaatcggaatattactgacgtggctggggctgaacagccgttccacatccctctccatgacctgcatcgctgtcggcatggtcaccctgtatctgggagtaatggtacaagccgacagcggctgtgtcattaactggaaagggcgcgaactgaagtgcggttctgggatttttgtcacgaatgaagtccacacgtggacggagcaatacaaatttcaggcagactccccgaaacgactcagcgcagcgataggcaaggcatgggaagaaggagtctgcggcatacgcagcgccactagactggaaaacataatgtggaaacagatctcaaacgagctgaaccacatcctgcttgaaaacgatatgaaatttaccgtagtagtaggcgacgcaaatggtatattagcccagggcaagaaaatgatccgcccacagccaatggagcacaaatacagttggaaatcatggggaaaagcgaaaattatcggcgccgacatccaaaacacaacattcataatcgatggccccgacacccccgaatgtcccgacgaccaacgagcatggaatatatgggaggtggaagactacggattcggcatattcacgaccaacatttggctaaaactaagggacagctacacacagatgtgtgaccacagactcatgtcggccgccataaaggactctaaagcagttcacgcggacatgggatactggatcgaatcagagaaaaacgaaacatggaagctagctagggcatcgttcatcgaggtaaagacttgcacatggcccaaatcacacacgttatggtcgaacggcgtattggaaagcgagatgataattccgaaaatatacgggggtcctatatcacaacacaactatcgtccagggtactttacgcagacggcaggcccctggcatctcggaaagctagagctagattttgacttgtgtgagggaacaacggtggtcgtagacgagcattgtgggaacagggggccttcgttaaggacaacgacggtaacaggaaagataatacacgaatggtgttgtagaagctgtaccctgccacccctgcgcttcagaggagaagacggctgctggtatggcatggagatcagacccgtgaaggaaaaggaggagaatctagtccgctcgatggtcagcgcgggctcaggcgaagtagactctctaagcctaggaatcctatgcgtgagtataatgatcgaagaagtcatgcgcagtcgttggtcgaggaagatgctcatgaccgggactttagccgtcttcctcctactgatcatgggacaactcacgtggaacgaccttatacggctgtgtattatggtaggcgcaaacgcctcagacagaatgggaatgggtacaacgtacctggctctgatggcgacattcaagctaaggcccatgttcgcggtaggcatcctgttccgacgcttaacctctagagaagtactcctcttgacgataggcctaagcctggtcgcgtcagtggaactccccaatagcctggaggagctcggtgacgggctcgcgatgggcataatgatgttaaaactccttactgagttccaaccacaccaactatggacaacgctcctaagcctgacctttatcaaaacgactctcagtctggactacgcgtggaagacaacagcaatggccttaagcattgtatccctatttcctctgtgcctgagcaccaccagccagaagaccacatggctgccggtactgttgggtagctttggttgcaagcccctcacaatgtacttcatcaccgagaataaaatctggggccgtaagagctggcccattaacgaggggatcatggccataggaattgtctcaattctcttaagttcattgttgaagaacgacgtaccccttgccggcccactgatagcaggcggcatgcttatagcgtgttacgtaatcagtggaagctcagctgatttaagcctagagaaggcagccgaagttagctgggagcaagaagcagagcactcagggaccagccacaatattctcgtagaagttcaagatgacggcactatgcgaataaaagacgaggaaaaagacgacacgctcaccattctattgaaggccacattgttagcggtctcaggagtatatccaatgtcaatccccgcaaccttattcgtatggtacttctggcaaaagaagaagcagcgtagcggagtattatgggacactccgtcacccccagaagtcgaacgcgcagtactcgatgacggaatctacaggatcttacagagagggctactgggccgcagccaagtcggcgtgggggtgttccaggatggcgtcttccacaccatgtggcacgtgacacgcggcgcagtcctgatgtaccaaggcaagcgactggaaccctcctgggcgagcgtaaagaaagacctcattagctacggaggcgggtggcgatttcaaggctcatggaacacaggagaggaagtgcaagtaatagccgtagaacccgggaaaaatcccaaaaacgttcagactacaccaggcacatttaaaacaccagaaggtgaagtaggcgctatcgcgcttgattttaaacccggaacctccgggagcccaatagtgaatcgagaaggcaaaatagttgggctatacggaaacggggttgtaaccacatctggaacctacgtgagtgcaatagcgcaagccaaggccagccaagagggccccctgccagagatcgaagatgaagttttcaagaagaggaatctgacaatcatggatctccatcccgggtctggtaaaacgcgccgctacttgcctgcaattgtacgagaggcgataaaacgcaagctccgtacgctcatcttagccccaactagagtggtagccagcgagatggccgaagccctaaaggggatgccaatacgataccaaaccacggccgtcaaaagcgaacatacgggacgagaaatagttgatttaatgtgccacgctacatttaccatgagactactatcgcccgtcagggtcccgaattataatatgattataatggatgaagcccacttcacagaccccgcctcaatcgcagcccggggatatatcagtacaagagttggaatgggtgaagcggcagccattttcatgaccgcaacaccgcccggttccgtggaagccttcccccaatccaacgccgtcatccaagatgaggaaagagacataccagagagatcgtggaacagcggatacgattggatcacagactttccaggaaaaacggtctggttcgttccctctattaagagcggaaatgacatcgcgaattgcctccggaagaacggaaagcgggtaatccagctgagccgaaagacatttgacaccgaataccagaaaaccaaaaacaatgactgggactatgtcgtcacgacggacatcagcgagatgggtgcaaacttccgcgcagaccgagtaatcgacccacggcggtgcctcaaacccgtgatactaaaagacggaccagagcgagtaatcctcgcaggcccaatgcccgtgacggttgcaagtgctgctcagcgacgaggacgaataggcaggaaccaaaacaaagaaggagaccaatacgtctacatgggacaaccgctcaacaacgacgaggaccatgcgcactggaccgaagcaaaaatgctccttgataacattaatacgccagaaggcattataccagcgttattcgaaccagagcgcgagaaatcggctgcgatagacggggaataccgtctgcggggagaagcgcgcaaaaccttcgtcgagctaatgcgtaggggcgacctgccagtgtggctaagctacaaagtagcgtcggaaggcttccaatactcggacagacgctggtgcttcgacggcgagcgtaataatcaagttctcgaggaaaacatggacgtagaaatatggacaaaggagggagagcggaagaaactgcgcccaagatggttggacgcacgtacatactctgaccctctcgcattgagagagttcaaggaatttgcagctgggcgaaggtccgtatccggagatctgatactagagatagggaaactgccacaacatttaaccctgagggcacagaatgcactggacaacctcgttatgctacacaactcagaacaaggagggaaggcctacagacatgccatggaagaactgccagatactatagaaaccttaatgcttctggctttgatcgccgttctgaccgggggagtcacgctatttttcttaagcggaaaagggctgggcaaaacctccatcggattactatgcgtgaccgcgtcatccgcactcctgtggatggctagcgtagaaccacattggattgctgcaagcataatcctggagttctttctcatggttttactgatcccggaacccgacaggcagaggacgcctcaagacaaccaattagcgtacgtggtcatcggactactcttcatgatcctcacagtagcagcaaatgaaatgggtctgctagaaacgaccaagcgagatctggggatagggcacgtagcagctgagaaccatcagcacgctactatgctagacgtagatctgaggccggcttcagcctggacgctgtacgcagttgcaaccactgtaataaccccaatgatgagacacaccatcgagaacacgaccgcgaacataagcctcacggctatagcaaaccaggcagccatcctcatggggttagacaaaggatggccgatatccaaaatggatattggagtgcccctcctagcgctgggttgctacagccaggtaaatcccctaaccctgacagccgctgtactcatgctagttgcacattacgctatcatcggaccgggcctacaagcaaaagcaacaagagaagcccagaaaagaaccgccgcagggattatgaagaaccccacagtggacggtatagtagccatagatctagacccggtagtgtatgacgccaaatttgaaaagcaactaggccagatcatgcttctaatcctctgtatctctcaaatcctacttatgcgaaccacatgggcgctgtgcgaatcgataacattagccacagggcccctgaccaccctgtgggaggggtctcctgggaaattctggaacacgacaatcgcagtcagcatggcaaacatcttccgcgggtcctacctagcaggggccgggctggccttcagcctgatgaaatccctcggcggcggacgtagaggtactggggcccaaggagaaacattaggagaaaagtggaagcgccagctcaaccagctttccaagccagagttcaacacgtataaaagatcgggaatcatggaagtagaccgctcggaggcaaaggagggtctaaaaaggggtgagacaaccaagcacgcagtctcgcggggaaccgcaaaattacgatggttcgtggaacgaaacctcgtgaagcctgaggggaaagtaatagacttaggctgcggaagaggaggctggtcgtactactgcgctgggctcaagaaggttacggaagtcaagggatacacgaaagggggacccggccacgaggagccgattccaatggccacatacggatggaatttagtaaaactacactcaggcaaagacgtattcttcatgccacccgagaagtgcgacactctcctatgcgacataggggaaagctccccaaaccccacgatcgaggaagggcgtacgctcagggtactaaagatggtagagccgtggctgcgaggaaaccaattctgcatcaaaatccttaacccatatatgccctccgtagtcgagaccctggaacaaatgcagaggaaacacgggggaatgctagtgcgcaaccccttgtcccgcaacagcacgcacgagatgtactgggtatcctgcgggacgggcaacatagtaagcgccgtgaacatgacatcccggatgttactaaaccgcttcaccatggcgcaccggaagcctacctacgaacgcgacgtagacctaggggccgggacccgccacgtagccgtagaaccagaagtcgcgaacctagacataatcggccaacgcatcgaaaacatcaaaaatgaacacaagtcaacctggcactacgatgaagacaacccgtataaaacctgggcttatcacggaagctacgaagttaaaccttccggctcagcatcaagcatggtgaatggcgtagtacgcctactaacaaagccctgggacgtgataccaatggtcacacagatcgcgatgacagacactactcctttcggccagcagagagtattcaaagagaaagtagacacacgcacccctcgtgcaaagagaggcaccacacagataatggaggtcacggccaagtggctctggggattcctttccagaaacaagaaaccccgaatatgcactagagaagagttcacacgaaaagtaaggtcaaacgctgccataggcgcagtgttcgtcgatgagaatcaatggaactcagctaaagaagcggtcgaagacgaacgattttgggatctcgtccaccgggagagagagttacacaaacaaggaaagtgcgccacatgtgtctacaacatgatgggcaaaagagagaagaaactaggagagttcgggaaggctaaaggttctcgcgcaatttggtacatgtggctcggcgcgagattcctagagtttgaagcactgggatttatgaacgaagaccactggttcagccgcgagaacagcttgagcggagtagagggagagggcctgcacaaattggggtacatattaagagatatatcaaagatacctggagggaacatgtacgcggatgacacagccggctgggacacgcgcatcaccgaagacgatctacagaatgaagccaaaataaccgacataatggagcccgaacacgccctcttagcaacgagtatctttaagctgacgtaccaaaacaaggttgtaagggtccaacgcccagcgaaaaacggaactgtcatggacgtaatctctcgacgcgaccaacgcggatctggtcaagtagggacctacggcttgaacacattcacgaatatggaggtacaactcatccgccaaatggagagcgaaggaattttcctgcccagcgagctggaaaccccaaacctggcagaaagggtcttagactggctggagaagcacggcgcggaaaggctaaagcgcatggcaatatcgggggacgattgtgtagtcaaacccatcgacgatcgcttcgcaacagcactaacagcgctcaatgacatgggaaaagtacggaaagatataccgcaatgggaaccgagcaaaggctggaacgactggcagcaagtgccattctgctctcatcacttccatcagctgattatgaaagacggacgcgaaatcgtagtcccgtgccgaaatcaagacgagctagtaggccgcgcacgtgtctcccagggcgccggatggtcactacgcgagacagcctgcctgggaaaatcctatgcacaaatgtggcagctaatgtatttccaccgacgagacctgcgtttagcagccaatgcaatttgctccgccgtacccgtagactgggtgcccacgtcaagaacaacttggtcaattcatgcacaccaccaatggatgacaacggaagacatgctcagcgtgtggaaccgcgtatggatcgaggagaacccttggatggaagacaagacccatgtctcgagctgggaagaagttccatacttaggaaagcgcgaagaccaatggtgcgggagcctaatcggactgaccgccagagcgacatgggctacgaacatacaagtcgcaatcaatcaagtgcgaagactgatcggaaacgaaagctaccttgactatatgacgtcgatgaaaagatttaaaaacgagtcagaccctgaaggagcactgtggtag

SEQ ID NO: 23970 - RNA, 9879 nt, synthetic construct
  misc_feature 1..9879: note = derived and/or modified CDS sequence (opt11) from DENV-1__KF973461__SS-prME
  source 1..9879: mol_type = other RNA
agcgtgacaatgctattaatgctcctccccaccgctctcgcattccacctcactacgcggggaggcgaaccgcacatgatcgtgagcaaacaagaaagggggaaatcactactattcaaaacctcagctggcgttaacatgtgcacactgatcgcgatggacttgggcgaactctgcgaagatacaatgacatacaagtgcccccaaataacagaggcggagccggatgacgtcgactgttggtgtaacgcgaccgacacctgggtcacgtacgggacctgttcccaaacaggcgagcaccgccgggacaagcgatcagtggcactcgccccgcacgtaggcctcggtttggagacccgtacagaaacttggatgtcctcggaaggagcatggaaacaaattcaaagagtagaaacctgggcactaaggcacccagggtttacagtgatagcattgttcctcgctcatgcaataggaacatccataactcagaaagggataatattcatactactcatgctcgtaacaccgtcaatggctatgcgatgcgtcgggataggcaaccgggactttgtagagggtctgtccggagcgacctgggttgatgtagtattagaacatggatcgtgcgtaacgacgatggctaaaaacaagcccacactggacatcgaactacttaaaacagaggtaaccaatcccgcaattcttaggaaactgtgcattgaggccaaaatcagcaacacgacaacagattcgcgctgcccaacacaaggcgaagcaaccctggtcgaagaacaagacgccaatttcgtctgcagacgaacgttcgttgaccgaggatggggcaacgggtgtggccttttcggaaagggatcactgctaacgtgcgcgaaattcaaatgcgtcacaaaactggaaggaaagatcgtgcaatatgaaaacttgaagtactccgtaatcgtcacggtacacacaggcgatcagcaccaggtaggaaacgagactaccgaacacggaacaatagcaaccattacaccacaagctccaacttcggagattcaactaactgactacggcgccttgaccctcgactgctcccctcgaacaggcctagactttaacgagatggtgttacttaccatgaaagaaaaatcctggcttgtacacaaacagtggttcctcgacctccccctgccgtggacaagcggagcaagcacctcgcaagaaacctggaaccggcaagatctgttagtaaccttcaaaacagcccacgccaaaaagcaagaagtagtcgtactaggttcacaagaaggggcgatgcacacggcactcaccggggcgaccgaaatccagacatcaggcacgacaacaatatttgccggacacctgaaatgcaggctaaaaatggacaaactcacattgaagggaacgtcctatgtcatgtgcactggatcattcaaactggaaaaagaagttgcagaaactcagcacggaactgtactcgtgcaggttaaatacgaaggtaccgacgccccttgcaaaattccattttcaacacaggacgaaaagggcgtcacacaaaacgggagactgataacggccaaccccatcgtcaccgacaaagaaaaaccggtaaatatagagacagaaccacccttcggagaaagctatatcgtagtcggggccggggaaaaagcgctcaagctatcctggtttaagaaaggatcttcaatcgggaaaatgtttgaagcgacagctcgcggcgccaggaggatggcaatcctaggggatacagcctgggacttcggcagcatgggcggtgtatttacctccgttggcaaactggtccaccaagtctttgggaccgcatacggtgtactcttcagcggcgtaagctggacaatgaagatcgggatcggcatcctcctgacctggttagggctaaactcgcgatccacctccctaagtatgacatgcattgcagtcggaatggtaaccctatatttgggcgtcatggtacaagcagattcgggatgcgtgataaactggaaaggaagagagctaaaatgtggcagtggcatatttgtcaccaacgaagtgcacacgtggacggaacaatacaaattccaagcggactcccccaagaggttgtccgcagcaatcggtaaggcctgggaagaaggggtatgcggcatccgcagcgcgacccgactcgagaacatcatgtggaagcagatttcgaatgaactaaaccacatcctcttggagaacgacatgaaatttaccgtagtggtcggcgacgccaacgggattttggctcaaggcaaaaagatgatcagaccccaacccatggaacacaaatattcgtggaaaagctggggcaaggccaaaataataggagcggatatccagaacactactttcatcatcgatggtcccgacacccccgaatgtccagataaccaaagagcgtggaatatatgggaagtcgaagactacggctttggaatatttacaaccaacatctggctcaaattgcgggacagttatacacaaatgtgcgaccataggctgatgagtgctgccatcaaagattccaaggcagtccacgcagacatgggctactggattgagtcagagaaaaatgaaacttggaaattggcccgtgcatccttcattgaagtcaagacttgcacgtggccaaagagccataccctatggagtaacggcgtcctagagagcgaaatgataataccgaaaatctacggcggccccatatcacagcataactatagacccggctacttcacacaaactgcaggaccctggcatctcgggaagctagaactagactttgagctatgcgaaggcactactgtcgttgtagacgagcattgtggcaatagaggtccctctctaagaactaccacagtcacggggaaaatcatacacgaatggtgttgccgatcatgcacactcccaccactaagattccgcggggaggacggttgctggtacggcatggagatacgaccagtgaaagaaaaggaggaaaacctggtacgcagtatggtctcggcaggatcgggggaagtcgattcattcagtctggggatactctgtgccagcatcatgatagaagaagtaatgcggagtaggtggagccgaaaaatgttaatgaccggaactttagcagtgtttctactgctcatcatgggccagctgacatggaacgaccttatcagattgtgcatcatggtaggggcaaacgcaagtgacaggatgggaatgggaacaacctacttggccctaatggccacgttcaagatgcgcccgatgttcgcggtcggactactgtttagacggctaacctcgcgcgaagtacttttactaacaatcggcctgtctttggtagccagtgtggaactacccaactcactggaggaactaggcgatggcctggcaatggggatcatgatgttaaagctgttaaccgagttccaaccacatcaactgtggaccacgctcctcagtctaacgtttataaaaacaaccctaagcctagactacgcatggaaaattaccgcaatggcactatccataatatcactcttccccctctgcctatccacaactagccaaaagacaacctggcttccagtcctactcggcagcttcggatgtaaaccactaaccatgtttctcattaccgagaacaaaatatggggaagaaagtcttggccgctgaacgaaggcatcatggccataggcatcgtctccattctgctatcatcactcctcaagaacgatgtccccttagcggggccgctgattgccggaggaatgctgatagcgtgttatgtaatatccgggtcctcagccgacctgagcctcgagaaggctgcggaggtttcgtgggagcaggaggcggagcactccggcacatcgcacaacatcctagttgaagtacaagacgacggtacaatgaagataaaagacgaagaaagagatgacacgttaacaatcctactaaaggcaacactcctcgcagttagcggcgtatacccaatgtcaataccggcaaccctattcgtatggtacttctggcaaaagaagaaacaacgatcaggcgtgctctgggacacaccgagcccgcccgaagtagaaagagcggtgctcgacgacggcatataccgcatcctacaaagaggtctccttgggagatcgcaagtaggagtaggagtctttcaggacggtgtattccacactatgtggcatgtgacaagaggcgcggtccttatgtaccaggggaagagactcgagccctcttgggcctcagtgaagaaagacctaatcagctacggagggggatggcgattccaagggagctggaatacaggggaggaagtccaggtcatcgccgtggaacccggcaaaaaccccaaaaatgtccaaactactccagggacgttcaaaacaccagagggtgaggtcggggccatagcgcttgacttcaaacctggaacgtccggctcccccatcgtcaaccgagaagggaaaatcgtgggactttatgggaacggcgtggtaactacatcaggaacatacgtaagcgcaatcgcacaagcaaaagcgagccaggaaggccctcttccggagatagaagacgaggtttttaagaaaaggaacctcacaataatggacctacacccaggaagcggaaagacacggcgctacttgccagctatcgtacgggaggcaataaagcggaagttgagaaccttgatacttgcgccgacccgtgtagtcgcatcagaaatggcagaagctctaaaaggtatgccgatacgataccagacaaccgcagtaaagagtgagcacaccggccgcgaaatcgtcgacctcatgtgccacgctactttcacgatgcgcctcttatccccggttcgcgttccgaactacaacatgatcataatggacgaagcacacttcacagacccagcaagcatcgcagcgcggggttacatttccacacgcgtaggaatgggagaagcagcagcgatattcatgacggcaacgcctccgggatcggtcgaagcatttccccagagtaacgcggtaatacaagacgaggagcgtgacatcccagagcgctcctggaacagcggctacgactggatcacggacttccctggcaagaccgtgtggttcgtcccctcaataaaaagcgggaacgacatagccaactgcctgagaaagaacggaaaacgagtaatccagctaagcaggaaaacctttgataccgaataccagaaaacaaagaacaacgactgggactacgtggtgacaaccgacatatcagaaatgggagccaacttccgggcagacagagtaatcgacccgcgtcggtgtctaaaaccggttatactgaaagacggccccgagcgagtaattttggcggggccaatgcccgtcaccgtagcaagtgcagcgcaaaggcgaggccgaatcgggaggaaccagaacaaagaaggagaccagtacgtgtacatgggccagcccctaaataacgatgaagaccacgcgcactggactgaggccaagatgctattggacaacatcaatacaccggagggaataatccctgctctattcgagccagaaagagagaaaagcgcagcgatcgacggagagtaccgactccgtggggaagcccgcaagacattcgtggaactgatgcgtcgaggtgacctccccgtgtggctgagctataaagtcgcatccgagggcttccaatactctgacagaaggtggtgctttgatggagaacggaacaatcaagtactggaggagaatatggatgtagagatttggacgaaagaaggcgagcgaaagaaactgagaccgcgatggctagacgcccggacatacagcgaccccctcgccctccgagaatttaaagagttcgctgcgggcaggcgaagcgtgtccggcgaccttatccttgaaatcggaaaattaccgcagcatctcacgctgcgcgcgcaaaatgcgctggacaacctggtcatgctacataattcggaacaaggaggaaaagcctatcgccatgcaatggaagaactaccagacactattgagaccttgatgctcttggccctgattgctgtgctcaccggtggagtaacgctgtttttcctgagcgggaaggggctgggaaaaacaagcatcggactcctatgcgtgaccgcttcctccgcattactttggatggcctccgtcgagccccactggatcgcggcatccatcatacttgagttctttctcatggtactcctcattccggaaccggataggcaacgaacaccccaagacaaccaactggcatacgtagtaattggcctactcttcatgatactaacggtagcagcaaacgaaatgggcctcctggaaacaacgaagaaagaccttggcataggccacgtagccgctgaaaaccaccaacacgcgaccatgctcgacgtcgacctgaggcccgcgagcgcatggaccctatacgccgtagcaaccacagtcatcaccccgatgatgcgccacaccatagaaaatacaacggcaaacataagccttacagccatagcgaaccaagccgcaatcctcatgggactcgacaaaggttggccaatctccaaaatggacatcggcgtacccctactcgccctgggctgttactcccaagtgaacccgctcaccctcacggcggcagtgctgatgctcgtagcccactacgcaataataggaccgggcctacaggctaaggcaacccgcgaagcgcaaaagaggaccgctgcaggcattatgaagaatccaaccgtagatggaatcgtcgctatagacctcgacccagtcgtctatgacactaaattcgagaaacaactaggacaaataatgttgctaatcctgtgcaccagtcaaatattactaatgcggaccacctgggcactgtgtgagtccataacattggctactggcccactcacaactctatgggagggctctccggggaaattctggaacaccacaatagcggtcagcatggcgaacatcttccggggctcgtacctcgcaggcgcggggctagcgttcagtttgatgaaaagcctaggaggaggcagacgcggcacgggtgcccaaggtgagaccctcggagaaaaatggaaacgccaactcaaccaactaagcaagtctgagttcaatatatacaaacggagcgggataatggaggtagacagatccgaggcgaaagaaggactcaagagaggtgagacaacgaaacacgcggtaagtcgcggaaccgcaaagttacgctggttcgtcgaacgcaacctagtaaaacccgagggaaaggtcatcgaccttgggtgcgggcgaggcggctggtcatactactgcgcagggctgaaaaaggtgaccgaagtaaagggatacactaaaggagggcctggccatgaggaaccaatacccatggcaacgtatggctggaaccttgtcaaactacacagtggcaaagacgtattcttcatgccaccggaaaaatgtgataccctactctgcgacatcggcgagtcgtcccccaaccccactatagaggaggggcgaacacttcgggtactgaaaatggtggagccctggctgcggggcaatcaattctgcatcaaaatcctaaacccttacatgccatcggtcgtcgaaactttagaacaaatgcagcgcaaatacggcggaatgctagtgcgaaaccctctgagcagaaatagtacccacgaaatgtactgggtgagctgcggcacaggaaacatagtatcagccgtcaacatgactagcagaatgttattaaacaggtttactatggcccacagaaagcccacctacgagcgggacgtcgacctaggcgcaggtacgcggcatgtggcagtagagccggaggtagcgaacctcgatataataggacagcgtattgaaaatatcaaaaacgaacacaagtcgacctggcactacgatgaggacaacccctataagacatgggcataccacggatcctatgaggtcaagccaagtgggtccgcctcctccatggtaaacggggtggtacggctcctaacgaagccgtgggacgtcatcccaatggtgactcaaatagccatgacagacacgacgccctttggccaacaaagggtctttaaggaaaaagtagacacccgaacaccacgcgcgaaacgaggcacaacccagatcatggaggtcacggcgaaatggctgtggggattcctatcccgaaacaagaaacctagaatttgcacgcgggaagaatttactagaaaagtcagaagcaacgcggccatcggagcggtattcgtcgacgaaaaccaatggaactctgcaaaagaggcagttgaagacgaacgattctgggatttagtccgacgagagagagagttacacaaacaaggcaaatgcgccacgtgcgtttacaacatgatgggcaagcgcgagaagaaacttggagagttcggcaaggccaaaggctcccgtgccatatggtatatgtggttgggagcgcgatttctcgagttcgaggccttaggttttatgaacgaagaccactggttcagcagagagaacagtctatcaggagtagaaggtgaggggcttcacaaactcgggtatatcctccgcgatataagtaaaataccagggggaaacatgtatgccgacgatactgctggttgggacactcgcatcacagaggacgacctacaaaatgaggccaaaatcactgacattatggagcccgagcacgcactgctcgcaacttccatatttaaactcacgtatcaaaacaaggtcgtgcgcgtccaacgtccagctaaaaacggaactgtaatggatgtcataagccgccgggaccagaggggcagtggccaggttgggacctacgggctaaacacgttcacaaacatggaggtccaactgatcaggcaaatggaaagcgaaggtatattcctcccgagcgagctcgaaacacccaacttggcggagcgtgtactggactggttagaaaagcacggcgccgaacgcctgaagcgaatggcaatatcaggagacgactgcgtggtcaagcctatcgacgaccgattcgcaacagccctaaccgcgctgaacgacatgggaaaagtcagaaaggacatacctcagtgggagccgtcgaaaggatggaatgactggcagcaagtacccttctgcagccaccactttcaccagctaataatgaaagacggtagagagatagtagtcccgtgtcggaaccaggacgaactcgttgggcgagcgagagtaagccaaggagccgggtggagcctccgcgagaccgcctgcctgggaaagtcatacgcgcaaatgtggcaactcatgtacttccatcggcgagacctaagactcgcagcaaacgcaatatgctcggcggtccctgtagactgggtaccaaccagcagaaccacatggtccatccatgcacaccaccaatggatgactacagaggatatgttaagcgtttggaatcgtgtgtggatagaagaaaatccctggatggaagataagacacacgtaagctcatgggaagaggtcccgtatctgggcaaaagagaagatcaatggtgcggctcattaatagggctcacagctcgcgccacgtgggccacaaacattcaggtagcaatcaatcaagtgcggagactcataggcaatgagaactatctcgactatatgacttccatgaaaagatttaagaatgagtcggaccccgaaggggcactctggtga

SEQ ID NO: 23971 - RNA, 9879 nt, synthetic construct
  misc_feature 1..9879: note = derived and/or modified CDS sequence (opt11) from DENV-1__KF973462__SS-prME
  source 1..9879: mol_type = other RNA
agcgtgacaatgttgctcatgctgctgcccacagccctcgccttccacctgaccacccggggcggggagccccacatgatcgtcagcaagcaggagcggggtaaaagtcttctgttcaagacctctgccggggttaacatgtgcaccctgatcgcaatggacctgggcgagttgtgtgaagacaccctgacctacaagtgcccccagatcatcgaggccgagcctgatgacgtggactgctggtgtaacgccaccgacacctgggtaacctatgggacctgcagccagaccggcgagcatcggcgggacaagcgcagcgtcgcactggcgccccacgtgggcctcgggctggagaccagaaccgagacctggatgagctccgagggcgcctggaagcagatccagcgcgtagagacctgggccctgcggcaccctgggtttactgtgatagccctgttcctggcgcacgccatcggaaccagtatcacccagaaggggattatctttatcttgctaatgctggtgacgccttccatggccatgcgctgcgttggcatcggcaaccgggactttgtggaggggttgagcggagccacgtgggtggatgtagtgctcgagcacgggtcctgcgtgactaccatggccaagaacaagcccacccttgacatagagctcctcaagaccgaggtcacgaaccccgccatcctgaggaagctttgcatcgaagccaagatctcaaacaccaccacggactcccggtgcccgacgcagggcgaggctacactcgtggaggagcaggacgccaatttcgtgtgccgccggacctttgtggaccgcggctgggggaatggctgcgggctatttggcaagggtagcttgcttacgtgcgcaaagttcaagtgcgtgactaagctggaagggaagattgtccagtatgagaacctgaagtactccgtcatcgtgacagtgcacactggtgaccaacaccaggtcgggaatgagaccacggagcacggcaccatcgcgaccatcacgccccaggccccgacgagtgagatccagctcacggactatggggccctgaccctggactgctccccccgcactggcctcgacttcaacgagatggtgctcctcaccatgaaggagaagagctggctagtccacaagcagtggttcctggacctgccactcccctggacgtccggggcgagcaccagccaggagacctggaaccgccaggatctgctggtgacgttcaagacggcccacgccaaaaagcaggaggtggtcgtgctcggtagtcaggagggggccatgcacaccgcgttaaccggtgccaccgagatccagaccagcggcaccaccaccatctttgccgggcacctgaaatgtaggctcaagatggacaagctgacgctgaaaggcacctcgtatgtgatgtgcaccggtagcttcaagcttgagaaggaaatggcggaaactcagcacggcacggtcttagtccaggttaagtacgaaggtacagacgcgccgtgtaaaatccccttcagtacccaggacgagaagggcgtgacacagaacggacgtctcattacggccaatccgatcgtgaccgacaaggagaagcccgtgaatatcgagaccgagccgccgttcggggagagttacatagtggtgggcgcaggcgagaaggccctgaagctctcatggttcaagaagggtagcagtatcgggaagatgttcgaggcgaccgctcgcggggcccgccggatggccatcctgggcgacactgcctgggacttcgggtcgatcggcggcgtgttcacatctgttgggaagctggtgcaccaggtgttcggcaccgcctacggggtcctcttttctggcgtgtcctggaccatgaagatcgggataggtattttactgacgtggctggggctgaactctcgctccaccagcctaagcatgacgtgcatcgccgtggggatggtcaccctataccttggcgttatggtacaggctgacagtggctgcgtcatcaactggaaagggcgcgagctgaagtgcgggtccggcattttcgtgacgaacgaggtgcacacctggacggagcagtacaagttccaggccgactcaccgaagcggctcagcgcggccattggcaaggcctgggaagagggggtctgcgggattcgctccgcaacgcggttggagaacatcatgtggaagcagatcagcaacgagctgaaccacattctacttgagaatgacatgaagtttaccgtggtggtcggggacgcaaacggcatcttggcgcaggggaaaaagatgatccgtccacagcccatggaacacaagtactcctggaagtcctggggcaaggccaaaatcatcggcgccgacatacagaatacgactttcatcatcgacggtcccgacaccccggaatgtcccgacaaccagcgtgcctggaacatatgggaggtagaggattacggcttcgggatcttcacgactaacatatggctgaagctgcgcgactcctacacccaggtatgcgaccatcggctcatgtccgcggccatcaaggattccaaagccgtccatgccgacatgggctactggatcgagtccgagaagaatgaaacgtggaagctcgcgcgcgcttccttcatcgaggtgaagacgtgcacgtggcccaagtcgcacacactgtggtccaatggcgtgctggagtccgagatgatcataccgaagatctacgggggtccgatctcccaacacaactatcggccagggtacttcacccaaaccgcgggtccatggcatctcgggaaactggagctggacttcgacctctgcgagggcacgaccgtcgtggtggacgagcactgcggcaaccgcgggccatcactgcgtacgaccacggtgaccggcaaaatcatccatgagtggtgttgccgcagctgcaccctgccgcccctgcggttcaggggggaagacgggtgttggtatgggatggagatccggcccgtcaaggagaaggaagaaaatctggtgcggagcatggtctccgccggcagcggcgaggtggacagcttctccttagggatcttatgcgccagcataatgatcgaggaggtgatgcgatcccgctggtctcgcaagatgctgatgaccggcacgttagccgtgttcctcctgctgatcatggggcagctcacgtggaacgacctgatcaggctgtgcatcatggttggagcgaacgcctcggaccgcatggggatgggcaccacctacttagcccttatggccacgtttaagatgcggccgatgttcgccgtaggtctactcttcagacgcctgacgtcacgcgaggttctgctcctcacaatagggctgtctctcgtggcgagcgtggagctgccgaactctctggaagagttaggcgacgggctcgcgatgggtatcatgatgctgaagctcctgaccgagttccagccccaccagctatggactaccctcctaagcctgaccttcatcaagactacgctgtcgttggactacgcctggaagaccaccgccatggcgcttagcatcatctccctcttccctctatgtctgagtacaacttctcaaaagaccacctggctcccggtactgctgggcagcttcgggtgcaaacccctcaccatgttcctgataaccgaaaataagatctggggccggaaatcctggccccttaacgaagggatcatggcgatcggtatagtgagcatcctgctaagtagcctactcaagaacgacgtccccttagccgggccgttaatcgccggcggcatgctcatcgcatgctacgtgatttctggaagcagcgcggatctgtccttagaaaaggcggccgaggtgagctgggagcaggaggccgagcactcgggcacgagccacaatatcctggtagaggtgcaggatgatggcaccatgaagataaaggacgaggagcgcgatgacactctgaccattctgctcaaggccacgctgctagcggtgtccggcgtatacccaatgagcatccccgccaccctcttcgtgtggtacttctggcaaaagaagaagcaacggtccggggtcctgtgggacactccgagcccgcccgaggttgagcgcgccgtgttagacgacggcatataccggatactgcagcgcggcttgctgggtcggtcccaggtgggggtcggggtgttccaggacggcgtgttccacaccatgtggcacgtgacgcgcggggccgttctgatgtaccaaggtaagcggctcgagcccagctgggccagtgttaagaaggacctcatctcatacggcgggggctggcgctttcaggggtcctggaacacaggcgaggaggttcaggtgatcgcggtggaaccgggcaagaacccgaagaacgtgcagaccacccccgggacgttcaagaccccagagggcgaagtaggggccattgccctggacttcaagcccggcaccagcgggtccccgatcgtgaatcgcgaaggaaagatcgtcggcctgtacgggaacggcgtagtgaccacgagcggaacgtatgtgtccgccatcgcgcaagcgaaggtgagccaggagggtccactgcccgagatcgaagacgaggtgttcaagaaacgcaacctgaccatcatggacctccatccggggagcggcaagacccggcgctacctgccggccatagtacgagaggccataaaacgcaagctccggacgctcatcctggcccccacacgagtcgtggcgtcggagatggccgaggctctgaagggcatgcccataagataccagaccaccgccgtcaaaagtgaacatacggggagagagatcgtggacctaatgtgccatgcgaccttcaccatgcgcctcctgagtccggtgcgagtccccaactacaacatgatcatcatggacgaggcgcacttcacggaccctgccagcatcgcggccagaggctacatatccacgcgagtgggaatgggcgaggccgcggccatctttatgaccgccacaccgcctgggagcgtggaggcctttccccaatccaacgccgtaatccaggacgaggagcgcgacatccccgagcggtcatggaactcgggatacgactggatcaccgacttccccgggaagacggtgtggttcgtccccagcatcaagtccgggaatgatatcgcgaactgcctacgtaaaaacggcaagcgggtcatccagctgagccgcaagacctttgacactgaataccagaagaccaaaaacaacgattgggactacgtggtgacgaccgacatatctgagatgggagcgaacttccgggctgatagggtcatcgacccccggcgctgcctgaagccggtaatcctcaaggacggccccgagcgggtgatcctggccgggccgatgcccgtcaccgtggcctctgcggcccagcgccggggccgcattggccgcaatcagaacaaagaaggggatcagtacgtatatatgggccagcccctgaacaacgacgaggatcacgcccactggaccgaggccaagatgttactggacaacatcaacacgcccgaagggataatccccgcgctgtttgagccagagcgagagaagtccgccgccatcgatggcgagtaccggctccgcggggaggcccgcaagaccttcgtcgagctgatgcggcgtggggacctgcccgtttggctcagctacaaggtcgcgagcgagggcttccaatactcagaccggcgctggtgcttcgatggggagcggaacaaccaggtgctcgaagagaacatggacgtagagatatggacgaaggaaggcgagcgcaaaaaactgaggccccgatggctcgacgcgcgaacctactccgacccgctggccctgcgcgagttcaaggagttcgccgccgggcggcgcagcgtcagcggcgatctaatcctggagatcggcaagctgccccaacacctcaccctgcgggcccagaacgcactggacaacctcgtaatgctacacaactccgaacagggcgggaaggcttaccgccacgccatggaagaactgcccgacacgatcgagaccctcatgttgctggccctcatcgcggtgctcaccgggggcgtcactctgttcttcctgagcggaaaaggacttggaaagacgtccatagggctcctctgcgtgaccgccagctccgccctgctatggatggccagcgtagagccccactggatagccgcgtccatcatcctcgagttcttcctgatggttttactgatcccggagcccgatcggcagcgcacaccccaagacaatcagttagcctacgtggtgataggactcctcttcatgatcctgaccgtagcggccaacgagatggggctgctcgaaacaacaaagaaggacctgggcatcgggcacgtagcggcggagaaccaccagcacgccaccatgctggacgtggatttgcggccggcgtctgcttggaccctgtacgccgtggcgacgaccgtgatcacccccatgatgagacatacaatcgaaaacacgaccgcaaacatctcccttaccgccatcgccaaccaggccgcgatcttaatgggactggacaagggctggcccatcagcaagatggacatcggggtaccgctgctcgccctaggctgctactctcaggtcaaccccctgacgttgacggccgctgtgctgatgctagtggcgcattacgccatcatcgggcccggcctccaggccaaggccactcgggaggctcaaaagcgcaccgcggccgggattatgaagaaccccacggtcgacggcatcgtggccatcgaccttgaccccgtggtctacgacactaagttcgaaaagcagctgggtcagatcatgctcctgatcctgtgcacttcccagatcctcctgatgcgcaccacctgggccctgtgcgagtccatcacgctcgccaccggacctctgaccactctgtgggagggcagcccggggaagttctggaatacgaccatcgccgtctccatggccaacatctttcggggcagctacctcgccggcgccgggttagccttttccttaatgaaatcccttggcgggggaaggcggggtaccggcgcgcaaggcgagaccctgggtgagaagtggaaacgccagctcaatcagctctccaagagcgagtttaacatctacaagcggagcggcatcatggaggtggatcgctccgaggcaaaggaaggtttgaagcggggggagacgacaaagcacgccgtcagccgcgggaccgccaaactgagatggttcgtggagaggaacctcgtgaagccggagggcaaagttatcgacctcgggtgcgggcggggaggatggtcctactactgcgcgggactgaagaaagtgaccgaggtgaagggatatactaagggcggacccgggcacgaggagccgatccccatggccacgtatggctggaacctggtcaggttgcatagcgggaaggacgtcttcttcatgccacccgagaagtgcgataccctcctatgcgacatcggcgaatccagcccgaaccccaccatcgaggaggggcggaccctcagggtcctgaagatggttgagccctggttacgggggaaccagttctgcatcaagatcctcaatccctacatgccgtcagtagtggagacactggagcagatgcagcgcaagtacggcggcatgttggtccggaacccattaagccgcaactccactcatgagatgtactgggtgagctgcggcactgggaacatcgtgtccgccgtaaatatgaccagccggatgctcctaaaccgattcacaatggcccatcgcaagccgacctacgaacgggatgtggatctaggagccggcacccgccacgtggcggttgagcccgaggtggcgaatctggacatcatagggcagcggatcgagaacataaaaaacgagcataagtctacatggcattatgatgaggacaacccctacaagacttgggcctaccacggctcctatgaggtcaagccctccgggtccgcctcaagtatggtcaatggcgttgttcgcctgctcactaagccctgggacgtcatcccaatggtgacccagatcgccatgaccgatacgacgccgttcgggcagcagcgggtcttcaaggagaaagtggacacccgcacgccccgggcgaagcgcggcaccacgcagatcatggaggtgaccgcaaagtggctgtggggcttcctttctcgcaacaagaagccccgaatctgcacaagagaggagttcacgcgcaaggttcgaagcaacgccgccatcggggccgtcttcgttgacgagaaccagtggaacagcgcgaaagaggccgtcgaagacgagcgcttctgggatctcgttcatcgcgaacgcgagctgcacaagcagggcaaatgcgcgacctgcgtttataatatgatggggaagcgggagaagaagctgggcgagttcggcaaggccaagggctctagggcgatctggtacatgtggctcggtgcccggttcctggagttcgaggccctggggtttatgaacgaggatcactggttctctcgcgaaaactccctcagcggcgtcgagggggagggcttgcacaagctggggtacatcctccgggacatcagcaagataccgggaggcaacatgtacgcagatgataccgccggttgggacacccgcattacggaggacgacctgcagaacgaggcgaagattactgacataatggagccagaacacgccctgctcgccaccagcatcttcaagctgacctaccaaaacaaggtggtgcgcgtccagcggcccgccaagaatgggactgtcatggacgtgatcagccgcagagaccagcgcgggagcggccaggtcggcacctacgggttaaacacctttaccaacatggaagtgcaactcatcaggcagatggagtcagagggaatctttctgccgtcggagctggagacgccgaacctagcaaagcgggttttggattggttagagaagcacggtgcggagcggctcaagcgcatggccatcagcggcgacgactgtgtcgtgaagcctatcgacgatcggttcgcgaccgccttgaccgcgctgaacgacatgggcaagatccgcaaggacatcccccagtgggagcccagcaagggctggaatgactggcaacaggtcccgttttgtagccaccacttccaccaactaatcatgaaggacgggcgggagatagtcgtgccctgccgcaatcaggacgagctggtgggtcgggcgcgggtcagccagggcgcagggtggtccttgcgggagaccgcctgcctaggcaagtcctacgcacagatgtggcagcttatgtatttccaccgccgggacctgcggctcgccgcgaacgccatctgctcggccgtgcccgtggactgggtccccaccagccggacgacttggtcaatccatgcccatcaccagtggatgacaaccgaggacatgctgtcggtctggaaccgcgtgtggatcgaggaaaacccatggatggaggacaagacgcacgtcagctcctgggaggaggtgccctacctggggaagcgcgaagaccagtggtgcggcagccttatagggctgactgcgcgggctacctgggccaccaatattcaggtcgcgatcaaccaggtccgtcggctgatcggaaacgagaactatctagactacatgacgtccatgaaacggttcaagaacgagagcgacccagagggggctttgtggtga

SEQ ID NO: 23972 - RNA, 9879 nt, synthetic construct
  misc_feature 1..9879: note = derived and/or modified CDS sequence (opt11) from DENV-1__KF973463__SS-prME
  source 1..9879: mol_type = other RNA
agcgtgactatgctgctcatgctgatgcctactgccctggcattccacctaacgacgcgcggcggggagccacatatgatcgtctccaagcacgagcgaggcaaagcgctgcttttcaagaccagcaccggggtaaacatgtgcacgctcatcgccatggacctgggcgagctgtgcgaggacaccatgacctacaaatgcccccgtatcacggaggccgagccagatgacgtggactgctggtgcaacgccacggacacctgggtcacctacggaacctgcagtcagacgggcgaacaccggagggacaagcggtcggtggccctcgcgccgcacgtgggcctggggctggaaacccggaccgagacctggatgtccagcgaaggggcctggaagcaaatccagcgggtcgagacgtgggccctccggcacccggggtttacagtcatcgcgctgttcctggcgcacgccatcggcacttccatcacccagaaggggatcatctttatcctcctgatgctggtcacgccctcgatggccatgcggtgcgtcggcatcggaaatcgcgacttcgttgaggggctctcgggcgctacctgggtggacgtcgtgctcgaacacgggagctgcgtgactaccatggctaagaacaagccgacgctggacatcgagctcctgaagaccgaggtcaccaaccccgcggtgttgagaaaactctgcatcgaggccaagatctccaacacaacgaccgacagccgctgcccgacccagggcgaggcgacgctggtggaggagcaagacgcgaactttgtttgtagacgcaccttcgtggaccggggctgggggaacggctgcgggctgttcgggaaggggtccttactgacctgtgccaagtttaagtgcgtgactaagctggaaggcaagatcgtacagtacgagaacctcaagtacagcgtgatcgttaccgttcacacgggagaccagcaccaggtggggaacgaaaccacagagcacggcacaatcgcgaccatcacgccccaggcccccaccagtgagattcagttgaccgactacggcgccttaacactcgactgctcaccgcgcacgggtctggatttcaacgagatggttctgctcaccatgaaggagaagtcgtggctcgtgcataagcagtggttccttgacttgccgctgccgtggaccagcggagcctccaccagccaggagacgtggaaccggcaggacctgctcgtgacctttaaaaccgcccacgcaaaaaagcaggaggtcgtagtgttgggcagccaggagggcgccatgcacaccgccctgacgggggccactgagatccagacctctggcaccacgaccatattcgccggccacctcaagtgcagactgaaaatggacaagctcacactgaagggaaccagctatgtcatgtgcacgggttccttcaagttggagaaggaggttgcggagacccagcacggcaccgtgctggtacaggttaagtacgaggggaccgatgccccctgcaagatcccgttctctacgcaggatgagaaaggggtcacccagaacggccgcctgatcactgccaaccctattgtcaccgacaaggagaaaccagttaacatcgagaccgagccccccttcggggaatcctacatcgtggtcggcgccggcgagaaggccctcaagctgagctggttcaagaaagggtccagcatcggcaagatgttcgaagccaccgcgcgcggagccagacgaatggccatcctgggagacaccgcgtgggacttcgggtcgatcggcggcgtgttcaccagcgtggggaagttagttcaccaggtgttcggtacggcgtacggggtcctgttctccggcgttagctggaccatgaagatcgggatcggcatcctattaacctggctgggcctgaattcccggagcacgtccctcagcatgacttgcatcgcggttggtatggtgaccttgtatttaggcgtcatggtacaggccgactccgggtgcgtgatcaattggaaaggccgggaactcaagtgcggaagcggcatcttcgtcaccaacgaggtgcacacctggactgagcagtacaaattccaggccgactccccgaagcgcctgagcgccgccattggcaaggcgtgggaggagggggtgtgcggcatacggtctgcaactcgtctggagaacatcatgtggaagcagatctccaacgaactcaatcatattctgctggagaacgacatgaagttcacggttgtggtgggggatgccaatggtatcttagcgcaggggaagaagatgatccgtcctcagccaatggagcataagtactcgtggaaatcctggggcaaggccaagatcatcggcgctgacatccagaacaccaccttcatcatcgacgggcccgacacgccggagtgtccggacgaccagcgcgcctggaacatctgggaagtcgaggactacgggttcgggatcttcaccaccaacatctggctgaagctgcgggacagctacacacagatgtgcgaccaccgcttaatgtccgcggcaatcaaggacagcaaggccgtccacgccgacatgggctactggatcgagtccgagaagaacgagacgtggaagctggcccgggcgagcttcatcgaagtgaagacctgcacctggcccaagtcccataccctctggtccaacggagtcctcgagagcgagatgataattcccaagatttacgggggtccgatcagccagcacaactatcgccccgggtacttcacgcagacggccggcccctggcacctgggcaagctggagctcgacttcgacctgtgcgaggggaccaccgtagtggtcgacgagcactgcggcaaccgagggccgtctctgagaacgaccacagtgaccggcaagatcatacacgagtggtgctgccggagctgcacgctcccccccctgcgcttccggggggaggacggctgttggtacgggatggagatccgccccgtgaaggagaaggaggagaacctggtccggtccatggtgtctgcaggctccggggaggtggacagcttcagcctaggaatactgtgcgtcagtattatgattgaggaggtgatgcgcagccggtggtcaaggaagatgctgatgaccggtaccctcgccgtgttcctgctgctgataatggggcaactcacctggaacgacctgatcagactctgcatcatggtgggcgctaacgcgagcgacaaaatggggatgggcacgacctacctagccctgatggccaccttcaaaatgcggccgatgttcgccgtcggcatcctcttcaggagactgacctcccgcgaggtgctgctacttacgatcggtctgagcctcgtcgcctccgttgagctgcccaacagcctggaggagctcggcgacgggttggcgatgggcatcatgatgctgaagctcctgaccgagtttcagccccaccagctctggaccaccttgctgtccttaacgttcatcaagacgactctcagcctggactacgcctggaagaccacggccatggcgttgtcaatcgtcagcttattccccctttgcctttccacaacctcccagaagaccacctggctcccggtgctgctgggctccttcgggtgcaagcccctaacgatgttccttatcaccgagaacaagatatggggccgaaaaagctggccgatcaacgagggaattatggcgatcggcattgtgtccatccttctcagctccctgctgaagaacgacgtccccttggccgggcctttgatcgccggcggcatgctgatcgcctgctacgtcatcagcgggagctccgccgacttaagcctggagaaggcggccgaggtgtcctgggagcaggaggcagagcatagcggcacctcacataatatcctagtcgaggtgcaggacgacgggacgatgcgcattaaagacgaggagaaggacgacacgctcaccattctgctgaaggcaaccctcctggcagtgagcggcgtctaccccatgtccatacccgcgacgctgttcgtgtggtatttctggcagaagaagaagcagcggagcggtgtgttatgggacacgccctcaccgcctgaggtcgagcgcgctgtgctggacgacggcatctaccggatcctacagcgcggcctcctggggcggagccaggtgggcgttggagtgttccaggacggcgtgttccacaccatgtggcacgttacgcgcggggccgttctgatgtaccagggcaagcggctggagccctcctgggcgagcgtgaaaaaggacttgatctcttatggcgggggttggcgcttccaggggagctggaacacaggcgaggaggttcaagtgatagccgtggagccggggaagaatcccaagaacgtccagacgactcccggtaccttcaaaacctccgagggggaagtgggggcgatcgccctggatttcaaacccgggacgtcggggtcccctatcgtgaacagggaggggaagatcgtcggactgtacgggaacggtgtggtgacgaccagcgggacttacgtctctgccatcgcccaggcaaagacgagccaggaaggcccgctccccgagatagaagacgaggtgttcaagaagcgcaacctcaccattatggatctgcacccggggagcggcaaaacacggagatacttaccggcgatagtgcgcgaggccataaagaagaagctgcgcactctgatcctcgcccccacccgggtcgttgcctccgaaatggcggaggcactgaagggcatgcccatccgttaccagaccactgccgtgaagagcgaacacaccgggcgcgaaatagtcgacctgatgtgtcacgccaccttcaccatgagacttctgtcccccgtgcgcgtgccgaattataacatgatcatcatggacgaggcacactttaccgatcccgctagcatcgccgcgcgggggtacatctccaccagagtcgggatgggcgaggctgccgcgatcttcatgacggccactccccccggtagcgtggaggcattcccacagagtaacgccgtgatccaggacgaagagcgggacattcccgagcgcagctggaactctggttatgactggatcaccgacttccccggcaagactgtctggtttgtgcccagcatcaagtccggcaacgacatcgccaattgcctgcggaagaacggcaagcgcgtaatccagctgagccggaagacgtttgacaccgaataccagaagacgaagaacaacgattgggactacgtcgtgacgacggacatctccgagatgggggcaaacttccgcgccgacagagtgatcgacccaagaagatgcctgaagcccgtcatcctaaaagacggccctgagagagtgatactcgcggggcccatgccggtgaccgtcgccagcgcagctcagcggagagggcggatcggacgcaaccagaacaaagagggggaccagtacgtgtacatgggtcagcccctgaacaatgacgaggatcacgcccattggaccgaggccaaaatgctgctcgataacataaacacacccgaagggataatcccggccctgttcgagccggaacgggagaaatccgcggcgatcgacggggaataccgcctgagaggggaggccagaaaaaccttcgtcgagctcatgcgccggggcgacctgccggtgtggctgagctacaaggtggcctccgagggatttcagtacagcgaccgccggtggtgcttcgacggggaacggaataaccaggtcctcgaggagaatatggacgtggagatctggacgaaggagggcgagcggaagaagctgcgcccccggtggctggacgctcgcacctattccgaccccctcgcgctgagagagttcaaggagtttgccgccgggcgccggagcgttagcggagacctcatcctggagatcggcaagctgccgcagcacctgaccctccgcgcccagaacgctctggacaacctggtcatgctccacaattccgagcaggggggcaaggcgtaccggcacgccatggaggagctacctgacaccatcgagacgctgatgctcctggcccttatcgccgtgctcaccgggggcgtgacattgtttttcctgagcgggaagggcctcggcaagacctccatcggactgctgtgcgtcacggcgagctccgccctcctgtggatggcctccgtggagccccactggatcgcggcctcaatcatcctggagttcttcctaatggtgctgctgatccccgagcccgaccgccagcggaccccccaggataaccagctggcttacgtcgtaatcggcttgcttttcatgatactcacagtggccgccaacgagatggggctgttagagaccacgaagcgcgacctcgggatcgggcacgtcgccgccgagaaccaccagcacgcgaccatgctggacgtggaccttcggcccgcaagcgcctggaccctctacgccgtggccacgacggtcatcaccccgatgatgcgacacaccatcgaaaacaccacggcgaacatctccttaaccgccatcgccaaccaggccgccatcctgatgggcctcgacaagggttggccaatcagcaaaatggacatcggcgtgcccctcctggcgctcggctgctactcccaggtgaacccactgaccctgaccgcagccgtcctcatgctggtggcgcactacgcgatcatcgggccgggcctgcaggccaaagccacgcgggaggcccagaagcgcaccgccgcggggatcatgaaaaaccccaccgtggatggcatagtcgctatcgacctcgaccccgtggtgtacgacgccaaattcgagaagcagctgggccagatcatgctgctcatcctctgcacctcccagatcctactcatgcgcacgacatgggccttgtgcgaatccatcacactggccaccgggcctctcacgaccctgtgggagggcagcccgggaaagttctggaacaccacgatcgcggtctccatggccaacatctttagaggcagctacctggcgggggcaggcttggccttctccctgatgaagagcctgggagggggccgccgggggacgggagcgcaaggtgagaccctcggcgagaagtggaagcgccaactgaaccaactgtccaagccggagtttaatacctacaagcggagcggcatcatggaggtggaccgcagtgaggccaaggagggactcaagaggggcgagaccaccaagcacgccgtgtcccgtgggacagccaagctgcggtggttcgtagagcgtaacctggtgaagccggaaggtaaagtgatcgacctcggctgtggtcgtggcgggtggagctactactgcgcgggtctgaaaaaggtcaccgaggttaaggggtacaccaagggcggccccggacacgaagagccgatccccatggccacctacggctggaacctggttaagctgcactccggaaaggacgtcttcttcatgccccccgagaagtgcgacacgctcctgtgcgacatcggcgagagctccccgaaccccacaatcgaggaggggcgcaccttgagagtgctcaagatggtggagccatggctgcgcggcaaccagttttgcatcaagatcctgaacccctacatgccgagcgtagtggagaccctcgagcagatgcagagaaagcacggagggatgctggtgcgcaacccattgtccagaaacagcacgcacgagatgtactgggtctcatgcgggacaggaaatatcgtttcggccgtgaacatgaccagtagaatgctcctgaaccggttcaccatggcccaccgcaaacccacgtacgagcgcgacgtcgacctgggcgccggcacgagacatgtggcggtggaaccggaagtcgccaacctcgacataatcgggcagcgtatcgagaacatcaagaatgagcacaagagcacctggcactacgacgaggacaacccgtataaaacctgggcctaccatggctcctatgaagtgaagcccagcgggtctgccagctccatggttaacggcgtcgtgcggctactgacgaagccctgggacgtcatcccgatggtcacgcagatcgcaatgaccgacaccacgccgttcggccagcagcgcgttttcaaggagaaagtcgatacccggaccccccgcgcgaaacgggggaccacgcagatcatggaagtgactgcaaagtggctctggggcttcctgtcccgcaacaagaagccccggatctgcacccgcgaggagttcacccggaaggtccgctccaacgctgcaataggggccgtcttcgtggacgagaatcagtggaactccgccaaggaagccgttgaggatgaacggttctgggacctggtgcaccgcgagcgggagctccacaagcagggcaagtgcgcaacgtgcgtgtacaacatgatggggaagcgcgagaagaaactgggggagttcgggaaggccaagggcagccgggcgatttggtacatgtggctgggcgcccgattcctcgaattcgaagccctggggttcatgaacgaagaccactggttctcacgggagaacagtctctccggcgttgagggggagggactccacaaactggggtacattctgagggacatcagcaagataccaggcggaaatatgtacgccgacgacaccgctgggtgggacacccggattaccgaggacgatttacagaacgaggcgaagattacagacattatggagcctgaacacgccctgctggccacatccatattcaagcttacctaccagaacaaggtcgtgcgcgtgcagcgccccgccaaaaacgggaccgtcatggacgtaatcagccggcgcgaccagcgggggtccggccaggtgggcacgtacgggctgaacaccttcaccaacatggaggtccaactgatcagacagatggagtcagaggggatcttcctcccttcggagctggagaccccgaacctagcagagcgggtgctcgactggctggagaaacatggggcagagcgactgaagcgtatggctatcagcggcgatgattgcgtggtcaaacccatcgacgaccgcttcgccacggccctcacggctttgaacgatatggggaaagtgcggaaagacatcccccagtgggagccgtccaagggctggaacgattggcagcaggtgccgttttgtagccatcacttccaccaactcataatgaaggacggccgagaaatcgtcgtgccctgtcggaaccaggacgagttagtggggcgcgcaagagtctcccagggcgccggatggtcactgcgcgagaccgcctgcctgggcaagtcctatgcacagatgtggcaactcatgtacttccaccggcgcgacctgcggctggccgctaacgccatctgcagcgccgttcccgtggactgggttccgacctcccgcaccacgtggagcatccatgcacaccatcagtggatgaccaccgaggacatgctcagcgtgtggaaccgggtgtggatagaggaaaacccgtggatggaggacaagacacatgtctccagctgggaggaggtgccctacctgggcaagcgcgaagaccagtggtgcggttccctgatcggcctcactgcgcgcgccacctgggccacgaacatccaggtggcgattaaccaagtccggcgcctgatagggaatgaaaactacctggactacatgacgagcatgaaacggtttaaaaacgagagcgaccccgagggcgccctctggtga

SEQ ID NO: 23973 - RNA, 9879 nt, synthetic construct
  misc_feature 1..9879: note = derived and/or modified CDS sequence (opt11) from DENV-1__KF973464__SS-prME
  source 1..9879: mol_type = other RNA
agcgtgaccatgcttctcatgctcctgcccaccgccctcgctttccacctgacaacccggggtggagagccccacatgatcgtgtctaaacaggagcgaggcaagagcctgctgttcaagacctctgccggggtgaatatgtgtacgctgatcgctatggacctgggcgagttgtgtgaggacacaatgacctacaagtgcccgcagatcactgaggccgagccggacgacgtggattgctggtgcaatgctaccgacacctgggtgacctacgggacctgcagtcaaacaggcgagcatcgccgtgataagagatccgttgccctggcgccccacgtgggactgggactcgagacccggaccgaaacctggatgtcgtccgagggggcttggaagcagatccagcgcgtggagacctgggccctcaggcaccccgggttcacggtaattgccctgttcctagctcatgcaatcggcacatcaataacgcagaaggggataatattcattctgctgatgctcgtgacccccagcatggccatgaggtgtgtaggcatcggcaatagggacttcgtggagggtctgagcggagccacgtgggtggacgtcgttctagagcacgggtcctgcgtgaccaccatggccaagaataagcccactctcgacatagagctgttgaagacggaggttaccaaccctgcgattctccgcaagctgtgtatcgaagctaagatcagcaacaccaccacggattcccgttgcccgacccaaggggaggcgaccctggtggaagaacaggacgcgaactttgtatgccgccgaacattcgtggaccgcggctggggaaacggctgcggcctcttcggcaaggggtctcttctgacgtgcgccaagttcaagtgtgtgactaagctcgagggaaagattgtgcaatacgagaacctgaaatattccgtcatcgtgacagtgcataccggcgaccagcaccaagtagggaacgagacgaccgagcacggcaccatcgcgacgatcacgccacaggcgcccacgagcgaaatccagctgaccgactacggggctctgaccctggactgcagtcccagaacaggcctggacttcaacgagatggtactcctgacgatgaaggagaaatcctggctggtacacaagcagtggttcctcgacctacccctgccctggacctccggtgcgagcacgagtcaggagacctggaatcgacaggacctcctggtgaccttcaaaaccgctcacgcaaagaagcaggaagtagtcgtcctgggctcccaggagggggcaatgcacactgcgctcaccggggccacggagattcagaccagcggcacgacgacgatcttcgccggccacctgaagtgccgtcttaaaatggacaagctcaccctgaagggaacctcctacgtgatgtgcaccgggtccttcaaactcgagaaagaggttgcggagacgcagcacggcaccgtactggtgcaagtcaagtacgagggcacagacgccccctgtaaaatccccttctccacccaggacgagaaaggggtgacgcagaacggcagactcattaccgctaatccgatagtgaccgacaaagagaagcccgtcaatatcgagaccgagccgcccttcggggagagctacatcgttgtcggcgccggggagaaggcgctgaagctgtcctggttcaagaaggggagctccattggcaagatgttcgaggctacagccagaggagcccgccggatggctatcctcggagacacggcgtgggatttcgggtctatcgggggcgtcttcacatccgtggggaagctggtgcaccaagtcttcggcactgcatacggggtgctgttctccggcgtgtcctggacgatgaagatcggtatcgggatcctcctgacgtggctggggctgaacagccgctccactagcctgtcaatgacctgcatcgccgtgggcatggtgacgctgtacctcggcgtgatggtccaagccgactccgggtgtgtgatcaattggaagggccgggaactgaagtgcggatcgggaatctttgtgaccaacgaggtccacacctggacggagcagtataaattccaggctgactccccgaagagactgtcagccgccatcggtaaggcctgggaggagggggtttgcggcatccgctccgcaacccgactcgagaacataatgtggaaacagatttcaaacgaactgaaccatatcctgctcgagaatgacatgaagttcacggttgtagtaggagacgctaacggcatcctcgctcagggaaagaagatgattcgcccccagcccatggagcacaagtactcctggaaatcctggggcaaagctaagattattggcgcggacatccaaaacaccaccttcattattgacgggcccgacaccccggagtgcccggacaaccaacgggcatggaacatctgggaggtagaggactacggcttcgggattttcaccaccaatatctggctgaagctacgagactcctatacccaaatgtgcgatcaccggcttatgtcggccgcaatcaaggactccaaggcagtccacgccgacatgggctactggatcgagagcgagaagaacgagacctggaagctggcccgcgcgtccttcatagaggttaagacgtgtacctggcctaaaagccacacgctctggtcaaatggcgtgctggaatcggagatgatcatcccgaagatctatggcggcccgatatcccaacacaactatcggcccgggtatttcacccaaacggccggcccttggcaccttggtaagctcgagctggatttcgacctgtgtgagggcaccaccgtcgtggtggacgaacactgtggcaatagagggcctagcctgaggaccacgaccgtaaccggcaagatcatccacgagtggtgttgtcgttcctgcaccctaccacccttgcggttccgtggtgaggacggctgctggtatgggatggagatacggccggtgaaggaaaaggaggaaaacctcgtccgcagcatggtcagtgcaggcagcggggaggttgacagtttttccctggggatcttatgtgccagcatcatgatagaggaagtgatgcgatcccgctggagcagaaagatgctaatgacgggcaccctggccgtctttctgctgctgataatgggccagcttacctggaacgacctgatccgcctgtgcatcatggtgggtgcgaacgcctccgaccgcatgggtatggggaccacgtacctggctctcatggccacatttaagatgcggccgatgtttgccgttgggctactgttccgccggcttacaagccgcgaagtgctgctgctcactatcgggttatccctggtggcaagcgtggaactccccaactccctggaagaacttggcgacgggcttgcgatgggcatcatgatgctgaagctgctcacggagttccaaccccaccagctatggacaaccctgttgtcgttaaccttcatcaagacgaccctatccttggattacgcctggaagaccaccgctatggcgttgtcgatcatttcccttttcccattgtgcctgagtacgacctcacaaaagaccacctggctgccggtacttcttggcagcttcggatgcaagccactaactatgttcctcatcacagaaaacaagatatggggccggaaaagctggccactcaacgagggtatcatggccatcggtatcgtgagcatcctgctcagcagcctcctgaaaaatgatgtcccccttgccgggccgctgatcgccggcggcatgctgatcgcctgttacgtgatcagcgggtcaagcgcggacctctctctcgagaaggccgccgaggtgagctgggaacaggaggccgagcacagcggcacaagtcacaacatcttagtggaagtgcaggacgacgggaccatgaagataaaggacgaggaaagggacgacaccttaacaatcttgctgaaggccaccctcctggcggtgtccggtgtataccccatgagcatccccgccaccctgttcgtgtggtatttctggcagaagaaaaagcagcggagtggagtactgtgggacacgcccagcccgcccgaagtcgagcgcgccgttctggacgacggcatctatcggatcctccagcggggactgctcggacggagtcaggtaggcgtcggggttttccaggacggagtatttcacacgatgtggcacgtcacccgcggggcggtgctgatgtaccaggggaagcgtctagagcctagctgggcctccgtcaagaaggatctcatcagctacggtgggggctggcgcttccaggggtcctggaacacaggcgaagaagtccaggtgatcgcggtggagcccgggaagaatccgaagaacgtccagaccacgcccggcatattcaaaacccccgagggcgaggtgggggccatcgcgttagacttcaagcccggtacgagcgggagtccgatagttaaccgggagggcaaaattgtggggttgtacgggaacggcgtggtgaccacttccggtacctacgtctccgccatcgcgcaggccaaggcgtcgcaggagggacccctccccgagatcgaagacgaagtgttcaagaagcgcaacctgaccatcatggacttacacccggggtccggcaagacacggcgctacctccccgccatggttcgggaggcgattaagaggaagctgcggacgctgatcctcgcgcccacacgcgttgtggcctcggaaatggccgaggccctgaaaggcatgcccatccgctaccaaaccaccgccgtcaaaagcgagcatacggggcgggagatagtcgacctgatgtgccacgcaaccttcaccatgcgcctcctgtcccctgtgagagtgcccaattataacatgattatcatggatgaggcccacttcaccgaccctgccagcatcgccgcccgcggctatatctccacacgggtcggtatgggcgaggcggctgcgattttcatgaccgcaaccccgcccgggagcgtggaggccttcccacaatccaacgcggtgatccaggatgaggaacgcgacattcccgagcggagctggaactccggctatgactggattaccgacttccccggcaagactgtctggttcgtgccgagcatcaagagcgggaatgacatcgcaaattgcctgcgcaagaatggcaaacgcgtgattcagttaagccgtaaaacctttgacaccgagtaccaaaagaccaaaaacaacgactgggattacgtcgttacgaccgacatcagtgagatgggcgccaactttagggctgaccgcgtgatcgacccgcggcgctgccttaagcccgtcatcttaaaagacggccccgagcgggttatcctcgcggggccgatgcccgtcacagtcgcctcggcagcacagaggagaggccgtatcggcagaaatcagaacaaggagggggaccagtacgtgtacatgggccaacccctgaacaacgacgaggaccacgcccactggaccgaggccaaaatgctgcttgacaacatcaacacgccagagggaatcatcccggccctgttcgaaccagagagggagaaatccgccgcgatagatggcgagtaccgcctgcgcggggaagcccggaagaccttcgtggaactcatgcggcgcggcgacctgccagtttggctgtcttataaggtggcctccgagggtttccagtactcggaccggagatggtgtttcgatggtgaaaggaacaaccaggtcctagaggagaacatggacgtcgagatctggaccaaggagggcgaacgaaagaaactgcgccccaggtggctggacgcccggacctactccgacccgctcgccctccgtgagttcaaggagttcgccgccgggcggcgtagcgtgagcggagacctcatactcgaaattggaaaacttccccaacatttgacccttcgcgctcagaacgcgctggataacctggtcatgctccacaattccgaacagggcggtaaggcctacagacacgctatggaggaattacctgacaccatcgagacactgatgctcttagcgctgatcgccgtgttgaccggtggggtgactctgttcttcctaagcgggaagggcctaggcaaaacgtctatcgggctgctatgcgtcaccgcctcatccgccctgctgtggatggccagcgtagagccccactggatcgcagcctccatcatcctggagttcttcctcatggtgctgctgatcccagagcccgaccggcagcgtacgccccaagacaaccaactagcctacgtcgtgatcggcctgctgttcatgatcctcaccgttgctgccaatgagatggggctgctggagaccactaaaaaggacctcggcatcgggcacgtagctgccgagaatcatcaacatgcgacgatgctggacgttgacctgcggccggccagcgcctggacactctatgctgtggcgacgaccgtcatcaccccgatgatgaggcacaccatcgagaacaccacagccaacatctccctgacagccatcgccaatcaggcggccatcctgatgggattagacaagggctggcccatcagcaagatggacatcggggtgcccctgctggcattagggtgctactcgcaggttaacccgctgaccctgacggccgcggtgctcatgctcgtcgctcattatgcgatcatcgggcctggcctgcaggccaaagccacccgcgaggcgcagaagcgcaccgccgccgggatcatgaagaaccctaccgtggatggcatcgtcgccatcgacttggacccggtggtgtacgatacgaaatttgaaaagcaactgggccagatcatgctgctcatcctgtgcaccagccaaattctgcttatgcgcacaacctgggccctttgcgaatccatcacgttggccacagggccgctcaccaccttatgggagggcagcccagggaagttctggaatacgaccatcgccgtctcaatggccaacatttttcggggctcatacctggccggggccggtctcgcgttttctctgatgaaaagcctgggcgggggccgccgggggacaggcgcccaaggcgagaccttgggtgagaagtggaaacggcagttaaaccagctgtccaagagcgagttcaacatctacaagcggagcggcatcatggaggtggaccggtcagaggctaaggagggcctcaagcggggcgagacgacgaagcatgcggtgagccgcggaaccgcgaaactgcgctggttcgtcgagcggaacttagtgaagccagaaggcaaggttatcgacctggggtgcggccggggcggctggtcgtactactgcgctggcttgaagaaggttaccgaggtaaaggggtacacaaagggtggtcccggccacgaggagccgatccccatggccacatacggctggaacctggttaaattacatagtggtaaggatgtcttcttcatgccgcccgaaaagtgcgataccctcctttgtgatataggcgagtcttcaccgaaccctacaatcgaggaggggcgcaccctgcgggtactcaagatggtggagccctggctgcgaggtaaccagttctgcatcaaaatcttaaatccctacatgccgtccgttgtggaaacgctagagcagatgcagcggaagtatggcggcatgctggtgcgcaacccactgtctcggaactcaacccatgagatgtactgggtctcctgcggcaccggaaacatcgtatcggccgtcaacatgaccagcagaatgctcctgaacagattcacgatggcccaccgcaagcccacctacgagcgcgacgtggacctcggcgcgggaacccggcacgtggccgttgagcccgaggtagccaacttagatatcatcggtcagcgcatcgagaatatcaagaacgagcacaagtcaacctggcattacgacgaagacaacccgtacaaaacttgggcttaccatggctcttacgaggtgaaacccagtggaagcgcctccagcatggtgaatggcgtcgtccggctgttgaccaagccctgggatgtgatccccatggtcacccaaatcgcgatgaccgatacaacaccgtttgggcaacagcgcgtgttcaaggagaaggtcgacacccggacgccccgggcaaagagaggcacgacccagattatggaagtcacggcaaaatggctctggggcttcctttcgcgcaacaagaaaccccgcatttgcacccgcgaggagttcacccggaaggtgcgcagcaacgccgccatcggagcggtcttcgtggacgagaaccaatggaactcagccaaggaggccgtcgaagacgagcggttctgggacctagtccaccgcgagcgtgagctccacaagcagggtaagtgcgcgacatgcgtgtacaatatgatgggaaagcgcgagaaaaagttgggcgagttcgggaaggcaaagggctcccgcgccatctggtacatgtggctgggtgcccgcttcctcgagttcgaggccctggggtttatgaatgaggatcactggttttcacgggagaactccctgtccggcgtagaaggggaggggcttcacaagctggggtacatcctgcgcgacatctccaagatccctggcggcaacatgtacgccgatgacaccgctgggtgggatactcggatcacggaggatgatcttcagaacgaggccaaaataaccgacataatggagcccgaacacgccctattggccacttccatatttaagctaacctaccagaacaaagtcgtacgcgtccagcgcccagccaaaaacggcacggtcatggacgtaattagccggagagaccagaggggcagcggccaagtgggaacctacggtctgaataccttcactaacatggaggtccagctgatccgccaaatggagtctgagggcatcttcctccccagcgagctggagacaccaaacctggccgagcgagtgctcgactggcttgagaagcacggggccgagagactgaaacgtatggccatctccggcgacgactgcgtggtaaagcccatcgacgaccgcttcgccaccgccttaaccgcgctgaacgacatggggaaggtgcggaaggacatcccacagtgggagcccagcaagggctggaacgactggcagcaggtcccgttctgctcccatcacttccatcagctgattatgaaggatggccgcgagattgtagtgccctgccggaatcaagatgagctcgtgggaagggcccgggtaagccagggcgccgggtggtccctccgggaaaccgcttgcctgggcaagagctacgcccagatgtggcaactcatgtatttccacaggcgagacctgcggctggcggccaatgccatctgctctgccgtgcccgtggattgggtccccacaagccgcactacttggagcatacacgctcaccatcagtggatgaccaccgaggacatgctctccgtgtggaacagagtttggatagaggagaacccgtggatggaggacaagacgcatgtcagctcctgggaggaggtgccctacctggggaagcgcgaggaccaatggtgcgggagcctgatcgggctcacggctcgtgccacctgggcgaccaatatccaggtggccattaaccaggtcaggcgcctgattgggaatgagaactacctggactacatgacgtccatgaagcggttcaagaacgagagtgaccccgagggtgcgctctggtga

SEQ ID NO: 23974 - RNA, 9879 nt, synthetic construct
  misc_feature 1..9879: note = derived and/or modified CDS sequence (opt11) from DENV-1__KF973465__SS-prME
  source 1..9879: mol_type = other RNA
agcgtaaccatgctgctcatgcttctgccgacggcccttgcctttcatctgacaacgcgtggcggtgaacctcacatgatcgtatctaaacaagaacggggcaagagcctcctatttaagacaagcgccggcgtaaacatgtgcacccttatcgccatggacctgggtgaactctgcgaagacacaatgacgtacaagtgcccccagattaccgaggccgagcccgacgatgtggattgttggtgcaacgctaccgacacgtgggtaacctacgggacctgcagccagaccggcgagcaccggcgggacaagcgatcggtggccctggcgccccacgtcggcttggggcttgagactcggacggaaacttggatgtcttctgagggcgcctggaaacagatccaacgtgtagagacctgggctttacggcaccccgggttcacggtgatcgcccttttcctagcgcacgcgatcggcaccagtatcacccagaaggggatcatctttatcctgctgatgctcgtcacccccagtatggccatgcgctgcgtcggcatcggtaatcgggacttcgtggaggggctaagcggcgccacgtgggtggacgtggtgctagaacacgggtcttgtgtgaccaccatggccaaaaacaagcccacgcttgacatagagctgctgaagacggaggtcaccaacccagcgatcctccgcaagctgtgcatagaggccaagatctctaacacgaccaccgattcccggtgcccaacacagggcgaggccaccctggtggaggagcaggacgccaattttgtgtgcagacgaaccttcgtcgatcgcggctggggcaacggctgcggcctgttcggcaaggggagcctgctgacgtgcgctaaattcaagtgcgtaaccaagctcgaagggaagatcgtgcagtacgagaacctgaagtactcagtaattgtaaccgtgcataccggcgaccagcaccaagtggggaacgaaaccacggagcatggcactatcgctactatcactccccaagctcccacatctgagatccagctgacagactacggtgccctcaccctggactgcagccctcggacgggcctggacttcaatgagatggttctcttgacaatgaaggagaagtcctggctggtccacaagcaatggtttctggacctccctctgccctggacatccggggcctctaccagccaggagacgtggaaccgccaggacctcctggtgacgttcaagaccgcacacgcgaagaagcaggaggtggtcgtactgggatctcaggagggcgccatgcacaccgccttaactggagccacggaaatccagacctcaggcacgactacgatattcgcaggtcacctaaagtgtcggttaaaaatggacaaactaactcttaagggcacctcctatgtaatgtgcaccgggagctttaaactggagaaggaggtcgcggagacgcagcatggcaccgtgctagtgcaggtaaaatatgaaggcactgacgccccctgcaagatacccttctccacccaggatgagaagggggtcacgcagaacggccgcttgatcacagcgaaccctatcgtcacggataaggagaaacccgtaaacatcgagaccgaacctccttttggggaaagctacatcgtggtcggcgctggtgaaaaggctttaaagctctcctggttcaagaaggggtcgtccatcggcaaaatgttcgaggccacggcacgcggggcgcgcagaatggccattctcggcgacacggcgtgggactttggtagcatgggaggcgtcttcacatctgtcggtaaacttgtacaccaagtcttcggcacagcttatggagttctgttctctggcgtctcctggacgatgaagatagggatcggcattttattgacttggctgggcctcaacagccgctcaaccagcctgtccatgacgtgcattgccgtggggatggtaacgctgtacctcggcgtcatggtccaggcagacagcggttgtgtgatcaactggaaggggcgggagctgaagtgcggctcggggatcttcgtaaccaatgaggtccacacctggaccgagcaatacaaatttcaggccgacagcccgaaacggctgagtgcggccatcggcaaggcatgggaggagggggtgtgcgggataaggtctgccaccagactagagaacataatgtggaagcagatctcgaacgaactgaaccacatcctgctggagaacgatatgaagttcactgttgttgttggtgacgcaaatggcatcctcgcgcaggggaagaagatgatcagaccccagcccatggagcacaaatattcctggaagtcctggggcaaggccaagatcattggggcggacatccaaaataccacctttatcatcgacgggcccgacaccccggagtgccccgacaaccaaagggcctggaacatatgggaggtagaggactacggcttcgggatcttcacaaccaacatatggctgaagctccgagactcatacacgcaaatgtgtgaccaccggttgatgtccgcggctattaaagactccaaggccgtgcacgctgatatgggctactggatcgagagcgagaagaacgagacatggaagctggcgagggcctcgtttatcgaagtgaagacgtgtacatggcccaagtcccacacactctggtcaaacggagtgctggagagtgagatgatcatccccaagatctatggagggccgatatcccagcacaattaccgacccgggtacttcactcagacggccggtccctggcacctgggcaagctcgagttagacttcgagctgtgtgagggcaccaccgtcgtggtggacgagcactgcggtaaccgcgggccgagcctccgaaccacgaccgtcactggcaagatcattcacgagtggtgctgtcgttcctgcaccttgccgcctttgcgtttcagaggggaagacgggtgctggtacgggatggaaatccggcccgtgaaggaaaaggaggagaacctcgtgcgatcaatggtctccgccggcagcggtgaggtggatagcttcagtcttgggatcctatgcgcttccattatgattgaggaagtcatgcggtcgaggtggagccggaaaatgctcatgacgggcaccctggctgtgtttctgctactgatcatgggccagctgacctggaacgacctcataaggctgtgcatcatggtgggtgcgaacgcgagcgaccgcatgggaatgggcaccacctatctagccctcatggccacctttaagatgaggcccatgtttgcagtggggttacttttccgccggttaaccagccgtgaggtgctgctgctcaccattgggctgtccctggtagcgtcagtggagctaccgaactccctggaggaactcggcgacggtctcgccatgggcatcatgatgttgaaacttctcacggagttccagcctcaccaactgtggaccaccctgttaagcctgaccttcatcaaaacgaccctgagtctcgactacgcttggaagaccaccgcaatggcgctgagcataatctctctgtttcccttatgtcttagcaccacgtcacagaagaccacctggctgccggtcctcctgggcagtttcgggtgcaaaccgctgacaatgttcctcatcacggaaaacaaaatctggggtcggaagtcctggccgctgaacgaggggattatggccataggcatcgtaagcattctcctctcgagcctgttgaaaaacgacgtccccttagccgggcctctaatcgccggtggtatgctaatcgcctgttacgtgatctctgggtccagcgcggacctctcattggagaaggccgccgaggtgagctgggagcaggaggcagagcatagcggcacaagccataacatactggtcgaagtgcaggacgacggaacaatgaagattaaggacgaggagcgcgatgacaccctcacgatcctcctgaaggccacgctcctggccgtgtctggggtctatcccatgagcatccccgccaccctgttcgtttggtacttctggcaaaagaagaagcagcggtcgggggtgctctgggatacccccagcccgcccgaggtcgaacgcgccgtcctcgacgacggcatctaccggatccttcagcgcggtctgctcggacggagtcaggtaggggtgggggttttccaggacggcgtcttccacacgatgtggcacgtcacccgcggggccgtgctgatgtaccagggtaagcggctggaacccagctgggcctcggttaagaaagaccttatttcttacggtggtgggtggcgcttccaggggagttggaacacaggtgaggaggttcaggtgattgcggtagagccggggaagaacccgaagaacgtccagaccacccctggcacgtttaagactcccgaaggtgaggtgggggccattgccctagacttcaaacccggcacgagcggcagtcccatagtgaaccgggagggcaagatcgttggcttgtacgggaacggcgtggtgacgaccagcgggacttacgtctccgccatagcccaagcgaaggctagccaggaaggccccctccccgaaatcgaggatgaggtattcaagaaacgcaacctgacaatcatggatctgcacccggggagcggcaagacgcggaggtatctccccgccatagtgcgagaggccatcaaacgtaagctgagaaccctcatcctcgcgcccactagggtcgtcgcatccgaaatggccgaggcactgaaaggcatgcccatccgctaccagacaaccgctgtcaaaagcgagcacaccgggagggagattgtcgacctgatgtgccacgcgaccttcaccatgcgcctcctgtccccggtaagggtgcccaactataacatgattatcatggacgaggcgcactttacggaccccgccagcatagccgcacgcggctatatctccacgagagttgggatgggcgaagcggctgcaatcttcatgacagccacgccacccggcagtgtggaggcctttcctcagtccaacgcggtgatacaggacgaggagcgcgatatccccgagcggagttggaatagcggctatgactggattacagacttccccggcaagaccgtttggttcgtgccctcaatcaagtcagggaatgatattgctaactgcctgcgcaaaaacggcaagcgcgtgatccagctaagccggaagacgttcgatactgagtaccaaaagactaagaacaacgactgggactacgtggtgaccacagacatctccgagatgggggccaacttccgggccgaccgagtgatcgacccccggcgttgcctaaagcccgtcatccttaaggacggccccgagcgggtaattttagcggggcctatgcccgtgactgtcgcgagcgctgcccagcgccggggccgcatcggccggaatcagaataaggaaggggatcagtacgtctacatgggccagcccttgaacaacgacgaggatcatgcgcattggacggaagcaaagatgctgctcgacaacattaacaccccagaggggatcatcccggctttgttcgagccagagcgtgagaagtccgccgccattgatggcgagtaccgcctccgcggggaggcccgcaagaccttcgttgagcttatgcggcgcggcgacctacccgtgtggctaagctacaaggtggcgtctgagggctttcagtattccgatcggcgctggtgcttcgacggggagcggaacaaccaggtgttagaggaaaacatggatgtggaaatatggaccaaggagggcgagcgcaagaaactaagaccccgctggctggacgcccggacctattccgacccactcgcacttcgcgagttcaaggagttcgccgctgggcggcgctccgtaagcggcgacctgatcctagagatcggcaagctgccccagcacctgacgctcagagcccagaacgccctggataacctggtcatgctccacaactccgaacagggagggaaggcctacaggcatgccatggaggagcttccagacaccatcgagactctgatgctcctggcgttaatcgccgtattgaccgggggtgtgacactgttctttctgagcggtaagggcctcggcaaaacctccatcgggctgctgtgcgtcaccgccagttccgccttgctgtggatggccagcgtagaaccccattggatcgcggcttctatcattcttgagttctttctgatggtgctgctgattccggagcccgaccgtcagcgaacgcctcaagataaccagctcgcctacgtcgtgatcggcttactctttatgattttaacggtggccgcaaacgaaatggggctgctggagactaccaaaaaggacctcgggataggccatgtcgcagcagagaaccaccaacacgccaccatgctggacgtggatcttcgacctgccagtgcctggacgttatacgcggtggccacaactgtcatcacacccatgatgagacacacgatcgagaacaccacagctaacatcagtctcaccgccattgcgaaccaagccgcgatcctcatgggactcgacaagggttggcccatctcgaagatggacatcggggtgcccctgctcgccctcggctgctactcccaggtgaacccccttacgctgacagccgcggtccttatgttagtggctcactacgctatcataggccccggccttcaagcaaaggccacccgggaagcgcaaaagcgcaccgccgccggaataatgaagaacccgacagtggacggtattgtcgcgatcgatttagatcctgttgtctacgacaccaaattcgagaagcaactgggtcagataatgctcctcatcctgtgcaccagccagatcctcctcatgcggaccacgtgggccctgtgcgagtccatcacccttgccacggggcccctcaccaccctctgggagggaagcccaggtaagttctggaacacaaccatcgccgtctccatggccaacattttccggggcagctatctggctggcgccgggttggctttctcccttatgaagagtttaggcgggggtcgcaggggaaccggggcccagggtgagacgttaggggagaagtggaagcgccagctgaaccaactgtccaagtctgagtttaacatctacaagcggtccgggatcatggaagtggaccgctcagaggccaaggagggcctgaagcggggcgagacgacaaagcacgccgtcagtcgcgggaccgcgaagctgcgatggttcgtcgaaagaaacctggtgaagcccgagggaaaggtaatcgacctcggctgcggtaggggcgggtggtcctactattgcgcgggcctcaaaaaggtcacagaggtgaagggctatacgaaagggggccccggacacgaggagcctatacccatggcgacatacggctggaacctggtgaagctccattcgggcaaggacgtcttcttcatgccgcccgaaaagtgtgacaccctcctgtgcgatatcggagagtccagcccgaaccccaccatagaagaagggcgcacgctgcgggtactcaagatggtggagccctggctacgcggcaaccagttctgcattaagatcctgaacccctacatgccgagcgtcgtagagactctcgaacagatgcaacgtaagtatggcggtatgctggttcgcaaccccctgagccggaactcgacccacgagatgtactgggtcagctgtggcaccggcaacatcgtgtccgccgtaaatatgacgagccgcatgctcctgaatcggttcaccatggcacatcgcaagccgacttacgagagagacgtcgatttgggcgctggcactcgccacgtggccgttgagccagaggtcgcaaatctcgacatcatcggacaacgaatcgagaacatcaaaaacgaacataagtcaacatggcattacgatgaagataatccctacaagacctgggcctaccacggaagttacgaggtaaagccctccggcagcgcctcctccatggtgaatggcgtagtgcggctgctaactaagccctgggacgtgatccctatggtgacacagatcgcgatgactgacaccacaccgtttgggcagcaacgcgtttttaaggaaaaggttgacacccgcacgccccgcgcgaagcggggaaccacccaaatcatggaagtgacagccaagtggctctggggcttcctgtccaggaacaaaaagccacggatctgcactagagaggagttcacgcggaaagtaaggagtaatgccgcaataggggcggtgttcgtggacgagaatcagtggaacagcgcgaaggaggctgtcgaggacgagagattctgggacctcgtacgccgggagagagagctccacaagcagggtaagtgcgcaacctgcgtttacaacatgatggggaagagagagaagaagttaggcgagttcgggaaggccaaggggtcccgcgccatatggtatatgtggctgggcgcacggttcctcgagtttgaggccttggggttcatgaacgaggatcactggttctcgcgcgagaactccctctcaggtgtggaaggcgagggccttcacaaacttgggtacatcctgcgcgacatttcgaagataccaggcggcaacatgtacgcggacgacacggcgggatgggacacgcgcataaccgaggacgacctccaaaacgaagccaagataaccgacatcatggagcccgagcacgcgcttctggctaccagcattttcaaactcacctaccaaaacaaggtcgtgcgcgttcaacggcccgccaaaaatgggaccgtcatggacgtcatctcccggcgtgatcagcgcgggagcggccaggtgggcacatatgggctgaacaccttcacgaacatggaagtgcagctgattcggcagatggagtccgagggcattttcctccccagtgaactggagaccccgaaccttgcggaacgcgttttggactggctcgagaaacacggggccgagcggctgaagcgcatggctatctccggcgacgattgcgtagtcaagcccatcgacgaccggttcgccaccgcgctcaccgcgcttaacgacatggggaaagtgcgcaaggacatcccgcagtgggagcctagtaagggatggaatgactggcagcaggtacctttctgttcccatcacttccatcagctgatcatgaaggacggaagggagatagtagttccttgccggaaccaggatgagctcgtagggcgcgcccgcgtaagccagggtgccggttggtccctgagggagacggcgtgcttaggcaagagctatgcgcagatgtggcagctaatgtacttccacagacgggatctccgactggcggccaatgccatttgtagtgccgtgcctgtggattgggtccccaccagccggactacctggtccatccacgcgcatcaccagtggatgactacagaggacatgttgtcagtgtggaatcgcgtgtggatcgaagagaacccgtggatggaagacaagacccacgtcagctcctgggaggaggtgccctatctggggaagagagaggaccagtggtgcggcagcttaatcggcctcaccgcccgggctacgtgggccaccaacatccaggttgccataaaccaggtccgcagattaattggtaacgagaactacctggattacatgacctccatgaagcgctttaagaacgagtctgacccagaaggagccctctggtga

SEQ ID NO: 23975 - RNA, 9879 nt, synthetic construct
  misc_feature 1..9879: note = derived and/or modified CDS sequence (opt11) from DENV-1__KF973466__SS-prME
  source 1..9879: mol_type = other RNA
tccgtgaccatgctgctcatgttgatgcccaccgccctggccttccacctcacgacccgcggcggggagccgcacatgattgtctccaagcatgagcggggcaaggcgctcctgttcaagaccagcaccggggttaacatgtgcacgctcatcgccatggatctgggcgaactgtgcgaggacaccatgacctacaagtgcccccgcatcaccgaagccgagcccgatgacgtggactgctggtgtaacgcgacggacacctgggttacttatgggacgtgctcccagacgggcgagcaccggcgagacaagaggtcggttgccttggcgccccatgtgggcctggggcttgagacccgtaccgagacctggatgtccagcgagggagcctggaagcaaatccagcgggtcgagacctgggcacttcgccacccgggattcaccgtaatcgccctgttcttagctcacgccatcggcacctccatcacccagaaaggcatcatcttcatcctcctgatgttagtgacgcccagcatggcgatgcggtgcgtcggaatcggcaaccgcgatttcgtggagggactatccggcgcaacgtgggtggatgtcgtgctggagcacggtagctgcgtgaccactatggccaagaacaagcccacgctggacattgagctcctgaaaaccgaggtcaccaaccccgcggttctgcgaaaattgtgcatagaggccaaaatatccaacacgaccactgactcgaggtgcccgacccagggcgaggccactctggtggaggaacaggacgccaacttcgtctgccggcgcacgttcgtggaccggggctgggggaacggatgcgggctgttcgggaagggttcccttctgacctgcgccaaattcaaatgcgtgaccaagctggagggcaagattgtccagtacgagaacctcaagtacagcgtgatagtgaccgtccacacaggcgaccagcaccaggtggggaacgaaaccaccgagcatggcactatcgcgaccataacgccccaggcccccacatccgagatccagctgaccgattacggggctctgaccctagattgcagcccccggactggcctggacttcaatgagatggtcctgctcacaatgaaggagaagtcctggctggtgcacaagcagtggttcctagacctcccgctgccctggaccagcggagcctccaccagccaggagacatggaaccggcaggatctcctcgtaaccttcaagaccgcccacgcgaagaaacaggaggtcgtagtgctgggcagccaggagggcgccatgcataccgctctgacgggggccaccgagatccagacgtccgggaccactaccatattcgccgggcacctcaaatgccgcctgaaaatggataagttaacattaaaaggcaccagctatgtcatgtgcacgggatctttcaagctggagaaggaggtggcggagacccagcacggcaccgtgctcgttcaggtgaagtacgagggcaccgacgccccctgcaagatacctttcagcacgcaggacgagaagggggtgacccagaacggccggctgatcacggccaatcccattgtcaccgacaaggagaagcccgtgaatatcgagacggagccaccctttggggagtcctacatcgtcgtaggcgccggcgagaaagcgctcaagctgagctggttcaagaaaggatccagcatcggcaagatgttcgaggccaccgcccgcggggcccggcgtatggcgattctcggcgacaccgcgtgggacttcggctccataggcggtgtattcaccagcgtggggaaattagtccaccaggtattcggcacggcctatggggtactgttttccggcgtcagctggacaatgaaaattgggatcggcatcttactcacgtggctgggcttgaactcccgcagcacgtccctctcaatgacgtgtatcgccgtggggatggtgacgttatacctgggcgtcatggttcaggccgactccgggtgcgtaattaattggaagggccgggagctcaagtgcgggagcggcatctttgtcactaacgaggtgcacacctggaccgagcagtataagttccaggctgactccccgaagcgcctgagcgcggccatcggcaaggcctgggaggagggggtgtgcggcataaggagcgccacccgcctggagaacattatgtggaagcagatctccaacgagcttaaccacatcctgcttgagaacgacatgaagttcaccgtcgtggtgggggatgctaacggcatcctcgcgcaaggtaagaagatgatccggccccaacccatggagcacaagtatagctggaagtcttgggggaaagcgaagatcatcggcgccgacattcagaataccactttcatcatcgacgggcccgatacgccggagtgccccgacgaccagcgcgcctggaacatctgggaagtcgaggactacggtttcgggatcttcaccactaacatatggctgaagctgcgggacagctacacccagatgtgcgaccaccgcctcatgtcagcggccatcaaagacagcaaggccgtgcacgccgacatgggatactggatcgagtccgagaaaaatgagacttggaagctggcccgggccagctttattgaagtgaaaacctgcacctggcccaaatcgcacaccctgtggagcaacggcgtccttgagtccgagatgatcatccccaagatctacggaggcccgatctcccagcacaactacagaccggggtacttcacgcaaaccgccggcccctggcatctgggaaaactagagttagacttcgacctgtgcgaggggaccaccgtggtggtcgacgagcactgcggcaaccgggggccgtcattgcgcacgaccaccgttaccgggaaaataatccacgagtggtgttgcaggagctgcaccctaccacccctgcggttcagaggggaggacggatgctggtacgggatggagatccgccccgtgaaggagaaggaggagaatctggtacggagtatggtgagcgcaggctccggcgaggtagacagcttctctctcgggatcctgtgcgtctccatcatgatcgaggaggttatgcgcagccgctggtcccgcaagatgctgatgaccgggaccttagccgtgttcctactgcttatcatggggcagctgacatggaacgacttgatcagactctgcatcatggtcggagccaatgcgagcgaccgcatggggatgggcacgacctatctggctttaatggccaccttcaagatgcgcccgatgttcgccgtgggcatcctctttcggcgcctcacctccagggaggtgctgctactgacgatagggcttagcctcgtcgcctccgttgagctgcccaacagcctggaggaattgggcgacggcctggcgatgggcatcatgatgctgaagttgctgaccgagttccagccccaccaattatggaccacactcttgagcctgacgttcatcaagaccactctaagcctggattacgcctggaagaccacggcgatggccctgtccattgtcagtttattccccctgtgcctgtccaccaccagccagaagacgacctggctcccggtactgctgggttccttcggctgcaagcccctaacgatgttcctgatcaccgaaaataaaatctggggccgcaagtcatggcccatcaacgaggggataatggcgataggcatagtgtccatcctgttatcctccctgctgaaaaatgacgtacccctcgcaggaccgctgatagccggcggtatgctgatcgcctgctacgtcatcagcggcagttccgccgaccttagcctggagaaggcggccgaggtgagctgggaacaggaggccgagcacagcggcacctcccacaacatcttggtcgaggtgcaagacgacgggaccatgcggatcaaggatgaggaaaaggacgacacgctcaccatcctgctgaaggccaccctcctggctgtgagcggcgtttaccccatgtccatccccgcgaccctgttcgtgtggtacttctggcagaagaagaaacagcgcagcggggtgctctgggacacgccctccccgcccgaggtcgagcgggctgtgctggacgacggcatctaccgcatcctgcagcggggcctcctggggcgcagccaggtcggggttggggtttttcaggatggcgtgttccacaccatgtggcatgtcaccagaggggcagtcttaatgtaccagggaaagcgcctggagccctcctgggcctcggtgaagaaggacctcatctcatacggcgggggttggcggttccaaggatcctggaacacaggcgaggaggtccaggtgatcgccgtagagcccgggaaaaacccgaagaacgttcagacaacccccggcactttcaagacttccgagggcgaggtgggggcgatcgccctggacttcaagccgggcacgagcgggtcccccatcgtgaatcgcgagggcaagatagtcggcctgtacgggaatggcgtggtaaccacctctgggacctacgtctccgcaatcgcccaggccaagaccagccaggagggcccgctccccgaaatcgaggacgaggtgtttaagaagcggaatcttaccatcatggacctgcatcccgggagcggcaagacccgccgatacctcccggcgatcgtgcgcgaggccattaagaggaaactgcgcactctgatcctcgcccccacgcgtgtggtcgcctcagagatggcggaggccctgaaaggcatgccgattagataccagaccaccgccgtaaagagcgagcacaccgggagagaaattgtcgacctcatgtgtcacgcgacctttaccatgcggctcctgtccccagtgcgcgtgccgaactacaacatgatcattatggacgaggcccactttaccgacccggcgagcatcgccgccaggggctatatctctacccgcgtcgggatgggcgaggccgccgcgatctttatgacggctacaccacccggaagcgtggaggccttcccgcagtccaacgcggtgatccaggacgaggagcgcgacatccccgagcgcagctggaactccggctacgactggatcaccgacttccccggcaagaccgtctggtttgttcccagcattaagtccgggaacgacatcgccaactgcctgaggaagaacggaaagagggtgatccagctctctcggaagacgttcgacactgagtaccagaagaccaagaacaatgactgggattacgtcgtgaccacggacatctccgagatgggggcgaacttccgcgccgaccgggtaatcgacccgagacggtgccttaagcccgtcatcctgaaagacgggcccgaacgcgtgatcctcgcagggcccatgccggtgaccgtcgccagcgcggcccagcggcgcggccggatcggtcgcaaccagaacaaagagggggaccagtatgtgtacatgggccagcccctgaacaacgatgaggaccatgcccactggactgaggcgaaaatgctgctcgacaacataaacacccccgaggggatcatccccgctcttttcgagccggagcgcgagaagtccgcggctatcgacggcgagtaccgactgcgcggggaggcccgaaaaaccttcgtcgagctcatgcgccgaggtgacctgcccgtgtggctgagctacaaggtggccagtgagggcttccagtacagcgaccgccggtggtgttttgacggggagcggaacaaccaggtccttgaagagaatatggacgtggagatctggacgaaagaaggcgagcgaaagaagctgcgcccccggtggctagacgcccgcacctactccgaccccctcgcgttacgggagttcaaggagttcgcagccgggcgacggagtgtgagcggggacctgatccttgagatcggcaagctgccgcagcacctgaccctcagggctcaaaacgccttggacaacctggtgatgctccataactccgagcaagggggtaaggcgtaccggcacgccatggaggagctgccggacaccatcgagactctgatgctcctggccttaatcgccgtcctcaccgggggcgtgaccctgttcttcctgagcgggaagggcctcggcaagacctccatcgggctgctgtgcgtcacggcgagctccgccctcctctggatggccagcgtggagccccactggatcgctgccagcatcatcctggagttcttcctcatggttctgctgatccccgagccggaccgtcagcgcacaccccaggacaaccaactcgcgtacgttgtgattggcctgctgttcatgatcctcaccgtggccgccaacgagatggggcttctggaaaccacgaagcgagatctcggcatcgggcatgtcgcagccgaaaatcatcagcacgcgaccatgctggacgtggacctgcggccggccagcgcctggaccctctacgctgtggcgaccacggtaatcacgccgatgatgcgccacaccatcgagaacaccacggcgaacatctccctgaccgcgatcgccaaccaagcagcgatcttgatgggcctcgacaagggatggcccatcagtaagatggacatcggagtgcccctgcttgcgctaggctgctactcccaagtgaaccccctgaccctgaccgccgctgtcctcatgctggtggcccattacgcgatcatcgggcctggcctgcaggccaaggccacgcgcgaggcccaaaaacggacagccgcgggcatcatgaagaaccccaccgtggacggcattgtcgccatcgacctggaccccgtagtgtacgacgccaagttcgagaaacagctggggcagatcatgctgctcatcctgtgcaccagccaaatcctactcatgcgcacgacctgggccctgtgtgagtccatcaccctagccaccgggccactcacgacgctatgggagggcagcccggggaagttctggaacaccactatcgcggtcagtatggccaacatcttccggggctcgtacctggccggcgcggggttggctttctccctgatgaaaagcctgggcgggggccgccggggtacaggtgcgcaaggagagaccctcggggagaagtggaagcgccagctaaatcagctatccaagcctgagttcaacacctacaagcggtccggcatcatggaggtggaccgctctgaggccaaggagggactcaagagaggggagaccaccaaacacgccgtaagccggggtacggccaaacttcggtggttcgtcgagagaaacctggtgaaacccgaaggcaaggtgatagacctcgggtgcggtcggggcgggtggtcctactactgcgcgggactgaagaaggtcaccgaggtgaaggggtacaccaagggcgggccaggccacgaggagcctataccaatggccacctacggctggaacctggttaagctgcactccgggaaggacgtcttcttcatgcccccggagaagtgcgacacgctcctgtgcgacatcggcgagagctccccgaacccaaccatcgaagaggggcgcaccttacgggtgctcaaaatggtggagccctggctgcgcggtaaccagttctgtataaagatcctcaacccctatatgccgagcgtcgtagagaccctcgaacagatgcagcggaagcatggtgggatgctggtgcgcaacccactgtcccgcaactctacgcacgagatgtactgggtctcctgcggcaccgggaacatcgtgagcgcggtgaacatgacctcccgaatgctcctaaaccgcttcacaatggcccaccggaagcccacgtacgagcgtgacgtcgacctcggcgccggcacccggcacgtcgccgtggagcccgaggtcgcgaacctcgacattattgggcagcgaatcgagaacatcaagaatgagcacaagagcacctggcactacgacgaggacaacccgtacaagacctgggcctatcacggctcctacgaggtgaagcccagcgggtctgctagttcgatggtgaacggcgtagtgcggttgctgacgaagccatgggacgtcatccccatggtgacccagatcgccatgaccgacaccacgccattcgggcagcagcgcgtgtttaaagaaaaggtcgacacccggactccccgggctaagaggggcactacgcagataatggaggtgaccgccaagtggctctggggcttcctgagtcgcaataaaaagccccggatctgcacccgcgaggagttcacccggaaggtgcgcagcaacgccgctatcggggccgtcttcgtggacgaaaaccagtggaatagcgcgaaggaggccgtggaggacgagcggttctgggacctcgtccatcgcgagcgggagctccacaagcaaggcaaatgcgcgacgtgcgtgtacaacatgatggggaagcgcgagaagaaactcggcgagttcgggaaggccaagggcagccgcgcgatctggtacatgtggctgggcgcccgcttcctcgagtttgaggcgctggggttcatgaacgaagaccactggttttcccgggagaacagcctttccggtgtggagggagaagggcttcacaagttgggatatatcctgcgtgacattagcaagataccgggcggcaacatgtacgccgacgacactgctgggtgggacacccgcatcacggaggacgacctccagaacgaggcgaagatcactgacatcatggagcccgaacacgccctgctggccacctccatcttcaagctcacctatcagaacaaggtcgtgagggtacagcgccctgcaaagaacgggaccgtcatggacgtcatcagtcggcgggaccaacgagggtccggtcaggttggaacttacggactgaacactttcactaacatggaagtccagctgatccgccagatggagagcgaaggcatcttcctaccgtccgagctggagaccccgaacctggccgagcgcgtgctcgactggctggagaaacacggggcggaacgcctgaagcggatggctatcagcggcgatgattgcgtggtcaagcctatcgacgaccgcttcgccacagcactcacggccctgaacgacatggggaaggtgaggaaggacatccctcagtgggagccctccaagggatggaatgactggcagcaagtgccgttctgcagccaccacttccaccagctgatcatgaaggacggccgcgagatcgttgtgccctgccggaaccaggacgagcttgtggggcgcgcgcgggtgtcccagggcgccgggtggagcctgcgcgagaccgcctgcctgggaaaaagctacgcccagatgtggcagctcatgtacttccaccggcgcgacttacggttggctgcgaacgccatctgcagcgccgtgcccgtggattgggtccccacctcccgcaccacgtggtcgatacacgcccaccaccagtggatgaccaccgaggacatgctcagcgtgtggaatcgcgtatggatcgaggagaacccctggatggaggacaagacccacgtctctagttgggaggaggtgccctatctggggaagcgggaggaccagtggtgcgggtcactgattggcctcacggcgcgcgcaacctgggccaccaacatccaggtggccatcaaccaggtacggcgcctgatcggaaacgagaactacctggactacatgaccagtatgaagcggttcaaaaacgaatccgaccctgagggcgccctctggtga

SEQ ID NO: 23976 - RNA, 9879 nt, synthetic construct
  misc_feature 1..9879: note = derived and/or modified CDS sequence (opt11) from DENV-1__KF973471__SS-prME
  source 1..9879: mol_type = other RNA
agcgtgaccatgctgctcatgctgctgcccaccgcattggcctttcacttgaccacccggggcggggagccccacatgatcgtgtctaagcaagagcgtggaaagagcttgctgttcaagaccagtgccggggtgaatatgtgtaccctgatcgcgatggatctcggagagctctgcgaggacacgatgacctacaagtgcccccagatcaccgaggccgagcccgatgacgttgactgctggtgcaacgctaccgacacgtgggtgacctacgggacctgcagccagaccggcgagcatcggcgggacaagagatccgtggctctggcgccacacgtgggcttggggctcgagacccggaccgaaacctggatgagcagcgagggcgcctggaaacagattcagcgcgtcgagacctgggccctgcgccacccagggttcaccgtcatcgccctgtttctcgcgcacgccatcggcaccagcatcacccagaaaggcatcatcttcatcctgctgatgttagtgaccccctcaatggccatgcgctgtgtaggtatcggcaaccgggacttcgtggagggtctgagcggcgccacgtgggtggacgtcgtgctggagcacgggtcctgtgtgaccactatggccaagaacaaacccaccctcgatatcgagctgctgaagacggaggtcaccaaccccgcgatcctcaggaaactgtgtatcgaggccaagatcagcaataccaccacggactcacggtgccccacacagggcgaggccaccctggtggaggagcaggatgcaaattttgtgtgccgcaggactttcgtcgacaggggctgggggaacggctgcggcctctttggtaaggggagcctgctgacgtgtgccaagttcaagtgcgtgactaagctcgagggcaagatcgtgcagtatgagaacctaaaatattccgtaatcgtgaccgttcacaccggggaccagcaccaggtcgggaatgaaacgaccgagcatggcacaatcgcgacaatcacgccccaggcccccacgagcgagatccagctaaccgactacggggccctcaccctcgactgctctccccggaccggcctggactttaacgagatggtactcctgacgatgaaagagaagtcctggctggtccacaagcagtggtttctcgacctgcccctgccctggacctccggggcctcgaccagccaggagacctggaaccgccaggacttgctggtgacgttcaagaccgcgcacgcgaagaagcaggaggtggttgtcctgggctcacaggagggcgcgatgcataccgccctcaccggggccacggagatacagaccagcggcaccaccacgatcttcgccgggcacctaaagtgccggctgaagatggacaagctcaccttaaagggaacctcctacgtgatgtgcaccgggtctttcaagttggagaaggaggtagctgagactcagcacggtaccgtgctggtgcaggtaaaatacgagggcaccgacgccccctgcaagatccccttctccacccaggacgagaagggggtgacgcagaacggacgcttgatcaccgcaaacccgatcgtgaccgacaaggagaaacccgtcaatatcgagaccgagccgccgtttggggagagctacatcgtggtgggcgccggcgagaaggcgctgaagctctcctggttcaagaaggggagctccatcggcaagatgttcgaggccaccgcacgcggggcccggcggatggccattctcggcgacaccgcgtgggacttcggcagcataggcggagtcttcacctccgttgggaagctggtgcatcaggtcttcggcaccgcctacggggtgctattcagcggcgtgtcctggactatgaaaatcgggatcggcatcttactgacatggttaggcctcaacagccgctccacgagcctgtccatgacctgcatcgccgtcggtatggtgacgctgtacctaggggtgatggtccaggccgatagcgggtgcgtgatcaattggaagggtcgcgagctgaagtgtgggtccggcattttcgtgaccaacgaggtccacacctggaccgagcagtacaagttccaagccgacagcccgaagcggctgagcgcggccatcggcaaggcctgggaggagggggtttgcggcattcggagtgccacccggctcgagaacatcatgtggaagcagatcagcaacgagctgaaccacatcctgttagaaaacgacatgaagttcacggtcgtcgtcggggacgccaacggcatcctcgcccagggcaagaagatgatccgcccccagcccatggaacacaagtactcctggaagtcctggggcaaggccaagatcatcggcgccgacatccagaacaccaccttcatcatcgatgggcccgatacccctgagtgtcccgacaaccaacgggcctggaacatctgggaggtcgaggactacggtttcggaatattcacgaccaacatctggctgaaactccgcgattcttacactcaaatgtgtgaccaccggctgatgtctgcggccatcaaggattccaaggccgtccacgccgacatgggctactggatcgagtctgaaaagaacgagacatggaaactagcccgcgcgtccttcatcgaggtgaagacgtgcacctggccaaaaagccacaccctctggtctaacggggtgctggagagcgagatgatcatacccaagatctacgggggcccgatttcccaacacaactaccggcccgggtacttcacccagacggccggcccttggcacctggggaagctcgagctggatttcgatctgtgcgagggcaccaccgtggtggtggacgaacactgcggaaaccgcggcccgtctctccggacaacgaccgtcaccggcaagataatacacgagtggtgttgccgctcctgcaccctgccgcctttgcggttccgcggagaggacggctgctggtacggtatggagatccgaccagtgaaggagaaagaggagaacctcgtgcgcagcatggtctcggccggcagcggagaggtggacagcttctccctggggatcctatgcgcaagcattatgatcgaggaagtgatgcggtcccgttggagccggaagatgcttatgacgggcaccccggccgtgtttctgttgttaatcatggggcagctgacctggaacgacctgatccgcttatgtatcatggtgggcgcgaacgcatccgaccgtatgggcatgggcaccacgtacctggccctgatggccaccttcaaaatgcgtccaatgttcgccgtgggcctcctgttccgccgcctgaccagccgcgaggtcctcctgctgaccatcggactcagtttggtggcaagcgtggagctgcccaattccttagaagaacttggcgacgggctggccatgggcattatgatgctcaagctgttgacggagttccagccccatcagttatggacaaccctgctgtctctcaccttcatcaagaccaccttatccctggactacgcctggaagaccacggccatggcgttaagcatcatcagtctgttcccgctctgtctcagcacaaccagccagaagaccacgtggctgcccgtcctgttgggcagcttcggctgcaagccattgaccatgtttctgatcacggagaacaaaatttgggggagaaagagctggcccctcaacgaggggattatggcgattgggatcgtgagcatcctgcttagctctcttctgaagaacgacgtcccgctagctgggcccctcaccgccgggggcatgctgatcgcttgctacgtgatctccgggtccagcgcggatctgtccctcgagaaggccgccgaggtgtcgtgggagcaggaggccgagcactccggtacgtcgcacaacatcctggtcgaggtccaggacgacgggaccatgaagatcaaggatgaggagagggacgatacgctgacaatcttactgaaggcaaccctgctcgcggtgtccggcgtgtaccccatgtcgattcccgccaccctgttcgtgtggtacttctggcagaagaagaaacagcggtccggggtgctgtgggacacgccatccccgcccgaggtcgagagagccgtgctcgacgacggcatctaccggatcctacagcgcggcctgctgggtaggtcacaggtgggcgtgggggtgttccaggatggcgtgttccataccatgtggcacgtcaccagaggggcagtgctcatgtaccaggggaagcggctggagccctcgtgggcgtcggtgaagaaggacctgatttcctatggcgggggctggcgcttccaggggtcgtggaataccggcgaggaggtccaagtgatagcggtggagccggggaagaaccccaagaacgtccagacgacccccggcaccttcaagacccccgagggcgaggtgggggccattgccctcgatttcaagccgggcactagcgggtcccccatcgtcaaccgggaggggaagatcgtcggcctgtacggaaacggcgtagtcaccaccagcgggacctatgtcagtgccatcgcgcaagcgaaggccagccaggagggccccctgccggagatcgaggacgaggtgttcaagaagaggaacttaacgatcatggacctgcaccccgggagtggcaagacccggcgctacctgcccgccatcgtgcgggaggccatcaagcgtaagctccggaccctgatcctggctccgacacgcgttgtagcgtcagagatggccgaggctctcaagggcatgccgatccgctaccagacgacagccgtcaagtccgagcacaccggccgggaaattgtcgacctaatgtgccacgctacgttcacgatgcgcctgctctcccccgtgcgcgtgcccaactacaacatgataatcatggatgaggcccactttaccgacccagcgagcatagccgctagaggttatatctccacccgggtcgggatgggcgaggccgccgccatcttcatgactgcgacgccgccagggtcagtggaggccttcccgcagtccaacgctgtcatccaggacgaggagcgcgacattcccgagcggagctggaactccggctacgactggataacagacttcccgggcaaaaccgtatggttcgtgcccagcatcaagtcagggaacgacatcgccaactgcctgcgcaagaacggcaagcgggtgatccaactgagccgcaaaactttcgacacggaatatcaaaagaccaagaacaatgattgggactacgtcgtgaccaccgacatctccgagatgggggccaactttcgggccgacagagtgatcgacccccggcgctgcctcaagcccgtcatccttaaggacggtccggagcgggtgatcctggcggggcccatgcctgtaacagtcgcaagcgccgcgcaacgccggggccgaatcgggcggaatcagaacaaggaaggggaccaatacgtgtacatgggccaacccctcaataacgatgaggaccacgcccactggaccgaggcgaagatgctgctggacaatataaatactccggaagggatcatcccggctctcttcgagcccgagcgcgagaagtccgccgcaatcgatggcgagtaccgcttacgcggggaggcccgcaaaaccttcgtagagcttatgcggcgaggcgatttacccgtctggttgagctataaggtggcgtcagagggcttccagtacagcgaccggcgctggtgcttcgacggggaacggaacaaccaggtcctagaggagaatatggacgtggagatctggacgaaggagggggaacgcaagaagctccggccgcgctggctggacgcccggacgtactctgacccactggccctccgcgagttcaaggagttcgccgcggggcgccgcagcgtgagcggcgatctgatcctggaaataggcaaactcccccagcatctgactctgcgggcccagaatgccctagataacctggtcatgctgcataactccgagcaaggcggtaaggcttaccgtcatgccatggaggagctccccgacaccatcgagaccctgatgctgcttgcgctgatcgccgtgctgaccggcggagtgaccctcttcttcctgagcgggaaggggttgggcaagacctccatcgggctcctgtgcgttaccgccagctctgccctgctctggatggccagcgttgagccgcactggatcgcggcctccattatcctggagttcttcctgatggtcctcctgatccccgagcccgaccggcaacgcacgccgcaggataaccagttagcctacgtcgtgataggcctcctgttcatgatcctgacagtggcggccaacgagatggggttactggagaccaccaagaaggacctgggcatcgggcacgtcgcggccgagaaccaccagcacgccacgatgctcgacgtggacttacggcccgccagcgcctggaccctgtatgcggtggccacaaccgtcatcacgcccatgatgcgccatactatcgaaaacactaccgccaacatttcgctcacggcgatcgccaaccaagcggctatcctgatgggcctcgacaagggctggccaatcagcaagatggacattggggtgccgctcctggccctgggctgctacagccaggtgaatcccttgactctcaccgccgcagtcctgatgctggtggctcactacgccattatcgggcccggtctgcaggccaaggcaacgcgagaggcacagaagcggacggccgcgggtatcatgaaaaaccccaccgtggatggcatcgtcgccatcgatttagacccggtggtgtacgacaccaagttcgagaagcagctcggccagatcatgctgctgatcctctgcaccagccagatcctgctcatgcgcacaacctgggccttgtgcgagagcattaccctggcgaccgggccactgacgaccctctgggaaggcagcccagggaagttttggaacaccaccatcgccgtcagtatggccaacatcttccggggctcgtacttagccggcgccgggctggcgttctcgctcatgaagtccctgggcgggggtcgtcggggtactggcgcccagggggagaccctgggggagaagtggaagcgccagctcaaccaacttagtaagagcgagttcaacatctacaagcggtctggcatcatggaggtggaccgctccgaggccaaggaggggctcaagagaggcgagaccaccaagcacgctgtgtcacgcgggactgcgaagttgcggtggttcgtggagcgcaacctggtcaaacccgagggaaaggtgatcgacctgggctgcgggcgtggcgggtggtcctactactgcgcgggcctgaagaaggttacggaggtgaaggggtacacaaaaggcggcccgggccatgaggagcctatccccatggcaacctacggctggaaccttgtgaagctccactcggggaaagacgtcttcttcatgcccccggaaaagtgcgatacactgttatgcgacatcggcgagtcctcacccaatccaacggtggaggaggggcgtaccctgcgagtgctgaaaatggttgaaccctggcttaagggcaaccagttctgcatcaagatcttgaacccgtacatgccctccgtggtggagaccttagagcagatgcagcgtaagtacggcgggatgctcgtccggaaccccctgagccgcaactccacccacgaaatgtactgggtgagttgcggcacggggaacatcgtgagtgccgtcaatatgaccagcaggatgttactaaaccgcttcaccatggcccatcggaagcccacctacgaacgcgacgtggaccttggcgcgggcacgcgccacgtggccgtcgaaccagaggttgccaacctggacatcatcgggcagaggatagagaacatcaaaaacgagcacaagtccacctggcactacgacgaggacaatccctacaaaacctgggcctaccacggcagctacgaggtgaagccctccgggagcgcctcgagcatggtcaacggcgtggtacgccttctgaccaagccctgggacgtcatcccgatggtgactcagatcgcgatgacggacaccacccccttcgggcagcagcgcgtcttcaaggagaaagtggacacgcgcacgccccgcgccaagcgcggcaccacccaaatcatggaggtgacagccaagtggctgtggggcttcctctcccgaaacaagaagccgcgcatctgcacccgagaggaatttacaaggaaggtccgaagcaacgccgccatcggggcggtgttcgtcgacgaaaaccaatggaacagcgctaaggaggcagtcgaagacgagcgcttctgggatttggtgcaccgggagagagagctgcataagcagggcaagtgcgcgacctgcgtgtacaacatgatggggaagcgggaaaagaagctcggcgagttcggtaaggcaaaggggtcccgagcaatctggtacatgtggctgggcgcccggttcctcgagttcgaggccctcggattcatgaacgaggaccactggttcagcagggagaactccctgagcggcgtcgagggcgaggggctgcacaaactcgggtacatcctgcgggacatctccaagatccctgggggcaacatgtacgccgacgacacggcgggctgggacacccgcataaccgaggatgacctccagaacgaggccaagatcaccgacatcatggagcccgaacacgccctccttgcgacgtccatctttaagctcacctaccagaacaaggtagtgcgggtccagaggccggccaagaacggcaccgtgatggacgtgatttcccgccgggaccaaagggggagcggccaggtgggcacctatggtctcaacacgttcaccaacatggaggtgcaactgatccggcagatggagtccgagggcatctttctgccgagcgagctcgagacacccaacctggcggaacgcgtgttggactggttggagaagcatggggccgagcggctgaagcgcatggccatcagtggcgacgactgcgtcgtcaaacccatagacgacaggttcgccaccgccctgaccgcgctcaacgacatggggaaggttcgcaaggacatcccccagtgggagccgagcaaggggtggaacgactggcagcaggtccccttctgctcccaccacttccaccagctgatcatgaaagacggccgggagatcgtcgtgccctgccgcaaccaggacgaattagtcggacgggcccgcgttagccagggcgccggttggtccctcagagagacggcctgcctgggcaagagctacgcccagatgtggcagctgatgtacttccaccgccgggacctccgcctcgcggcgaacgccatctgctcagcggtgcccgtggactgggtgccgaccagccggactacttggagcatacatgcgcaccaccagtggatgacgaccgaggacatgctgtccgtgtggaaccgcgtctggatcgaagagaacccttggatggaagacaagacccacgtatcatcctgggaagaagtgccctatctcgggaagcgtgaagaccagtggtgcggcagcctgatcggcttgaccgctcgcgccacatgggccaccaacatccaggtagcaatcaaccaggtgcgccggctcatcggaaacgagaactacctcgactacatgacgagtatgaagcgctttaagaacgagagcgaccccgagggggcgctctggtga

SEQ ID NO: 23977 - RNA, 9879 nt, synthetic construct
  misc_feature 1..9879: note = derived and/or modified CDS sequence (opt11) from DENV-1__KF973472__SS-prME
  source 1..9879: mol_type = other RNA
agcgttaccatgctcctcatgttactccccaccgccttagcatttcaccttaccacccggggcggggaacctcacatgatagtcagcaagcacgaacggggcaagtcattattgttcaagacctctaccggggtaaatatgtgcacgctgattgccatggacttaggcgagctctgtgaggatactatgacctataagtgcccccgcattaccgaggccgagcctgacgacgtggactgctggtgcaacgccacggacacatgggtgacatatgggacgtgtagccagacgggcgagcaccggcgcgacaagcggtccgtggctctggcgccccacgtgggtttggggcttgagacccggacggaaacctggatgagcagcgaaggcgcctggaagcaaatccaacgggtcgaaacatgggccctacgccaccccggttttacggttatcgccctattcctcgcccacgcgatcggcacctcaatcacccaaaaggggatcatatttatcctgctgatgctcgtgactccctctatggccatgcgctgcgtcggtatcggcaaccgcgacttcgtggaggggttgtcgggcgccacatgggtggacgtcgtgctggagcatgggtcatgcgttaccactatggcaaagaacaaaccgaccctcgacatcgagctgctgaagacggaggtcaccaatcccgccgtgctccggaaactttgcatcgaggcgaagatatccaacacgactaccgattcccgctgcccgacccagggcgaagccaccctggttgaagaacaggacgccaacttcgtttgcaggcgtacgctcgtggatcggggctgggggaacggttgcggtctcttcgggaaagggagcttgctgacctgcgccaaattcaagtgcgtcacaaagctggagggcaaaatcgtccaatacgaaaacctgaagtacagcgtaatcgtcacggtccacacgggggatcagcaccaagtggggaacgaaaccaccgaacacgggactatcgcaaccatcacgcctcaagctccaacctccgagatccagctaaccgactacggggcactggccctggactgctcaccccggaccggcctcgatttcaacgagatggtccttctgacaatgaaggaaaagtcctggctcgtgcacaagcagtggttccttgatctgccactcccctggacatccggggccagcaccagccaggagacctggaaccggcaggacctgcttgtgacattcaagaccgcccatgcgaagaagcaggaggtcgtggtgctcggctcccaggagggcgccatgcacaccgccctgacaggtgccacggaaattcaaaccagcggcacgaccacgatattcgccgggcacctgaagtgtcgcttaaaaatggacaagctgactctgaagggcactagctacgtaatgtgcaccgggtcatttaagctggagaaggaggtcgcggagacccagcacggcaccgtcctagtacaggtaaagtacgaaggcacggacgccccctgcaagatcccattctccacccaagatgagaagggtgtgacgcagaacggccggctgattacagccaacccgatcgtcaccgacaaggagaagcccgtaaacatcgagaccgagccgcccttcggggagagctacattgtggtcggcgctggggagaaggcgctgaaactttcttggttcaagaaaggtagctccattggcaagatgtttgaagccaccgcccgtggggcccggcggatggcgattctgggcgacaccgcctgggacttcgggagcatcggcggcgtgttcactagcgtggggaagctggtccaccaggttttcggcaccgcttacggtgtcctcttcagcggcgtgtcttggacgatgaagataggcatcggcatcctgctgacttggctcggcctgaacagccgctctaccagcctaagtgtgacatgcatcgccgtggggatggtcaccttgtacctgggggtgatggtgcaggccgactctgggtgcgtcatcaactggaagggccgggagctgaagtgtgggtccggcatcttcgttaccaacgaggtgcatacttggaccgagcagtacaagtttcaggctgactcacccaagcgcctcagcgcggctatcggcaaagcatgggaggagggggtctgcggcatacggtcagccactcgactcgagaacatcatgtggaaacagatcagcaatgagctgaaccacatcctcctggaaaatgacatgaagttcacggtggtggtcggagatgccaacggcatcctggcgcaagggaagaagatgatccggccccagccaatggaacacaagtactcttggaaaagctggggaaaggccaaaataatcggcgcagacatccagaacaccacctttatcatagacgggcccgatacccctgagtgccccgacgaccagcgagcctggaacatctgggaagtggaggattacggcttcgggatcttcaccaccaacatctggttgaagctgcgggattcctacacacagatgtgtgaccatcgcctgatgtccgcggctatcaaggactccaaggctgtgcacgccgacatgggctactggatcgagtctgagaagaacgagacctggaagctcgcacgggcgtccttcatcgaggtcaagacttgcacctggcccaagagccataccctgtggtctaatggcgtgctggagagcgagatgatcattcccaagatctacgggggccccatctcgcagcacaactaccgccccgggtactttactcaaaccgccgggccctggcacttaggaaagttagaactggacttcgacctctgtgagggcacaacggtcgtcgtggacgaacactgtggaaaccgggggccgagcctacgcaccacgaccgtgaccggtaagatcatccacgaatggtgctgccggtcctgcacgctgccgcccctaagatttcgcggtgaagacggctgctggtacgggatggagatccgccccgtcaaagagaaggaggagaatctggtgcggtcgatggtgagcgccggcagcggcgaagtcgactctttttcgctcgggatcctttgtgtgagcattatgatcgaggaggtgatgagatcccgctggtctagaaagatgctgatgacgggcacattggctgtcttcctgctgctgatcatggggcagctcacatggaacgacctgatacgcctttgcatcatggtaggcgctaacgcctccgaccggatggggatgggcaccacgtacctcgccctgatggccactttcaaactgcgccccatgttcgccgtgggcatcttgtttcggcgcctgacgtcccgggaggtcctgttgttgaccatcgggttaagcctcgtggcaagcgtagagttaccaaactccctggaggaactcggagatgggctggcaatgggcatcatgatgttaaagctcctgacggagtttcagccccaccagctatggacgaccctcctgagcctgacgttcatccgcacgaccctctccctcgattacgcctggaagaccaccgctatggccctgagcattgtctcactctttcccctgtgcttgagcacgacctcccagaagaccacctggcttccggtgctgctgggcagcttcggctgcaagcccctaaccatgtacttcatcacggagaacaaaatctggggccggaagtcgtggcccatcaacgaggggattatggctattggcattgtcagcatcctgctgtctagcctcctgaagaatgacgtgcccttggccgggcctctcatcgctggcggcatgctgatcgcctgctacgtcatcagcggctcctctgccgacctctccctagagaaggcggccgaggtcagctgggaacaggaggcagagcactccggaaccagccacaacatcctggtcgaggtgcgcgacgacggaacaatgcgcattaaggacgaggagaaggacgacacactaacgatcctcctgaaggccaccctgctcgcagtctcaggcgtgtatcccatgagcatacccgccacccttttcgtgtggtacttctggcagaagaagaagcagagatccggcgtcctgtgggacacccccagcccgcccgaggtggagcgagcagtgctggacgatggaatttacaggatcctgcagaggggcctactggggcgctcccaagtcggcgtgggggtgttccaagacggcgtcttccacaccatgtggcacgtgacccgaggggccgtactcatgtaccagggaaagagactggagcccagctgggcctccgtcaaaaaggacctgatcagctacgggggtggctggcggtttcaggggtcctggaacaccggcgaggaagtacaggtgatcgccgttgagcccgggaaaaacccgaagaacgtgcaaaccactccgggcaccttcaagacccccgagggcgaggtgggggctatcgcgctcgacttcaagcccgggacgtccgggagccccatcgtcaatcgcgaaggcaaaatcgtgggcctgtacgggaacggcgtggtcacgaccagcgggacctacgtgtccgctatcgcccaggccaaggcatcacaggagggccctctgcccgaaatcgaggacgaggtttttaagaaacggaacttgactatcatggacctacacccagggtcaggcaagacgagacggtacctgcccgccatcgtccgcgaggccatcaagcgcaagctgcgcaccctgatcctggcccccactcgcgtggtggcgtccgagatggccgaggccctaaagggcatgcccatccggtatcaaaccacggccgtcaagagcgagcacaccggacgcgagatcgtggacctgatgtgccacgccaccttcacaatgcggctgctctcaccggtgcgcgtccccaactacaacatgatcattatggacgaggcacacttcactgaccccgcgagcatcgccgcccggggctacatctctacccgcgtggggatgggcgaggcggcggccatcttcatgactgccaccccacccgggagcgtggaggccttcccccagtccaacgccgtgatccaggacgaagaacgcgacatccccgaacgcagctggaactccggctacgactggatcactgacttcccgggcaagaccgtgtggtttgtgcccagcataaagtccgggaatgacatcgccaactgcttgcggaagaacggcaagcgcgtcatccaactgtcacggaagaccttcgacaccgagtaccagaagactaagaacaacgactgggattacgtggtgaccacggacatctcggagatgggagctaactttcgcgccgaccgggtcatcgacccccgccggtgcctcaagccagtcatactgaaggacggccctgagcgcgtgatcctggccgggccgatgcccgtcaccgtggcgagcgccgcccaacggcgcggccgaatcggccggaaccagaataaggagggggaccagtacgtctacatggggcaacctctcaacaacgacgaggatcacgcccactggacggaggctaagatgctgttggataacatcaacacccccgaggggatcataccggcactcttcgagccagaacgcgagaaatcggccgccatcgatggcgaataccggctaagaggggaagcccggaaaaccttcgttgagcttatgcgccggggtgacctccccgtctggctgagctacaaggtcgcctccgagggcttccaatactcagacagaaggtggtgcttcgacggagagcgcaataaccaggtgcttgaggagaacatggacgtcgagatctggactaaggagggcgagcggaagaaattgcgccccaggtggctggacgcgcgtacctactctgacccgttggccctccgggagttcaaagagtttgccgccgggcgccggtcggtcagcggcgatttgatcctggagatcggtaagctcccccagcacctgacgctgcgtgcccaaaacgcgctcgacaacttggtgatgctgcacaattccgagcagggcggtaaggcctaccggcatgctatggaggagctccccgacaccatcgagacgttgatgctgctcgccctgatcgcggttctgaccgggggcgttaccttgttcttcctgtcggggaagggccttggcaagacctcgatcggtctcctgtgcgtgaccgcaagctccgcacttctctggatggccagcgtggagccccactggatcgccgcgtccatcatcctggagttcttcttaatggttctcctgatcccagaacccgacagacagcggacgccgcaggacaaccagctagcctacgtggtgattggtttactgtttatgatccttacagtcgccgcgaacgagatggggctactggagacaacgaaacgtgacctgggcatcgggcatgtagcggcggaaaaccatcagcacgccaccatgctcgacgtggatctgcgcccggcttccgcctggactctctacgccgtcgctaccacggtgatcacccccatgatgcggcatacgattgagaacaccaccgccaacatatccttaaccgccatcgccaaccaggccgctatcctgatgggcctggacaagggatggcccatcagtaagatggacattggcgtgcccctcctggctctgggctgctactcccaggtcaacccgctgacgctgaccgccgccgtgctgatgctcgtcgcgcactacgccataatcggtcccggcctgcaagcaaaggccacccgcgaggcccagaagagaaccgcggctgggattatgaagaaccccacggtcgacgggatcgtggcgatcgacctggaccccgtagtctacgatgccaagttcgagaagcagctcggacagataatgttactgattctgtgcaccagccagatactgctgatgcgcactacttgggccctctgtgaatccatcacgctggcgaccggacctctgacgaccctctgggagggcagcccagggaagttctggaacacaaccattgctgtgtccatggccaacattttccggggcagctatctggccggcgccggcctggcgttctccctcatgaagtccctgggcggagggcgacgggggaccggcgcccagggcgagacgctgggggagaagtggaaacggcaattgaatcagctgtccaaacccgagttcaacacgtacaagcggagcggcatcatggaagtggatcgctcggaagccaaagaggggctgaagcggggtgagaccaccaagcacgccgtctcgcgcgggaccgccaagctccgctggttcgtggagcgcaacctggtgaagcccgagggcaaggtaatcgacctaggatgcgggcggggtgggtggagctattactgcgccggtctaaagaaggtgaccgaggtgaaggggtacactaagggcggcccggggcacgaggagccaatccccatggccacgtacggctggaacctggtcaaactgcacagtgggaaggacgtgttcttcatgcccccggagaagtgcgacaccctgctctgcgacatcggtgaaagcagtccgaaccccactatcgaggaggggcgcacgctaagagtgctgaaaatggtcgagccctggctccgtgggaaccagttctgcatcaagatcctgaacccgtacatgccaagcgtcgtggagaccctggaacagatgcagcggaagcacggcggaatgcttgtccgcaaccccctgtcccgtaactctacccatgagatgtactgggtgtcctgcggcaccggtaacatcgtgtcggcggtaaatatgacgtcccggatgctgctaaaccgcttcactatggcccaccgtaagcccacctacgagcgcgacgtggacctgggcgcaggcacacgacacgtggccgtcgagccggaggtcgcgaacctagacatcatcgggcagagaatcgaaaacatcaagaacgagcataaaagcacatggcactacgacgaggacaacccctacaagacctgggcctaccacggctcctacgaggtgaagcccagcgggagtgcgtctagtatggtaaacggagtggttcgattactgaccaagccctgggatgtaattcctatggtaacccagatcgcgatgacagataccacccccttcgggcagcagcgtgtctttaaggagaaagtggacaccaggacgcccagggccaagcgaggcacgacccaaatcatggaggtgacagccaagtggctctggggctttttgagccgcaacaagaagccgcggatctgtacgagggaggagtttacccggaaggtcagatcaaacgccgccattggtgcggtattcgtggacgagaaccagtggaatagcgccaaggaggccgtcgaggacgagcggttctgggatctggtgcaccgtgagcgggagctccacaagcagggcaagtgcgcaacctgcgtgtataacatgatggggaagcgcgagaagaagctcggagagttcgggaaggcgaaaggctcgcgcgccatttggtacatgtggctgggcgcgcgcttccttgagttcgaggccctagggttcatgaacgaggaccattggttctctcgcgaaaactccctgtccggcgtagagggggagggcttacacaagctcgggtacatcctgcgggacatcagcaagatccctggagggaacatgtatgccgacgacaccgctggctgggacacgcgcatcaccgaggatgacctgcagaacgaggccaagatcacagacatcatggagcccgagcacgccttgctggccacaagtatcttcaagctgacgtaccagaacaaggtcgtacgggtccagcgccccgcaaagaacggcaccgtgatggacgtgataagccggcgcgaccagcggggatcggggcaggtagggacttacgggctcaatacctttacgaacatggaggtgcagctaatccggcaaatggagagcgagggcatcttcctgccgtccgagctcgagacccccaacctggcggagcgggtcctagactggctcgagaagcacggggcggaaagacttaagcggatggccatcagcggggatgactgcgtcgttaagccgatcgacgaccgcttcgctaccgccctgaccgcgctcaacgacatggggaaagtgcggaaggacatcccacagtgggagccgtccaaaggctggaacgactggcagcaggtccccttctgctcacaccacttccaccaattaatcatgaaagacggccgcgagatagtagtcccctgccgtaaccaggacgaactggtagggcgcgcccgcgtgtcgcagggcgccgggtggtcgctccgcgaaaccgcgtgcttaggcaagtcatatgcacagatgtggcaactgatgtatttccacaggcgagacctccgcctggcggccaacgccatttgcagcgccgtgcccgtcgattgggtcccaacgtcccggaccacctggagtatccacgcgcatcaccagtggatgacaacggaggatatgctgagcgtttggaaccgtgtctggatcgaggagaacccctggatggaggacaagacgcatgtgtccagctgggaagaagtgccgtacctagggaagcgggaagaccagtggtgcggctctttgataggcctgacagcccgagcgacatgggccacaaacatacaggtcgccatcaaccaggtacggcgattaatcgggaacgagtcatacctggactacatgacctccatgaagcggttcaagaacgagtcggaccccgaaggcgcgctatggtga

SEQ ID NO: 23978 - RNA, 9879 nt, synthetic construct
  misc_feature 1..9879: note = derived and/or modified CDS sequence (opt11) from DENV-1__KF973474__SS-prME
  source 1..9879: mol_type = other RNA
agcgtgacgatgctcttaatgctgctccccaccgccctcgcattccacctgaccacccgcggcggggagccgcatatgatagtgagcaagcatgagaggggcaagtcccttctgttcaagaccagcaccggggtgaacatgtgcactctcatagccatggacctgggcgagctctgcgaggacacgatgacctacaagtgcccgcgcatcacggaggccgaacccgacgacgtagactgctggtgcaacgccacggacacctgggtgacctacgggacctgttcgcagacgggcgagcatcggcgcgacaagcggtccgtagctttggcgccccacgtgggcctggggcttgagacccgcaccgaaacatggatgagcagtgaaggcgcctggaagcagatccagcgggtcgagacgtgggccctgcgccaccccgggttcaccgtgatcgccctgtttctcgcccacgcgatcggcaccagcatcacccagaaggggatcatattcatcctgctgatgctcgtgacgccctccatggccatgcggtgcgttggcatcggcaatcgagatttcgtcgagggattaagcggcgccacttgggtggacgtcgtcctggagcacgggtcctgcgtgaccactatggccaaaaacaagcccaccctcgacattgagctgctgaagacggaggtcaccaaccccgccgtactccgcaagctgtgcatcgaggcgaagatcagcaacaccacgactgactcccgctgcccgacccaaggtgaggccaccctggtggaggagcaggatgccaacttcgtctgcaggcgcacgctcgttgacagaggctgggggaacggttgcgggttgtttggcaaggggagcctgctgacatgcgccaagttcaaatgcgtgaccaagctggaggggaagatcgtccagtacgagaacctgaagtactccgtgatcgtcacagtccacacgggtgaccagcaccaggtgggcaacgagaccaccgagcacggcaccatcgccacaatcacgccacaggcacccacgagcgaaatccagcttaccgactacggggccctcgccctggactgcagcccccggaccggccttgacttcaacgagatggtcctgctgacgatgaaggagaagtcgtggctcgtgcacaaacagtggttcctggacttgcccctcccgtggacctccggggccagcaccagccaggagacctggaacaggcaggatctgctggtgacctttaagacagcccacgcgaagaagcaggaggtcgtggtgctcggctcccaggagggcgccatgcacactgccttaaccggggcaacggagatccagaccagcggcaccacgacaattttcgccggccacctgaaatgccgcctcaaaatggacaagctgaccctgaagggaacgtcttacgtcatgtgcaccgggagctttaagctcgagaaggaggtggcggaaacgcagcacggcacagtgctcgtccaggtgaagtacgagggcactgacgctccctgcaagatcccgttctccactcaggacgaaaagggggtgacacagaacggtcggcttatcacagctaacccgatcgtcactgataaggagaagcccgtgaacatcgagaccgaaccgcccttcggtgagagctacatagtggtcggcgccggggaaaaggcgctgaaactgtcctggttcaagaaggggagctccatcggaaagatgttcgaggccacggcccgcggcgcccgacgcatggccatcctgggcgacaccgcgtgggacttcgggtctatcggcggggtgttcacatccgtggggaagctggtacaccaggtgttcggcaccgcctacggcgtactcttctccggcgtctcctggacgatgaagatcgggatcggcatcctgttgacctggctgggcctgaacagccgctccaccagcctgtccatgacctgcatcgccgtggggatggtgactctctacttgggcgtcatggtgcaagccgactctgggtgcgtgataaactggaagggccgggagctgaagtgcgggagtggcatctttgtcaccaacgaggtgcacacctggacggagcagtacaagttccaggccgacagcccgaagcgccttagcgctgccatcggcaaggcgtgggaggagggggtgtgcgggatcaggagtgccacgcgcctcgagaacatcatgtggaagcagatctccaacgagctgaaccacatcctcctggagaacgatatgaaattcacggtcgtggtgggagatgccaacggcatcctagcgcagggcaagaagatgattcgaccccagcccatggagcacaagtactcctggaagtcctggggcaaggccaagatcatcggcgccgacatccagaacaccaccttcatcattgacgggcccgataccccggagtgtcccgacgaccagcgcgcctggaacatctgggaggtagaagactacggcttcgggatcttcacgaccaacatctggctcaaactgcgcgactcctacacccagatgtgcgaccaccgcctgatgagcgcagccattaaggattccaaggccgtgcatgccgacatgggctactggatcgagagcgagaagaacgaaacctggaagctggcccgggcttccttcatcgaagtgaagacctgtacctggcccaagagccacaccctgtggtccaatggcgtcctggagagcgagatgatcatccccaagatctacggaggcccgatctcccagcacaactatcgccccgggtacttcacccagacggccgggccctggcatctcgggaagctggaactggacttcgatctttgcgagggcaccaccgtcgtggtggatgagcattgcggcaaccgtgggccgagcctgcgcaccaccaccgtgaccggtaagataattcacgagtggtgctgccggtcctgcactctgccgcccctccgcttccgaggggaggacggctgttggtatgggatggagatcaggcccgtgaaggagaaggaggagaacctggtacggagcatggtgtccgccggcagcggcgaggtggacagcttctccctggggatcctatgcgtcagcatcatgatcgaggaggtgatgcgctctcgctggtctcgcaagatgctaatgaccggcaccctggccgtgttcctcctactgatcatggggcagctcacctggaatgacctgatccgcctgtgcatcatggtcggcgccaacgcgtccgacaggatggggatgggcaccacgtacctcgccctgatggccaccttcaaactacgcccgatgtttgccgtcggcatccttttcaggcgcctgacatcacgggaggtgctgctactgaccatcgggttatccctcgtcgccagcgtcgagctgcccaactcccttgaagagctaggcgacggactggcgatgggaataatgatgctgaagctcctaacggagttccagccacaccagctgtggacgaccttgctgagcctgaccttcatcaagacgaccctctccctggactacgcctggaaaaccacagccatggccctgagcatcgtttctctctttcccctgtgcctaagcacgacctcccaaaagaccacatggctcccggtgttactcggcagcttcggttgcaagcccctcacgatgtatctgatcacggagaacaagatctggggccgcaagtcctggcccatcaacgaggggatcatggcgatcggcatcgtgagcatcctgcttagtagcctgctgaagaacgatgtccccctcgcggggccgctgatcgctggcggtatgctgatcgcctgctacgtgatcagcgggtctagcgccgacctctccctggagaaagcggccgaggtgagctgggagcaggaggccgagcactccggcaccagccacaatatcctggtcgaggtgcaggacgacggtaccatgcggatcaaggacgaggagaaagacgacaccctcacgatcctgctgaaggccaccctcctagccgtgtccggggtctaccccatgagcatccccgcgaccctgttcgtgtggtacttctggcagaagaagaagcaacgctccggggtgctgtgggacaccccctcaccgccagaggtcgagcgggccgtgctcgacgatggcatctacaggatcctgcagcggggactgctaggccgaagtcaggtgggcgtcggggtgtttcaggacggcgtgttccacacgatgtggcacgtcacccgcggcgccgtgttaatgtaccaaggaaagcgcctggagcccagctgggcctccgtcaagaaggacctcatctcctacgggggcggctggcggttccaggggtcctggaacaccggcgaggaggtccaggtgatcgccgtggagcccgggaaaaatccgaaaaacgtacaaactacacccgggactttcaagaccccggagggagaggtgggggcgatcgcgttggacttcaagcccgggaccagcgggtccccgatcgtgaaccgcgagggcaagatagtgggcctgtacgggaatggcgtggtgacgactagcgggacctacgtctccgccatcgcccaggcgaaagcgagccaagaaggccccctgccagagatcgaagacgaggtgttcaagaagcggaatctgaccatcatggacctgcacccggggagcggcaaaacgcgccggtacctccccgccatcgtgcgcgaggccatcaagcggaagctgcgcaccctgatcctcgctccgacccgcgtcgtggcaagtgagatggccgaggcactgaagggcatgccggtgcggtatcagaccacggctgtcaagtccgagcataccgggcgcgagatagtcgatctaatgtgccacgccaccttcacaatgcggcttctttctccggtgcgcgtccccaactacaacatgattatcatggatgaggcgcactttacggaccccgccagcatcgccgcgcggggctacatctccacccgcgtggggatgggcgaagccgcggccatctttatgaccgctactccgcccgggagcgtggaggctttcccccaatccaacgccgtcattcaggacgaagagcgggacatccccgaaaggagctggaactccggctacgactggatcacggacttcccgggcaaaaccgtgtggttcgtgcctagcatcaagtccgggaacgacatcgcgaactgtctgagaaagaacggcaagagggtcatccagctgagcagaaagacatttgataccgaataccagaagacgaagaacaacgactgggattatgtcgtgactactgacatctccgagatgggggccaactttcgcgccgaccgggtcatcgacccgcgccggtgcttgaagcccgtgattcttaaagacggcccggagcgcgtgattctcgccggcccgatgcctgtaacggtggcgagcgccgcccagcggcggggccggatcggccgaaaccagaataaagagggagaccagtacgtctacatgggccagccactgaataatgacgaagaccacgcccactggacggaggccaagatgctgctcgacaacatcaacacacccgaggggatcattccggcgttattcgagcccgagcgtgagaagtccgccgcgatcgacggcgagtatcggctgcgcggcgaggcccggaagaccttcgtggaactcatgcgccggggcgaccttcctgtgtggctaagctacaaggtcgcctccgagggcttccagtacagcgatcgtcggtggtgttttgacggggagcgcaacaaccaggtgttggaggagaacatggacgtggaaatttggacaaaggagggcgagcggaagaagctgcgcccgcggtggttagacgcgcgtacctacagtgacccactcgcactgcgtgagtttaaggagttcgccgccgggcgccggagcgtcagcggcgacctgatcctcgaaatcggcaaactgccccagcacctgacgctccgcgcccagaacgcgttggataacctggtgatgctccacaactccgagcagggcggcaaggcctaccgacacgccatggaagagctgcccgacactatcgagaccctgatgttgctcgccctgatcgccgtgctcacaggtggtgtcacgcttttcttcctcagcggaaagggcctcggcaagacctccatagggcttctgtgcgtgacggccagttccgcccttctctggatggccagcgttgagccccactggatcgctgcgtccatcattctggagtttttcctcatggtgttactgatcccggaacccgaccgccagcggacgccacaggacaaccagctcgcttacgtggtgatcggcctgttattcatgatcctcacggtcgccgccaatgagatggggctgctggagaccaccaagcgcgaccttggcataggtcacgtggcggcggagaaccaccagcacgccactatgctggacgtggacctgagaccggcctccgcctggactctctatgccgtcgcgaccaccgtaattactcccatgatgcgccacacgattgagaataccaccgcaaacatctccctaaccgccatcgccaaccaagccgcgatcctgatgggcttggacaagggctggcctatcagcaagatggacatcggggtgcccctgctggccctcggctgctactcacaggtgaaccctctgacgctgaccgccgccgtgctaatgctggtggcgcactacgccatcatcggacccggcctgcaggccaaggccacccgcgaggcccaaaagcgcaccgcagccggcatcatgaaaaaccccacggtcgacggcatcgttgccatcgacctcgaccccgttgtctacgacgccaagttcgagaagcaactgggtcagatcatgctgctcatcttatgcaccagccagatactgctcatgcgcaccacctgggccttgtgtgagtccatcacgctggccaccggaccgctcaccaccttgtgggagggaagccccggaaagttctggaacacgaccatcgccgtgtccatggctaacatcttccggggcagctaccttgcgggagccggccttgcgttctccctgatgaagtccctgggagggggccgccgggggactggcgcgcagggcgaaaccctcggggagaagtggaaacgccagctgaaccagctgtccaagcccgagttcaacacgtacaagcggtcgggcatcatggaggtggaccgcagtgaggcgaaggaagggctcaaaaggggcgagaccaccaagcacgctgtctcgcgcgggaccgcgaagctgcggtggttcgtcgagcgcaacctggtgaaacccgagggcaaggtgatcgacttgggctgcgggagaggtggttggagctactactgcgccgggctcaagaaggtgaccgaggtgaaggggtacacgaagggcggtccgggacacgaggaacccatccccatggcaacctacgggtggaacctcgtcaagctgcacagcgggaaggacgtgttcttcatgcccccggagaagtgcgacaccctcctgtgcgacatcggcgagagctcccctaaccccactatcgaagaggggcgcacgctgcgggtgctcaagatggtcgaaccctggttgcgcggcaaccagttctgcatcaagatcctgaacccgtatatgcccagcgtggtggagaccctcgagcaaatgcagcggaagcacggagggatgctggtccgcaaccccttgtcccggaacagcacccacgagatgtactgggtgtcctgcggtacggggaacatcgtaagcgccgtcaacatgacgtcccgcatgctcctgaaccgcttcaccatggcccaccggaagcccacttacgagcgcgacgttgacctgggcgctggcacccgccacgtgacggttgagccggaggtggcaaatctcgacatcatcgggcagcgcattgaaaacataaagaacgagcataagagcacctggcactacgacgaagacaacccctataagacctgggcctaccacggctcatatgaggtgaaaccgagcggatccgcctcgtccatggtgaacggcgtggtccggctgctgacaaagccctgggacgttataccgatggtgacgcagatcgccatgaccgacacaacccccttcgggcagcagcgcgtcttcaaggaaaaggtggacacgcggacgccccgtgcgaagcgtggcaccacccaaatcatggaggtaacggccaagtggctatgggggttcctctcaaggaataagaaacctaggatttgcacccgagaggagttcacccgcaaggtacgctcaaacgcagccataggggcggtgttcgtggacgagaaccagtggaatagcgcgaaagaggcagtcgaggatgagcggttctgggacctggtgcaccgcgagcgggaattacacaagcagggcaagtgcgcgacgtgtgtgtacaacatgatgggaaagcgagagaagaagctgggtgagttcgggaaagcaaagggaagccgggccatctggtatatgtggctgggcgcccgctttctcgagttcgaggcactggggttcatgaacgaggatcattggttctcccgggagaattcgctgtccggcgtcgaaggcgagggcctccacaagctggggtatatcttacgcgacatcagcaaaatccccggagggaacatgtatgccgacgacacagccgggtgggacacacgcatcacagaggacgacctccagaacgaagcgaagattaccgacatcatggagcccgagcatgccttgctagccacaagcatcttcaagctcacataccagaacaaggtggtgcgggtccaacgtcccgccaagaatggcaccgtgatggacgtgatctcacggcgggatcagagggggtccggccaggttggcacctacgggctgaatacgttcacaaacatggaggtgcagctgatccgccagatggaaagcgaaggtatctttctcccgtcagagctagagactcccaatctggccgagcgagtgctcgactggttagagaagcacggggcggagcgcttgaagcgtatggccatcagcggcgacgactgcgtcgtgaagccaatcgacgaccgcttcgcaaccgccctcacggccctaaacgacatggggaaggtgagaaaggacatcccccaatgggagccatccaagggctggaacgactggcagcaggtacccttctgcagccaccatttccatcaactgattatgaaagacggacgagagatcgtggtgccctgccggaatcaagacgagctagtcgggcgcgcgcgggtctcccagggcgccggttggagcctgcgcgagacggcctgtttgggcaagtcctacgcccagatgtggcagctcatgtacttccaccggcgtgacctccggctggccgcgaatgccatctgcagcgccgtgcccgtcgactgggtgccgacatcccgcaccacttggagcatccacgcccaccaccagtggatgacgaccgaggacatgctcagcgtttggaatagggtctggatagaggagaacccctggatggaggacaagacccacgtgagtagctgggaagaggtaccctacctagggaagcgggaggatcagtggtgtggctccctgattggcctaactgcgcgtgccacgtgggccaccaacatccaggtcgcaatcaaccaagtgcggcggctcatcgggaacgagaattacctagactacatgacctcaatgaaacgtttcaagaacgagtccgaccccgagggcgctctttggtga

SEQ ID NO: 23979 - RNA, 9879 nt, synthetic construct
  misc_feature 1..9879: note = derived and/or modified CDS sequence (opt11) from DENV-1__KF973475__SS-prME
  source 1..9879: mol_type = other RNA
agcgtcaccatgctgctcatgctgatgcccaccgccctggccttccacctaacgacgcgcggcggggaaccgcacatgatcgtctccaagcacgagcgggggaaggcgctgctgttcaagaccagcaccggggtgaacatgtgtactctcatcgccatggacctcggcgagctgtgcgaggacaccatgacctacaagtgcccccgcataaccgaagcagagcccgacgatgtggactgctggtgcaatgccacggacacatgggtcacctatgggacctgctcccagacgggcgaacaccggcgcgataagcggagtgtggccctcgcgccccacgtaggcctggggctggagactcgcaccgagacttggatgtccagtgaaggcgcctggaagcagatccagcgggtcgagacatgggcccttcgccacccggggttcaccgtgatcgccctgttcctggcgcacgccatcggcacctccataacccagaaggggatcatcttcattctcctgatgctggtgactccctctatggccatgcggtgcgtcggcatcggcaaccgcgactttgtggaggggctctccggcgccacctgggtggacgtcgtgctggagcatgggagctgcgtgaccaccatggccaagaacaaacccacgctggacatcgagctcctgaagaccgaggtcactaacccagcggtcctccggaagctttgcatcgaggctaaaatttccaacaccacgaccgacagccgctgcccgacccagggcgaggccaccctggttgaggagcaggacgccaacttcgtctgccggaggacgttcgtcgaccggggctggggaaacggctgtgggctgttcggcaaggggtcccttctgacctgcgccaagtttaagtgcgtgacgaagctggaggggaagatcgtccaatacgagaacctcaagtacagcgtgatcgtgaccgtccacacgggcgaccagcaccaggtggggaatgagaccacggagcacggcaccatcgcgaccatcacgccccaagcccccacctccgagatccaattaactgactacggggccctgaccctcgactgcagccccagaacgggcctggacttcaacgagatggtactgctcaccatgaaggagaaatcctggttggtgcacaagcagtggttcctggacctcccgctgccctggaccagcggagcctccaccagccaagagacatggaaccggcaggacctgctcgtgaccttcaagacagcccacgcgaaaaagcaggaggtcgtggtgctgggcagccaggagggcgccatgcacaccgccctgacgggggccaccgagatccagacctccgggaccactaccatcttcgccgggcacctcaaatgccgcctgaagatggacaagctgaccctcaagggcaccagctacgtcatgtgcactgggtccttcaagctggagaaggaggtggcggaaacccagcacggcaccgtgctggtccaggtgaaatatgagggcacagacgccccctgcaagatccctttctctacgcaggacgagaagggggtgacccagaacggccggttaatcaccgccaatccgatcgtgactgacaaggagaaacccgtgaacatcgagacggagccccccttcggggagtcctacatcgtagtcggcgcaggcgagaaggcgctcaagctgagctggttcaagaaggggtccagcatcggcaagatgttcgaggccaccgcccgcggggcccggcgcatggccatcctgggcgacaccgcgtgggacttcgggagcatcggtggcgtgtttaccagcgtggggaagctagtccaccaggtgttcggcacggcttacggtgtgctcttctcgggtgtcagctggaccatgaagatcgggatcggcattctgcttacctggctgggcttaaactcccgcagcacctccctctccatgacgtgcatagccgtcgggatggttacgttataccttggcgtaatggtgcaggccgactccgggtgtgtgataaactggaagggtagagagctcaagtgcgggagcggcatcttcgtaaccaacgaagtgcacacttggaccgagcagtacaagttccaggcggacagtccgaagcgcctgagcgcggccatcggcaaggcctgggaggaaggggtgtgtgggattcggagcgccactcgcttagagaacatcatgtggaagcagatctccaacgaactcaaccatatcctgctggagaacgggatgaagttcaccgtcgtggtgggcgacgcgaacgggatcctagcgcaggggaagaagatgatccggccccagccaatggaacacaagtacagctggaagtcctggggcaaggccaagatcatcggggccgacatccagaacaccaccttcattatcgacggcccagacacgccggagtgccccgacgaccagagagcctggaacatctgggaggtcgaggactatgggttcggcatctttaccaccaacatctggctgaagctgcgggacagctacacccagatgtgcgaccaccgactcatgtccgcggcgatcaaggacagcaaggccgtgcacgccgacatgggctactggattgagtccgagaagaacgaaacgtggaagctggctcgggctagcttcatcgaggtgaagacatgcacctggcccaagtcccacaccctgtggagcaacggtgtcctcgagtccgagatgatcatccccaagatctacggcgggccgatcagtcagcacaactatcgccccggctatttcacgcagaccgccgggccctggcacctgggtaagctggagctcgacttcgatctgtgcgagggcaccaccgtggtggtcgacgaacactgcgggaaccggggaccgagtctgcgtacgaccaccgtcacagggaagatcatccacgagtggtgctgccggagctgcacactaccccccctgcgcttccggggcgaggacggttgctggtacgggatggagattcgccccgtgaaggagaaggaggagaacctggtgagatctatggtgtctgcgggctccggggaggttgatagcttctctctcggaatcctgtgcgtctctatcatgattgaggaggtgatgcgcagccggtggtcccgcaagatgcttatgaccgggaccctcgccgtgttcctgctgctcatcatgggccagctcacgtggaatgacctgatccgcttgtgtatcatggtcggggcaaacgcgagcgaccggatgggcatgggcacgacctatctggccctcatggccaccttcaagatgagacccatgtttgctgtgggcatcctcttccggcgcctgacctcccgggaggtactgctcctgacgatcgggctgagcctcgtcgcctctgttgagctgcccaacagcctcgaggaactcggggacggtctggccatgggcattatgatgctgaagctcctgacagagttccaaccacaccagctgtggacaaccctcctgtcgctgacgttcatcaagaccaccctcagcctggactacgcctggaagaccacggccatggcgctgtccatcgtctctttgttccccctgtgtttgtcaaccacctcgcaaaagaccacctggctccctgtgctgctgggttccttcggttgcaagcccctcacgatgttcttgatcaccgagaacaagatctgggggcgcaagagctggcccataaacgagggcattatggcaataggaatagtgtccatcctgcttagcagtctgctgaagaacgatgtacccctcgccggcccgcttatcgccggcgggatgctgatcgcctgctacgtgatcagcggcagctccgccgacctctccctggaaaaggcggccgaggtgtcctgggagcaggaggccgagcacagcgggacatcccacaacatcctggtcgaggtgcaggacgatggcaccatgcggatcaaagacgaggaaaaggacgacacgctcaccatcctactgaaggccaccctcctagccgtgagcggagtctaccccatgtccattcccgcgaccctgttcgtgtggtacttctggcagaagaagaagcagcgctctggagtgctctgggacactccctccccgcccgaggtcgagagagccgtgctggacgatggcatataccgcatcctgcagcgggggctcctgggccgaagccaggtgggggtaggagtgttccaagacggggtgttccacaccatgtggcacgtcacccgcggcgccgtgctgatgtaccagggcaaacgcctggagccgtcctgggccagcgtgaagaaggatctcatctcctacgggggggggtggcggttccagggcagctggaacaccggggaagaggtccaggtgatcgcggtggagcccggcaagaacccgaagaacgttcagacgacccccggcaccttcaagacttccgaaggagaggtgggggcgatcgccctggacttcaagccggggactagcggctcccccatcgttaatagagagggcaagatcgtggggctgtacggcaacggagtggtgaccacgagcggcacctacgtctccgccatcgcccaggcaaagacgagccaagaggggccgctcccagagatagaggacgaggtgttcaagaagcggaacctgactattatggacctgcacccaggcagcggaaaaacccgccggtacctcccggcgatagtccgcgaggccatcaagcggaagctgcgcaccctgatcctcgcgcccacgcgtgtggtggcgtccgagatggcggaggccctgaaggggatgcccatccggtaccagaccaccgcggtgaagtctgagcacaccggccgcgagatcgtcgatctgatgtgccacgccacgtttaccatgcggctactgtcccccgtgagggtgccgaactacaacatgatcatcatggacgaggcccatttcaccgaccccgcgagtatcgccgcccgggggtacatctccacccgcgtcggcatgggggaagcggctgcgatcttcatgacggcgaccccccctggtagcgtggaagctttcccacagtccaacgccgtgatccaggatgaggagcgtgacatccctgaaagatcgtggaactccggctacgactggatcaccgacttccccgggaagacggtctggttcgtgcccagcatcaagtcgggcaacgacatcgccaactgcctgcgaaagaacgggaagcgtgtgattcagctcagccggaagacgttcgacaccgagtatcagaagacaaagaataacgactgggactacgtcgtcaccacggacatctcggagatgggcgcgaacttccgcgccgaccgggtgatcgacccgcgccggtgcctgaagcccgtgatcctgaaggacgggcccgagcgcgtcatcctcgccggccccatgccggtgaccgtcgccagcgcggcccagcggcgcggccggatcgggcgcaaccaaaacaaggagggcgaccagtacgtgtatatggggcagcccctgaacaacgacgaggatcacgctcactggaccgaagccaagatgctgctcgacaacattaacacccccgagggcatcatccccgcactgttcgagcccgaacgcgagaagagtgcggccatcgacggcgagtaccggctgcgcggcgaggcgcggaaaacattcgtcgagctcatgcgccgcggcgacctgcccgtgtggctaagttataaggttgcctccgaggggttccagtacagcgaccgtcggtggtgcttcgacggcgagcgcaacaaccaggtcctcgaggagaacatggacgtcgagatctggacgaaagagggcgaacggaagaagctgagaccccggtggctagacgcgcgaacctactccgaccccctcgcgctgcgtgagttcaaggagttcgcggcaggccgcagaagcgtgagcggtgacctgatcctcgaaatcgggaagctgccgcaacacctgaccctgcgcgcccagaatgccctggacaacctggtcatgctccacaattccgagcaaggcgggaaggcgtacagacacgccatggaggagctgcccgacacgatcgagacgttaatgctcctcgccctgatcgctgtgctaactggcggcgtgaccctgttcttcctaagcggcaagggcctcgggaagacctccatcggcctgttgtgcgtcacagcgtcgtccgccctcctgtggatggccagcgtggaaccccactggattgccgcctctatcattctggagttcttcttgatggtgctgctgatccccgagccggatcgccaacggaccccccaggacaaccagttagcgtacgtcgtcatcggccttctgttcatgatcctcaccgtggccgccaacgagatgggcctgctggagaccacgaagcgggacctcgggataggccacgtcgccgccgagaaccaccagcatgctacgatgctggacgtggacctgcggcccgcaagcgcgtggaccctctacgcggtggccaccacggtcatcaccccgatgatgcgccacaccatcgagaacaccacggcgaacatctcgctgaccgccattgcgaaccaggccgctatactgatgggcctcgacaaggggtggccaataagcaagatggacatcggcgtgccactgctggcgttagggtgttactcccaagttaatcccctgaccctgaccgccgccgtactcatgctggtggcccactacgcgatcattggcccggggctgcaggccaaggccacgagagaagcccagaagcggaccgccgctggcatcatgaagaaccccactgtggacggcatcgtggccatcgacctcgaccccgtggtgtacgacgccaagttcgagaagcagctggggcagatcatgctcctaatcctgtgcaccagccagatcctgctcatgcgcacgacttgggccctgtgcgagtccatcaccctcgcaaccggcccgctcacgaccctgtgggaggggtcaccgggcaagttctggaacaccacgattgctgtctccatggcgaacattttccggggtagctacctggccggggctggcctcgccttctccctgatgaagagcctggggggcgggcgccggggcaccggcgcgcagggggagaccctcggcgagaagtggaagcgccagctgaatcagctgtccaagcccgagttcaacacctacaagaggagcgggataatggaggtggaccgctccgaggccaaggagggccttaagaggggggagaccaccaagcacgccgtgtcgcgcggcacggccaaactgcggtggttcgtcgagcgcaacttggtgaaacccgagggcaaggtaatcgacctcgggtgcggtcgggggggctggagctactactgcgcggggctgaagaaggtcaccgaggtgaaaggctacaccaagggcggaccgggccacgaggagccgatccccatggccacctacgggtggaacctggtgaaactgcactctggcaaggacgtcttcttcatgccccccgagaagtgcgacacgcttctgtgcgacataggggagagctccccgaaccccaccattgaggagggccgcacccttagagtgctcaagatggtggagccttggctgcgcggaaaccagttctgcataaagatcctgaacccctacatgccgtcagtcgtggagaccttggagcagatgcagcggaagcatgggggcatgctggtgcgcaaccccctgtcccggaacagcacgcacgagatgtactgggtatcctgcgggacgggcaacatcgtgagcgccgtgaacatgacgtcccgcatgctgttaaaccgcttcacaatggcccaccggaagcccacgtacgagcgcgacgtcgatctgggcgccggaacccgccatgtggcggtggagcccgaggtagccaacctcgatatcataggccagcgcatcgagaacatcaaaaacgagcacaagagcacatggcactacgacgaggacaacccgtacaagacctgggcctaccacgggtcctacgaggttaagcccagcggctccgccagctccatggtgaacggggtcgtccggctgctgactaagccctgggatgtcatccccatggttacccagatagccatgaccgacaccacgccgttcggacaacagcgagtgtttaaggagaaggtggatacccggaccccccgcgcgaagcggggcaccacgcagatcatggaggtgaccgccaagtggctctgggggtttctcagccgcaacaaaaaaccccggatctgcacccgcgaggagttcacgcggaaggtgcgctccaacgcggccatcggcgccgtcttcgtggacgagaaccagtggaacagcgcgaaggaagcagtggaggacgagcggttctgggacctggtccaccgcgagcgggagctccacaaacaggggaagtgcgccacgtgcgtgtacaacatgatgggcaagcgcgagaagaagctgggtgagttcggcaaggccaagggcagccgggcgatctggtacatgtggctgggggcacgcttcctcgagttcgaggccctgggcttcatgaacgaggaccactggttctcccgggagaacagcctctccggggtggagggcgaggggctccacaagctgggctacatcctgcgcgacatcagcaagatcccaggcggaaacatgtacgccgacgacaccgccggctgggacacccgcatcaccgaggacgacctccagaacgaggcgaagatcacggacattatggagcctgagcacgccctgttggccacgagtatcttcaagctaacataccagaacaaggtagttcgggtgcagcgccccgccaagaacggaactgtcatggacgtcataagccggcgcgaccagcggggctccggccaggttgggacgtacggcctgaacaccttcaccaacatggaggtgcagctgatccgtcagatggagagcgaggggatcttcctcccctccgaactggagaccccgaatctggccgagcgcgtgctcgactggctggagaagcacggcgcggagcgcctgaagcgaatggccatcagcggggacgactgcgtggtcaagcctatcgatgaccgctttgcgaccgccttaacggccctgaatgacatgggcaaggtgcggaaggacatcccccagtgggaaccctccaagggatggaacgattggcagcaggtgccgttctgcagccaccatttccaccagctgatcatgaaagatgggagggagatcgtagtgccctgccgaaaccaggatgagctcgtgggccgcgcgcgggtctcccagggggctggctggagcctgcgcgaaactgcctgcctggggaagtcctacgcccaaatgtggcagttgatgtacttccatcggcgcgacctccgacttgccgcgaacgccatctgcagcgccgtgcccgtggactgggtccccacaagtcgcaccacgtggagcatccacgcccaccaccaatggatgacaacggaggacatgctcagcgtgtggaaccgcgtgtggatcgaggagaacccgtggatggaggacaaaacccacgtttccagctgggaggaggtgccctatctgggcaagcgggaagaccagtggtgcggctccctgatcgggctgacggcgcgcgccacctgggccaccaacatccaagtggccatcaaccaggtccggcgcctgatcggtaacgagaactacctagactatatgacaagcatgaaacggttcaagaacgagtccgaccccgagggggccctctggtga

SEQ ID NO: 23980 - RNA, 9879 nt, synthetic construct
  misc_feature 1..9879: note = derived and/or modified CDS sequence (opt11) from DENV-1__FJ898448__SS-prME
  source 1..9879: mol_type = other RNA
tcagtcaccatgctgttaatgctcttgcctaccgtacttacattccacctgacgacccgtggcggcgaaccccacatgatcgtgagcaagcaggagcgaggcaagagcctgctatttaagacttcggctggagtgaacatgtgcacgcttatagcgatggaccttggcgaactctgtgacgacacaatgacatacaagtgcccccgcattaccgaaactgagcccgatgacgtagactgttggtgcaacgccacagagacatgggtcacatatgggacgtgtagccagacgggagaacaccgtagagacaagagatctgttgcactagccccacatgtaggcctgggactcgagactaggaccgaaacgtggatgagcagcgagggcgcgtggcgccagatacaaaaagtcgaaacatgggccctcaggcacccaggcttcacggtcatcgctctcttcctagcgcacgccattggcacaagcatcacccaaaagggcatcatcttcatactccttatgctcgtaactccatcgatggcaatgcggtgcgtaggaatcgggaaccgggacttcgtagaggggctcagtggtgctacatgggtagatgtagtcctcgaacatggcagctgcgtgacaaccatggcaaaggacaaaccgaccctggacatagaactactcaaaacggaggttaccaacccagcagttctcagaaagctgtgcattgaggctaaaatcagcaacacgacaaccgacagtagatgtcctacccaaggtgaagcgacacttgtagaagaacaggacaccaattttgtctgccgacgcacattcgtagaccgcggctggggcaacggttgcggcctattcggaaagggctccttaatcacttgtgccaagttcaaatgcgtgactaagctcgagggaaagatagtgcaatacgaaaacctgaagtacagcgtcatagtaactgtgcacaccggagaccagcatcaggtcgggaacgaaacgacagaacacggtaccatagcaaccataaccccgcaagcacccacctccgaaatccaactcacagactacggcgccctaacgctcgactgcagcccccgaaccggtttagactttaacgaaatggtgttactaaccatgaaagaaaagtcatggctagtccacaaacagtggttcctagatttaccactcccctggacgagtggtgcgagcacctctcaagaaacctggaaccgacaagacctcctggtcacattcaaaaccgcccatgcgaaaaaacaggaggtagtagtactaggctcccaggagggcgcgatgcacacagcactaacgggagcgaccgagatccaaacatcaggaacaacgacgattttcgccggacacctcaaatgcagactcaagatggacaagctcaccttaaaagggatcagctacgttatgtgcacaggaagtttcaagcttgaaaaggaagtcgcggagacccaacacggaaccgtactggttcaagtcaaatacgaaggtactgacgctccatgcaaaatcccgttcagcagccaagatgaaaagggtgtaacgcagaacgggaggctggttaccgcgaatcccatcgtaaccgacaaagaaaagccagtcaacatcgaagccgaaccgccattcggggagtcctacatcgtcgtgggggcgggagaaaaggcgctgaagctctcctggtttaaaaaaggctcctccatcggaaaaatgtttgaagccactgcgaggggggcccgaagaatggccatcctcggcgacactgcctgggacttcggctccataggcggtgtattcactagcgtaggcaagctggtgcatcaaatatttgggacggcatacggggtgttattcagtggcgtgtcctggacaatgaagataggtattggaatcctactaacttggctaggactgaactcgcggagcacttccctgtccatgacttgcattgcggtcggaatggtaacactatacctcggagtaatggtgcaagcagacagcggctgtgtcattaactggaaggggcgagagctaaaatgcggatcaggcatattcgtcaccaacgaggtacacacgtggacagaacaatataagttccaagctgactcaccgaaaaggctcagcgcagccattggtaaagcgtgggaagagggcgtctgcgggatcaggagtgcaactcggctagagaacataatgtggaaacaaatatccaacgaactcaaccacatactgctagaaaatgacatgaaattcaccgtagtggtaggggacgttagtggaatcctcgcgcaaggcaaaaagaccatccgtccgcagccaatggaacacaaatacagctggaagtcgtgggggaaggcgaagatcataggagcggacgtacaaaacacgacgttcataatagacggacccaacacaccagaatgtccagacgatcaacgagcctggaacatctgggaagtagaggactacggattcggcatcttcacgaccaacatctggctaaaattacgagactcgtacacacaagtgtgcgaccatcggctcatgtccgcggccatcaaggacagcaaagcagtgcacgcagacatgggctactggattgagtcagagaagaatgaaacttggaagctcgccagagcctcgttcatagaagtgaaaacctgcgtctggccaaaatcacacaccctatggtcaaatggggtcctagagagtgaaatgatcataccgaaaatatatggggggccaatctcacagcacaattatagaccgggctacttcacacagacggcgggaccctggcaccttggaaaactcgagctcgactttgacctctgcgaggggacgacagtagtcgtggacgaacactgcggaaataggggtccgagtctccgaacgacgaccgtaactggcaaaataatccacgaatggtgttgccgctcctgcacactccctccgctaaggttcaaaggcgaagacggctgctggtacggaatggagattagaccggttaaagaaaaagaagagaacctagtcaagagtatggtgagcgcgggaagtggcgaggtggattcattcagccttggattactttgcatcagtatcatgatcgaagaggtgatgcgatcaagatggtctcgcaaaatgctaatgaccggtaccttagtcgtattccttcttctaaccctgggacaactgacatggaacgacctcatacgcctgtgtatcatggtcggcgctaatgcctcagacaacatgggaatgggcacaacttaccttgcactaatggctaccttccggatgcgccccatgttcgcagtgggcctactcttcaggcgtctcacgagccgagaggtgctcctcctaactgttggactgagcctggttgcgtcggttgagttacctaattcgctggacgaactcggcgacggactggcaatggggataatgatcctaaaactgctcacggacttccaaagccaccaactgtgggcgacattactttctctgaccttcgtgaaaacaacactcagccttcattatgcctggaaaaccatggcaatgatcctatccatcgtaagtttactgccgctatgcctcagcacgacatcccaaaaaaccacctggctcccagtacttttgggaagtcttggctgcaaaccgctcaccatgttcctgattacggaaaataaaatatggggacgaaagtcctggccccttaacgaaggaatcatggcagtaggcatagtaagcatactattaagcagtctcctgaagaacgacgttccacttgcaggacccttgatcgctggagggatgttaatcgcctgctatgttataagtggctcatcagcagatctaagtctagagaaagccgctaaggtatcatgggaggaagaggcagaacacagcggtgcctcccacaatatactggtagaaatccaagacgacggaacgatgaaaatcaaagatgaagagcgggacgacaccataacaatactgctcaaggccaccctcttagcgatctccggggtgtacccgatgagcatacccgcgaccctcttcgtttggcacttctggcaaaagaagaagcaacgaagtggagtcttatgggacacaccatccccaccagaggtagagaaggctgttttagacgacggaatctaccgcatcctccagcgaggactcctaggacgttcacaggtcggcgtaggagtctttcaagaaggagtctttcacaccatgtggcatgtaaccagaggcgccgtactcatgtaccaaggtaaacgcctagagccgtcctgggccagtgtcaaaaaagatttaatttcgtacggagggggttggaggtttcagggaagctggaacaccggagaggaagtgcaagtcatcgcagtcgaaccagggaagaatccaaagaacgtgcaaacggcacccggcactttcaaaacgagcgagggggaagtaggtgcaatagcattggacttcaagccgggcaccagcgggagccctatcgtaaatcgagaaggcaaaatagtgggactgtacgggaacggtgtagtcacaacgtcgggcacatacgtatcagccatcgcacaagctaaagcgtcgcaagaaggccccctacccgaaatagaggacgaggtatttcggaaacgaaatctgactataatggatttacatcccggctcaggcaaaacacgtcggtacctaccggccattgtcagagaggcaatcaaacgtaagctaaggacactcgtactggctccgaccagggtagttgcaagtgagatggcagaggctctcaaaggtatgcccatacgataccaaactaccgcggttaaatcagaacacaccggcaaggagattgtggacctgatgtgccacgctacctttacaatgagactgctaagcccagtgcgagtcccgaactataacatgattataatggatgaggcccactttacagatcccgcaagcatagcggcccgaggttacataagcacccgggtaggaatgggggaggcagccgctattttcatgacggcgacaccgccaggctcagtcgaggcgttcccgcagagcaatgcagttatccaagacgaagaaaaagacattccagagcgctcgtggaacagcggatacgactggattaccgacttccccggaaagaccgtgtggttcgttcccagtataaaaagtggcaacgacatagcaaactgcctccggaagaacggaaaacgagtcatacaacttagtcgcaagactttcgatacggagtaccaaaaaacaaaaaacaatgattgggactacgtggtcacaacagacatcagcgagatgggagccaactttagagctgatcgagtaatagacccccgccgatgcctaaaacctgtcatactcaaagatggccccgagcgagtaatcctagcggggcccatgccggtcaccgttgccagtgcagcccagcggagagggaggatagggcggaaccagaacaaggaaggagatcagtacatctatatgggccagcccctaaacaacgacgaggaccacgcccactggaccgaagcgaagatgctgctagataatataaacaccccagagggaattataccagcgctcttcgagccggaaagagagaaatcggccgcaatagacggagaatataggctacgcggggaagcgcgaaaaacattcgtcgagttaatgcgtcgaggagacttgcccgtatggctatcctacaaagtcgccagcgaaggtttccaatatagcgaccgccgttggtgttttgatggcgaacgaaacaatcaagtcttagaagaaaacatggacgtagaaatttggaccaaagagggtgagcgtaaaaaactcagaccacgttggctggacgccaggacctactccgaccccctagcgttacgagagtttaaagaattcgctgccgggcgccggagcgtgagcggagaccttattcttgagatcggcaagctccctcagcacctgacgcagagagcacaaaatgcactcgacaacctagtgatgctccacaacagcgagcaaggcggtaaggcgtaccgccatgcgatggaggaactacctgatacgatagaaacaataatgctactagccctcatagcagttcttacaggcggagtgacattgtttttcctatccggcagaggcctgggaaaaaccagtatcgggctactatgtgtgacatcctctagtgcactactctggatggcgtccgtggaaccgcactggattgcggctagtatcatactcgaatttttcctcatggtactactaatcccagaacccgaccgacaaaggacaccgcaggataatcagctagcatacgttgtgataggactattatttatgatccttacagtagccgcgaacgagatgggattactcgaaacaaccaaaaaagacttagggatcggccacgccgcagccgaaaatcaccaccacgcagccatgctagacgtggacttacacccagcgagcgcttggacgctgtacgcagtcgcaacaaccattatcacaccaatgatgcgtcacacgatagaaaacactacggctaacatcagcctgactgcgatagcgaaccaagccgcaatactcatgggactggacaaaggatggccaatctcaaaaatggacatcggcgtgccactgctagcactgggctgctacagccaggtgaatccactcaccttaactgcggcagtcctgatgttagtggcccactacgcaatcataggcccgggactacaagcgaaagcaaccagggaggcacaaaaacgaaccgccgcgggaataatgaaaaatccaaccgtcgacgggatcgtagctatagatctggacccagtcgtttatgatgcgaaattcgaaaaacagctaggacagataatgctcctaatattgtgcacgtctcaaatactactcatgcgaaccacatgggctctatgtgaatccattacgttggcaaccggacccctgacaaccctgtgggagggatcccccgggaagttctggaacacgacgatcgcggtatcaatggccaatatcttccgagggtcgtaccttgctggggcaggcttggccttctccctaatgaaatccttgggaggcggacgcaggggtacgggagctcaaggagaaaccctaggagagaaatggaaacgacaactcaaccagttgtccaaaagtgaatttaacacctacaagagatcagggatcatcgaggtagacaggtctgaggcgaaagaaggactcaagaggggagagaccacaaaacatgcagtgtcacgggggactgccaagctaagatggttcgtagagaggaacttagttaagcctgaaggaaaggtaatagacctaggctgtggccgaggcggatggtcatactactgtgccggacttaaaaaagtcacagaagtgaaagggtacaccaagggagggccggggcatgaagagcccatcccaatggcaacatatggctggaacctggtgaaattacacagcggaaaggacgtcttctttattccaccagagaagtgcgacacgttattatgcgacattggagaaagctcacccaaccccacgatagaggaagggcggacactacgcgtcctcaaaatggttgagccctggcttcgcggcaatcaattttgcataaaaatattaaacccgtacatgccctctgtcgtcgaaaccctcgagcaaatgcagcggaaacatgggggaatgctcgtacgaaaccctctcagccgcaacagcacacacgagatgtactgggtctcctgcgggacaggcaacatcgtcagcgccgtcaacatgacaagtaggatgctactaaacaggttcaccatggcgcaccgcaaaccgacatacgagcgagatgttgatctgggcgcagggacaaggcacgtagccgtcgaacccgaggtcgccaacttggacataattggacaacgaatcgaaaacataaaaaatgaacacaaaagcacttggcattatgatgaagacaacccgtacaagacatgggcatatcatgggtcatacgaagtgaaacccagcggatctgcgtcttctatggtaaacggagttgtacgactcctcaccaagccatgggatgtaataccgatggtaacacagatcgccatgacggacactacgccattcggacaacaacgtgtattcaaagagaaagtcgataccaggactccgaaggcgaaacgcgggactgctcaaataatggaagtcacagccaaatggttatgggggttcctcagccgaaacaaaaaacccaggatatgcacgcgagaagaattcacccggaaggtacgcagcaatgcagctataggggcggtcttcgtggacgaaaatcaatggaattcagccaaagaagcggtcgaggacgaaaggttctgggacctggtgcgacgagaacgagaactccacaagcagggcaagtgcgcgacatgcgtttacaatatgatgggcaagcgagagaaaaaattaggcgaattcggaaaagcgaagggaagccgagccatttggtacatgtggctaggcgcccggtttctcgagttcgaagccctaggctttatgaacgaggaccactggtttagtcgggagaacagcctgagcggggtcgaaggggaaggacttcacaagctcggctacattctgagggacattagtaaaataccaggcggcaatatgtacgcagacgatacagcaggttgggacacacgaattacggaagacgatttacaaaacgaggcaaaaataacggacattatggaaccagaacacgcattgctagcgacctccatattcaagctaacataccaaaacaaagtcgtccgcgttcaacgcccggcgaagaacggcacagtaatggacgtcatttccagaagagatcagcgagggagcggacaagttgggacctacgggctgaacaccttcacgaacatggaagcacagctaataagacagatggaaagcgagggaattttttcgccctccgagctagaaacgcctaatctggccgggagggtactagactggctcgaaaaacatggaactgagcgtctccgccgaatggccataagcggcgatgactgcgttgtaaaacccatagacgacagatttgccacagccctcacagccctaaacgacatgggtaaagtccgtaaagatataccacaatgggaaccctcaaaagggtggaacgattggcaacaagttccattctgcagccaccattttcaccagctaataatgaaagatggtcgagagattgtagtcccctgtcgtaaccaagacgaactcgtgggacgcgcgcgcgtctcgcagggagctgggtggagcctgagggaaaccgcatgcctaggaaaaagttatgcccaaatgtggcaactaatgtactttcaccgccgagacctacgactcgcggcgaacgccatttgtagtgcagtaccggtagattgggtcccaacgagccgaaccacgtggagcatacacgcccaccatcaatggatgaccacagaggacatgctgagtgtctggaatcgcgtgtggatagaagaaaacccgtggatggaagataaaacccacgtaagctcgtgggaggacgtcccgtacctcgggaagcgagaggatcagtggtgtggctcgctaataggactcacggcgcgggcaacatgggcgacgaacatacaagtcgcaatcaaccaagtgcgccgactgatcggaaatgaaaactacctcgactacatgacatcaatgaagagatttaaaaacgaatccgaccccgaaggagcgctctggtaa

SEQ ID NO: 23981 - RNA, 9879 nt, synthetic construct
  misc_feature 1..9879: note = derived and/or modified CDS sequence (opt11) from DENV-1__GQ868602__SS-prME
  source 1..9879: mol_type = other RNA
agcgttaccatgctgctcatgctgctgcccacagctctcgccttccacctgaccacccgtggcggggaacctcacatgatcgtaagcaagcaggagcggggcaagagcctcctgttcaagacaagtgctggggtaaacatgtgcaccctgatcgccatggacctgggcgagctctgcgaagacaccatgacgtacaagtgcccgcgaatcaccgagaccgaacccgacgacgtggactgttggtgcaatgccaccgagacgtgggtaacctatgggacctgtagccagaccggcgagcaccggcgcgacaagcgttccgtggccctcgctccccacgttggcctgggtttggaaacccgcactgagacctggatgagttccgagggggcgtggagacagatccagaaggtggagacctgggccttaaggcatcccgggttcaccgtaatagccctgttcctcgcccacgcgatcgggacgagtatcacccaaaagggtatcatcttcatcctgctcatgctcgtgacgccctccatggccatgcggtgcgtcggcattggcaaccgtgacttcgtggaggggctgagcggggcaacctgggtggatgtcgtactggagcacgggtcctgcgtgaccaccatggctaaggacaagcccactctcgacatcgagctgctgaagaccgaggtcaccaaccccgcggtgcttcggaagttgtgcatagaggcgaagatcagcaacaccacgacggattcccgctgccccacccagggcgaggccaccctggtagaggagcaggacacgaacttcgtctgccgtcgaacatttgtggatcggggctgggggaacgggtgcggcctgttcggcaaggggtcgttaatcacgtgcgccaagttcaagtgcgtgactaagctggagggcaagatcgtccagtacgagaatctcaaatactccgtaatcgttacggtccacacgggcgaccagcaccaggtggggaatgaaaccaccgagcatgggaccacggccacgatcacgccccaggcgcccaccagcgaaatccagctgacggattacggggcgttaaccctcgactgttcaccccggactggcctggacttcaacgagatggtactgctcaccatgaaagagaaatcctggctagtccacaagcaatggttcctggacctcccgctaccctggacgtccggagcgagcaccagccaggagacctggaaccggcaggacttgttagtgaccttcaagaccgcacatgccaagaagcaggaggtggtagtcttaggttcccaggagggggccatgcacaccgcgctgacaggggccacggagatccaaacgagcggtaccaccactatcttcgccgggcaccttaagtgccgcctgaaaatggacaagcttactctcaagggcgtgtcctacgtgatgtgcaccgggagcttcaagctggaaaaggaggtggccgagacgcagcacggcaccgtgctggtgcaggtcaagtacgagggcacggatgccccctgcaagatccccttctctagccaggatgagaagggagtcacacaaaacggccggctgatcacggcgaacccgatcgtgacggacaaggagaagccggtgaacatcgaggccgagccgcccttcggagagagttacctcgtagtaggtgcaggcgagaaggccctgaaactctcatggttcaagaaagggtcaagtatcggcaagatgttcgaggcgaccgcaaggggggcccggcgcatggccattctcggcgacaccgcctgggacttcggttccatcggcggcgtgttcacgagcgtcgggaagctgatccatcagatcttcggcaccgcgtacggggtgttgttttcaggagtgagttggacgatgaagattgggatcgggattctcctgacctggttgggtctcaacagccgcagcacctccttatctatgacatgcatcgccgtcgggatggtgacgctgtacctcggcgtgatggtccaggccgactccggatgcgtgatcaactggaaaggtcgggagctgaagtgtgggtcgggcatctttgttaccaacgaggttcatacctggaccgagcagtacaagttccaggccgacagcccaaaacgcctgtccgccgcgatcggcaaggcctgggaggagggggtgtgcggaatcagaagcgcaacccgcctcgagaacatcatgtggaagcaaatctccaacgaactgaatcacatccttctggagaacgatatgaagttcacggtggttgtgggggacgtgaacggcgtcctggcccagggaaaaaagatgatccgccctcagcccatggaacataagtacagctggaagagctggggcaaggccaaggtgatcggagcggatgtgcagaacataaccttcatcatcgacgggcccaacaccccggagtgccccgacgaccagcgcgcctggaatatctgggaggtcgaggattacggattcgggatcttcaccacgaacatttggctcaagctccgggacagctacacccaagtgtgcgaccaccgcctgatgtccgccgccataaaggacagcaaggctgtccatgctgacatgggatactggattgaatccgaaaaaaatgagacctggaagctgactcgggccagcttcatcgaggtcaagacgtgcatctggccgaagtcccacaccctctggagtaacggcgtgctagagtccgagatgatcatccccaagatctacggggggccgatctcacaacacaactaccgcccagggtattttacccagaccgctggtccctggcacctagggaaactcgagctggacttcggcctctgcgaaggcacaaccgtggtcgtggacgagcattgtgggaatcggggaccgtctctccgcaccaccacggtgaccggaaagatcatccacgagtggtgctgccggtcatgcaccctgccgcccctgcgcttcaagggcgaggacggatgctggtacggcatggagattcggcccgtcaaagagaaggaggagaacctcgtgaaatccatggtgtcagccggcagcggggaggttgactccttcagcctcggcctgctctgcatctccatcatgatcgaggaggtgatgcgcagtcggtggagtcgcaagatgctcatgaccgggacgctggcggtctttctcctgctgatcatgggtcaactcacgtggaacgacctcattcgactgtgcatcatggtcggagccaacgccagcgacaagatgggcatgggaacaacctacctcgccctgatggcaacgttccgcatgcgaccgatgtttgccgtggggttactgttcagacgcctaacctcccgggaagtcctgctcctgaccgtcgggctgagcctcgttgcctcggtcgagctgcccaacagcctggaggagctcggggatggcctggccatgggaatcatgatgctgaagcttctgaccgatttccagtcccaccagttgtgggccacgctcctatctctgaccttcgtgaagacaaccttttcgctccattacgcctggaagacaatggcgatgatcctgagcatcgtgagtctgtttcccctctgtctttcgactaccagccagaagaccacgtggctaccggtcctcctggggagcctgggctgcaaaccgctcaccatgttcctgataacagagaataagatctggggccgcaagtcctggcccctcaacgaggggatcatggccgtgggcatcgtaagcatccttctgagctcattattaaagaacgacgtccccttagcgggccccctgatcgccgggggcatgctcatagcgtgctacgtgatcagtggcagcagcgcggacctgtcactggagaaggccgctgaggtgagctgggaagaggaggccgagcattccggggcatcacacaacatactcgtcgaggtgcaggacgacggcaccatgaagatcaaggatgaggaacgggacgacaccctgaccatcctgttaaaggccactctgttagccatctccggggtgtacccgatgagcatccccgctaccctcttcgtctggtatttctggcagaagaagaagcagcgctccggggtgctttgggacacccccagccctccggaagttgagcgggcggtcctagacgacggcatctaccgcatcttacagcgggggctcttgggcaagtcccaggtgggagtgggcgtatttcaggagggcgtgtttcacacgatgtggcacgtgaccaggggcgcggtactgatgtaccagggcaagcggctcgaaccctcttgggcatccgtcaagaaggacctgatctcgtacgggggagggtggcgctttcagggctcctggaatatgggggaggaagtgcaggttatcgctgttgagcccggcaaaaacccaaagaacgtgcagacggcacccggcaccttcaagacgcccgagggcgaggtcggcgccatcgcgctggactttaaacccgggactagcgggtcgcccatcgtgaaccgggagggaaagatagtggggctctacggcaatggggtagtgaccacaagcggtacatacgtgtcggctatcgcccaggccaaggcctcccaggagggccctctgcccgagatcgaggacgaggtattccggaagcggaacctgaccataatggatctccatcctggcagcggcaagaccagacggtacctgccagcgatcgtgcgcgaagccatcaaacggaagctgagaaccttggtgctcgccccaacgcgggtagtggccagtgagatggcggaggccctaaagggcatgccgatcaggtatcaaaccaccgccgtcaagagcgaacacaccggcaaagagatcgtcgacctcatgtgccatgcgactttcaccatgcgtctgctgtcccccgtgcgggtgccgaactacaatatgatcatcatggatgaggcccacttcactgaccccgcaagcatagccgcccgcgggtacatctccacacgggtcggcatgggggaggccgccgcgatcttcatgacagccaccccgcccgggagcatggaagccttcccacagagtaacgccgccattcaggacgaggagcgagacatccccgaacggagctggaattccggatacgactggatcaccgactttcccggtaaaactgtgtggttcgtgcctagcattaagagtggtaacgacatcgcgaactgcttacgaaagaacgggaagcgggtcgtacagctgagccggaagacgttcgacaccgaatatcagaaaaccaagaataacgattgggactacgttgtcaccacggacatctccgagatgggcgctaacttccgggccgatcgagtaattgatccgcggagatgtctgaagcccgtcattctcaaggatggccccgagcgcgtgatcttggccggccccatgccggtgaccgtcgcgagcgcggcacagcgccgcggccggattgggaggaaccagaataaagagggagatcagtacatctacatgggccaacccctgaacaacgacgaggaccacgcccactggactgaagccaaaatgttgctggacaatatcaacacccccgaagggatcatccccgcgctgttcgagccggagcgagaaaagtccgccgccatcgacggggagtatcggctacggggtgaagcacgcaagacattcgtggagttgatgcggcgcggggatctgcctgtctggctcagctacaaggtcgcctctgaggggttccagtatagcgacagacgctggtgcttcgacggcgagaggaacaaccaggtgctgctcaaaaacatggacgtggagatctggaccaaggagggggagcgcaaaaaactccggccccgctggttggacgcccgcacctatagcgatcccctggccttacgcgagtttaaggagttcgcggccggccggcgatccgtctctggtgacctgattctggagatcgggaagctcccgcaacatctgacccagcgggcacaaaacgcgctggataatctagtgatgctgcacaactccgagcaaggcggcaaggcttaccgccacgccatggaggagctacccgacacgatcgagaccctcatgctcctggccctcatcgcggtgctgaccggtggggtcacgctctttttcctcagcggacgcggcttagggaagacatccatcggtctgctctgtgtgatggccagctccgccctgctgtggatggccagcgtggaacctcactggattgcagcaagtatcattctcgaattcttcctgatggtcctgttaatccccgagcctgaccgccagcggacgccccaggataaccagctggcatacgtggtgatcgggctcctgttcatgatcctgaccgtcgcagcgaacgagatggggttacttgaaaccacaaagaaggacctgggaatcgggcatgttgcagcggagagtcaccaccacgccgcgatgttggacgtcgatcttcaccccgcctccgcctggacgctgtatgcggtcgcaaccacgatcatcaccccgatgatgcgccacaccatcgagaacaccaccgccaacatcagtttgaccgccatcgccaaccaggctgccatcctcatgggcttagacaaagggtggcccatttccaagatggatattggcgtacccctgctagccctggggtgctacagccaggttaatcccctgacgctcactgccgcggtcctgatgctcgtggcccactacgctataatcggcccggggctgcaggccaaagccactcgggaggcgcagaagaggaccgctgccggcataatgaaaaatcccacagtggacggcatcgttgccatagatctcgacccagtagtgtacgacgcgaagttcgagaagcagttaggacagattatgctgctgatcctttgcacctcccagatcctcctgatgcgtaccacctgggcattgtgcgagagcatcacgttggccaccggcccgctgaccaccctgtgggagggttccccgggaaagttctggaacacgaccattgccgttagcatggcgaacattttccgcggctcgtacttggccggggcgggactggccttcagcctaatgaagagtcttgggggcgggcgccggggcaccggggcccagggcgaaactttgggcgagaaatggaagcgccagctgaaccagctctcaaagagcgaattcaacacgtacaagcggtccgggatcatcgaagtggacaggtcggaggccaaggaaggcctgaagcgcggcgagaccaccaagcacgctgtgtcccgcggcaccgccaagctgcggtggttcgtcgaacgcaacctggttaagcccgagggcaaagtgatcgacctcggatgcggccgcggcgggtggagctactactgcgccgggcttaagaaggtcaccgaggttaaggggtataccaagggcgggcccggccacgaggagcccatcccgatggccacctacgggtggaacctggtgaagctctactccggcaaagacgtcttcttcactccgcccgagaaatgcgacacgctgctgtgcgacatcggggagagctcgcccaacccgaccatcgaggagggcaggaccctccgggtgctgaagatggtcgagccctggctgcgcggcaaccagttttgcatcaaggtactcaacccctacatgcccagcgtggtggagactctggagcagatgcagcgcaaacacgggggcatgctggtccgaaatcccctctctcggaacagcacgcacgagatgtactgggtgtcctgcggcacgggcaatatcgtgagcgcggttaacatgacctcccgcatgctgcttaatcggttcaccatggctcaccgcaagcccacctacgagagagacgtagacctgggagccggaacgcgcaatgtggccgtcgagccggaggtggccaatcttgacattatcggacagaggattgaaaacatcaagaatgagcacaagagcacctggcactacgacgaagacaacccatataagacttgggcctaccacgggtcttatgaggtcaaaccgagcggctccgcgagcagcatggtgaatggagtggtccggctgctcaccaagccctgggatgtgatccccatggtgacgcagatcgcgatgaccgacaccacccccttcggccagcagcgcgtcttcaaagagaaggttgacacccggactcctaaggccaagcgcggcaccgcccaaatcatggaagtgacggcccggtggctgtgggggtttttgtccaggaacaagaagcccaggatctgcacgcgcgaggagtttacgagaaaggtccgcagcaacgcagccattggagcggtgtttattgacgagaaccagtggaactccgccaaggaggcggtcgaggacgaacggttctgggacctcgtccacagagagcgggagctgcacaagcaggggaagtgtgcgacgtgcgtatacaacatgatgggcaagcgcgagaagaagttgggggagttcgggaaggccaaaggcagccgggccatctggtacatgtggttaggtgcccggtttctggagttcgaggcgctgggcttcatgaacgaggaccactggttctcccgggagaatagcctgtcaggggtggagggtgagggactgcataagctcggttatatcctccgcgacatctcgaagatacccggcgggaacatgtacgccgacgataccgccggctgggacacgcggatcacggaagacgacctgcagaacgaggccaagattaccgacatcatggagccggaacacgccctgctcgcgacctccatcttcaaactgacataccagaacaaggtcgttagagtgcagcgtcccgcgaaaaacgggaccgtcatggatgtaatcagcagaagagaccagcggggctctggccaggtagggacctatggcctgaacaccttcacgaacatggaggcccagctcatccgacagatggaaagcgagggcatcttcctgccctccgaattggagaccccaaacctcgcagaacgggtgctggactggctggagaagcacggcatcgaacgactcaaacggatggccatctcgggggacgactgcgtggtcaagcccatcgacgatcgctttgcgaccgccctcaccgccctgaacgatatggggaaggtccggaaggacattccgcagtgggaaccctccaaaggatggaatgattggcagcaggtccccttctgcagccaccacttccaccagctcattatgaaagacggccgcgagatcgtggtcccgtgccggaaccaagacgagctggtaggccgcgccagggtgtcccaaggtgcgggctggagcctgcgcgagacggcgtgtctgggcaaatcgtacgcccagatgtggcagctgatgtacttccatcggcgcgacttacgtcttgccgccaacgcgatctgctccgccgtccccgttgactgggtgccgaccagccgcaccacctggtccatccacgcccaccaccagtggatgacgaccgaggacatgctgtccgtctggaaccgggtgtggatagaggaaaacccctggatggaggacaagacccatgtctccagttgggaggatgttccgtacctgggtaaacgggaggatcagtggtgcggctccctcatcgggctgaccgcccgggcgacgtgggcaacgaacatccaagtggccatcaaccaggtgcgccgcctgatcggcaacgagaactatctagactacatgacctctatgaagcggttcaagaacgaaaatgaccccgagggagccctgtggtga

SEQ ID NO: 23982 - RNA, 9879 nt, synthetic construct
  misc_feature 1..9879: note = derived and/or modified CDS sequence (opt11) from DENV-1__KF921911__SS-prME
  source 1..9879: mol_type = other RNA
agcgtgactatgctgctcatgctgctacccaccgccctcgcctttcacctgactaccaggggcggggagccccacatgatcgtctcaaagcaggaacggggcaagagcctgctgttcaagaccagcgtgggtatcaatatgtgcaccctgatcgcgatggacctgggcgagctctgcgaggacaccatgacctacaagtgcccccggatcaccgaggcggagccggatgacgttgactgctggtgcaatgccaccgacacctgggtcacctacggcacctgcagccagacaggcgagcaccggcgcgacaagcggtccgttgccctggcgcctcacgtgggcctggggctcgagacgcggaccgagacctggatgagctccgagggcgcctggaaacagatacagaaggtcgaaacctgggccctgcggcaccccggtttcaccgtgaccgccctattcctcgcccacgccatcggcaccagcatcactcagaaggggataatcttcatattgctgatgctagtgacgcctagcatggccatgcgctgcgtcggcataggcaaccgggacttcgtcgaggggctgagcggcgccacctgggtggacgtcgtgttagagcacgggtcctgtgtgaccaccatggccaaagataaacccacgctcgacatcgagttgctaaagaccgaagtcacaaaccctgccgtactccgcaagctgtgcatcgaggcgaagattagcaacaccacgaccgacagtcggtgtccgacccagggagaggccaccctggtggaggagcaggacagcaacttcgtttgtaggaggacctttgtagaccgtgggtgggggaacggctgcggtctcttcggaaaggggtccctgctgacctgcgcgaaattcaagtgcgttacaaagctcgagggcaaaatcgtccaatacgagaacctgaagtatagcgtgatcgtcaccgtccatacgggcgaccagcaccaggtggggaacgagaccaccgaacacggcacaatcgcgaccatcacgcctcaggccccaacaagcgagatccagttaaccgattacggggcgttgaccctggactgtagcccccgcacgggactggacttcaacgagatggtcctactgaccatgaaggagaagtcctggctcgtgcacaagcaatggttcctcgaccttccgctgccctggaccagcggggccagcaccagccaggagacgtggaatcgccaggatctcctggtaaccttcaagaccgcccacgccaagaagcaggaagtagtggttctgggcagccaggagggcgccatgcataccgcgttaacgggggccaccgagatccagacctccggcaccacgaccatctttgccgggcacctgaagtgccgcctgaaaatggacaagctgacacttaagggcatgtcttacgttatgtgcaccgggtccttcaagctcgagaaggaggtggccgaaacgcagcacggcacggtgctggtccaagtgaaatacgagggtacggacgccccctgcaagattcccttctcggcgcaggacgagaagggggtgacccagaacggccgtctcatcacggccaatccgatagtcaccgacaaggagaagcccgtgaacatcgagaccgagccgcccttcggggagtcctacatcgtgattggcgccggcgaaaaggccctgaagctgagctggttcaagaagggttctagcataggcaaaatgttcgaggctaccgcccgcggagcgcgacggatggccatcctcggcgacacggcttgggacttcggctccatcggcggcgtcttcaccagcgtggggaagctggtgcaccaggttttcggcgcggcctacggggttctgttttccggcgtgagctggacgatgaagattgggatcggcatcctcctaacctggctgggcctcaactcccggagcacgtccctgtctatgacctgcatagccgtcggtatggtcacactgtacttgggcgtgatggtccaggcggattccgggtgcgtcatcaactggaagggacgcgagctcaagtgcgggagtggcatcttcgtgaccaatgaggtccacacgtggaccgagcagtacaagttccaggccgacagcccgaagcggctgagtgctgccatcggaaaggcttgggaggaaggggtgtgcgggatccgcagtgccacccgcctcgagaacatcatgtggaagcagatctcgaacgaattgaatcacatcctcctggagaacgacatgaagttcaccgtggtcgtgggggacgccaacggcatcctggcgcaggggaagaagatgatccggccccagcccatggagcacaggtacagctggaaaagctggggtaaggccaagatcataggcgccgacatccagaataccacgttcatcatcgacgggcccgacaccccggagtgtcccgatgatcagcgggcgtggaacatttgggaggtggaggactatggtttcgggatcttcaccaccaacatctggctgaagctccgggacagctacactcagatgtgcgaccaccgcctgatgtctgcggctatcaaggacagcaaggccgtccatgccgacatggggtactggatagagtcggagaagaacgagacctggaagctggctagagcatcgttcattgaggtaaaaacgtgcatatggcccaagtcccacaccctctggagcaacggcgtgttggagtccgagatgattatccccaagatctacgggggcccgattagccagcacaactaccgccccgggtactttacgcagaccgccggcccttggcacctggggaaactcgagctagacttcgacctctgcgagggaaccaccgtcgtggtggatgagcactgcggcaacagagggccctccctgcgcacgaccaccgtcaccggtaagatcatccacgaatggtgctgtcggagctgcacgctgccgccgctgcgtttcaggggcgaggatggctgctggtacgggatggagattcgccccgtgaaggagaaagaggaaaacctagtgcggtccatggtctccgccggcagcggcgaggtggattccttcagccttgggatactgtgcgtgtccatcatgatcgaagaggtcatgcgctctcggtggaaccgcaagatgctcatgaccggcaccctggccgtattcctgttactgatcatggggcagctgacgtggaatgacctcatccgcctgtgcatcatggtgggcgccaatgcgtccgaccggatggggatgggcacgacctacctggccctcatggccaccttcaaaatgcgccctatgtttgcagtcggcctgctgttcaggcgtctaacctctcgcgaggtgctactgctcacgatcggcctgtccctggtggccagcgtagagctcccaaactccctggaggagttaggcgatgggctagcgatgggcatcatgatgctgaagctgctcacggaatttcagccccatcagctgtggaccaccctgctcagcctgacgttcatcaagaccaccctgtccctcgactacgcctggcgaaccatggccatggttctgagcatcgtctccctgttccccctctgcctgagcacgacctcccagaagaccacatggctgccggtgttactgggcagcttcgggtgcaagcccctgacgatgttcctcatcaccgagaacaagatctggggccggaagtcctggcccctgaatgaaggcatcatggctatcggcatcgtgtcgatcctgctctccagcctgctaaagaacgacgtccccctcgcggggccgctgatcgcgggtggaatgcttattgcatgctacgtgattagcgggtccagcgccgacttgtctttggagaaggccgcggaggtgagctgggaagaggaggccgagcattccggcaccagccataacatcctggtcgaggtgcaggacgacgggaccatgaagataaaggacgaggagcgcgacgacacgctcacgatcctgctgaaggccaccctccttgccgtgagtggcgtctaccccatgagcattcccgctactctgttcgtgtggtacttctggcaaaagaagaagcagcggagcggggtgctctgggacaccccctctccgcccgaggtcgagcgcgcggtgctggacgacggcatataccggatcctgcaacgcggactgctcggacggtcccaggtcggagtcggggtgttccaggacggcgtgttccacacgatgtggcacgtcacccgaggcgccgtgctgatgtaccagggcaagcggctggagcctagctgggcttccgtgaaaaaagacctcataagctacggggggggctggcgcttccagggctcctggaacaccggcgaggaggtacaggtgatcgccgtggagccggggaagaaccctaagaacgtccagaccacccccggcaccttcaagacaccagagggcgaggttggggccatcgcgctggacttcaagcccggaacgagcggttcgccgatcgtcaatcgtgagggcaagatcgtctctctgtacggcaacggtgtggttacgaccagtggcacctacgtgagcgccatcgcccaggccaagacaagccaggaagggcccctacccgaaatcgaggacgaggtgttcaagaaacgcaacctgacgatcatggacctgcacccgggctccgggaaaacccggcgctacctccccgccatcgtgcgggaggcaatcaagagaaagctgcgcaccctgatcctggcacccacccgggtcgtggccagcgaaatggccgaggcgttaaagggcatgcccatacggtatcagacgaccgcagtcaagtccgagcacaccgggcgggagatcgtcgacctgatgtgccacgccaccttcacgatgcgattgctgagtccggtccgcgtgcccaactacaacatgattatcatggacgaggcgcactttaccgaccctgcgtccattgcggcccgcgggtacatcagtacccgtgtcggcatgggggaggccgcggccatcttcatgaccgctacgcccccgggctccgtagaggcgttcccccaaagcaacgccgtgatccaagacgaggagcgcgacatcccggagcggtcctggaacagcgggtacgactggatcactgacttccccggcaagaccgtctggttcgtgccgtcgatcaagagcgggaacgatatcgccaactgcctgcgcaagaacggaaaacgggttatacagctctcccgtaagaccttcgacacggagtatcagaagaccaagaacaacgactgggattacgttgtgaccaccgatatcagcgagatgggcgccaacttccgggcggacagggtgatcgatcctcggcgctgccttaagcccgtcattctgaaggacgggcccgagcgcgtgatccttgccggcccgatgcccgtgacggtcgcctccgccgcgcagcgccgggggcgcatcgggcgcaaccagaataaggagggcgaccagtacgtctacatggggcaaccgttaaacaatgacgaggaccacgcccactggacggaggcgaagatgttactcgacaatataaatacacccgagggcatcatcccggccctgttcgaacccgagcgggagaaatccgccgcgatcgacggggagtaccgcctgcggggcgaggcccgcaagaccttcgtcgagctaatgcggcgcggggatctgccagtgtggctgtcctacaaggtggcctcggagggcttccagtactcggaccggcgctggtgcttcgacggcgagcgcaacaatcaggtgctcgaggagaacatggacgtggagatttggacaaaggagggggagcgcaagaagcttcggccccgctggctggatgcccgaacctacagcgacccgctcgccctgcgcgagtttaaggagttcgcggccggccggcgctccgtgtccggagacctgatcctcgaaatcggaaagctcccccaacacttgactctccgtgcccagaacgctctggataacctggttatgctccataatagcgagcagggcggtaaggcctatcggcacgcgatggaggagctgcccgacaccatcgagaccctgatgctcctggcactaatcgccgtgctcacggggggcgtgaccttgttcttcctgtccggcaagggactcggcaagaccagcatcgggctgctatgcgtcatggccagttcggcgctcctgtggatggccaatgtggagcctcactggatcgccgcctccatcatccttgagttctttctcatggtgctgctgatcccggagcccgaccggcagcgcacgccccaagacaaccagctcgcctacgtcgtgatagggctgctgttcatgatcctcacggtggcggccaacgagatgggcctgctggagacaaccaagaaggacctcgggatcggccatgtcgccgcggagaaccaacaccacgccacgatgctggacgttgacctgaggccagcgagcgcctggacgctctacgccgtggccaccacagtcatcacccccatgatgcgccacaccatcgagaacaccaccgccaacatcagtctgaccgcgatcgccaatcaggctgctatcctgatggggctcgacaagggctggcccatcagcaagatggacattggcgtgccactgctggccctaggatgctactctcaggtgaacccgctgacgctgacggcggccgtcctaatgctggtggcccactacgcaatcatcggaccggggcttcaagcgaaggccactcgcgaggcccagaagcggaccgccgccggtatcatgaagaaccccaccgtggacgggattgtcgcgatcgacttagaccccgtggtgtacgacgccaagttcgagaaacagctggggcagataatgctgctcatcctatgcacgtcgcaaatcctgctcatgcgcaccacgtgggctctgtgcgaatccataacgctagccactggcccactcaccaccctgtgggagggcagccccggcaagttctggaacacaaccatcgccgtgagtatggcgaacattttccgggggagttacctggccggcgccggcctcgccttctccctgatgaaatccctagggggcggtcgacgggggaccggggcccaaggcgaaaccctcggcgagaaatggaagcgccagctgaaccagctgtccaaaagcgagttcaatacgtacaagcggagcgggatcatggaggtggaccgctccgaagctaaggagggcttgaagcgcggtgagaccaccaaacatgccgtcagccgcggcaccgctaagctgcgttggttcgtcgagcggaacctagtaaagcccgagggtaaggtcatcgacttaggctgcggacgcggcgggtggtcctactattgcgccggtctcaagaaggtcacggaggtgaaggggtacaccaagggcgggcccggccacgaagagccgatccccatggcgacctacgggtggaacttggtgaagctgtacagcggaaaggacgtcttcttcacgccccccgagaagtgtgataccctcctgtgcgacatcggcgagtccagcccgaatcccacaatcgaggagggccgcaccctgcgggtactcaagatggtggagccctggctacgcgggaaccagttctgcattaaaatcctgaacccctatatgccgtccgtcgtggagaccctggagcagatgcagcggaagcatgggggcatgctggtccgcaacccactgagccgaaattccacccacgagatgtactgggtgtcttgcggcacgggcaacatcgtatccgccgtgaacatgaccagccgcatgcttctgaaccggttcaccatggcgcaccggaagccgacctatgagcgcgacgtcgacctgggggccggcacacggcacgtggccgtggagcccgaggttgcgaacctcgacattatcggtcagcgtatcgaaaatatcaagaacgagcacaaatccacctggcactacgacgaggacaacccttacaagacctgggcctaccatgggagctacgaggtgaagccctccggcagcgcctccagcatggtgaatggggtcgtgcggttactgaccaagccctgggacgtcattcccatggtgacgcagatcgccatgaccgacaccacccctttcggccagcagcgcgtgttcaaggaaaaagtcgacacccggacgccacgggccaagagggggaccgcgcagattatggaggtgacggccaagtggctctggggcttcctgtcccgcaacaaaaaaccgcgcatctgcacacgcgaggagttcacccggaaggtgcgcagcaacgcggccatcggggccgtcttcgtcgatgagaaccaatggaactctgctaaggaggccgtggaagacgagcgcttctgggacctggtctaccgcgagcgggagttacacaagcaggggaagtgcgcgacttgcgtgtacaacatgatgggcaagcgcgagaaaaagctgggagagttcggaaaggccaaggggagccgggcgatctggtacatgtggctgggcgcccggttcctcgagttcgaggccctgggctttatgaacgaggatcattggttcagccgggagaactcctttagcggggtagagggagaggggctgcacaagctcggctacatcctgagagacatctccaagattcccgggggcaacatgtacgcggacgacaccgccggctgggatacgagaatcaccgaggacgacctgcagaacgaggcgaagatcaccgacatcatggagcccgagcacgctctactggccacaagcatcttcaaactgacgtaccagaacaaggtggtgcgggttcaacgcccagccaaaaacgggaccgtcatggacgtgatctcccgtcgagaccagcggggatctggccaggtgggtacctacggcctcaacaccttcacgaatatggaggtacagctcattcgccaaatggaatctgagggcatcttcctccccagcgagctcgagaccccgaacctggccgagcgagtcctggactggctcgaaaagcacggcactgagcgcctcaagcgtatggccatctccggggacgactgcgtggtcaaacccgtggacgaccgcttcgcgaccgctctgatcgccctcaacgacatgggcaaggtgcggaaagacatcccccagtgggagccatcaaagggctggaatgactggcagcaggtcccgttttgttcccaccactttcaccagttaattatgaaggacggccgcgagatcgtggtgccctgccggaaccaggacgaactggtggggcgcgcccgggtgagccagggcgcgggctggtccttgcgagagacggcctgcctgggtaaaagctacgcccagatgtggcagctgatgtacttccacaggcgcgacttacggctggccgccaacgcgatctgctccgccgtgcccgtcgattgggtgcccaccagccgcaccacctggagcatccatgcacaccaccagtggatgaccaccgaggacatgctgtccgtttggaaccgcgtctggatagaggagaacccttggatggaagacaagacccacgtgagctcgtgggaggaggtgccgtacctcggcaagcgggaggaccagtggtgtgggtcgctgatcggcctgaccgcccgcgcgacctgggcaactaacatccaggtcgccattaaccaggtgcggcgcctcatcggcaatgagaactacctggactacatgacatccatgaagcggttcaagaacgagagcgaccccgagggagcactctggtga

SEQ ID NO: 23983 - RNA, 9879 nt, synthetic construct
  misc_feature 1..9879: note = derived and/or modified CDS sequence (opt11) from DENV-1__KJ189350__SS-prME
  source 1..9879: mol_type = other RNA
agcgtgaccatgctgctcatgctgctgcccaccgccctcgcctttcatctgactacccgcggcggggagccgcatatgatagtctccaagcaggaacggggcaagagcctgttgttcaagacctccgcgggggtgaacatgtgcaccctcatcgccatggaccttggcgagctctgcgaggacacgatgacctataagtgcccccgcatcaccgaggccgagcccgacgacgtggactgctggtgcaacgccaccgatacgtgggtcacctacgggacttgcagccagaacggcgagcaccggcgcgagaagagatccgtggccctggcgccccacgtgggcctcgggctcgagactcgcacggaaacctggatgagctccgaaggcgcctggaagcagatccagcgggtcgaaacctgggccctgcgccacccgggctttaccgtgatcgccttcttcctggcgcacgccattggcacgagcatcactcagaaggggatcatattcatcctcctgatgctggtgactccctccatggccatgcggtgcgtcggcatcggtaaccgcgactttgtggaggggctcagcggcgctacctgggtggacgtcgtgctggagcacggctcctgcgtgacgaccatggccaagaacaagcccaccttggacatcgagctcctgaagaccgaggtcacgaaccctgcggtgctgcggaagctctgcatcgaggccaagattagtaacacaaccaccgactcccgctgcccgacacagggcgaggctaccctggtggaggagcaggacgccaacttcgtctgccggcgcaccttcgtggaccgggggtgggggaacggctgtgggcttttcggcaaggggagcctcttgacgtgcgccaagttcaagtgcgtgacgaagctggagggcaagatagtccagtacgaaaatctcaagtactccgttatcgtgacagtacacaccggcgaccagcaccaggtgggtaacgagaccacggagcacggcaccatcgcgaccatcacgccccaggcccctaccagcgagatccagctgaccgactacggggccctgacgctcgactgttctccccgcaccggcctggatttcaacgagatggtcctgctaaccatgaaggagaagagttggctggtgcacaagcaatggttcctggacttaccgctgccctggacgagcggggctagcaccagccaggagacctggaaccggcaggacctgctcgtgaccttcaagacggcccacgcgaagaagcaggaggtcgtggtgctgggctcccaggagggcgccatgcacaccgcccttacaggggccaccgagatccagacgagtggcaccaccacaatcttcgccggccacctcaagtgccgcctgaagatggacaaacttacgctcaagggcatgtcctacgtgatgtgcaccgggagcttcaagctggaaaaggaggtggcggaaacccagcacggcacagttctggtccaggtgaagtacgaggggacggacgccccctgcaagatccccttctccacccaggacgagaagggggtgacccagaacggtcggctgatcaccgccaatccgatcgtcacggacaaggagaagcccgtgaacatcgagaccgagccacccttcggggagagctacatagtggtaggcgccggggagaaggccctcaagctctcctggttcaaacgcgggtcttccatcggcaagatgttcgaggccaccgctcggggagcccgccgcatggccatcctgggcgacaccgcctgggacttcgggagcattggcggtgtgttcacgtccgttgggaagctcgttcaccagatcttcggcaccgcatacggcgtgctgttcagcggcgtgtcctggaccatgaagatcgggatcggcatcctgctcacctggctggggctgaacagccggtccacgagcttgtccatgacatgcatcgctgtcggaatggtgaccttatacctcggagtgatggtccaggccgatagcgggtgcgttataaactggaagggacgcgagctcaagtgcgggtccggcatcttcgtgactaacgaggtccacacctggactgagcagtacaagttccaggccgacagccctaagcggctgagcgcggccatcggcaaggcctgggaggagggggtgtgcggcatccgctccgccacccggctggagaacatcatgtggaagcagatctcaaacgaactcaaccacatcctactggagaatgacatgaagttcaccgttgtagtgggggacgctaatggtatcctcgcgcaggggaagaaaatgattcgcccccagcccatggagcacaagtactcctggaaaagctggggtaaggccaagatcatcggcgccgacatccagaacaccacgttcatcatcgacgggcccgacaccccggagtgccccgacggccagcgggcctggaacatatgggaggtagaggactacgggttcggcgtattcaccaccaacatctggttaaagttacgcgacagttacacgcagatgtgcgatcaccggctgatgagcgcggccatcaaggactcaaaggccgtgcacgcagacatgggctactggattgagagcgaaaagaacgagacctggaagctggcccgcgcgtccttcatcgaggtgaagacctgcacctggcccaaaagccacacgctgtggtccaacggggtcctcgagagcgagatgataatccccaagatctatggagggcccatatcccagcataactatcggcccggctacttcacccagactgccgggccctggcatctaggaaagctggagttagactttgacctgtgcgagggcacaacagtggttgtcgacgagcactgcggcaatcgcggccctagcctgcggaccaccaccgtgacgggtaagatcatccacgagtggtgctgccgctcctgcaccctaccaccccttcggttccgcggcgaggacgggtgctggtacggcatggagatcaggcccgtgaaggaaaaggaggagaacctggtccgcagcatggtgtccgccgggagcggggaggtggatagcttctctctcggcatcctgtgtgttagcatcatgatcgaagaggtgatgcgctcccgatggtctagaaagatgctgatgaccgggaccctcgccgtgttccttctgctcatcatgggccagctgacgtggaacgacctgatcaggctctgcatcatggtgggagccaatgcctctgaccgcatgggaatgggcaccacctacctggcccttatggccacctttaagatgcggccaatgttcgccgtggggctcttattccgtcggctgacgagccgcgaggttctcctgctaacgatcggcctctcgctggtcgcgagcgtggagctacccaactccctcgaggagctgggggacggcctggcgatgggcatcatgatgctcaagctgttaaccgagttccagccccaccagctctggaccactctactgagcctcaccttcgtcaagaccaccctgtccctggactacgcctggaagacgaccgccatggccctgagcatcgtttccctgttccccctgtgcctcagcaccacctcacagaagacgacctggctgccggtgctcctcgggtcgttcggctgcaagcccctgaccatgttcctgatcaccgagaacaagatctgggggcggaagtcctggcccctcaatgagggcatcatggctatagggatcgtcagcatcttgctgtccagcctcctgaagaacgacgtccctctcgccggcccgctaatcgccggcgggatgctgatcgcctgctacgtgataagcggctccagcgccgacctgtccctcgagaaggcggccgaggtcagctgggagcaggaggccgagcactccggggcaagccatagcatcctggtggaggtgcaggacgatggcaccatgaaaatcaaagacgaggagcgcgacgacacactgaccatcctcctgaaagccaccctgctcgcggtcagcggggtgtaccccatgagtatacccgccacgctgttcgtgtggtacttctggcaaaagaagaagcagcggagcggcgtcctgtgggacacgcctagccctccagaggtagaacgcgccgtgctcgacaatggcatctaccgaatcctgcagcgcggactgctaggcaggagccaggtcggggtgggcgtgttccaggacggggtcttccacaccatgtggcacgtgacacggggcgctgtgctcatgtatcagggcaaaaggctggagccctcctgggctagcgtaaagaaggacctgatctcctacgggggcgggtggcggttccagggcagctggaacaccggggaggaggtacaggtgattgcggtcgagcccggcaagaacccgaaaaacgtgcagacgactcccggcaccttcaagacccccgagggggaggtcggcgccatcgcgctcgacttcaagccggggacgagtggcagcccgatcgtaaaccgggagggcaagatcgtggggctgtacggaaacggggtggtcaccacctccggcacctacgtgtcggccatcgcccaggccaaggcgagccaggaggggcccctgcccgagatcgaggacgaggtgttcaagaagcgtaacctcacgatcatggacctgcacccgggctccgggaagacacggcgctacctgcccgccatcgtccgggaggccatcaagcgcaagctccgcaccctgatactggcgcccacccgggtggtcgccagcgagatggccgaggcactcaaggggatgcccatccgctaccagacgaccgccgtcaagtccgagcacaccggccgggagatcgtcgacctgatgtgccacgcgacctttacgatgcgcctgctcagcccggtgagagttcccaactacaacatgatcatcatggacgaggctcacttcaccgaccccgcctccatcgccgcccgcgggtacattagtacccgggtgggcatgggtgaggcggccgccatattcatgaccgccactcccccgggctccgtggaggccttcccccagtctaacgcggtcatccaggatgaggagcgcgacatccccgagcggtcctggaacagcggctacgactggatcaccgacttcccggggaagaccgtgtggttcgtgccctccatcaagagcggtaacgacatagccaactgcctgcgcaagaacgggaagcgggtgatacagctgtcccgcaagaccttcgacacggaataccagaagacaaagaacaatgactgggactatgtggtgacaaccgacatcagcgagatgggcgccaacttccgggccgaccgcgtcatcgacccgcggcgctgcctcaagcccgtgatcctgaaggatgggcccgagcgggtgattctggcgggccctatgcccgtgacagccgcctccgccgcccagcgtcgggggagaatcgggcgcaaccagaacaaggagggcgaccagtacgtgtacatggggcagcccctcaataacgacgaggaccacgcgcactggaccgaggcaaagatgctgctggacaatatcaacaccccggaaggcatcattcctgccctctttgagcccgagcgagagaaaagcgcagccattgacggggagtatcgcctgcgtggagaagcgcgcaaaactttcgtcgagctgatgcggcgcggggacctccccgtgtggttatcctacaaggtggcctccgaggggttccagtactccgatcggcgttggtgctttgacggcgagcggaacaaccaggtcctggaggagaacatggacgtggagatctggacgaaagagggggagcgcaagaagctccggccccgctggcttgatgcccgcacctactcagacccgcttgcccttcgcgagttcaaggagttcgccgcgggccgtcgcagcgtgtccggcgacctaatcctggagatcgggaagctcccccagcacctgaccctgcgggcccagaacgccctcgataatctggtcatgctgcacaacagcgagcagggcgggaaggcctaccgccacgcgatggaggagctccccgacaccatagagaccctgatgctgctcgccctgatcgccgtcctgacgggaggggtgaccttattcttcctaagcgggaagggcctggggaagactagcatcggtctcctttgcgtcaccgcctccagcgcactgctctggatggcgtccgtggagccacactggatcgccgccagcatcatcctggagttcttcctgatggtcctcctgatccctgagcccgatcggcagaggactccccaggacaaccagctggcctacgtcgtgatcggcctcctgtttatgatcctgaccgtggccgccaatgagatgggcctcctggagaccacaaagaaagacctggggatcggctacgttgccgccgagaaccaccagcacgcaaccatgctcgatgtggacctgcaccccgcttcggcgtggaccctgtacgccgtggccaccaccgtcataacgcccatgatgcggcacaccatcgaaaacaccactgccaatatcagcctcacagccatcgcgaaccaggctgccatcctgatgggcctggataaggggtggcccatctcaaagatggacatcggcgtgcccctcctggccctagggtgttacagccaggtgaacccgcttaccctgaccgcggccgtcctgatgctcgtcgctcactacgccatcataggccccgggctgcaggccaaggcgacccgcgaggcccaaaagcgcacggccgcaggcattatgaagaaccccaccgttgacggcatcgtcgccatcgacttagaccccgtggtgtacgacgcgaagttcgagaagcagctcgggcaaatcatgcttctgatcctctgcaccagccagatcctgctgatgcggaccacgtgggccctgtgcgagagcatcaccctggccaccggcccgctgaccacgctctgggaggggtcccccggcaagttctggaacaccaccatagccgtcagcatggccaacatcttccgcggcagctacctggcgggggccggcctggcattctccctcatgaagtctctgggcggcgggcggcgaggcaccggcgcccaaggggagacgctgggcgagaagtggaaacggcagctcaaccagctgagcaagagcgagttcaacacctacaagcgttccgggatcatggaggtagaccggagcgaggcaaaggaaggcctgaagcgaggggaaaccaccaagcacgctgtttcccggggcacggccaaactccgctggttcgtagaacggaatctggtgaagccagaaggcaaggtgatcgacctggggtgcggtcggggtggatggagctactactgtgctgggctgaaaaaggtcactgaggtcaaaggctacaccaagggcgggcccggccacgaggagccgattccgatggcaacctacgggtggaacctcgtgaagctgcactccggaaaggacgtgttctttatgccacccgaaaagtgcgacaccctgctctgcgacatcggggagtcatccccgaaccccacgatagaggagggaagaaccttgagagtgctgaagatggtggagccctggctcagaggcaaccagttctgcatcaagatcctgaacccctacatgccaagcgttgtcgagacactggagcgcatgcagcggaagcacgggggcatgttagtgcgcaaccccttatccagaaacagcacccacgagatgtactgggtctcctgcggcaccggcaatatcgtaagcgcggtaaacatgacctcccgcatgctgcttaaccgcttcactatggcccaccggaagcccacctacgagcgcgacgtcgacctgggggccgggacgcggcacgtggccgtggagcccgaggtcgccaacctggacataatcggccagcgcatagaaaatatcaagaacgagcacaagtctacctggcattacgacgaggacaacccttacaagacctgggcgtaccacgggagctatgaggtgaagcctagcggctccgctagctcaatggtgaacggggtagtgcggctcctgaccaagccctgggacgtcatcccgatggtgacccagatagccatgaccgataccaccccgttcggccagcagcgcgtgttcaaggagaaggtagacacgcggacaccccgcgccaagcggggcaccactcagatcatggaggtgacggccaaatggctgtggggctttctcagccgcaacaagaaaccccggatctgcacccgggaggagttcacccggaaggtgaggagcaacgctgcgatcggcgccgtcttcgtggacgagaaccagtggaactccgccaaggaggcagtggaggacgagcggttctgggacctggtccaccgcgagcgggagctgcacaagcaggggaagtgcgcaacctgcgtgtacaatatgatggggaagcgcgagaagaagctcggggagttcggcaaggccaagggatcacgggccatctggtacatgtggctgggagcccgcttcctggagttcgaggccctcgggttcatgaacgaagaccactggttctcccgggagaacagcctgtccggcgtcgagggagaggggctgcacaagctcggctacatcctgcgcgacatcagcaagatcccgggcggaaacatgtacgccgatgacactgccggctgggacacccgcgtcaccgaggacgacctgcagaacgaggccaagatcacagacatcatggagccagaacacgcgctcctggcgacgtccatcttcaagctgacctaccagaacaaggtggtgcgggtccaacgaccagccaagaacgggaccgtaatggacgtgatcagccggcgcgaccagcggggcagtggccaggtcgggacctacggcctcaacacgtttaccaacatggaggtccagctgattcgccagatggagagcgaggggatcttcctgccctccgagctcgagaccccgaacctcgcagagcgggccttggactggctcgagaagcacggggccgaacgtctgaagcggatggcgatcagcggggacgactgcgtggtcaagcctattgacgaccgcttcgccaccgccctgacggccctcaatgacatgggcaaggtgcggaaggacataccccaatgggaaccctccaagggttggaacgactggcaacaggtgccgttttgctcccaccacttccatcagctgatcatgaaggacggccgcgagattgtcgtgccctgccggaaccaggacgagctggtgggccgagctcgggtctcccagggggccggatggagccttcgcgagaccgcgtgcctggggaagtcctacgcacagatgtggcagctgatgtacttccaccggcgcgatctccgtctggccgcgaacgcaatctgcagcgcggtgcctgtcgactgggtccccaccagccgcaccacctggtccattcatgcccaccaccagtggatgacgacagaagacatgctgagcgtttggaaccgcgtatggatcgaagagaacccgtggatggagaacaaaacccacgtgtccagctgggaggaggtgccctatctcgggaagcgagaagaccagtggtgtggctcactgatcgggttgaccgctcgggccacgtgggccaccaacatccaggtggccataaaccaggtccggcgcctaatcggcaacgagaactatctggactatatgaccagcatgaagcggttcaagaacgagtctgacagcgagggggccctgtggtga

SEQ ID NO: 23984 - RNA, 9879 nt, synthetic construct
  misc_feature 1..9879: note = derived and/or modified CDS sequence (opt11) from DENV-1__KJ189351__SS-prME
  source 1..9879: mol_type = other RNA
agtgttaccatgcttctgatgctactgccaacagtactggctttccacctcaccacccgcggcggggaaccgcatatgatagtttcaaaacaagaaaggggcaaatccctcctatttaaaaccagtgctggagtaaacatgtgtacactcatagcgatggacctcggagaactttgcgaagacacgatgacatacaaatgcccccggatcacagaagcggaacctgacgacgtggactgctggtgcaacgccaccgacacatgggtgacgtacggtacgtgttcgcaaacaggcgaacaccggcgagagaagcgttccgtagccttagctccccacgtgggcctgggcctagaaacaaggacagaaacctggatgtcctcggagggggcctggaaacaaatacaacgggtcgagacatgggcgctgagacaccccggcttcaccgtaatagcattcttcttagcgcacgcaatagggacatccataacgcaaaagggaataatatttatactcctgatgcttgtaaccccatcaatggcaatgcgatgcgtagggattggtaaccgcgacttcgtggaaggcctgagcggcgcgacctgggtggacgtcgtactcgaacatggatcctgtgtgacgactatggcgaaaaacaaaccgacactagacatcgaactactcaaaaccgaggtcacaaacccggctgtattaagaaaactctgcatagaagccaagatatcaaatactaccacggactcgcggtgtccgacacaaggagaagcaaccctggtcgaggagcaagacgccaacttcgtgtgcaggcgaacatttgtcgaccgaggctggggcaacggatgtggactctttggaaaaggctccctgctaacgtgcgcaaagtttaagtgcgtcaccaaattggaaggtaaaattgtccagtacgagaacctcaaatactcagtgattgtcactgtacacaccggagatcaacatcaagtaggaaatgagaccacagagcatgggacgatagcaacgatcacgccccaggcgccgacctccgagatacaactcacggactatggggcactgacgctggattgctcgccacgaaccggcttagactttaacgagatggtcctgctaaccatgaaagagaaaagctggctagtacataaacaatggttcctagacctcccactgccatggactcccggcgcgtcaacaagtcaggagacctggaatcgtcaggaccttctagtgacatttaaaaccgcgcacgccaagaaacaagaagtcgtggttttaggatcccaagaaggagccatgcacacggcactcacaggggccaccgagatacaaacatcggggacaaccactatcttcgccggtcacctgaaatgtcgtctcaagatggacaagctcacccttaagggaatgagctacgtaatgtgcacgggatcatttaaactggaaaaagaggtcgcggaaacccaacatggtacagtgctcgtccaggtaaaatacgaaggcaccgacgcaccgtgcaagatccctttcagcacgcaggacgagaaaggtgtaacccagaatgggcgcttgataaccgcaaatcccattgtcacggacaaggaaaaaccagtcaacatcgaaacagagccgccgttcggtgagtcctacatagtagtcggcgctggagagaaggccctcaagctcagttggttcaagaggggatcttcaatagggaaaatgttcgaggcaacggcgcggggcgcccggcgtatggccatactaggggataccgcatgggacttcggctccatcggcggggtattcaccagcgttggcaagctggtgcaccaagttttcggaacagcgtacggggtcctattcagcggcgtgtcctggactatgaaaataggcattggaatactacttacatggctaggcctgaactcccgttccacatcactctcgatgacgtgcatagccgttggtatggtaaccctctatctaggtgttatggtacaggccgactcagggtgtgtaatcaactggaaagggcgcgagctaaaatgcggcagcggaatcttcgtcacaaatgaagtccacacctggaccgaacaatacaagttccaggcggacagcccgaaacggctaagcgccgcgataggtaaagcctgggaagagggcgtgtgtgggatacggtcggctacacggctagaaaacataatgtggaaacagatcagcaacgaactcaaccacatcctcctagaaaacgatatgaagttcacggtggtagtaggtgacgcaaacggaatcctagcccagggtaaaaagatgatccgaccccagccgatggagcacaaatacagttggaaaagctgggggaaagcgaagattataggagctgacatccaaaacacgacattcattatcgacggccccgacacgccagaatgccccgacggccaacgcgcatggaacatttgggaggtagaggactacggattcggtgtgttcacaaccaacatctggctcaaattacgagactcttacacacagatgtgcgaccaccggttgatgtcagctgccattaaggactcgaaggccgttcacgccgatatgggatactggatagaatcagagaaaaatgagacatggaagctggcaagagcgtcctttatcgaagtaaagacttgtacctggccaaaaagtcacacactttggagtaatggggtgctagagagcgaaatgatcatccccaaaatatatggaggaccgatcagtcagcacaactaccgtccgggctacttcacgcaaacggccgggccttggcacctaggcaaactcgaactggatttcgacctatgcgaaggaacgacggttgtagtggacgaacactgcggtaaccgaggcccgagccttcggacgactacggtcactggtaaaataatccacgaatggtgttgccgttcctgcactctgccacccctgagattcaggggagaagatggatgttggtatggaatggaaataaggccagtaaaagaaaaggaagagaatctagtccggtcaatggtaagcgctggcagcggcgaagtcgattccttctccttgggcatactatgtgtgtccataatgatagaagaagtaatgagaagccgctggagtcgcaaaatgttaatgactggaaccctcgccgtcttcctgctgcttatcatgggacagctaacgtggaacgacctgactaggctgtgcatcatggtgggagccaacgcgtccgatcgcatgggaatggggaccacgtacttagcactcatggcgaccttcaaaatgcgcccaatgttcgccgtaggcctcctcttcagacggctcacttcgcgggaagtgctactactcaccataggcttgagcttagtagcgtcggtagaactaccaaattcactcgaagaactaggcgacggattggcgatgggcataatgatgctgaagctgctgacggagttccaaccccaccagctgtggacaactctattgtcactaacattcgtcaaaacaactctctcgctagactacgcgtggaaaaccaccgcgatggcacttagcatagtatccttattccccctctgcctgagcacgacgtcacagaaaacgacatggttacctgttctacttggatccttcgggtgcaaaccacttacgatgtttctcatagcagaaaaccgaatatggggtcgcaaatcatggccattaaatgaaggaatcatggccataggcatagtaagcatactgcttagctccctcctcaaaaacgacgtaccattagccggacctctgatcgcgggaggcatgctaatcgcctgctacgtaatatcagggtccagcgcggatctgtcccttgagaaagccgcggaggtctcctgggaacaagaggcggagcacagcggcgcatcacatagcattctagtagaagtgcaagacgacggtaccatgaaaatcaaggatgaagaacgagacgacacgctcacaattctactcaaagcaaccctactcgccgtgtcgggggtgtaccctatgagtatacctgcaacgctgttcgtgtggtacttctggcagaaaaagaaacagcgatcgggcgtgctgtgggacacccctagcccaccagaggtggagcgtgccgtcctcgacaacgggatctacagaatcctgcaacgaggcttattaggcaggagccaagtgggggttggagtatttcaagacggggttttccacacaatgtggcatgttacgcgcggcgcggtgctgatgtaccaaggaaaaagactagaacccagctgggcttcggtcaagaaagacctaatttcttatggcggaggctggcgcttccaaggatcgtggaacacgggcgaagaggtccaagtaatagccgtagaaccaggcaaaaaccccaaaaacgtccaaaccactccaggcacctttaagaccccagagggagaagttggagcaatagccttagactttaaacccggcaccagcgggagtcccatcgttaaccgcgagggaaagattgtcggactatacggaaacggggttgtcaccacgtctggcacgtatgtctccgcaattgcccaagcgaaggcaagccaagaagggccgctcccagaaatcgaagacgaagtgttcaagaaacggaatctgacaataatggacttacatcccggaagcggtaaaacgcgccgctaccttccagccatagtccgggaggcgatcaaacgaaaacttagaaccttaatcttggctcccacacgagtggtagcctcagagatggccgaggcacttaaaggcatgcctatccgctaccagacaacggcagtaaaaagcgaacacacaggcagggaaatagtagacttaatgtgccacgccacctttacaatgagactgctgtcccccgtccgggtgcccaactacaatatgattatcatggacgaagcgcacttcaccgaccccgccagtatagccgccagagggtacatatccacgagagtcggcatgggggaagcagccgcaatctttatgacggcaacacccccgggttcagtcgaggcattcccgcaaagcaacgcggtaattcaagacgaagaaagagacattccagagcggagttggaacagtggatatgattggattacggactttcccggcaaaacagtctggttcgtaccatcgataaaaagcggaaacgatatcgcaaactgcctacggaaaaacggaaaaagagtgatacagctctccaggaagaccttcgacactgaatatcagaaaactaagaacaacgactgggattacgtagttacaaccgacatctccgaaatgggggccaacttccgagccgaccgcgtaatcgacccgcgacgatgcctgaagccagtgatactgaaagacggaccagaaagggtcatactggcgggacctatgccggtaacagtggcgagcgccgcgcagaggcggggacgcataggcagaaaccaaaataaagaaggagaccagtacgtctacatgggccaaccactgaacaacgatgaagatcacgcccactggacagaagcaaagatgctcctggacaatatcaatacacccgaaggtataataccagccttgttcgagccagaaagagagaaaagcgccgcaattgacggggaatatcgtttgcgcggtgaagctagaaagacattcgtcgagttaatgagacggggtgaccttccagtgtggctcagctacaaagtcgcttccgaaggattccaatactccgacaggcgctggtgctttgacggagaacgcaacaaccaggttctcgaggaaaacatggatgtcgaaatttggacaaaggaaggagaaaggaagaaactacgcccaagatggctagatgcccggacctactcagacccgctagcacttcgggagtttaaagagttcgcggcggggcgtcgctcggtctcaggcgatctcatccttgaaatcgggaagttaccacagcatttgactctccgggcacaaaacgctctcgataacctagtgatgttacataacagcgaacaagggggaaaagcctaccggcacgccatggaagagttgccagatacgatagaaaccctgatgttactagcactaatcgcggttctcacgggaggcgtaacacttttctttctatcaggaaagggacttggcaagacatcaataggactactatgcgtgaccgcgagttcggctctcctctggatggcctcagtcgaaccccactggatagccgcttcgatcatcctagagttcttcctcatggtactgctcatcccagaacccgatcgccaacgaacaccgcaggataaccagcttgcatacgtagttatcggactcctattcatgatactcacagtagccgcaaacgagatgggcctactagaaaccaccaagaaagacctcggaatagggtatgtcgccgccgaaaaccaccaacacgcgacaatgcttgacgtggacttacatcccgcctcagcgtggactttgtacgctgtagcgacgacagtcataacaccaatgatgcgacatactatcgagaatacgacagcgaacataagcctgacggcgatagcgaaccaggcggccatactcatgggactagacaaaggatggcccataagtaaaatggacattggggtacctctcctcgccctaggatgttattctcaagtaaacccgctaacactgacggccgcagtcctaatgctggtcgcacactacgccattatagggcccggtctacaagcaaaggcgactagagaagctcagaaaaggaccgccgctggaatcatgaaaaacccgaccgttgatggtatagtagcgatcgacctcgaccccgtagtgtacgacgcaaagttcgaaaaacaactagggcagatcatgttgctaattctctgtacatcccagatcctcctgatgagaacaacctgggcgctgtgcgaaagcatcacattggctactggccccctaactaccctgtgggaagggtcccctggcaaattctggaataccactatcgcagtaagcatggccaatatatttagaggcagttacctagcgggcgccggccttgccttctccctcatgaagagtctaggcggcggacggcggggcacaggggcacaaggggaaactttaggagaaaagtggaaaaggcaattgaatcaactaagcaaatcagagttcaatatctacaagagatcagggatcatggaagtagatagaagcgaagcaaaagagggattgaagagaggggaaaccaccaagcacgctgtctcccgcggtaccgcgaaactccgatggttcgtcgaaaggaacctagtcaaacccgaaggaaaggtaatagacttgggctgtggacgtggaggatggagctactattgcgcagggctcaagaaagtaacagaagtcaaagggtacacaaaaggcggacccggacatgaggagcccatcccaatggcaacgtatggatggaacctagtgaaactccactcgggcaaggacgtattcttcatgccgccagaaaagtgtgacacgcttctgtgcgacataggagaatccagtccgaatccaacaatcgaggaaggacgaaccctccgagtgttaaaaatggtagaaccatggctgcgagggaaccagttctgcgtgaagattctcaacccgtacatgccatccgttgtagaaaccctggaaaggatgcagcgcaaacatggtggcatgctcgtccgcaaccccctttcccgtaactcaacccacgagatgtattgggtttcatgcggcaccgggaatatagtgtcagccgtcaacatgacttcccggatgctcctaaacagattcactatggcccatcggaagcccacctacgaaagggacgttgacttgggtgcaggaaccagacatgtagcggttgagcctgaggttgctaacctcgacataatagggcagcgaatcgaaaatatcaaaaatgagcataaatccacctggcattatgatgaagacaatccgtataagacatgggcctaccatggatcctacgaagttaaatctagcggctcagctagctccatggtaaacggagtcgtgcgcctgctaaccaagccctgggatgtgataccgatggtcacccaaatagcaatgacagatactacccccttcggccaacaaagagtttttaaggaaaaggtggacactagaacgccacgagcgaaaaggggaaccactcagataatggaggtaacagccaagtggttatgggggttcctgtcgcgaaacaagaaaccacggatatgtacccgggaggagtttacgcgcaaggtacgaagcaacgccgccatcggagcggtctttgtcgacgagaaccaatggaactcggcgaaagaagcagttgaagatgagcgcttctgggacttggtacaccgggagagggaactccacaaacaggggaagtgcgcaacatgcgtatataacatgatgggtaaacgggaaaagaagctgggggaatttgggaaggccaaagggagcagagctatatggtatatgtggctaggcgccagattcttagagttcgaagcacttggcttcatgaacgaagaccactggtttagtcgcgagaactctctctcgggggtggaaggcgaaggcctccacaagctaggatacatactccgtgacatctctaaaatccccggtgggaacatgtacgccgatgacacggcgggatgggacacacgaataactgaagacgaccttcaaaacgaggcgaaaattactgacatcatggaaccagaacacgccctactcgccacgtcaatcttcaaattaacataccaaaacaaagtagtgcgggtccagcgacccgcgaaaaacggcacagtaatggatgtgataagtcgccgcgaccagaggggatcaggccaagtcggaacctacggactgaacaccttcaccaacatggaggtccagctcatccgacaaatggaatccgaaggaatattcctacctagcgaacttgagacaccgaacctggccgaaagagccctcgactggctcgaaaaacacggagcagagcgactcaaacgaatggccatcagcggcgacgactgcgtcgtgaaacccatagatgaccgattcgcgacagccctaacagcactaaacgatatggggaaggtgaggaaagacataccacaatgggaaccatcaaaagggtggaacgactggcagcaggtacccttctgcagtcaccactttcatcaactcatcatgaaagacggacgagaaatcgtagtcccttgtcgcaaccaagacgaattggttggccgggctagagtatcgcagggtgccggatggtcactcagggagactgcatgcctggggaagtcctacgcccagatgtggcaactaatgtacttccaccgaagggacctaaggctcgcagccaacgcaatttgctccgcagtgcccgtagactgggtgccgacgagccgcacaacgtggtcaatacacgcccaccaccaatggatgacgacagaagacatgctctcggtttggaaccgcgtttggatcgaggaaaacccgtggatggaagacaaaacccacgtaagcagttgggaagaagttccttacctaggaaaacgagaagatcaatggtgcggctcgcttattggtctgaccgctcgagcgacctgggcgacgaacattcaggttgccataaaccaagtaagaaggctcataggaaacgaaaactacttagactacatgacgagcatgaaacgcttcaaaaacgaatcagactccgagggagctctctggtag

SEQ ID NO: 23985 - RNA, 9879 nt, synthetic construct
  misc_feature 1..9879: note = derived and/or modified CDS sequence (opt11) from DENV-1__KJ189352__SS-prME
  source 1..9879: mol_type = other RNA
tccgtgacgatgctgctcatgctgctgccgactgccctcgccttccatcttaccacccggggcggtgagccccacatgatcgtgtcaaaacaggagcggggcaagagcctcctgttcaagacttccgccggggtcaacatgtgcaccctgatcgccatggacctgggcgagttatgcgaggacactatgacctataagtgtcccagaatcacagaggccgaacccgacgatgtggactgctggtgcaacgcgacagacacctgggtgacgtatgggacctgctcacaaaccggtgaacaccggcgggagaagcgttccgtggcgttggcgcctcatgtcggcctggggctcgaaacccgaaccgagacctggatgagcagtgagggcgcctggaagcagatacagcgggtcgagacctgggccctgcgccaccccggtttcactgttatcgccttcttccttgcgcacgcgatcggaaccagtatcacgcagaagggcattatcttcatcctcctgatgctggtgaccccctccatggccatgcggtgcgtgggcatcgggaaccgcgacttcgtggaggggctcagcggcgccacgtgggtggatgtcgtgcttgagcacgggtcgtgcgttaccacaatggcgaagaacaagcccacactggacatcgaattactgaagacggaggtcacgaaccccgcggtccttcggaaactgtgcatcgaagccaagatcagcaataccacgacggattcccgctgcccaacccagggcgaggctaccctggtggaggagcaggacgccaatttcgtctgccgtcgcactttcgtggaccggggatgggggaacggctgcggcctgttcggcaaggggtctctcctgacgtgcgccaagttcaagtgcgtgaccaagctggagggaaagattgttcaatacgaaaatctcaaatacagtgtgatcgtgaccgtgcacaccggcgaccagcaccaggtgggaaacgagaccacggagcatggcaccattgcgaccatcactccccaggcacccacgagcgagattcagctgaccgattacggtgcgcttaccctggattgcagcccgcgcacaggcctggacttcaacgagatggtccttctcacgatgaaagagaagtcctggttagtgcacaagcagtggtttctggatctccctttgccctggacctccggcgccagcaccagccaggagacctggaatagacaagacctgctcgtgacgttcaagaccgcccatgcgaagaagcaggaggtcgtcgtactggggagtcaggagggagccatgcataccgcccttaccggggcaacggagatccagacgagtggaaccaccacgatcttcgccggacacttgaagtgcaggctgaagatggacaagctgaccctcaaaggcatgtcctacgtcatgtgtactgggtcattcaagttagagaaggaggtagcggaaacccaacacggcacggtgctggtacaggtgaaatacgagggcacggatgcgccgtgcaagatccctttctctacccaggacgagaagggcgttacgcagaatggccgtctgatcaccgcgaacccgatcgtcaccgacaaggagaagcccgttaacatcgagaccgaacctcccttcggggagagctacatcgtcgttggcgccggcgagaaagcgctcaagttatcctggttcaagcgcgggagctccattggaaagatgttcgaggcaaccgcccgcggggcccgccgcatggccatcctcggtgatactgcgtgggacttcgggagcattgggggggtgttcaccagcgttgggaagctcgttcatcagattttcggcaccgcctatggtgtgctgttcagcggcgtgagttggaccatgaagatcggcatcgggatcctgttgacctggttaggcctgaacagccggtcaaccagccttagcatgacctgcatcgcagtggggatggtgactctgtacctgggcgttatggtccaggctgatagcggctgcgtcatcaactggaagggccgcgagctcaagtgcggatccggcatcttcgtcacgaacgaggtgcacacctggaccgaacagtacaagttccaggcggactcgcctaagcggctgagtgcggccatcggcaaggcttgggaggaaggggtctgcggtatcagatccgccacccgtctggagaatattatgtggcgccagatcagcaacgaactcaatcacatcctgttggagaatgacatgaagtttaccgttgtcgtcggggacgccaacggcatccttgcgcaggggaagaagatgatccgtccccagcctatggagcacaaatattcgtggaagtcctggggcaaagccaaagtgatcggagctgacattcagaacacgaccttcattatcgacgggccagataccccggagtgccccgacggccaacgggcctggaacatctgggaagtggaggactacggctttggagtgtttaccactaacatatggttgaagctgagggactcctacacccagatgtgcgaccaccgcctcatgagcgccgccatcaaggattcgaaggcagtgcacgccgacatgggctactggatagaaagcgagaagaacgagacctggaagctggcccgggctagctttatcgaggtcaaaacctgcacgtggcctaagtcgcacacactgtggtccaacggggtgctcgagtcggagatgatcattccgaagatctacggcgggccgatttcgcagcacaactaccgtccgggctatttcacccaaaccgccgggccctggcatctgggcaagctggagctcgacttcgatttatgcgagggtaccaccgtggtcgtcgacgagcattgtgggaatcggggcccgagcctgagaaccaccaccgtgaccggcaagattatacacgagtggtgctgccgatcctgcacgctcccgcccctgcgcttccggggcgaggacgggtgttggtacggcatggagatccgccccgtcaaggagaaggaggagaacctggtacggtccatggtgtcagcaggcagcggggaggtagatagcttctccctcggaatcttgtgtgtaagcataatgatcgaggaggtaatgcgctcccgctggagtcggaagatgctgatgactggcacactcgccgtcttcctgctgctcataatgggccaactgacttggaacgacctgatccgactctgcatcatggtgggggcgaatgcatccgaccggatgggcatgggcaccacctacctggcgctgatggcaaccttcaagatgcgcccaatgttcgccgtggggctccttttcagacgcttaaccagccgggaggttctcctgttaaccatcggcttaagtttggttgcgagcgtcgagctgcccaactccctagaggaactgggggacggcctggcgatgggcatcatgatgctcaaactgctaaccgagttccaaccacaccaactgtggacgaccctgctaagccttactttcgtgaagaccacgctgtccttagattacgcctggaagactaccgccatggcgctaagcatcgtgtccctgttccctctatgcttgtcgacgacgtcgcagaagaccacgtggctgccggttcttctcgggagcttcggctgcaagcccctgaccatgttcctgatcaccgagaataaaatttgggggcgaaaatcctggcccctcaacgagggcataatggcgatcgggatcgtaagcatcctgctctcctccctcctcaagaacgacgttcccctggctggcccgctcatcgcaggcgggatgctgatcgcatgctacgtcatcagcggctccagcgccgacctcagccttgagaaagcagcggaggtgtcgtgggagcaggaggctgaacactccggggcttcgcactccatcctagtcgaggtacaggacgacggcacgatgaagataaaagacgaggagcgagacgataccctgaccatcctcctgaaggcaactctcctcgctgtgagcggggtgtaccccatgtccatccctgccaccctttttgtctggtatttctggcagaagaagaagcagagatccggagtactctgggacaccccctccccgccagaggtggagagagccgtcctcgacaacggcatataccgcatcctgcagcgcgggctgctgggccgcagccaggtgggggtgggcgtcttccaggacggtgtattccataccatgtggcacgttacgcggggcgccgtcctcatgtaccagggcaagcgcctggaaccctcctgggccagcgtgaagaaggacctgatcagttacggcggagggtggcggttccagggctcatggaacaccggggaggaggtgcaggtcattgcggtggagcccggaaagaatccgaagaacgtgcaaacgacccccgggactttcaagacgcccgaaggcgaggttggcgccattgccctcgacttcaagcccgggacctccggctccccgatcgttaatcgcgagggcaagattgtggggctctacggaaacggggttgtgaccacctccggcacttacgtgagcgcaatcgcgcaggcaaaggccagccaggaggggcccctccccgagattgaggacgaggttttcaagaagcggaacctcaccattatggacctgcacccgggatccggcaagacccgccgatacctacccgccatcgtgcgagaggccataaagcggaagctccgcaccctgatcctggcgccaacgcgcgtggtcgcctccgaaatggccgaggccctcaagggtatgccgatccggtaccagacaaccgccgtgaagtccgagcacacggggcgcgagatcgtggacctgatgtgccacgcgacgttcaccatgcggctgctcagccctgtccgcgtgccgaactacaacatgatcataatggacgaggcacactttactgaccccgccagtatcgcagccaggggatacatttcaacccgcgtgggtatgggagaagcggctgctatcttcatgacggccacgccgcccggtagcgtcgaggcgttcccccagagtaacgcggtgatccaggacgaagagagggacatccccgagagatcctggaacagtggctatgactggatcacggacttcccggggaaaaccgtgtggtttgtaccatcgattaaaagcggcaatgacatcgccaactgcctgcgtaagaacgggaaacgggtgattcagctgtccagaaagaccttcgataccgagtaccagaagacgaagaacaacgactgggattacgtggtcactacggacatcagcgagatgggcgccaacttccgcgcggaccgggtgattgacccgcgacggtgcctcaagcccgtgattcttaaggacgggccggagcgagtcatcctggcgggcccgatgcccgtgacggccgcctccgccgcacagcggcgcggccgcatcgggcggaaccagaacaaggagggcgaccagtacgtctacatggggcagcccctcaataacgacgaggaccacgcgcactggaccgaggctaagatgctcctggataacatcaacacccccgagggcatcatcccggcattattcgagccggagcgcgagaaatccgcggctatagatggggaataccggttgcgtggggaggcgcgcaagacattcgtcgaactgatgcgccggggcgatctgcctgtgtggctgtcctacaaggtcgcctctgaggggttccaatattccgaccgccggtggtgcttcgatggcgaacgcaataaccaggtgctggaggagaacatggacgtcgagatctggaccaaagaaggtgagcggaaaaagctccgcccccggtggctggacgcccgcacctacagcgacccactggccctacgggagttcaaggagttcgccgctggtcgccggagcgtctcaggcgacctgatcctggagatcgggaagctcccgcagcacttgaccctgcgcgcccagaatgccctggacaatctggtgatgctgcacaatagcgagcagggcgggaaggcgtaccggcacgcaatggaggaactccccgataccatcgagacgttaatgctgctcgcactaatcgcggtgttaaccggaggggtgaccctttttttcctatccgggaagggcctggggaagaccagcattggccttctgtgcgtgacggcctctagcgcccttctctggatggcttccgtggagccccactggattgccgcgagcatcattctggaattcttccttatggtactactgatccctgaaccagacagacaacggacgccccaagacaaccagctagcatacgtagtgatcgggctcttattcatgatcctgacggtagctgcgaacgaaatgggcctcctagagacaacgaagaaggacctaggaatcggctacgttgccgccgagaaccatcagcatgctaccatgcttgacgtggacttacacccggcctccgcgtggaccctgtacgcagtcgccaccaccgttatcaccccaatgatgcggcatactatcgaaaacaccacggccaacataagcctcacggcgatcgccaaccaagccgcaatcttaatgggcctggacaaggggtggccgatctccaagatggacatcggcgtgccattactggccctggggtgttacagccaggtgaaccctctcacactgactgcggcagtgctgatgctcgtggcacactacgcaattatcggccccggtctgcaggccaaggcgacgcgcgaagcccagaaacggaccgccgccggcatcatgaagaaccccaccgtcgatggcatcgtggctattgacctggaccccgtggtctacgacgcgaagtttgagaagcaactcgggcagatcatgctgctgatcctctgcacctcgcagatcttgcttatgcgcacgacctgggcgctctgcgagagcataactctggccaccggcccattaactaccctctgggagggctcccctggtaaattctggaacaccaccatcgcggtgagtatggccaacatattccggggctcctacctggcgggggccgggctggccttctccctcatgaagtccctcggcggcggccgccggggcacgggtgcccagggggagactctgggagagaaatggaaaaggcagctcaaccagctgagcaaaagcgaattcaacacctacaagcggtccgggattatggaagttgacagaagtgaggcgaaagagggccttaagcgcggggagaccacgaagcacgccgtttcgcgcgggactgcaaagctccggtggttcgtggagaggaacctggtcaagcccgaagggaaagtcatcgacctggggtgcggtcgggggggctggagctactactgcgccgggctgaagaaggtgaccgaggtcaagggctatactaagggcgggccgggtcacgaggagccgatccccatggccacctacgggtggaacttagtaaagctgcactcgggtaaggacgtattctttatgccgcccgagaaatgcgacactctgctctgtgacatcggggagtcctcccccaaccccacaatcgaggagggccgcaccctgagagtgctaaagatggtcgaaccctggctccgcggcaatcaattttgcatcaaaatcctgaatccttacatgccatcggtggtggagaccctggagagaatgcagcgcaagcatggtggcatgttagtccgtaaccccctgtcccgcaacagcacgcatgagatgtactgggtatcctgcgggacaggcaacatagtaagcgctgtcaacatgacctctcgcatgttgctaaaccggtttaccatggcccaccgaaagccgacgtacgagagagacgtggacctgggggccggtacccgccatgtcgccgttgagcccgaggtggccaacctagacataatcggccaacggatcgagaatatcaaaaacgagcacaaaagcacctggcattacgacgaagacaacccgtacaagacgtgggcgtaccacggttcctacgaggtgaagcccagcggctccgcaagctcgatggtcaacggggtggtccgactcctgacaaaaccgtgggatgtgatccccatggtgacccagatcgctatgaccgatacaacgcctttcggtcagcagcgtgtcttcaaggagaaagtggacacccggacgccccgtgcaaagcgaggcacgacgcagataatggaggtgaccgccaaatggctgtggggcttcctatcccgaaacaagaagccccgcatatgcacccgggaggagttcacgcgcaaggttcggagcaacgcggccatcggtgccgtgttcgtcgacgagaaccagtggaactctgcaaaggaggcggtcgaggacgagcgcttctgggacctagttcatcgggagagagagcttcacaagcaggggaagtgcgcaacgtgcgtgtataacatgatgggcaagcgggagaagaagctcggtgaattcggcaaggcaaagggtagccgcgccatctggtatatgtggctcggagcccggttcctggagttcgaagcgctcggtttcatgaatgaagaccactggttctcccgtgaaaatagcctttccggggtcgagggcgaggggctgcacaaactgggctacatcttgcgcgatatcagcaagatcccgggcggaaacatgtacgcagacgacacggccggctgggacacccgggttacagaggacgacctgcagaacgaggcgaagataacggacatcatggagccggagcacgccctattggcgacctccatcttcaaattgacctaccagaataaggtggtcagagttcagcggcccgcaaagaatgggaccgtgatggatgtcatctcgcgacgagaccaacgcgggtctggtcaagtggggacttacggattaaacaccttcaccaatatggaggtgcagctgatccggcagatggagagcgaggggatttttctaccctccgagctcgagacgcctaacctggcggaacgcgcccttgactggctcgagaagcatggcgccgagcggctgaaacgcatggcgatcagcggggacgactgcgtagtgaagcccatcgacgaccgtttcgccacggctctaacggccctcaatgacatggggaaggttcgtaaggacattccccaatgggagccgtctaagggttggaacgactggcagcaggtcccgttttgcagccatcacttccaccaactgatcatgaaggacgggcgagagatagtcgtgccctgtcgcaatcaggacgagctggtcgggcgtgccagagtgtcccaaggggctggctggtctctccgggagaccgcctgtctgggaaaatcttacgcacaaatgtggcagctgatgtactttcaccgccgggacctccgcctggccgcaaacgctatttgcagcgccgtgcccgtagattgggtaccaaccagcaggaccacgtggagcatacacgcccaccatcagtggatgaccaccgaagacatgctaagcgtgtggaaccgggtctggatcgaggagaacccttggatggagaacaagacacacgtgagttcctgggaggaagtgccctaccttggcaagcgcgaagatcagtggtgcggttccctgattggtttgactgcccgggcgacctgggcgaccaacatccaggttgccattaaccaggtgcgccgtcttatcggaaacgaaaactacctagactacatgaccagcatgaagcgcttcaagaacgaatccgacagcgagggcgccttatggtga

SEQ ID NO: 23986 - RNA, 9879 nt, synthetic construct
  misc_feature 1..9879: note = derived and/or modified CDS sequence (opt11) from DENV-1__KJ189353__SS-prME
  source 1..9879: mol_type = other RNA
agcgtgaccatgcttctcatgctactgccgaccgccctcgccttccacttaaccacccgcggcggggaaccccacatgatcgtgtcgaagcaagagagaggcaagagcctcctattcaaaactagcgcgggcgtaaacatgtgcactctgattgccatggaccttggggagctctgcgaggataccatgacctacaaatgccccaggatcaccgaggccgagcccgacgacgtagattgctggtgcaacgccaccgacacgtgggtgacctacggtacctgtagccaaaccggagagcaccggcgtgagaagcggtctgttgccttggcgcctcacgtgggcctgggtctcgaaactcgcacagagacctggatgagctccgagggcgcctggaagcagatccagcgggtcgagacctgggccctgaggcacccagggttcacggtgatcgccttcttcctggcgcacgctataggcaccagcatcacccagaaggggatcatcttcatcttactgatgctggtgacaccctccatggcaatgcgctgcgtcggcatcggcaaccgcgacttcgtagaggggcttagtggagcaacctgggtggacgtcgttttagagcatgggtcctgcgtgacgaccatggccaaaaacaagcccaccttggacatcgaactgctgaagacggaggtcaccaatccagccgtgcttcgcaagttgtgcattgaggccaaaatcagcaataccaccacggactcccgctgtccgacccaaggggaggccacgttggtggaggagcaggacgctaacttcgtctgccggcgcaccttcgttgatcggggctgggggaacggttgcgggctgttcggcaaagggagcctcctcacgtgcgccaagttcaagtgcgtgaccaagttggagggcaagatcgtacagtatgagaacctcaaatactccgtgatcgtgaccgttcacaccggtgaccagcaccaggtcggcaacgagacgaccgagcatggcaccattgcgacaatcaccccacaagcccccaccagtgagatccagctgaccgactacggggccctgaccttagactgctcgccacggaccgggctggatttcaacgagatggtcctgttaacgatgaaggagaaaagttggctggtgcacaagcagtggttcctggacctcccgctgccctggacctccggggccagcacgagccaggagacctggaaccggcaagacctgctcgtgacgttcaagaccgcacacgcgaagaagcaggaggtcgtagtgctggggagccaggagggcgccatgcataccgccctaaccggggccacggaaatccaaaccagcggcaccaccacaatctttgccgggcacctcaagtgccgtcttaagatggacaagctcaccttgaagggaatgagttacgtcatgtgcacgggaagctttaaactggaaaaggaggtggcggagacccagcatggcacggtgctcgtccaggtgaagtacgagggaactgacgccccctgcaagattcccttctccacccaggatgagaaaggggtgacccaaaacggacggctgatcacggccaatcctatcgttacggacaaggaaaaaccggttaacattgaaaccgaacctccttttggggagagctatatcgtggttggcgccggcgagaaggcgctcaagctgtcctggttcaagcgcgggagctccatcggcaaaatgttcgaagcaaccgcccgcggggctcgccgtatggccatcttgggcgacacagcatgggacttcgggagcattggcggcgtgtttacttccgtggggaagcttgtccaccagatcttcggtaccgcctacggggtcctgttcagcggcgtgtcctggactatgaagatagggattggaatcctgctgacgtggctgggcctaaacagccggagtacaagcctctccatgacctgtatcgcagtaggcatggtcaccctgtacctgggcgtaatggtacaggctgactccgggtgcgtgatcaactggaagggccgcgagttgaagtgcgggtccgggatcttcgtgacgaacgaagtccatacctggacagagcagtacaaattccaggccgacagcccgaagcggctgagtgccgccatcggcaaggcgtgggaggagggggtgtgcggcatacgctccgcgacccggttggagaatatcatgtggaagcagattagcaatgagttgaaccacatccttcttgagaacgatatgaagtttaccgtcgtagtgggcgacgccaatggcatcctcgcgcaggggaagaaaatgatccgacctcagccgatggaacacaagtactcctggaagtcatggggtaaagccaagatcatcggcgcggacatccaaaacactacctttatcatcgacgggcccgacaccccggagtgccctgacggccagcgcgcctggaacatctgggaagttgaagactacggattcggtgtgttcacgaccaatatctggctcaagctgcgcgactcctacacccaaatgtgcgatcaccgactgatgagcgctgccatcaaagactccaaggccgtgcacgccgacatggggtactggatcgagagcgaaaagaacgagacctggaagttagcccgcgcgtctttcatcgaagtaaagacctgtacgtggcccaagtcacacacgctgtggtccaacggagtcctcgagagcgagatgataatccccaagatctacggcggtccaatctcccagcacaattacagaccaggctacttcacccaaaccgccgggccctggcacctcggcaagttagagctcgacttcgagctgtgcgagggcacgaccgtggtggtagacgagcattgcgggaacagaggcccgagcctgcggaccaccaccgtgaccgggaagatcatccacgaatggtgctgccggagttgcaccttgccgcccttacggttccggggggaggacgggtgctggtacggcatggagattcgacctgtgaaggagaaagaggagaacctggtccgcagcatggtgtccgccggcagcggcgaggtggatagcttctccctcgggatactttgcgtaagcatcatgatcgaggaggtgatgcggagtcgctggagcagaaagatgctgatgaccgggacgctggccgtttttttactactcatcatgggccagttgacctggaacgacctgatccggctctgtatcatggtgggggctaacgcatcagaccgcatgggcatgggcacaacctatctagcactgatggccacgttcaagatgcggcccatgttcgccgtggggctcctgttccgccggctgacctcccgcgaggtgctcctcctgaccatcggcctctccctggtagccagcgtggagctgcccaatagcctcgaggagctgggggacggtctggcgatggggatcatgatgctcaagctgctgaccgagttccagccccatcagctctggacgaccctgctgagcctcaccttcgtcaagacaacgctgtccctggactacgcctggaagaccactgccatggccctcagcatcgtatccctgttccccctgtgcctgagcaccacgtcccagaaaaccacctggctgccggtgctgctaggaagcttcggctgcaagcccctgaccatgtttctgatcaccgagaacaagatctgggggaggaagtcctggcccctcaacgagggcattatggcaatcgggatagtctctatcctactgtcctctctactgaagaacgacgtgccactggcgggcccgctcatcgcgggcgggatgctgatcgcctgctacgttattagcggttccagcgccgacctgtccctcgagaaggccgcagaggtgagctgggagcaagaggctgagcactccggtgccagccacagcatactggtggaggtgcaagacgacggcacgatgaagatcaaggacgaggagcgcgacgacaccctgaccatcctcctaaaggccacgctgctcgcggtctctggggtgtaccccatgtccatcccggctaccctgttcgtctggtatttctggcagaagaagaagcagcgttccggcgtcctctgggataccccctccccacccgaggtcgagcgcgccgtcctcgacaacggcatctaccggatcctgcagcgcgggctgctagggcggtctcaggtcggggtgggcgtgtttcaggatggggtcttccacaccatgtggcacgtgacccgcggtgccgtgctcatgtaccaaggcaagcgtctggagccctcctgggccagcgtaaagaaggacctgatctcctacgggggtgggtggcgtttccagggcagctggaacacgggggaagaggtgcaggtgatagcggtggaacccggcaagaatccgaagaacgtccagactacccccggcacgttcaaaacgccagagggtgaagtgggcgctattgcactcgacttcaagcccgggacctccggctctccgatcgtcaaccgggagggcaagatcgtggggctttacggcaacggggttgtgaccacctccggcacgtacgtgagcgccatcgctcaggcgaaggccagccaggaaggccccctgcccgagattgaggacgaggtattcaagaagcgcaatttgactatcatggacctgcacccaggttccggcaaaacccgccgctacctgcccgccatcgtgcgggaggctataaagcgcaagttgcgcaccctgatcctggcgcccacgcgggttgtggccagcgagatggccgaggcactcaaggggatgcccatcaggtaccagaccactgccgtcaagagcgaacacactggccgggagatcgtggatctgatgtgccacgcgacgttcacgatgcgactgctgagccccgtgcgggtgcccaactacaacatgatcatcatggacgaggcccacttcacagaccccgcctccatcgccgcccgcggatacatctcgactcgggtgggcatgggggaagcggcagcaatcttcatgacggccacgccacccggctccgttgaggccttccctcagagcaacgcggttatacaggacgaggagcgagacatccccgagcggtcctggaacagcggctacgattggatcaccgatttccccgggaaaaccgtgtggtttgtgccctccataaagagtggcaatgacatcgcgaactgtctgcgcaaaaatggcaagcgggtaatacagctgagtcggaaaacgttcgacaccgagtaccagaagaccaagaacaacgactgggactacgtggtaacaacagacatatctgagatgggcgccaactttagggccgatcgcgtcatcgacccccggcgctgtctcaagcccgtgatcctgaaggacggacccgagcgggtgatactggcgggcccgatgcctgtcacggcggcctccgccgcccagcgccggggccggatcgggcgcaaccaaaacaaagagggagatcaatacgtgtatatgggacagccgctcaacaacgacgaggaccacgcgcactggaccgaagcgaagatgctgctggacaacataaacaccccagagggcatcatcccggcgctattcgagcctgagcgcgaaaagtcggcggccatcgacggcgagtaccgcttaagaggcgaggcgcgcaaaacgttcgtcgagttaatgcggaggggcgacctgcccgtgtggttaagctacaaggtagccagcgaagggttccagtactccgaccggcgttggtgcttcgacggcgagcggaacaaccaggtccttgaggagaacatggacgtggagatatggaccaaggagggggagcgcaagaagctccgaccgcgctggctggacgcgcggacatacagcgaccctctggcactccgcgagttcaaggagttcgccgcggggcggcgcagtgtttccggcgatctgatcctggagatagggaagctcccccagcatctgaccctgagagcccagaatgcgctcgacaacctagtcatgctgcacaacagcgaacagggcgggaaggcctaccgccacgcgatggaggagcttcccgacaccatcgagacactaatgctgctcgccttaatcgccgtgctgacgggcggggtgactttgttcttcctttcaggcaagggtttaggtaaaaccagcatcggcctcctgtgcgttacggcctccagcgcccttctctggatggcgtccgtggagccccattggatcgccgccagcatcatcctggagttcttcctgatggtgctcctgatccccgagcccgaccgtcagagaaccccccaggacaaccagctggcctatgttgtgatcggtctcctgttcatgatcttaaccgtggccgcgaacgaaatggggttgctggagaccacgaagaaggacctgggtataggatacgtggccgccgagaaccaccagcatgccaccatgttggatgtggacctgcacccggcatccgcctggaccctctatgccgtggccaccacggtcatcacccccatgatgcgacatactatagagaacactacggctaatatttccctcaccgcgatcgcgaaccaggccgccatactgatgggcctggacaaagggtggcccatctccaagatggatatcggggtgcccctcctggccctggggtgctacagccaggtgaacccgctcacactgactgcggccgtgctgatgctcgtggctcactatgccatcatcggtcccgggctgcaggccaaagcaacgcgggaagctcagaagaggacagccgccggcattatgaagaaccccaccgttgatggcatcgtcgccatcgacctggacccagtggtctacgacgcgaagttcgaaaagcagctagggcagataatgctgctgatcctatgcacctcccagattttactgatgaggacgacctgggccctctgcgagagcatcaccctggcaaccggccctcttacgactctgtgggagggatccccaggcaagttctggaacaccaccatcgccgtcagtatggccaacattttccgcggatcgtatctcgcaggggccggtctggcctttagcctcatgaagtccctcgggggaggccgacgcggtacgggtgcgcagggggagaccctgggcgaaaagtggaaaaggcaattaaaccagttaagcaagagcgagttcaacacgtacaaacggagcgggataatggaggtcgaccggagcgaggcgaaggagggcttaaagcgtggcgagacgacgaaacacgccgtgagtcggggcaccgccaagctccgctggtttgtagaacggaacttagtgaagccagagggaaaggtgatcgacctgggttgcggcagagggggctggagctattattgcgccggactgaagaaggtgaccgaggtgaaaggctacaccaaaggcgggcccggtcacgaagaaccgatcccaatggccacgtacggctggaatcttgtgaagctgcactctggcaaggacgtctttttcatgccgcccgagaagtgcgacaccctgctctgcgacatcggggagagcagccccaacccaaccatcgaggaaggacggaccctgcgcgtgctgaagatggtggaaccgtggctccgcggaaaccaattctgcatcaagatcctgaacccctacatgccgagcgtggtggagaccctggagcgcatgcagcgaaaacacggtggcatgctagtgcgcaacccgctgtcccggaattcaacgcacgaaatgtactgggtatcctgcgggaccggcaacatcgttagcgcggtgaatatgacctcccgcatgttgctcaaccgcttcacaatggcccaccggaagccgacgtacgagcgcgacgtcgacctgggtgccgggacccggcatgttgccgtggagcctgaggtcgccaacctggacatcatcggccagcgcatagagaacatcaaaaacgaacacaagtcaacgtggcattacgacgaggataacccgtacaagacctgggcgtaccacgggtcctacgaagtaaaacccagcggctccgctagctccatggtgaatggggtcgtgaggctcttaaccaagccctgggacgtcatccccatggtgactcagatcgccatgaccgatactacgccctttggccaacagcgcgtgttcaaagagaaggtcgacactcggacgccaagggccaagcggggcaccacgcagatcatggaggtgaccgcgaagtggctgtgggggtttctcagccgcaacaagaaaccccgcatctgcacccgcgaggagttcacgcgtaaggtgcgcagcaacgctgccatcggcgcggtctttgtcgacgagaaccagtggaactcagctaaggaggcggtggaggacgagcggttctgggatttggtccatcgtgaacgagagctgcataagcaggggaagtgtgccacgtgcgtgtacaatatgatgggcaagcgcgaaaagaagttgggggagtttgggaaggccaaaggttctcgggccatctggtacatgtggctgggggcccgcttcctggagtttgaagcgctcggtttcatgaatgaggaccactggttctcccgggagaacagcctgagcggggtggaaggcgaggggctgcataagctcggatacatcctgcgcgacatctcgaaaatcccgggcggcaatatgtacgccgatgacaccgccggatgggacaccagggttacagaagacgatcttcagaatgaggccaagatcacggacatcatggagcccgagcacgccctcctggcgacctccatatttaaattaacataccaaaacaaagtggtgcgggtccaacgccctgccaagaatggtacggtgatggacgtgatcagccggagggaccagcggggctccggccaggtcgggacctacggccttaacaccttcaccaacatggaagtgcagctgatccgccaaatggagagcgaagggatcttcttgccctccgagctcgaaacccccaatctggccgagcgagccctggactggttggagaagcacggtgccgagcgactgaagcggatggcgatcagcggggacgactgcgtagtcaaacccatcgacgaccgcttcgccactgccctaacagccctcaacgacatgggcaaagtgcggaaagacatcccccagtgggagccctcaaaaggctggaacgactggcagcaggtcccgttctgctcacaccattttcaccagttgatcatgaaggacgggcgcgagatagtcgttccctgccggaaccaggacgaactggtgggccgagcgcgtgtttcacagggtgcgggctggagccttcgcgagactgcctgccttgggaagtcctacgcccagatgtggcagctgatgtacttccaccggcgcgatttacggctggccgcgaacgcaatctgtagcgccgtgcccgtcgactgggtccccaccagccgcaccacgtggtccattcacgcccaccaccagtggatgaccaccgaggacatgctgtccgtgtggaaccgggtgtggatcgaagagaacccgtggatggagaataagacccatgtctctagctgggaggaggtaccatacctcggcaagcgggaggatcagtggtgcggatccctgatcggcctgactgccagagcgacctgggccacgaacatccaggtggccatcaaccaggtcaggcgcctcatagggaacgagaattaccttgattacatgacaagcatgaagcgtttcaagaacgagtccgacagcgagggtgccctgtggtga

SEQ ID NO: 23987 - RNA, 9879 nt, synthetic construct
  misc_feature 1..9879: note = derived and/or modified CDS sequence (opt11) from DENV-1__KJ189354__SS-prME
  source 1..9879: mol_type = other RNA
tctgtcactatgctgctcatgctgctgcccaccgccttggcattccacctgacgacccgcggcggggagccccacatgatcgtgagcaaacaggagaggggcaagagcttgctgttcaagacctcggcgggggtgaatatgtgcacactgatcgccatggacctgggcgagctctgcgaagacaccatgacctacaagtgcccccggataaccgaggccgaacccgacgacgtggactgctggtgtaacgccaccgacacctgggtgacctatgggacctgcagccagaccggtgagcaccggcgtgagaagaggtccgtggccctggcaccccacgtgggcctggggctcgagacccgcaccgaaacctggatgtcttccgagggcgcctggaagcaaatacagcgggttgagacctgggcccttcgccaccctgggttcacggtaatcgccttcttcttagcgcatgcaatcggcacctcgatcacacagaagggtatcatcttcatcctcttgatgctggtaaccccctccatggccatgcgatgtgtcggcatcggcaaccgcgacttcgtcgaggggctttcaggggcaacgtgggtcgacgtcgtgctggagcacgggtcgtgcgtgaccactatggccaaaaacaagcccacattggacatagagctcctgaagacagaggtgaccaaccccgcggtgctgcggaagctctgcatcgaggccaagatctcgaacaccaccacggactcccgatgtccgacccagggtgaggccaccttggtggaggaacaggacgccaacttcgtgtgccggcgcaccttcgtggaccggggctggggcaacggctgtgggctgttcggtaaggggagcctcctgacatgcgccaaattcaaatgcgtgaccaagctggagggcaagatcgtccagtacgagaacctcaaatactccgtgatagtgaccgtccacaccggcgaccaacaccaggtggggaacgagactaccgagcatggtaccatcgcgaccatcacgccccaggcccccacgagcgagatccagctgaccgattacggggccctgaccctcgattgcagcccccgcacaggtctggatttcaacgagatggtcctgctcacgatgaaggagaaaagctggttggtgcacaagcagtggtttctggacctccccctgccctggacctcgggggcatccacttcgcaagaaacctggaaccgtcaggacctcctggtgactttcaagaccgcacacgctaagaaacaggaagtcgtggtgctaggctcccaggaaggcgccatgcataccgccctgaccggtgccacggagattcagaccagcggcacaacgacgattttcgccgggcatctcaagtgccgcctgaagatggataagctcaccctcaagggcatgtcctacgtcatgtgcacggggagctttaagctggagaaggaagtggctgagacccagcatggcaccgtactggtccaagtgaaatacgagggtaccgacgcaccctgtaagatccccttctccacccaggacgagaagggcgtgacccagaacggacggctgatcacggcaaatccgatcgtcactgacaaggagaaaccggtgaacatcgagaccgagccgccgtttggggaaagctacatcgtcgtcggcgccggcgagaaagcactcaaactgtcctggttcaagcgcgggagctccatcggtaagatgttcgaagccaccgccagaggggcacgccgcatggccatcctgggtgacacggcgtgggacttcgggagcatcggaggggtgtttacctccgtcgggaagctcgtccaccagatcttcggcaccgcctacggggtgctgttcagtggcgtgtcctggaccatgaagataggcatcggcatactgctcacgtggctcggcttaaacagccggagcaccagcctcagcatgacttgcatcgccgtcggaatggtgaccctttaccttggcgtgatggtgcaggctgatagcggctgcgtaatcaactggaagggccgcgagcttaagtgcgggtcaggcatcttcgtgacgaacgaggttcacacctggaccgagcagtacaagttccaggccgattcgccgaagcggctgagtgcggccatcggcaaagcctgggaggagggggtgtgtggcatccgctccgccacccggctcgaaaacatcatgtggaagcagatctcaaacgaactgaatcacatcctgctagagaacgacatgaagttcacagtggtagtgggggacgccaacggcattttagcgcaaggaaagaagatgatccgcccccagccgatggaacataagtattcttggaagtcctggggcaaggccaagatcataggcgccgacatccagaacacgaccttcataatcgacggccccgacaccccggaatgccccgacggccagcgggcctggaacatctgggaggtggaggactacgggttcggtgtctttacaacgaacatctggctgaagctgcgggactcctacacccaaatgtgcgatcaccggctcatgtctgcggccattaaggactccaaggccgtgcatgctgacatgggctactggatagagagcgaaaagaacgagacttggaagctggcccgcgcgtccttcatagaggtgaaaacttgtacgtggcccaagagccacaccctatggagtaacggggtcctcgaaagcgagatgatcatcccgaagatatacggcggtcccatctcccagcataactaccggcccggctacttcacccagaccgctgggccctggcatctcggcaagttggagctcgacttcgacctatgcgaaggcaccaccgtcgtggtcgacgagcactgcgggaaccgcgggccgagcctgcggaccaccaccgtgaccgggaaaatcatccacgagtggtgctgtcgctcctgcaccttaccgcccctgcggttccgcggcgaggatgggtgctggtacggcatggagatccgcccggttaaggagaaggaggagaacttggtccgctcaatggtttccgccggttccggagaggtcgatagtttctccctcggcatcctgtgtgtgagcatcatgatcgaggaggtgatgcggtcacgctggagccgcaagatgttaatgaccgggacgctcgctgtgttcctgctgctcatcatgggtcagctgacctggaacgacctgatccggctctgcattatggtaggggccaacgcgtccgatcgcatgggcatggggaccacctatctggccctaatggccactttcaaaatgcggccgatgttcgccgtgggattactgtttcgtcggctgactagccgcgaagtgttactgctgaccatcggcttatccttagttgccagcgtggagcttcctaattccctcgaggagctgggggacggcctagccatgggaataatgatgctcaaactgcttaccgagtttcagccacatcagctctggaccaccttactcagcctcacgttcgtcaagactacgctgtccctggactatgcctggaaaacaaccgccatggccctctccatcgtgtccctgttccccttatgcctttcgaccacttcccagaagactacctggctgccggtattactcgggagcttcggctgcaagcccttaaccatgttcctgatcaccgagaacaagatctggggacggaaaagctggcccctcaacgagggcattatggcgattgggattgtaagcatcctgctgtcctcactactgaagaatgacgtccccctggccggcccgctcatcgccggcgggatgctgatcgcctgctacgtaatcagcggctccagcgccgacctgagcctcgagaaggcggccgaggtgtcatgggagcaggaggccgagcactccggcgccagccactccattctggtggaggtgcaagacgacggtaccatgaagatcaaggacgaggagcgcgacgacaccctgacgatcctcctgaaagccacccttctcgcggtcagcggggtataccccatgtccatccctgccacgctgtttgtgtggtatttctggcagaagaagaagcagcggagcggtgtcctatgggacaccccatcgccgcctgaagtggagcgcgccgtgctggacaacggcatctaccggatcctgcagcgcgggctgctgggacgtagccaggtcggagttggcgtgtttcaggacggagtcttccacaccatgtggcacgttacacgcggcgccgtacttatgtaccagggcaagcggctggagccctcttgggccagcgtcaagaaggacctgatctcatacgggggcgggtggcgcttccagggtagctggaacacgggggaagaggttcaggtgatcgcagtcgaacccggcaagaacccaaagaacgtgcagaccacccccggcaccttcaaaactcccgaaggggaagtcggcgccatcgctctcgacttcaagcccgggacaagtgggagccctatcgtcaaccgcgaaggcaagatcgtggggctctatggcaacggtgtggttactacctcagggacgtatgttagtgctatagcccaggcgaaggcgagccaggaggggcccctaccggagatcgaagacgaggtgttcaagaagcgcaacctcaccatcatggaccttcacccgggctccggcaagacccgacgctatctgcccgcgatcgtacgagaggccatcaagcgcaagttaaggaccctgatcctggcgcccacgcgggtggtggccagcgagatggccgaggctttaaaggggatgcccatcaggtaccagaccacggccgtcaagtccgagcacacgggccgggaaatcgtggacctgatgtgccacgcgacgttcaccatgcgcctgctcagccctgtgcgggtcccaaactacaatatgatcatcatggacgaggctcatttcaccgaccccgcatccatcgccgcacgcggatacatctctacgcgggtgggcatgggggaggcggccgccatcttcatgacggccacaccacccggctccgtggaggcattcccccaaagcaacgctgtcatccaggacgaggagcgagatatcccggagcggtcctggaacagtggctacgattggataactgatttccccgggaagaccgtgtggttcgtgccgtccatcaaatctggcaacgacatagcaaactgcctgcgcaagaacgggaagcgggtcatacagctatccaggaaaaccttcgataccgagtaccagaagaccaaaaacaacgactgggattacgtagttaccaccgatatcagcgagatgggcgccaacttccgggccgacagggtcatcgacccccggaggtgcctgaagccagttatcctcaaggacgggcccgagcgggtgatactcgcgggccccatgcccgtaactgccgcctccgcggcccaacgccgaggtcgtatcgggcgcaaccagaacaaggagggagaccagtacgtatacatggggcagcccctcaacaacgacgaagaccatgctcattggaccgaggccaagatgctgctagacaacatcaacacccctgaagggatcatcccggccctcttcgagccagagcgggagaagtccgccgccatcgacggggagtaccgcctgagaggggaagcacggaagacgttcgtagagctgatgcggcggggcgatctccccgtgtggctttcctacaaggtggcgagcgaggggttccagtactccgaccggagatggtgcttcgacggagagcggaacaaccaggtcttggaggagaacatggatgtggagatctggacaaaggagggggaacgcaagaagctccgaccccgctggttagatgctcgtacctactcagacccgctggcccttcgtgagtttaaggagttcgccgcagggcggcgcagcgtgtctggtgacctgattctggagatcggtaagctcccccaacacttaaccctgcgggcccagaacgctttggacaacctcgtgatgctgcataacagcgagcagggtggaaaggcgtaccgccacgcgatggaagaactccccgacactatcgagacgctgatgctgctggccctgatagccgtgctgaccggcggggtgacccttttcttcctttccggcaagggcttagggaagaccagcataggcttgctgtgcgtcacggcctccagcgcgctgctttggatggcgtccgttgagccgcactggatcgccgcgagcatcatcctggagtttttcctgatggtgttacttatcccagagcctgaccggcagcgcacaccccaggacaaccagctggcctacgttgtcattgggcttctgttcatgattctgaccgtggccgcaaatgagatgggcctcctggagacgacgaagaaggacctggggatcgggtacgtagccgccgagaatcaccaacacgctaccatgctcgacgtcgacctgcatccggcttccgcctggaccctgtatgcggtggccactacggtcatcacccccatgatgagacataccatcgaaaacaccacggccaatatcagcctcaccgcaatcgcgaaccaagccgccatccttatgggcctggacaaggggtggcccatatccaagatggacatcggcgtgcccctcctggcccttgggtgctacagccaggtgaaccctctcaccctgaccgcggccgtcttaatgctcgtcgcccactatgccatcatcggccctggactccaggccaaggcaacgagagaggcccaaaagcgtaccgccgccggcatcatgaaaaatccaaccgtggacggaatagtagccatcgacctggaccccgttgtgtatgacgcgaagttcgagaagcagcttgggcagattatgctgctgatactttgcacctcccagatcctgctgatgcgcacgacttgggccctctgtgaaagcataaccttagccacgggccctctaacgaccctatgggaggggtcccccgggaagttttggaataccaccattgccgtcagcatggccaatatattccgcggctcctacctggcgggtgccggtctcgccttcagtctcatgaaaagcctaggagggggtcggcgcggcacgggcgcccaaggggagactctgggagagaagtggaagcggcagcttaaccagctgagcaaaagcgagttcaatacatacaaacggtccggaatcatggaggtggacagaagtgaggctaaggagggcctgaagcgcggtgagaccacgaagcatgcggtgtcccgaggtacggcaaagttgcgatggttcgtagagcggaacttagtgaagcctgagggcaaggtgattgacctgggctgcggccgcgggggctggagctactattgcgcgggactgaagaaggtgaccgaggtcaagggctacaccaaaggcgggcccggacacgaagaaccaatccccatggctacctacgggtggaacctcgtgaaactgcactccggcaaggatgtattctttatgccgccagagaagtgcgacaccctgctctgcgacataggagagtcctccccgaatcctaccatcgaagagggacggaccctgcgggttctgaagatggtggagccatggctccgtggcaaccagttttgtattaagatcctgaacccctacatgcctagcgttgtagagaccctggaacgcatgcaaagaaagcatgggggcatgctcgttcgtaacccgctgtcccggaactcgacgcatgagatgtactgggtttcctgcgggaccggcaacatcgtgagcgcggtaaacatgacctcccggatgttgctcaatagatttaccatggcccacaggaagcccacgtacgagcgcgatgtcgatctgggcgctggaacccggcatgtggccgtggaacctgaggtcgccaacctggatataatcggccagcgtatcgagaacatcaagaacgagcacaagagcacctggcactacgacgaggacaacccgtacaagacctgggcgtaccacggatcctatgaagtgaagccctccggatccgccagctccatggttaatggtgtcgtgcgtctcctgacgaaaccctgggacgtcatccccatggtgacgcaaatcgccatgaccgacacaacgccgttcgggcagcagcgggtgttcaaagagaaggttgacaccaggacgccccgcgctaaacggggcactacccagattatggaggtgaccgcgaagtggctgtgggggttcctctctcgcaacaagaagcctcggatctgtacccgcgaggagttcacccggaaggttcgctcaaacgccgccataggcgccgtcttcgtggacgagaaccagtggaactccgctaaggaggcggtggaagacgagaagttctgggacctggtccaccgggagcgggagctgcacaagcaggggaagtgcgctacgtgtgtgtacaacatgatgggcaagcgggagaagaagctcggggagttcgggaaggcgaagggcagccgagccatttggtacatgtggctgggggctagattcctggagttcgaggcgctcggcttcatgaacgaggaccactggttctctcgcgagaatagcctgtccggggtggaaggcgaggggctgcataagctcggttacatactgcgagacatcagcaagattccaggagggaacatgtacgccgatgacacagccggctgggacacgcgcgtcaccgaggatgatctgcagaacgaagccaagatcactgacatcatggagcccgagcacgccctcctcgcgacctccatcttcaagctgacctaccagaacaaggtggtacgcgtgcaacggcccgcaaagaacgggactgtgatggacgtgatttcccgccgtgaccaacgcggctccggccaagtcgggacgtacggcctcaacaccttcaccaacatggaggtacagctgattcgccagatggagagcgaggggatcttcctgccctccgagctagaaacccctaatctggccgaacgcgcattggactggctcgaaaagcacggcgccgaacggctgaaacgcatggcgatctccggggacgattgcgtagtcaaacccatcgatgaccggttcgcgacggccctgaccgccctaaacgacatgggcaaggtgagaaaggacataccccagtgggagccctccaagggctggaatgactggcagcaggtcccgttttgtagccaccacttccaccagctgattatgaaggatgggcgcgaaattgttgtcccctgccgcaaccaggacgagctggtgggccgggccagggtctcccaaggggctggatggagcctccgcgagacggcctgcctgggtaaatcctacgcgcagatgtggcagctgatgtatttccatcgccgggacctgcgcctggccgccaacgccatctgcagcgccgttccggtggactgggtccccaccagccggacgacgtggagtatccatgcccatcaccagtggatgaccaccgaggacatgctgagcgtgtggaaccgcgtgtggattgaggagaacccgtggatggagaataagacacacgtctccagctgggaagaggtaccgtacctcggcaaaagagaggaccagtggtgtggctccctgatcgggcttacggcccgcgctacctgggccacaaacatccaggtggcaatcaaccaggtccgccggctcatcggcaacgaaaactacctcgactacatgaccagcatgaagcgcttcaaaaacgaaagcgacagtgagggtgccctgtggtga

SEQ ID NO: 23988 - RNA, 9879 nt, synthetic construct
  misc_feature 1..9879: note = derived and/or modified CDS sequence (opt11) from DENV-1__KJ189355__SS-prME
  source 1..9879: mol_type = other RNA
agcgtaaccatgctgctaatgctactgcccaccgccctcgccttccacctgaccacccgcggaggggaaccccatatgatcgttagcaaacaggaacggggaaaaagcctcctctttaaaaccagcgcgggggtaaacatgtgcaccctcatagccatggacctgggagaactatgcgaggacaccatgacttacaaatgcccccgcatcaccgaggccgaacccgatgacgtcgactgctggtgcaacgccaccgatacgtgggttacctacgggacctgcagccaaaccggcgagcatcggcgcgagaagcgatctgtagccctggcgccgcatgtgggtctgggcctagagactcgcacggagacctggatgagcagtgaaggcgcctggaagcagattcagagggtagagacgtgggccctacgccacccggggttcacggtgatcgccttcttcttggcgcacgccatcggcaccagcatcacccagaaaggtatcatattcatcctcctgatgctggtgaccccgtccatggctatgcggtgcgtcggcatcggcaatcgcgacttcgtggaggggctcagtggcgctacgtgggtggacgtcgtcttggagcacgggtcctgtgtgactaccatggccaaaaacaaacctaccctggatatcgaactattaaagacggaggtcacgaacccggccgtactacggaagttatgcattgaggctaagatcagcaataccaccacggattcccgttgcccgacccagggcgaggccaccctggtagaggagcaggacgctaatttcgtctgccgcagaacctttgtggatcggggttgggggaacggatgcgggctgtttggcaaggggagcctcctgacgtgcgccaagttcaagtgcgttactaagctggaaggcaagatcgtgcaatacgagaacctaaagtattccgtgatcgtgaccgtacacacgggcgaccagcaccaagtggggaacgagacgaccgaacacggcacaattgcgaccataactccccaggcccccacgagtgagatccagctgacagactatggggcactgacactcgattgcagtcccaggactggcctcgactttaacgaaatggtcctgctcacgatgaaggagaagtcttggctggtacataagcagtggttcctggacctcccgctgccctggacatccggggccagcacatcccaggagacctggaaccgtcaggatctgctcgtgacgttcaagaccgcccacgcgaagaaacaggaagtcgtggtgctgggtagtcaggagggcgccatgcacaccgccttaactggggccacagagatccagaccagcggaacgactacgatattcgccgggcacctcaagtgtcgcctgaagatggacaaactgaccctcaagggcatgtcatacgtaatgtgcaccggcagcttcaaactggagaaggaagtcgctgagacacagcacggcacggtcctagtacaggtgaagtacgaggggaccgacgccccctgcaagatccctttttccacgcaagacgaaaagggcgttactcaaaacgggcggctgatcacggccaaccccatcgtcatcgacaaagagaagcccgtaaacatcgagactgagccgccctttggcgagtcgtatatcgtcgtcggcgccggggagaaggcgctcaagctgtcctggttcaagaggggtagctccattggcaagatgttcgaggccaccgcacgcggcgcccggcgcatggcaatcctgggagacaccgcctgggacttcgggagcatcggaggcgtattcacgtccgtcgggaagctcgtccaccagatatttggcaccgcctacggggtgcttttcagcggcgtctcctggactatgaaaatagggataggcattctgctgacctggctgggacttaattctcggtccatgagcctatccatgacgtgtatcgccgtcgggatggtaaccctttacctgggcgtgatggtccaggccgacagcgggtgcgtgattaactggaagggtcgtgagctcaagtgcggctccgggatcttcgtgaccaacgaggtccacacctggaccgagcagtataagtttcaggccgatagcccgaagcggctgagcgcggccataggcaaggcgtgggaggaaggggtgtgcggaatccgctctgccacccggttagaaaatattatgtggaagcagatctcaaacgagctaaaccatattctgctggagaatgatatgaagttcaccgtggtagtgggggatgccaacggaatactcgcccaggggaagaagatgatccgcccccagcccatggagcacaaatactcctggaagtcttgggggaaggccaagatcatcggtgccgacatccagaacacaacgttcatcatcgatgggcccgacacgccggagtgccctgacggccagcgggcatggaacatctgggaggttgaggactacggattcggagtctttaccaccaacatctggctgaaactgcgcgactcctatacccaaatgtgtgaccaccggctcatgagcgcggcaattaaggactccaaggccgtgcacgccgacatgggctactggatcgagagcgagaaaaacgagacgtggaaactggcgcgcgcgtcatttatcgaggtgaagacctgcacctggcccaagagccataccttatggtctaacggggtccttgagagtgaaatgatcatccctaagatctacggtgggccaatatcccagcataactaccggcccggctatttcacgcagaccgcaggcccctggcaccttggcaagctggagctcgacttcgacctgtgcgaaggtaccacggtggtggtcgacgagcactgtgggaaccgaggcccgtctctgcggacgaccaccgtaactgggaagatcatacacgagtggtgctgccgctcctgtaccctaccgcccttacgtttccgtggagaggatgggtgctggtacggtatggagatacgccccgtgaaggagaaagaagagaacctggtccggagcatggtgtccgccggcagtggggaggtagacagcttctccctcggcattctgtgtgtatctatcatgatcgaggaggtgatgcggtcccgctggtctcgcaagatgctcatgaccgggaccctcgccgtcttcctactgctcatcatgggccagttaacttggaacgacctgattcggctctgcatcatggtcggggccaacgcttccgaccgcatgggcatgggcacgacttacctggcgttaatggccaccttcaagatgcgcccgatgtttgccgtgggtctcctgttccgccggctgacctctcgcgaggtgttattgctaacgattggcctctcactcgtggcctccgtggagttacccaactctctcgaggaactgggggatggactggcgatgggcatcatgatgttaaagctgctgaccgagttccagccccatcaactttggactacattgcttagcctgactttcgtcaagacaaccctgtccctggactacgcatggaagaccacggcgatggcgctcagtatcgtgtccctcttccccctatgtctctctactaccagtcagaaaaccacgtggctgccggtgctattgggcagcttcggctgcaagcccctgactatgttcctaatcaccgagaataaaatctggggccgtaagtcctggcccctaaacgagggtattatggcgatcgggatagtcagcattctgctgtcgagcctcttgaaaaacgacgtgcccctcgccggtccgctcatcgccgggggaatgctgatcgcatgttacgtgatctcgggctcctcagccgacctgtcgttagagaaagcagccgaggtgagctgggagcaggaggccgagcacagcggagccagccactccatcctcgtagaggtgcaggacgatggcaccatgaaaatcaaagacgaggaacgggatgacaccctgacaatcctgcttaaagctacccttctcgcagttagcggggtgtacccaatgagtatccccgccaccctgttcgtatggtatttctggcagaaaaagaaacaacgcagcggagtactctgggacaccccctcgcccccagaggtggaacgtgccgtgctcgacaatggcatctaccggatcctgcaacgcggcctgctgggtcgtagccaagtcggagtgggcgtgttccaggatggggtcttccacactatgtggcacgtgacccgcggcgccgtactcatgtaccaggggaagcggttggagccctcctgggccagcgtcaaaaaggacttgatcagctacgggggcggctggcgcttccaagggagctggaataccggggaggaggtacaggtgatagcggtcgagcctggcaagaacccgaagaacgtccagaccacgcccggcaccttcaagacacccgagggggaggtgggcgccatcgctctagactttaaaccaggaacgtccgggagcccgatcgtcaaccgggaggggaagatcgtggggctgtacggcaacggggtggtcacgacctcggggacgtatgtctcagctattgcacaggcgaaggccagccaggaggggcccctgcctgagatcgaggacgaggtgttcaagaagcgcaatttaaccataatggatctacacccgggctccggcaagacgcggcgctacctgcccgccatcgttcgagaggccatcaagcgcaagctccgaaccctgatcctggcgccgacgcgagtggttgcaagcgagatggccgaggccctcaaggggatgccaatccgctaccaaaccacggcggtaaagtctgaacacaccggcagagaaatcgtggacctaatgtgccacgcgaccttcaccatgcgcctgctcagcccggtgcgggtccccaactacaatatgatcatcatggatgaggcccacttcacggatcccgcctcgatcgccgcgcgcgggtacatcagcacaagagtagggatgggggaggcggccgcaatcttcatgaccgccacgccgcctggctccgtggaggctttcccccagagcaacgcggtcatccaggacgaggagagggacatcccggagcggtcctggaacagtggctacgactggataacggacttccccgggaagaccgtgtggttcgtgccgtcgatcaagagcgggaatgacatcgccaactgcctgcgcaagaacgggaaacgggtaatccagctctcccgtaagacgttcgacaccgagtaccaaaagacgaagaacaacgactgggactacgtcgtcaccaccgacatttcggaaatgggcgcaaatttcagagccgaccgcgtcatcgacccccggaggtgccttaagcccgtgatactgaaggacgggccagagagagtgatactggcgggccctatgccggtcactgccgcctcggccgcccagcgacggggccgcatcggccggaatcagaacaaagagggcgaccaatacgtgtacatgggacagcccctcaacaacgacgaggaccatgcgcactggacagaggccaagatgctgctggataacatcaacacacccgaagggattatccctgccctcttcgaacccgagcgggaaaaatccgccgccatcgacggtgagtatcgtcttagaggcgaggcccgcaagaccttcgtcgagttgatgcggaggggcgacctccccgtgtggctgtcctacaaggtagccagcgagggcttccagtactccgaccgtagatggtgcttcgacggcgagcggaacaaccaggtgctggaggagaacatggacgtggaaatctggaccaaagagggggagcgcaagaagctccggcccaggtggctggatgcccggacctacagcgacccgctggctttgcgggagttcaaggagtttgccgcgggcaggcgcagcgtgtcgggcgacttgattctggagatcgggaaactaccacagcacctgaccctgcgggcccagaacgccttagacaaccttgtcatgctgcacaacagcgagcagggcggcaaagcctatcgtcacgcgatggaggagctcccagacacaattgaaaccctgatgctgctcgcccttatcgccgtgctgaccggaggcgttacactcttcttcctatccggcaagggactgggtaagacgtccatcggcctgctatgcgtcaccgcctccagcgcgctgctctggatggcctccgtcgagccccactggatcgccgcctctatcattctagagttcttcttgatggttctcctgatcccggagcctgaccggcagcgcacgccccaggacaatcagttggcttacgtggtgatcgggctcctgttcatgattctgacggtggccgccaacgagatgggcctcttagaaactaccaaaaaggacctagggattggttacgtcgcagccgagaaccaccagcatgccacaatgctggatgtggacctgcacccggcctcagcatggacgctgtacgccgtggccaccaccgtcatcacccccatgatgaggcacacgatcgagaacaccaccgcgaacatatccctcacagcgatcgccaaccaggccgccatcctgatgggcctagacaaggggtggccgatttccaagatggatatcggcgtccccctcttagccctggggtgctacagccaggtaaacccgctcacgttaacggccgccgtcctgatgctcgtggcccactacgctatcatcggccccgggctgcaggccaaggcgacccgggaggcacaaaagagaacggccgccggcatcatgaagaaccctacggtggatgggatcgtcgccatcgacttggacccggtggtatacgacgcgaagtttgaaaagcaacttgggcagatcatgctgctgatcctctgcacctctcagatattgctgatgcggacaacctgggccctctgcgagagcatcacgctagctactggccctctgaccactctatgggaggggtcacccggcaaattctggaacacaacaatagccgtcagcatggccaacatcttccgcgggtcctacctggcgggggccgggctggccttctcactcatgaagtccctagggggcgggcggagaggaaccggggctcagggagagacccttggcgagaaatggaagcggcaacttaaccagttgagcaagagcgaatttaacacatataagcgatccggaatcatggaggtggatcgttcagaggcgaaggagggtctgaagcgcggggagaccactaagcacgcggtgtcgcggggcacagcaaagctcagatggttcgtcgagcggaatctggtgaagccggaaggaaaggtcatcgatctgggctgtgggcgcgggggctggagctactactgcgccgggctgaagaaggtgaccgaggtaaagggctacacaaagggcgggcccggccatgaggagccaatccccatggcaacctacgggtggaacctcgtaaagctgcattcaggcaaggacgtctttttcatgccgccggaaaaatgcgacaccctgctctgcgacatcggggagagctcccccaaccccaccattgaggaaggccggaccctccgtgttctgaagatggtggagccctggctgcggggcaaccagttttgcattaagatcctgaacccctacatgccgagcgtcgtggagaccctagagcgaatgcaacggaagcacgggggaatgctcgtgcgcaaccccctgtcccgtaacagcacgcacgagatgtactgggtctcctgcgggacaggaaacatagtgagcgcggtgaacatgacgtctcgaatgctcctgaatcgcttcaccatggcccaccgaaagcccacctacgaacgcgatgtcgacctcggcgcaggaacccggcacgtggccgtggagcccgaggtcgccaacctcgacatcattggacagcgaatcgagaacataaagaacgagcataagagcacctggcactacgacgaagacaacccgtacaagacctgggcgtaccacgggagctacgaggtgaaacccagtggctccgctagctcaatggttaatggggtcgtgcggctcctgacgaaaccctgggacgtgatccctatggttacccagattgcgatgaccgacactaccccgttcggccaacagagagtgttcaaagagaaggtcgacaccagaacgccccgggctaagcggggcaccacccagataatggaggttacggccaagtggctttgggggttcctaagccgaaacaaaaagccccgtatctgcaccagggaggagtttacacggaaggtgagatcgaatgcggcgatcggtgcagtattcgtggacgaaaaccagtggaactccgccaaggaggcggtcgaggacgagcggttctgggacctggtgcacagggagcgggagctgcataagcaggggaagtgcgcaacctgcgtctacaacatgatgggcaagcgggagaagaaactcggagagttcggcaaggccaagggatctcgggcaatctggtacatgtggctgggcgcccgctttctggagttcgaagcactcggcttcatgaacgaggaccactggttttctcgggagaatagcctatccggagtcgagggcgaggggctgcataaactaggctatatccttcgcgacatcagcaaaatcccagggggaaacatgtacgcggatgacaccgccggctgggatacgagagtcactgaggatgacctgcagaacgaggcgaaaatcaccgatatcatggagcccgaacacgccctcctggcgacatccatatttaagctaacgtaccagaataaggtggtacgggtgcaacgccccgccaagaatgggaccgtgatggacgtaatcagccggcgtgaccagcggggctcagggcaggtcgggacgtacggcctgaacaccttcacgaacatggaggtgcagctgatccgccagatggagagcgagggcatctttctccccagtgagctcgagacgccgaacctagccgagagggcccttggttggctcgaaaagcacggggccgagaggttgaagaggatggcgattagcggcgatgattgcgttgtgaagcctatagacgatcgcttcgccaccgccctgactgcgctcaacgacatgggcaaggtcagaaaggacattccccagtgggagcccagcaaaggatggaacgactggcagcaagtcccgttctgcagccaccatttccatcagctgatcatgaaggacggacgtgagattgtcgtgccctgtcgaaaccaagacgaactggtggggagagcccgggtcagtcagggcgcaggatggagcctccgcgagacggcttgtctgggcaagtcctacgcccagatgtggcagctgatgtacttccaccggcgggatctccggctggccgcgaacgccatttgctcggccgtgcctgtggactgggtccccaccagccgtacgacttggtccatacacgcccaccatcagtggatgactacggaggacatgctgagcgtgtggaatcgagtgtggatagaagagaatccgtggatggagaacaagactcacgtctcgtcttgggaagaagtcccatacctaggaaagagagaagaccagtggtgcggctccctcatcggcctgaccgcccgcgctacctgggccacgaatattcaagtagctatcaaccaggtccgccgcctcatcggtaacgagaactatctggactacatgactagcatgaagcggttcaagaatgagtccgatagtgagggcgcactgtggtag

SEQ ID NO: 23989 - RNA, 9879 nt, synthetic construct
  misc_feature 1..9879: note = derived and/or modified CDS sequence (opt11) from DENV-1__KJ189358__SS-prME
  source 1..9879: mol_type = other RNA
tccgtaacaatgctgttaatgctgctgcccactgtgctagccttccacctgaccaccaggggtggggaaccccacatgatagtgagcaagcaggagaggggcaagtccctcctgtttaagactagcgccggggttaatatgtgcaccctgatcgctatggatctgggcgagctctgcgaggataccatgacctacaagtgcccccgcatcaccgaggctgaaccagatgatgtggactgctggtgcaatgccaccgacacgtgggtgacttacgggacctgcagccagacgggcgagcatcgcagagaaaagcggtccgtcgctttagcgccgcacgtcggcctgggtctcgaaacccgcaccgagacctggatgagttccgagggcgcctggaagcagatccagcgggtggaaacgtgggccctgagacaccccgggttcaccgtgatcgcattcttcctggcccacgcgatcggcacgtcgatcacgcagaaggggatcatcttcatcctcctgatgctggtcaccccatccatggccatgagatgcgtgggaatcggaaatcgcgacttcgtcgaggggctcagcggcgcaacttgggtcgacgttgttctggaacacgggagttgcgtcaccaccatggccaagaataagcctactctggatattgagctcctaaagaccgaagtcacgaaccccgccgtgttacgcaagctctgcatcgaggcgaagatcagcaacaccaccacggactccaggtgcccgacccagggcgaggccaccctcgtggaggagcaggatgccaacttcgtctgccggcgcactttcgtggaccgcggctgggggaacggctgtgggcttttcggcaaggggagcctcttaacgtgcgccaagttcaaatgcgtcaccaagctcgagggaaagatcgtgcaatacgagaatctcaaatattccgtgatcgtcaccgtgcacaccggagaccagcaccaggtcgggaacgagacgaccgagcatggcaccatcgccaccatcacgccacaggcgcccacgagcgagatccagcttaccgactacggagccctgaccctcgattgtagcccccggaccggcctggatttcaatgagatggtactgctgacaatgaaagaaaagtcatggctggtgcacaaacagtggttcctggatctcccgctgccctggacctccggcgccagcactagccaggaaacctggaaccggcaggacttactcgtcacgtttaagaccgcccatgcgaagaagcaggaggtcgtagtcttgggctcccaggagggcgcgatgcacaccgccctaaccggggccacggagatacaaaccagcggcactaccacgatctttgccgggcacctcaagtgtcgccttaaaatggacaaacttaccctcaagggcatgtcgtacgtgatgtgcacagggagcttcaagctggagaaggaggtggccgagacccaacacggcacggtcctggtccaggtaaagtacgagggcaccgacgctccgtgcaaaatccccttctccactcaagatgagaaaggggtcacgcagaacggacggctgatcacggccaacccaatcgtgaccgacaaggagaagcccgtgaacatcgagactgaaccgccgttcggggagagctacatcgtggtgggcgcgggcgagaaggccctcaagttgtcttggttcaaacgcgggagctccatcggcaagatgttcgaggcgactgcccgcggtgcgaggcggatggcgatcctgggcgacacggcctgggatttcggcagcattggcggtgtgttcacctccgtagggaagctcgtgcatcaggtgttcgggaccgcgtatggggtgctgtttagcggtgtgagttggaccatgaagataggaatcggcatcctgcttacctggctgggcctcaatagccggtcgactagcctctccatgacgtgcatcgccgttgggatggtaaccctgtacctgggcgtgatggtacaggccgatagcgggtgcgttattaactggaagggccgagagctcaagtgcggatccggaattttcgtgactaatgaggtgcacacctggaccgaacagtacaaatttcaagcggacagcccaaagcggctgagcgccgcaatcggcaaggcctgggaggaaggagtatgcggcatccgatccgccacccggctggagaacatcatgtggaagcaaatctccaacgaactcaaccatattctgctggagaatgacatgaagttcaccgtggtggttggggacgccaacggtatcctcgcccagggcaagaagatgatcagaccgcaacctatggagcacaaatattcctggaagtcctggggcaaagcgaagatcatcggcgccgacatccaaaacacgacctttattatagacggaccagacaccccggagtgcccagatggccagcgtgcctggaatatctgggaggtggaggattacggcttcggggtgtttaccactaacatctggctgaaactgcgcgactcctacacgcagatgtgcgatcaccggctcatgtccgccgcgatcaaggactctaaggccgtccatgcagacatgggctactggattgagtccgagaagaacgagacctggaaactagctcgcgcgagcttcatcgaagtgaagacctgtacatggcccaagagccataccctgtggtccaatggggtgctcgagtcagagatgatcatccctaaaatctacggcgggccgatctcccagcacaactaccggcccggatatttcacccagaccgccgggccgtggcaccttggcaagctggagctcgacttcgacctatgcgagggcacgaccgtcgttgtggacgagcattgcgggaaccgcggcccgagcctgcggaccaccacggtgaccgggaagatcatccacgagtggtgctgccgctcttgcaccctgccgcctctgcgcttccgcggcgaagacggttgctggtacggcatggagatccggcccgtgaaggagaaagaggagaacctagtccgctccatggtctccgccggcagcggggaggtggactcattctcactcggcatcctgtgtgtgagcatcatgatcgaggaagttatgcgttcccgctggagcaggaagatgctgatgaccgggacgctcgcagtgttcctgttgctcatcatgggccaactgacctggaacgacctgattcggttatgcattatggtgggggccaacgcctccgacagaatgggcatgggcaccacccacctggcgctgatggctacgtttaagatgcggccgatgttcgcagtcgggctcttgttccgccgactgacctcacgggaggtgctactgctgaccattggtctttccttggtcgcgtcggtggagctgcccaactccctcgaggagctgggggacggcctggccatgggcattatgatgctgaagctgttaaccgagttccagccctaccagctctggactaccctgcttagcctcactttcgttaagaccacgctgtcgttggactacgcgtggaaaacgaccgcaatggcactctcaatcgttagtctgttccccctgtgcctcagcaccacgtcacagaagaccacctggctgccagttcttctcgggtccttcggctgcaagcccctgactatgttcctgatcactgagaacaagatctgggggcgaaagtcatggccattgaacgagggtatcatggccatcgggatcgtgagcattctgttgtcctcactcctgaagaacgacgtgcccctggcgggcccgctaatcgccggcgggatgctgatagcctgctacgtgataagcggctcctccgccgacctgtccctcgagaaggccgcagaggtgagctgggaacaggaggccgagcattccggggccagccactccatcctggttgaagtgcaggatgatggcacgatgaagattaaggacgaggagcgcgacgacaccctgaccattctcctgaaagccacgctgctcgcagtgagcggggtgtaccccatgtccatccctgcgacgctgttcgtgtggtacttctggcagcggaagaagcagcgcagcggcgtcctttgggacaccccctccccgcccgaggtcgagcgggcagtgctagacaacggcatataccggatcctgcagcgggggctgctgggccgctcgcaagtcggggtcggcgtgttccaggacggagtgttccacaccatgtggcacgtcacaaggggcgcagtgctcatgtaccagggcaagcgcctggagcctagctgggcaagtgtcaaaaaggacctgatctcctacgggggcggttggcggttccagggcagctggaatacgggggaggaggtacaggtcatcgccgtagagcccggcaagaacccgaagaacgtccaaaccacccctggaacctttaaaacgcccgaaggagaggtgggcgcgatcgcgttggacttcaagcccggtacgtccggctcgccgattgtgaaccgcgaggggaagatagtaggactgtacggcaacggggtggtgaccacctccggaacgtacgtcagcgccatcgcacaggccaaggctagccaagaggggcctctgcccgagatagaggacgaggtgttcaagaagcggaacttgactatcatggacttgcacccgggatccggcaagacccgcaagtatctgccggccattgtgcgggaggccatcaagcgcaaacttcgcaccctgatcctggcccctacgcgggtagtggcgagcgagatggcggaggccctcaaggggatgcccattagatatcagacaacggccgtgaagtccgagcacaccggccgggagattgtcgacctgatgtgtcacgccacgttcaccatgcgcctgctcagcccggtgcgggtccccaactacaacatgatcattatggacgaagcgcacttcaccgaccccgcttccatcgccgcccgcgggtatatcagcacccgggtcggcatgggggaagccgcggccatctttatgacggccacacctcccggcagcgtggaggccttcccacagagcaacgcagtgatccaggacgaggagcgtgacatccctgagcggtcctggaactcaggttatgactggatcacggacttcccaggaaagaccgtctggtttgttccttcgataaagagcggaaacgacatcgcgaactgtctgcgcaagaacggtaagcgggttatccagctgagtcgcaagaccttcgacaccgagtaccagaagacaaagaataacgactgggattatgtcgtgaccacagacatctcagagatgggcgccaacttccgagctgaccgggttatcgatccccgccgctgcctcaagcctgtcatcctgaaggacgggcccgagcgggtgatactggccggcccgatgcccgtcacagtcgcctccgccgcccagcgccggggccgcatcgggcgcaaccagaacaaggagggcgaccagtacgtatacatggggcaacccctcaacaacgatgaggaccacgcccactggaccgaggcaaagatgctgctggacaacatcaacaccccagagggcattatcccggctctcttcgagcccgagcgagagaagtccgccgccattgacggggagtaccgcctacggggcgaggccaggaagacatttgtcgagcttatgcggcgcggcgacctccccgtttggttatcctataaggttgccagcgaggggttccagtactccgaccggcgctggtgcttcgatggcgagcgcaacaaccaggtgctggaggaaaacatggacgtggagatctggaccaaggagggggagcggaagaagctccggcctcgctggttggacgcgcgtacctactccgatccgctggccctccgcgagttcaaggagttcgccgccggccgacgcagcgtgtccggcgacctgatcctagagatcgggaaacttccccagcacctgaccctgcgcgcccaaaacgcgctcgacaacctggtcatgctccacaacagcgagcaaggagggaaagcctaccgccacgccatggaggagcttcccgacaccatcgagacgctgatgctgctcgcccttattgcggtgctgaccggaggtgtgaccctcttcttcctgtccggcaagggcctggggaagaccagcatcggccttctgtgcgtcactgcctcctctgccctgttgtggatggcatcagtggagccccactggatcgctgcgagtatcatcctagagttcttcctcatggtgctcctgatcccggagcctgacaggcagcgtacgccacaagacaaccaactggcctacgtcgtgatagggctcctgttcatgatccttacggtggccgccaacgagatgggcttgctagagaccaccaagaaggacctggggatcgggtacgtcgccgcggagaaccaccaacacgccaccatgctcgacgtggacctgcacccggccagcgcgtggacgctgtacgccgtggcaaccacggtaattacccccatgatgcggcacacaatcgagaacaccacagccaatatcagcctcaccgccatcgccaaccaagccgcaatcctgatgggcctggacaaggggtggcccatcagtaagatggacattggcgtacccctactggcgctgggctgctatagccaggtgaatccgctcacgctgaccgccgctgtcttgatgttggtcgcacactacgccattatcggcccggggcttcaagccaaggccacgcgcgaagctcagaaacgcaccgcggctggcatcatgaaaaaccccaccgtagacggcatcgtcgccatcgaccttgaccccgtggtgtacgacgccaaattcgagaagcagttggggcagattatgctgctgatcctctgcacctcccagatcctgctgatgcggacgacctgggccctttgcgagtcaatcacactcgccaccggacctcttacgaccctatgggaggggtcacccggtaagttctggaacaccaccatcgccgtcagtatggccaacatcttccgcggctcctacctggccggggccggtctggcgttctcactcatgaaatcgctcgggggcgggcggcgcggcacgggcgcccaaggtgagaccctgggggagaagtggaagcggcagttaaaccagctgagcaagtctgagttcaacacctataagcgcagcgggatcatggaagtggaccgcagcgaagccaaggaggggctgaagcgcggggagaccacgaagcacgccgtatcccgaggcaccgcaaagctccgctggttcgtggagcggaacctggtgaagcccgaaggcaaggtgatcgacctgggctgcggcagaggcggctggagctattactgcgccgggctgaagaaggtcacagaggtgaaagggtacaccaagggcgggcctggccatgaggagccgatacccatggccacatacgggtggaacctcgtgaagctccactccggaaaggacgtcttcttcatgccgccggaaaagtgcgacacccttctctgcgacatcggggagagcagtccgaaccccaccatcgaggaagggcggaccctgagggtgctgaagatggttgagccctggctccggggcaaccaattctgcatcaagatcttaaacccctacatgccgagcgtcgttgagacactcgagcgcatgcagcggaagcatgggggcatgctggtccgcaacccgctgtcgcgcaacagcacgcacgagatgtactgggtctcctgcgggaccggcaacattgtgagcgccgtaaatatgacatcgcgcatgctgctcaaccgcttcaccatggcccaccggaagcccacgtacgagcgcgacgtagatctgggcgcggggacccggcacgtggccgtggagcccgaggtcgctaacctggacatcatcggccagagaatagaaaatatcaagaacgagcacaagagcacctggcactacgacgaggacaatccgtacaagacctgggcgtaccacgggagctacgaggtgaagccaagcggctccgccagctccatggtcaacggggtggtgcgactcctgacgaagccctgggatgttatacccatggtgacccagatcgctatgacagacacgactccgtttggccaacagcgcgtatttaaggaaaaggttgacacgcgaacaccccgcgccaagcggggcacgacgcagatcatggaggtaacggctaagtggctgtggggattcctcagccgaaataaaaagccccgcatttgtacccgcgaggagttcacccgcaaggtccgcagtaacgccgccattggcgccgtcttcgtagacgagaaccagtggaactcagccaaagaagccgtggaagacgagcgattctgggatctagtccaccgcgagagggagctgcacaaacaggggaaatgcgcgacgtgcgtctacaacatgatgggcaagagagagaagaagctcggggagttcggcaaggcgaagggctcccgggcaatctggtatatgtggctgggggcacgcttcttggagttcgaggctctcggcttcatgaacgaagaccactggtttagccgggagaacagcctgtccggggtggaaggcgaggggctgcacaagctggggtacatcctgcgcgacatctctaagatcccgggagggaatatgtacgccgatgacaccgcggggtgggatacccgcattacggaagacgacctgcaaaacgaggcaaaaatcacagatatcatggagcccgaacacgcccagctagccacctccattttcaagctaacctaccaaaacaaagtagtgagagtgcagcgccccgcaaagaacgggacggtcatggacgtgatctcacggcgcgaccagcggggctccggccaggtcgggacgtatggcctgaacaccttcaccaacatggaggtccagctcatccgccagatggagagcgaggggatattcttaccctccgagttagagaccccgaacctcgccgagcgggccctggactggctggagaagaacggggctgagcgcctcaagcggatggccatcagcggggacgactgtgtggtgaagcccatagacgacaggttcgccacggcgttaaccgcactgaacgacatgggcaaggtccggaaggacatcccccagtgggagccaagtaaggggtggaacgattggcagcaggtaccgttctgcagccaccacttccatcaactcatcatgaaggacgggcgcgagatcgtggtaccctgccggaaccaagacgaactcgtgggccgcgcccgggtgtcccagggggcgggctggtcgctacgcgaaaccgcctgcctcgggaagtcctacgcgcaaatgtggcagttgatgtatttccacagacgcgacttaagactcgcggccaatgccatttgcagcgcggtccccgtggattgggtgcccacgagccgcactacgtggtccatccatgcccaccaccagtggatgacaacggaggacatgctgagcgtgtggaatcgcgtttggatcgaggagaacccgtggatggaggataagacgcacgtgtcttcctgggaagaggtgccttacctgggcaaacgagaagaccaatggtgcggctccctcattgggttaacggcgcgcgccacctgggcaacaaacattcaggtggcgatcaaccaggtgcggaggttaatcggcaatgaaaactacctcgactacatgacaagcatgaagcggttcaagaacgagtctgacagcgagggggccctgtggtga

SEQ ID NO: 23990 - RNA, 9879 nt, synthetic construct
  misc_feature 1..9879: note = derived and/or modified CDS sequence (opt11) from DENV-1__KJ189359__SS-prME
  source 1..9879: mol_type = other RNA
agcgtgaccatgttgctcatgctcctgcccaccgtcctcgcctttcatctgaccaccagaggaggggaaccccacatgatcgtatccaagcaagagcggggcaagagcttactgttcaaaacatccgcgggcgtgaatatgtgcaccctgatcgccatggacctgggggagttatgcgaggacacaatgacctataaatgcccccgcataaccgaggctgagcccgacgacgtggattgttggtgcaacgccaccgacacctgggtaacgtatgggacttgctctcagacgggcgaacaccgacgggagaagcggtccgtggccctggcgccccacgtcggcttagggttagagacccgcaccgagacctggatgtcgtccgagggggcatggaagcagatccaacgggtggagacctgggccctgcgccaccccgggttcacagtgatcgcctttttcctggcccacgcgatcggcacgtccatcacgcagaaagggatcattttcatcctattgatgcttgtcacccctagcatggccatgcggtgcgtaggcattgggaaccgcgatttcgtggaggggttgtcaggcgctacgtgggttgacgtcgtgctggagcacgggtcttgcgtcaccaccatggctaaaaacaaacccaccctggacatagaattgctaaaaacggaggtaacaaaccccgccgtgttacggaagctctgcatcgaagccaagatctctaatacgacaacggactcccgttgtccgacccaaggcgaggctaccctggttgaggagcaggacgccaactttgtgtgtcggcggacgtttgtggaccggggctgggggaacggctgcggactgtttggaaaggggagtctcctgacttgcgctaagtttaagtgcgttaccaaactggagggaaagatcgtgcaatacgaaaatctcaaatattccgtgatcgtcaccgtgcacaccggcgaccagcatcaggtgggaaacgaaacgaccgagcatggcaccatagccacaattacaccccaagcgcctactagcgagattcaacttaccgactacggtgctctgacattagactgctccccacgtacgggattggacttcaacgagatggtcctcctcacgatgaaagagaaaagctggctggtgcataaacaatggttcctggacctacccctgccatggacctctggtgcttcaacgagccaggaaacatggaaccgccaggacctgctggtcaccttcaagacggcccacgcaaagaaacaagaggttgtggtcctggggtcccaggaaggcgcaatgcacaccgctctaaccggggccactgagatccagacgagcggtacaaccacgattttcgcggggcatttgaaatgccgcttaaagatggacaaactgaccctcaagggcatgagttatgtgatgtgcaccggaagtttcaagttggagaaggaggtcgctgaaacccagcacggcacagtcctggtccaagtcaagtatgaaggcaccgacgctccatgtaagatccccttctcgactcaagacgagaagggtgtcacccagaacggccggcttatcacggcgaacccgattgtaaccgacaaggaaaagcctgttaacattgagaccgagccacccttcggtgagtcctacatcgtggtcggcgccggagagaaggccctaaagttaagttggttcaagcgcgggagctcgatcggtaagatgttcgaggcaacagctcgcggtgcgcgtcgcatggccatactgggagacacggcctgggacttcggcagcataggtggcgtgttcacgtcggtagggaagctcgttcaccaggtcttcggcacggcgtatggggtcctgttctctggcgtgtcctggacgatgaagatcgggataggcatcttgctgacgtggctcggcctgaactcacgttccaccagcctcagtatgacctgcatcgcagtgggaatggtcaccctctacctgggggtgatggtgcaggccgacagcgggtgcgtcatcaattggaaaggccgcgagctaaagtgcggatccggcatcttcgtgacgaatgaagtgcatacgtggaccgagcaatacaagtttcaggccgacagcccgaagcggctgagtgccgcaatcgggaaggcctgggaggagggggtttgcggcattcgctccgccacccggctggagaatataatgtggaagcagatctccaacgagctcaaccatattctgctggaaaacgatatgaagttcactgtagtggtcggggacgccaacggcatactcgcccaaggcaagaagatgattcgcccccagcccatggagcacaaatattcatggaaaagttggggcaaggcgaagataatcggcgctgatatacagaacaccacttttatcatcgacggacccgatacgccggagtgtcccgatggacaacgggcctggaacatatgggaggtggaggactacggcttcggggtgtttaccacgaacatatggctgaagctgcgcgattcctacacccagatgtgtgaccaccggcttatgtcagcagcaatcaaggactccaaggccgtccacgcggacatgggctactggatcgagagcgagaaaaatgaaacatggaagctggcacgcgcctccttcatcgaggtgaagacatgcacgtggccgaagtcccacactctgtggtccaacggtgtgctcgagagcgagatgatcatccccaagatatacggcggtccgatttcccagcataactaccgtcccggctacttcacgcagaccgcggggccctggcacctgggcaagctggagctcgactttgatctgtgcgagggtacgacagtcgtggtggacgagcattgcgggaacagaggcccgagcttgcgtaccacaacggtcacggggaagatcattcatgagtggtgctgccgctcctgtaccctacctccattgcggtttcgtggggaggatggatgctggtacgggatggaaatacggcccgtcaaggaaaaggaggagaacctggtgcgaagcatggtaagcgccggtagcggggaggtggacagcttcagtctcggcatcttgtgtgtgagtatcatgatcgaggaagttatgcggtctcgctggagccgcaagatgcttatgaccggcacgctcgctgtgtttctgctgctcataatggggcagctgacctggaacgatctgatccgtctctgcataatggtaggggctaacgccagtgaccgcatgggtatggggaccacatacctggcgcttatggccacattcaagatgcggccgatgttcgccgtcgggctcctgttccgccggctgacatcacgcgaagttctcttgctgactatcgggctctcccttgtcgccagcgtcgaacttcccaactccctcgaggagctgggagacggcctggctatgggcatcatgatgctgaagctgttgacagagtttcaaccccaccagctttggacgacactgctgtcgctcacgtttgtgaagaccacgctgtccctggactatgcgtggaagaccaccgccatggctctctccatcgtctccctgttccctctgtgcctcagcactacatcccaaaagacgacctggctgccggtgcttcttgggagcttcggctgtaaacccctgaccatgttccttatcacggaaaacaagatatggggccggaagtcatggcccttaaacgaggggatcatggccataggaatcgtgagcatccttctgagcagcctccttaagaacgacgtccctctggcaggcccgctcatcgccggcgggatgctgatcgcctgctacgttatcagcggttccagcgccgatctgagcctcgagaaagcggccgaagtgagttgggagcaggaggcggagcacagtggggcttctcactccatattggtcgaggtacaggacgacggtacgatgaagatcaaggacgaggaacgtgatgacaccctgaccattctactgaaggccacactgctcgccgtgagcggggtctaccctatgtccatccctgcgacgctgttcgtatggtacttctggcagcggaagaaacagcgctcgggagtgttatgggataccccctcgcctcccgaggtggaacgggccgtactcgataacggcatctaccgcatactgcagcggggcctgctgggccggagccaggtgggggtcggagtgttccaggacggggtattccacaccatgtggcacgttacccgtggcgccgttctcatgtaccaagggaaacgcctggagccatcatgggcctcggtgaaaaaggacctgatctcatacggaggagggtggcgtttccagggcagctggaacacgggtgaggaggtccaggtcatcgccgtggagcccggcaagaacccgaagaatgtccagaccactccgggcacgttcaagacgcccgaaggggaagtaggcgcgatcgccctcgacttcaagcccggaacatccgggagcccgatcgtgaaccgcgaggggaagatcgtagggctgtacgggaacggggttgtaaccacctccggcacgtacgtaagcgccatagcccaggcgaaggcgagccaggaggggcctctaccagagattgaggatgaagtatttaaaaagcgaaacctcaccatcatggatctgcacccgggctccggcaagacacggcgatacctgcccgccatagtgcgtgaggccatcaaacgcaagctccgcaccttaatcctggccccgacaagggtcgtggcgtcagagatggctgaggcgctcaaggggatgccgatccgataccagaccactgccgtgaagtcggagcacaccggacgcgaaatcgtggacctgatgtgccacgccactttcaccatgcggctattaagtcctgtacgggtgcctaattacaacatgattataatggacgaagcccatttcacggatcccgcttccatcgccgcccgtgggtacatcagcacccgagtcggcatgggggaagctgcggcgatcttcatgacggccacgccgccaggcagtgtggaggccttcccccagtccaacgccgtaatccaggacgaggagagggacattcctgaacgcagttggaacagtggctacgactggatcaccgacttcccagggaagactgtctggttcgtgccttcaattaaaagcggcaatgacattgcaaactgcctgcggaagaacgggaaacgcgtgatccagctatcccgcaagaccttcgacacagagtaccagaagaccaagaacaacgactgggactatgtcgtgacaactgacatcagcgagatgggggcaaatttcagggccgaccgggtaatagacccccgccgatgtctaaagcctgtcatccttaaggatggacctgagcgcgtgattctggctggcccgatgcccgtcactgtagcttccgccgcccaaagacggggccgcatcggccggaaccaaaacaaggaaggtgaccagtacgtgtacatgggccagccactaaacaacgatgaggatcatgcgcactggaccgaggccaagatgctgttagataacatcaatacccccgagggcatcatcccggcactcttcgagcccgagcgcgaaaagtccgccgccatcgacggggagtacaggttgcgcggcgaagcccggaaaactttcgttgaactgatgcgtcgtggtgacctcccagtgtggctatcctacaaggtggcaagcgaggggtttcagtattccgatcgccggtggtgctttgacggagaacgcaacaatcaggtcctcgaggagaatatggacgtggagatatggaccaaagagggggaaaggaagaagctccgcccccggtggctggacgcccgaacttacagtgacccgctggccctccgggagttcaaagagttcgccgccggacggcggagcgtgtccggcgacctgatcctcgagattggcaaacttccccaacacctcactctacgagcccagaatgccctcgacaacctggtcatgctccacaacagcgaacagggcggtaaggcctatcggcatgcgatggaggaattgcccgacacgatcgagacgttaatgcttttagcactgatcgcggtgctgaccggcggggtgaccctcttcttcctcagcggcaagggcctggggaagacctccataggcctcctatgcgtcacggcctctagcgccctattatggatggcctccgtggagccgcactggatcgccgcgagcattatattggagtttttcctgatggttctcctgatcccggaacccgatcgacagcgcacgccccaggacaaccaactggcctacgtggttattgggctacttttcatgatcttgaccgtggccgcgaacgagatgggtttgctggaaaccaccaagaaggatttaggaatcggatacgtggccgcggagaaccaccagcacaccacgatgttagacgtggacctgcacccggcatccgcgtggaccctgtatgccgttgctacgacagtaattactcccatgatgcgccacacaatcgagaacacgaccgcgaacatcagcctcactgcaattgccaaccaagccgcaatactgatgggtctggacaaggggtggcccatatccaagatcgacatcggcgtacctttgcttgcgctgggatgttacagccaggttaacccgttgaccctaacggccgccgtcctcatgctcgtggcccactatgcaatcataggccccggacttcaggcgaaggcaacccgcgaggctcagaagcggactgcggcaggcatcatgaagaacccaactgtggacggaatcgttgcgatcgacctcgaccccgtggtgtacgacgccaagttcgagaaacagttggggcagatcatgctgctgattttgtgcacgagtcagatcttgctcatgcgcacaacctgggctctctgcgagagcatcaccctggcgacgggcccactgacgactctctgggaggggtcccccggaaaattctggaacacaacgatcgcggtcagcatggccaacatcttcaggggcagttatcttgccggtgccggtctggcattttccctcatgaagtcccttgggggcgggcgccgtgggactggagcccagggggagactctgggcgagaaatggaaacggcagctcaaccaattgtcaaaaagcgagtttaacacctacaagcggtccgggataatggaagtggaccgcagcgaggccaaggagggactgaaacgcggggagacgaccaagcacgctgtgagccgcggaaccgccaaactgcgttggtttgtcgagcggaacctggtcaagccggagggaaaggtaatcgacctggggtgtggcagaggcggatggagttactactgcgcggggctgaaaaaggtaaccgaggtaaagggatataccaaaggcgggcccgggcatgaagaacctatcccgatggccacatatgggtggaacctagtgaaactgcactccggcaaagacgtcttcttcatgccgcccgaaaagtgcgacaccctactctgtgacatcggtgagagctcccccaaccccactatcgaggaaggcagaacgctccgggtgctgaagatggtggagccctggctccgcggtaatcagttttgcattaagatcttgaacccctacatgcccagtgtcgtggagaccctggagcgaatgcagcgcaagcacgggggcatgctggtgcgcaaccccctttcccgtaatagcacccacgagatgtactgggtctcctgtggaaccggcaatatcgtgtctgccgtaaatatgacaagtcgcatgttactcaaccggttcaccatggcacaccgcaagcccacctacgaacgtgacgtcgacctgggcgcagggacccgccacgtggcagtggagcctgaggttgccaacttagacattattggccagcggatcgagaacatcaagaacgagcataaaagcacctggcactacgatgaagacaacccgtacaagacgtgggcataccacgggtcctatgaagtgaaaccttcgggctcagccagctccatggtgaacggggtcgtgaggctcctgacgaagccctgggacgtcatccccatggtgactcagatcgccatgactgatacgaccccgttcgggcagcagcgcgtattcaaagagaaagtggacactcgcacgccacgcgcgaaaaggggcactacgcaaatcatggaggtgaccgccaagtggctgtggggattcctcagccggaacaagaagcccaggatctgcacccgggaagagttcactcgcaaggtgcgaagcaacgcagcaatcggcgcggtctttgtggacgagaatcagtggaacacggcaaaagaggccgtggaggatgagcgtttctgggacctggtccaccgtgaacgcgagctccacaagcagggaaaatgcgcgacctgcgtgtacaacatgatgggcaagagggagaagaagctcggggagttcggcaaagcaaagggctcccgcgcgatttggtacatgtggttaggggctcggttcctggagttcgaggccctcggctttatgaacgaagaccactggttttcccgcgaaaattcgctcagcggggtggaaggagaggggctccataaattgggctatatccttcgcgacatcagtaagatcccgggcgggaacatgtacgcggacgacaccgcgggttgggacacgcgtattacagaggacgacctacaaaacgaggccaagattaccgacatcatggagccggagcatgcactcctagccacgagcatcttcaagctcacctaccagaataaggtcgtgcgagtgcagcgtcccgccaaaaacgggaccgtcatggacgtgatctcccgccgggaccagcggggaagcggccaggtgggcacctatggcttgaacaccttcacgaacatggaggtacaactgatccgtcagatggaatcggagggcattttcctgcccagcgagctcgagacgcccaacctggctgagcgcgcgctggattggctcgaaaagcatggcgccgaacggctgaagcggatggccatctccggggacgactgcgtggtgaaacccatcgacgatcggttcgcaaccgccctgaccgctctcaacgatatgggtaaggtccgaaaggacattccccagtgggagcctagcaagggctggaacgactggcagcaggtacccttctgttcccaccatttccaccagctgatcatgaaggacgggcgggagatcgtagtcccctgccgcaaccaggacgagttagtcgggcgggcgcgagtcagccagggtgcgggctggtccctccgggagaccgcatgcctcggcaagtcatacgcccagatgtggcagctgatgtacttccaccgccgggatctccgcttggcggccaacgccatctgttccgccgtccccgtggactgggtgccaacttcccgcaccacctggagtatccacgcgcaccatcagtggatgacaacggaggacatgctttccgtatggaaccgggtgtggatcgaggagaatccatggatggaggataagacccatgtgagctcctgggaggaggtcccctacctcggcaagcgcgaggaccaatggtgcggcagcttaatcgggctcacagctagagccacctgggccacgaacatccaggtggccataaaccaggtgcgccggctaataggcaacgagaattacctggattacatgacctccatgaaacgattcaagaacgaatctgacagcgagggagctctgtggtga

SEQ ID NO: 23991 - RNA, 9879 nt, synthetic construct
  misc_feature 1..9879: note = derived and/or modified CDS sequence (opt11) from DENV-1__KJ189360__SS-prME
  source 1..9879: mol_type = other RNA
agcgtaaccatgctgctcatgttactacccacggccttagcgttccacctgaccacgcgcggcggggagccccacatgatcgtgagtaagcaggagcggggcaagagcctccttttcaagacctctgcaggggtgaacatgtgcacccttatcgcaatggacctgggcgagctctgcgaggacacgatgacctacaagtgcccccgcatcaccgaggctgagcccgacgacgtggactgctggtgtaacgccaccgacacgtgggtgacgtacgggacttgtagccagacaggcgagcaccggcgcgagaagcggtccgtggccctggcgccccacgtgggtttagggctcgagacccgcaccgaaacctggatgtcgtccgagggcgcctggaaacaaatccagcgggtggagacctgggccctgcgtcaccccggcttcacagtgatcgccttcttcctggcacacgccatcggcaccagcatcacccagaaggggatcatatttatcctcctgatgctggtgaccccctccatggccatgcggtgcgtaggcatcggcaatcgcgacttcgtggagggtctaagcggagccacttgggtcgacgttgtactggaacacgggagctgcgtcaccaccatggcaaaaaacaagcctacgttagacatcgagctcttaaagacggaggtgaccaaccccgcggttctgcggaagctttgcatcgaggccaagatcagcaacaccaccactgactctcgctgccccacccaaggcgaggcaaccctggtggaagagcaggacgccaactttgtctgccggcgaaccttcgtggaccggggctgggggaacggatgcgggctgttcggaaaggggtccctcctgacgtgcgccaagttcaagtgcgtgaccaagctggagggcaagatcgtccagtacgaaaacctcaaatattccgtgatcgtaaccgtccataccggcgaccagcaccaggtagggaatgaaacgaccgaacatggcaccatagcgacgatcacgccccaggcgcccacgagcgagatacaattaaccgactacggggccctgaccctcgactgcagcccacggaccggcctggatttcaacgagatggtcctgctcacgatgaaggagaagtcctggctggtgcataagcagtggttcctggacttacctctgccctggacctccggggcctctacttcacaggagacctggaaccggcaagacctgctcgtgacattcaagaccgcccacgcgaaaaagcaggaggtcgtagtgcttggcagtcaggagggagccatgcacaccgccctgactggagccacagaaatccagactagcggcaccactacaatattcgccgggcacctcaagtgccgcctgaagatggataagctgaccctgaagggcatgtcctacgtaatgtgcaccggaagctttaagctggagaaggaggtggcggagacccagcacggcacggtgctggtgcaggtgaagtatgagggtaccgacgccccctgcaaaatcccgttctccacccaggacgaaaagggggtcacgcagaacggccgtctgatcacggcgaacccgatcgtcaccgacaaggagaaacccgttaacatcgaaaccgagcctcccttcggggaaagctacatcgtggtaggggccggggagaaggcgctcaagttatcctggttcaagcgcgggtcatccatcggcaagatgttcgaggccactgcacgcggcgcccgccgtatggcaatcctaggcgacacggcgtgggacttcgggagcatcgggggtgtgtttacttccgtaggaaagttagtacaccagatcttcggcaccgcctacggagtgctgttctctggcgtgtcctggactatgaagatcggtatcggcatcctgctcacgtggctgggcctgaactcgcgttccacctctctgtccatgacctgtatcgccgtcggcatggtgaccctgtatctgggcgtcatggtccaagccgactcggggtgcgtgatcaactggaaaggcagggagctcaagtgcgggtccggcatatttgtgactaacgaggtccacacctggaccgagcagtacaagtttcaagcagatagccccaaacggctaagcgccgctattggcaaggcctgggaagagggtgtgtgcggcatccgctccgccacgagactggagaatattatgtggaagcagatcagcaacgaactcaaccacatcttactggaaaacgacatgaaattcaccgtggtagtcggggacgccaacggaatcctagcgcaagggaagaaaatgatccgcccccaacctatggagcacaagtactcctggaagtcctggggcaaggccaagatcatcggcgccgacatccagaacacgaccttcatcatcgacgggcccgacaccccggagtgccccgacggccagcgtgcctggaacatctgggaggttgaggactacggattcggcgtcttcaccacgaacatatggctgaagctgcgtgattcctacacccagatgtgcgaccaccggctcatgagcgcggccatcaaggattccaaggccgtgcatgcggatatgggctactggatagagagcgagaagaacgagacatggaagctggctcgcgcgtccttcatcgaggtgaagacatgcacatggccgaagagccacactctatggtccaacggtgtcctcgagtcagagatgatcatccccaagatatacggcgggccgatctcccaacacaactaccgccccggctatttcacccagaccgcgggcccctggcacctgggcaagttagagcttgacttcgatctgtgcgaggggacgaccgtagtggtagacgaacactgcgggaatcgcggcccgagcctgcggaccacgacggtgaccgggaagatcattcacgagtggtgctgccgctcatgcactctcccgccactccggttccgcggcgaggacgggtgctggtacggcatggagatcagacccgtgaaggagaaagaggagaacctggtccgcagcatggtgtccgccggcagcggggaggtcgacagcttctccctaggaatattgtgcgtctcgatcatgatcgaggaggttatgcggtcccgctggagccgcaagatgctgatgactgggaccttggccgtattcctgttgttaatcatgggccagcttacgtggaatgacttaattcgtctctgcatcatggtaggggccaacgcgtccgaccgaatgggcatgggcaccacttacctggccttaatggccacgttcaaaatgcggcctatgttcgccgtcgggctgctgttccgcagactgaccagtcgcgaggtgcttctgctgaccatcggcctctccttggtcgctagcgtggagctgcccaactctttggaggagctgggagacggcctggcgatgggcatcatgatgctcaagctgttaaccgagttccagccacatcagctctggacgaccttgctgagcctcaccttcgttaaaactacgctgtctttagactacgcctggaagaccaccgcaatggcactcagcatcgtatcgctgttccccctgtgcctctcgaccacgagtcagaagactacctggctgccagtgctgttagggagcttcggctgcaagccgctgaccatgttcctgataaccgagaacaagatctgggggcggaagtcctggcccctcaacgagggaatcatggcgataggaatcgtcagcatcctgctgtccagcctcttgaagaacgacgtcccactggccggcccgctcatcgctggcggcatgctgatagcctgttacgtgatcagcggctcctcagccgatctgtccctcgagaaggcggccgaggtcagctgggagcaggaggcagagcactccggggccagccatagtatactggtggaggtacaggatgatggcacgatgaagattaaggatgaggagcgcgacgataccctgaccatcctcctgaaggccaccctgctcgcggtcagcggggtataccccatgtccatccccgccacgctgttcgtgtggtatttctggcagaagaaaaaacagcggagtggcgtcctgtgggacaccccctcgccgcccgaggtggagcgcgcagtgctcgacaacggcatctaccgaatactgcagcgcggcctcctcggcaggagccaggtcggggtgggagtgtttcaggacggggtctttcacacgatgtggcacgtgacccgcggcgccgtcctcatgtatcagggcaaacggctggagccctcttgggctagcgtgaaaaaggacctgatctcctacggaggcgggtggcgcttccagggcagctggaacacgggagaggaggtccaggtcatcgcagtggagcccggcaagaacccgaagaatgtacaaaccacccccggaactttcaagacgccggaaggcgaggtgggcgcgatcgccctcgacttcaagcccgggacctccggaagccctatcgtcaaccgggaaggcaagattgtggggctgtacggcaacggtgtggtcaccacttccggcacgtacgtcagcgcgatcgcccaggcgaaggccagccaggaaggccccctgcccgagatcgaagacgaggtgttcaagaagcgcaaccttacgatcatggacctgcacccgggcagcggcaagacccggcgctacctgccagccatcgtccgggaggccatcaagcgcaaactccgcaccctcatcctggcgcccacgcgggtggtcgcctcagaaatggccgaggcactaaaggggatgcctatcaggtatcagactacggccgtcaagtcagagcacaccggccgggagattgtagatctgatgtgccacgcgacattcaccatgcgcctgctcagccctgtgcgggtccccaactacaacatgatcatcatggatgaggcgcacttcaccgatcctgccagcatcgcagctcgcggctacatatcaacccgggtgggaatgggggaggcggctgccatcttcatgacggccacaccgcccggctccgttgaggccttcccccaaagcaacgcggtcatccaagacgaggagcgtgatatacccgagcggagttggaacagcggctacgattggatcaccgacttccccgggaagaccgtgtggttcgtgccctcgatcaagagcggcaacgacatagccaactgtctgcgcaaaaacgggaagcgggtcatccagctgtcacgcaagacttttgacaccgagtaccaaaaaaccaagaacaacgactgggactacgtagtgaccaccgacatctcggagatgggcgccaacttccgggccgatcgcgtcatagatccacggagatgcctcaagccagtgattctgaaagacggccccgagcgcgtgatcctggcgggcccgatgcccgtcactgccgctagtgctgcccagcgccgtggtagaatagggcggaaccagaacaaagagggcgatcaatacgtgtatatggggcaacctctcaacaacgacgaggaccacgcccactggacagaggccaagatgctcctggataacattaacacccccgagggcatcatcccggcactgttcgagcccgagcgtgagaagtcggccgccatcgatggggagtaccggctgaggggcgaggcgcgcaagacgtttgtcgagctaatgcggcgcggagacctccccgtatggttatcctataaggtggcaagcgaggggttccaatactccgatcggcgctggtgcttcgacggagagcgaaacaaccaggtcttggaggagaacatggacgtggagatctggaccaaggagggggagcgcaaaaagctcagaccccggtggctggatgcacgtacctattcagacccgctggccctccgcgagttcaaagagttcgccgcgggcaggcgtagcgtgtccggagacctgatcctcgagatagggaagctcccccagcaccttactcttcgggcccagaacgccctcgataacctggtcatgctgcacaacagcgagcagggcggcaaggcctatagacacgcgatggaagagctccccgataccatcgagacgctgatgctgctcgccctgatcgccgtgctgaccggcggggtcaccctcttctttctgtccggaaagggtctggggaagacaagcatcggcctactgtgcgtcacggcctccagcgccctcctctggatggcgtccgtagagccccactggatcgccgccagcatcatcctggagttcttcctaatggtgctactgatcccagagcccgatcggcagcgtacgccccaggacaaccaactggcctacgttgtgatcggtctacttttcatgatcctgaccgtggccgcgaacgagatgggcctactggagaccacgaagaaggacctgggcataggctacgtagccgccgagaaccaccaacacgccaccatgttggacgtggacctgcacccggcatccgcatggacgctgtacgccgtcgccacgacggttattacccccatgatgaggcacacgatcgagaacaccacagccaacatcagccttaccgccatcgcgaatcaggctgctatcttgatgggtctggataaggggtggccgatctccaagatggatatcggcgtgcccctcctggcgctgggctgctactcgcaagtgaacccgctcaccctgacagctgccgtcctgatgctcgtggcgcactacgccatcatcggccccggcctgcaagccaaagcgactcgcgaggcgcaaaagcgaaccgccgccggaatcatgaagaatcccaccgtggacggcatcgtagcaatcgacctggaccccgttgtgtacgacgcaaagttcgagaagcagctcgggcagatcatgcttctgatcctctgcacttcccagatcctgctgatgcgaacgacctgggccctctgcgagagcatcacccttgctaccggcccgttgacgacgctatgggaggggtccccgggcaagttctggaacaccaccatcgccgtcagcatggccaacatctttcggggctcctacctggccggggcgggcctggccttcagtctcatgaaatccctggggggcgggcggcggggcacgggggcccagggggaaaccctgggagaaaaatggaagcggcagctcaaccagctgagcaagagcgaattcaacacttataagcgcagtgggatcatggaggtggaccggagcgaggcgaaggaggggctgaagcgaggggagaccacaaaacacgctgtatcccggggtactgccaaattgcgctggttcgtcgagcggaacctggtgaaacccgagggcaaggtgatcgacttggggtgcggccgcgggggctggagctactactgcgccgggctgaagaaggtcaccgaagtcaagggctacacgaagggcggaccgggccacgaagagccgatccccatggcaacctacgggtggaacctcgtgaagctccactccggcaaagacgtatttttcatgccgcccgagaaatgtgacacactactctgcgacattggcgagagctccccgaaccccaccatcgaagagggccgaaccctacgcgttctgaagatggtagagccctggctccgtggcaaccaattctgcatcaagattctgaacccatacatgccaagcgtcgtggagaccctggaacgcatgcaacgaaagcacggtgggatgctcgtgcgcaaccccctttcccggaatagcacgcacgagatgtattgggtctcctgcgggacgggcaacatcgtgtcagctgtgaacatgacgtcgcgcatgctgttgaatcgcttcaccatggcccatcggaagcccacgtacgagcgcgatgtcgacctgggcgcggggacgagacacgttgccgtggagcccgaggtcgccaatttggacatcatcgggcagcgtatagaaaacatcaagaacgagcataagagcacctggcactacgacgaggacaatccctacaagacctgggcttaccacgggtcctacgaggtgaaaccgtcaggctccgcatcgagcatggtgaatggggtcgtgaggctcctgacgaagccctgggatgtcattcccatggtgacccagatcgccatgacagacaccaccccgttcggccaacaacgagtctttaaggagaaggtggacacccggacgccccgagccaagcgggggaccacgcagatcatggaggtgaccgccaagtggctgtgggggttcctcagccgtaacaagaagcccagaatctgcacacgcgaggagttcactcggaaagtgcggagcaacgctgccatcggtgccgtctttgtggatgaaaaccagtggaacagtgccaaggaggccgtggaggacgagcgtttctgggatttggtccaccgcgagagggagctgcacaagcagggcaagtgtgccacgtgcgtgtataacatgatgggcaagcgcgagaagaaactcggggagttcggcaaggccaaaggcagccgcgccatctggtacatgtggctgggggcccgcttcctggagttcgaggccctcgggttcatgaatgaggaccactggttttcccgggaaaacagcctgtccggtgtggagggcgaggggttacacaagttgggctacatcctccgggacatctctaagatcccgggggggaacatgtacgcagacgacaccgccggctgggacacgcgcgtaaccgaggacgacctgcagaacgaggccaaaatcacggacattatggaaccagaacacgccctcctggctacgtccattttcaagctgacctaccagaacaaggtagtgcgggtccagaggcccgccaagaacggtaccgttatggacgtgatctcacggcgtgaccagcggggctccggccaggtcgggacgtatggccttaacaccttcaccaacatggaagtacagttaatacgccagatggagagcgagggcatcttcctgccctccgagctcgagaccccgaacctggcagagcgcgctctggactggctcgagaagcatggagccgaacgcctaaagcgtatggcgatcagcggggacgactgcgtggtcaagcccatcgatgaccggttcgcgaccgccctaacagctctcaacgacatgggcaaggtgcggaaagacatcccccagtgggagccctccaagggttggaacgactggcaacaggtcccgttttgcagccatcacttccaccagctgatcatgaaggacgggcgcgagatcgtcgttccctgcaggaaccaggatgagctagtgggccgcgcccgggtcagccagggtgctggctggagcctccgcgagaccgcctgcctcggaaagtcgtacgcccagatgtggcaactgatgtacttccaccgtcgcgacctccgtctggccgcgaacgccatctgcagcgccgttccggtcgactgggtccccaccagccgcaccacgtggtcaatccacgcccaccaccagtggatgactacagaggatatgctgagtgtgtggaatcgcgtgtggatcgaggaaaacccgtggatggagaacaagacccacgtcagtagctgggaggaggtgccctatctcggaaagcgagaggaccaatggtgcggcagcctgatcgggctgacggcccgcgcaacctgggccacaaacatccaggtagctattaaccaggtccgacgtctcatcggaaacgagaattacctggactacatgacgagcatgaagcggttcaagaatgagtccgacagcgagggggcactgtggtag

SEQ ID NO: 23992 - RNA, 9879 nt, synthetic construct
  misc_feature 1..9879: note = derived and/or modified CDS sequence (opt11) from DENV-1__KJ189361__SS-prME
  source 1..9879: mol_type = other RNA
agtgtcacgatgctgctaatgctgctacccacagccatggccttccacctcacgacccgcgggggggagccacacatgatcgtgagcaaacaggaacgtgggaagagcctgttattcaagaccagcgcgggtgtgaacatgtgcaccctcattgctatggacttgggggaactgtgcgaggacaccatgacctacaagtgtcccagaatcaccgaagccgaaccagatgacgtggattgttggtgcaatgccaccgacacgtgggtgacctacggcacctgcagccagaccggggagcacaggcgcgagaagcggtccgtggctctggcgccccatgtggggttggggctggagacgcgcacggaaacctggatgagctcagaaggcgcatggaagcagatccagcgggtcgagacctgggccctccgccacccggggttcacggtgatcgccttctttctcgcacacgccatcggaacctctattacccaaaaggggatcattttcattctgctgatgctagttaccccatccatggcaatgcggtgtgtgggcatcggcaatcgcgatttcgtagaagggctgagcggcgctacttgggtagacgtcgttctcgagcacgggagttgcgtaaccaccatggctaagaacaagcccaccctggacatcgagctgctcaagactgaggtcaccaaccctgcggttctgcgtaaactgtgcattgaggcaaaaatcagcaatacgaccacggattcccgctgcccgacccagggtgaagccaccctcgtggaagagcaggacgccaacttcgtatgccggcgcaccttcgtggaccgcggctgggggaacggctgcgggctgttcggcaaggggagcttattgacgtgcgcgaaattcaagtgcgttaccaagcttgaggggaagatcgtccaatatgagaacctaaagtattcagtgatcgtgaccgtacataccggcgaccaacaccaggtgggaaacgagacaaccgagcacggtaccatcgcgaccattacgccccaggccccaactagcgagatccaacttaccgactatggggccctaaccttggactgcagccctcggaccggcctcgactttaatgagatggttctgctgacgatgaaagagaagtcctggttggtacacaagcagtggtttctggatttaccactcccgtggacttccggcgcctccacgagccaagagacctggaaccggcaggacctgttagtaacgttcaagacagcccacgccaagaaacaagaggtagtggtactcggcagtcaggagggggcgatgcacaccgccttaacgggcgcgaccgagattcaaacctcaggcactaccacgatcttcgctggacacttgaaatgtcgtcttaagatggacaagctgacattaaagggcatgtcttacgtcatgtgcaccggtagtttcaagctcgaaaaggaggtggcggagacccagcacggcacggtgctggttcaagtaaagtatgagggcaccgatgcaccttgcaagattcccttttccacccaggacgagaagggggtgacccagaacggccggctgattacggcgaacccgatcgtcaccgacaaggagaagcccgtgaacatagaaaccgagccgccgttcggagaaagctacatagtagtcggagccggcgagaaggcgttaaaattatcctggttcaagcgagggagctccattgggaaaatgttcgaggcgaccgcacgaggggcccgccgaatggccatcttgggcgacacggcctgggactttgggagcatcggcggtgtgttcacctcagtgggaaaactggtccatcagatctttggcaccgcctacggggtattgttcagcggcgtctcctggactatgaagatagggatcggcatcctgttgacgtggctgggcctaaacagcagatccaccagcctgtccatgacctgcatcgctgtcgggatggtgaccctctatctgggtgtcatggtccaggccgacagcgggtgcgtaatcaattggaagggccgcgagctgaagtgcgggagtggcatcttcgtgactaacgaagtacacacctggacggaacagtacaagttccaggcagactcacccaagcgtctgagtgccgccatcggcaaggcctgggaggaaggagtctgcggcatccgttctgccacccggttggaaaatataatgtggaaacagatcagcaacgaactgaaccatatactgttggagaacgatatgaaatttaccgtcgtagtgggggatgcaaacggaatattggcgcaagggaaaaagatgatccgcccccaacccatggaacataaatatagctggaagtcgtgggggaaggcgaagattatcggcgcggatatccaaaacacgacttttatcatcgacggaccagacaccccggagtgtcccgacggtcagcgggcgtggaacatctgggaggtagaagactacgggtttggtgtcttcactacgaacatctggctcaaactgcgcgattcctatactcaaatgtgtgaccacagactcatgtcagcagccatcaaggactcaaaggcggtacacgccgatatggggtactggatagagtcagagaagaacgagacatggaagcttgctcgcgcgtccttcatcgaagtgaaaacctgtacctggcccaagagccatacactgtggtccaacggtgtccttgaaagcgaaatgatcatccccaagatttatggcgggccgatctcccagcacaactaccggcccggttacttcactcagaccgccggtccctggcacctcggaaagctggagctggactttgacctctgcgaaggcacgacagtcgtggtcgatgagcattgcgggaatcgcggtccatcactacggaccactacggtaaccgggaaaatcatccacgagtggtgctgccgctcatgcactttgccacccctgcgtttcagaggcgaggacgggtgttggtacgggatggaaatacggcccgtcaaagagaaagaggagaacctcgtcagaagcatggtgtctgccggtagcggggaggtggacagcttctccctaggaatcctctgcgtcagcatcatgatcgaggaggtgatgcggtcgcgctggagcaggaagatgctgatgaccggcacgctagcagtttttcttctgctgataatgggtcagctcacctggaacgacctgatccggctgtgtattatggtaggggccaacgcatccgaccgcatgggcatgggcaccacatacctcgcactgatggcaacgtttaagatgcggccgatgtttgccgtggggctcctcttccgccggctgacgtctagggaggtgctgttgctgactatcgggctatccttagttgccagcgttgaattgcccaactcgctggaagagctcggggacggactggcgatgggcattatgatgttaaaactcttaaccgaattccaaccgcaccaactttggacgaccctcctgtcactcacgttcgtcaaaactacgctatccctcgactacgcatggaagaccaccgccatggctctgtcaatagtttccttgttccccctgtgcctgtcgaccacgtcccaaaagaccacatggctcccggtgctcctggggagcttcggctgtaaaccccttaccatgttcctcataaccgagaacaagatatgggggcgaaagtcctggcccctgaacgaaggcatcatggcgataggcatcgtcagcatcctcctgtccagcctgctcaagaacgacgtgccgctagcaggcccactgattgccgggggcatgctcatagcctgttacgtgatctctggctccagcgcggatctgtccctggagaaggctgcggaggtctcatgggagcaggaggccgagcactctggggccagccactccatcctggtggaagttcaagatgacggcacgatgaagatcaaggacgaagagagagatgatactctgacgatattgttgaaggccacgctgctcgcggtctccggagtgtaccctatgtccatccctgccactttgtttgtgtggtacttctggcagaaaaaaaaacagcggtcgggcgtcctgtgggataccccatccccccccgaagtggagcgagcagtgctggacaacggcatttaccgcatcttgcagcgcgggctgttgggccggtcccaggtcggggtgggagtgttccaagatggcgtcttccacacaatgtggcatgttacacgcggcgcagtgctgatgtaccaaggtaaaagactggaaccctcctgggccagtgtgaagaaagacctcatctcgtacgggggagggtggagattccagggcagttggaacacgggggaagaagtccaggtgatcgccgtagaacccggcaagaacccgaaaaacgtccagaccacccccggcactttcaaaacgcccgagggcgaggtgggcgcaatagcactagacttcaagccggggacatccggcagccctattgtcaacagagagggtaagatcgttgggctctacggcaacggagtggtaactaccagcggcacatacgtgagcgccatcgcgcaggcgaaggccagccaggaggggcccctgcccgagatcgaagacgaggtgttcaaaaagcgcaatctgaccatcatggacctccacccgggttcaggcaagacccggaggtacctccccgccatcgtccgggaggccatcaaacgcaagctaaggacgctcatactggcgcctacaagggtcgtggccagtgagatggctgaggcactgaaggggatgcccatccggtaccaaaccaccgcggtcaagtcggagcacaccggacgtgagatcgtggatctcatgtgtcacgcgacgttcaccatgaggctcctgagccccgtgcgtgtgccgaactataatatgattataatggacgaggcccacttcaccgatccagcctctattgcagcccgcggctacattagcactcgggtgggtatgggcgaggccgccgccatattcatgacggccacaccacccgggtccgtcgaagcgttcccacagagtaacgcggtgatccaagacgaagagagagacattcccgaacggtcttggaactcaggctacgactggatcacggacttcccggggaaaacagtgtggttcgtcccctccatcaagtccggcaacgacatcgccaactgtctaaggaagaacggcaaacgggttatccagctgtcccgcaagacttttgacacggaataccagaagactaaaaataatgactgggactatgtcgtgacgacggacatctcggagatgggcgccaacttccgggcggaccgcgttatcgacccccggcgctgccttaagcccgtgatcctcaaggatgggccagaacgggtcatcctagcggggcctatgccagtcaccgccgcttcagccgctcagagacggggacgcattggccggaaccagaacaaggagggcgaccagtacgtatatatggggcaaccgcttaataacgacgaggaccacgcgcattggaccgaggcgaagatgttgctagataatattaatacccccgagggaatcatccccgccctgttcgaacccgagcgggaaaagtccgctgccatcgatggggagtaccgtttacggggcgaggcgcgcaagacgttcgttgagctgatgcggcgcggcgacctgcccgtgtggctcagttacaaggtcgccagcgaaggattccagtactccgacaggcggtggtgcttcgacggcgagcggaacaaccaggttttggaggagaacatggacgttgaaatttggacaaaggagggagagaggaaaaaacttagacctcgttggttagatgctcggacctactcagacccattagccctgcgagaattcaaggaattcgcggccggacggcgctctgtctccggcgacctcatcctggagatagggaagctgccgcagcacctcaccttacgggcccagaacgctctcgacaacctggttatgctacataattcggagcaaggcgggaaggcctatcgtcacgcgatggaggaattgcccgacaccatcgaaactctcatgcttttagccctcatcgccgtgttaactggaggcgttaccttattcttcctgagcgggaagggcctgggcaaaacctccatcggcctgctctgcgttactgcttccagcgccctactatggatggcttccgtagaaccgcattggatcgctgccagcatcattcttgaattcttcctgatggtgttgctcattccggagcccgaccgtcagaggaccccccaggataatcagctagcctacgtggtgatcgggctcctctttatgatcctgacagtggcagcgaacgagatgggcctgctcgagaccacaaagaaggacctaggcatagggtacgtcgccgccgagaaccaccagcatgccaccatgcttgacgtagatctccaccctgcgagcgcgtggacgttatacgccgttgctaccacagtcatcacacccatgatgcggcacaccatcgagaacaccactgccaacatcagcttgaccgccatagcaaatcaagccgccatcctcatgggcctggacaaagggtggcccataagcaaaatggatatcggcgtgcccctgctagcccttgggtgctacagccaggtgaacccgctgacgctaacggccgcggtccttatgctggttgcccactatgccattatcggacccgggctccaggcaaaggcgacgcgcgaggcgcaaaagcggaccgcggcgggaatcatgaagaatcctacagtagacggtattgtagccatcgatcttgaccctgtcgtgtatgatgcgaaattcgagaagcagctcgggcagatcatgttgctcatactatgcaccagccaaatcctcctgatgcgaacaacatgggccctgtgcgagagcataaccctcgccaccggcccgttaaccactctgtgggaagggtcccccggcaagttctggaacaccaccattgccgtcagtatggccaatatctttcgcggctcatatttggcgggggctggattggccttctcgttgatgaaatccctagggggaggtcggcgcggcacgggggcgcaaggggagacgcttggcgagaagtggaagaggcagttaaaccagctcagcaagagcgagttcaacacgtacaaacgcagcggcatcatggaagtagaccggagcgaagcgaaggagggtcttaagcgtggcgagaccaccaagcacgcagtgtcacgggggaccgcaaagctacgttggttcgtggagcgcaacctagtgaagcccgagggtaaagtgatcgacctgggctgcgggcgcgggggttggagttattactgcgccgggctaaaaaaggttacggaggtcaaaggctacaccaaggggggccctggtcacgaagagcccattcccatggctacctacgggtggaatctggtgaagctccactccgggaaggacgttttcttcatgcctcccgagaagtgcgataccctgctatgcgacatcggggaatcctcgccgaatccaaccatcgaggagggccgcaccctccgagtcctaaagatggtggagccctggttgcggggcaatcaattctgcattaaaatcctaaacccatatatgccctcagtcgttgagacccttgagaggatgcagcgaaagcacggagggatgcttgtgcggaaccccctgtccaggaatagcactcacgaaatgtactgggtcagctgcgggaccggcaatattgtgtctgctgttaatatgaccagccggatgctactgaaccgctttaccatggcccacagaaagcccacgtacgaacgggatgttgaccttggcgccgggacgcggcacgtggccgtggagcccgaggtagccaacctggacatcattggccagcgcattgagaacatcaagaacgagcacaagtctacctggcactatgatgaagataacccgtataagacttgggcttaccacggctcctatgaagtgaagccgtcaggctccgcgtcaagtatggtgaacggggtcgtacggctgctcaccaaaccctgggacgtcatccccatggtgacccaaatagccatgaccgatactacgccgtttggtcaacaacgagtgttcaaggaaaaagttgacacccggacgccccgagccaagcggggaaccacacaaatcatggaggtgactgcgaagtggctatgggggttcttaagccgcaataagaaaccccgcatatgcacccgcgaggagttcacccggaaagttcgctcaaacgcggccattggtgccgtctttgtggatgagaaccaatggaactcagccaaagaagcggtggaggacgagcgattttgggacctcgtccatagggagcgcgagctgcacaagcaaggaaagtgtgcaacgtgcgtgtacaatatgatgggcaagcgagaaaagaagttgggagagtttgggaaggcgaagggaagccgtgccatctggtacatgtggcttggggccagattcctggagttcgaagcgctgggcttcatgaatgaggaccactggttctcccgcgagaacagccttagcggagtggaaggtgaagggctgcacaagctgggctatatcctccgtgacatcagcaagataccgggcgggaacatgtacgccgatgataccgccgggtgggatacacgcgtcacggaagacgaccttcagaatgaagccaaaatcacggacataatggagccagagcatgccctgctcgcgaccagtatattcaagttaacctaccaaaacaaagttgtgcgggtacagcggcccgccaagaatgggacagttatggacgtgatctcgcggagagaccaaagaggctccggtcaggtcgggacgtacggcctgaatacatttaccaacatggaggttcagctcatacgacagatggagagcgaaggaatcttcctgccgtcagagctggagacgccgaatctcgccgagagggcgctcgactggttggagaagcatggcgcagaacgccttaagcggatggcgataagcggggatgattgcgtggtcaagcctatagatgacagattcgcgacggccctgaccgccctgaacgatatgggcaaggtacggaaggacatcccgcaatgggagccatccaagggttggaacgattggcagcaggtaccgttctgctcacaccactttcaccagctcatcatgaaagatgggcgcgagatagtggttccgtgtaggaaccaggacgagctagtcggtagggccagggtctcccagggcgcgggctggagcctgcgcgaaaccgcctgtttgggtaagtcttatgcgcaaatgtggcaactgatgtatttccatagacgcgatcttaggctcgccgcgaacgccatatgctccgctgtgccagtagattgggttcccacaagccgcaccacgtggtccatccacgcccaccaccagtggatgaccacagaggacatgctgagtgtgtggaaccgcgtgtggatcgaagaaaatccgtggatggaagacaagacccacgtcagctcgtgggaagaagtgccttatctggggaagcgggaggaccaatggtgtggatctctcatcgggctaacggcaagggcgacctgggctacgaacatacaggtcgccatcaaccaggtacggagactgatcggaaatgagaactatctcgactacatgaccagcatgaagcgcttcaagaacgaatccgactcggaaggggctctctggtaa

SEQ ID NO: 23993 - RNA, 9879 nt, synthetic construct
  misc_feature 1..9879: note = derived and/or modified CDS sequence (opt11) from DENV-1__KJ189362__SS-prME
  source 1..9879: mol_type = other RNA
tcggtcacaatgctcctcatgctgcttcccaccgcgttggcgtttcacctgacgacccggggcggggaaccccacatgatcgtaagcaaacaggaacggggtaaaagccttctgttcaagaccagcgcgggggtgaatatgtgcacgctgatcgcaatggacctgggcgaactgtgcgaggacaccatgacctacaaatgccccagaatcacagaggccgagcccgacgacgtggactgctggtgtaacgccaccgacacttgggttacctatggtacctgcagtcagaccggcgagcaccggcgggaaaagagatccgtcgccctggcgccccacgtgggtctgggtctcgagacccgcaccgagacctggatgagcagtgagggggcctggaagcaaatccagcgggttgaaacctgggcgctgcgccatccagggttcacggtaatcgcgttcttcctggcgcacgccatcggcacgagcatcactcagaaagggatcattttcatactgttgatgctggtgaccccctccatggccatgcgctgcgtcggcatcggcaatcgtgacttcgtagagggcctcagcggcgccacgtgggtggacgtcgtactggagcacgggagttgcgtgaccacaatggcgaagaacaagccaacgcttgacattgaattgctgaaaacggaggtcaccaaccccgcggtattgcgaaagctctgcatcgaagccaagatcagcaataccaccacggactcccgatgcccgactcagggggaggccactttggtcgaggagcaagacgccaacttcgtctgccgacgcaccctggtagaccgcggctgggggaatgggtgcggtctgtttggcaaggggtctttgctaacttgtgctaagtttaagtgcgtgacgaaattggagggtaagatcgtccagtatgaaaacctgaagtactccgtgatagtgaccgtccacaccggggaccagcaccaagtgggtaacgagactaccgagcacggcaccatagcgacgatcacgccccaggcacccactagcgagatccagctgaccgactatggggcactcaccctggactgcagccctcgcaccggcttagacttcaacgagatggtcctcttgacgatgaaggagaagagttggctggtacacaagcagtggttcctcgatctgcctttaccctggacctctggggcaagcacgagccaagagacctggaaccggcaggacctcctggtcaccttcaagaccgcccacgcaaagaagcaggaggtcgtggtgttgggcagtcaggagggggccatgcatacagccctcaccggggcgactgagatccagacttcaggcaccaccacgatatttgccgggcacctgaagtgtcgccttaagatggataagctcaccctaaagggcatgtcctacgtcatgtgtacagggagcttcaagctggagaaggaggtggcggagacccagcacgggaccgtgcttgtgcaggttaagtatgagggcaccgacgccccctgcaaaatccccttctctacccaggatgagaagggcatgacccagaatggcaggcttatcacggccaaccccatcgtgaccgacaaggaaaagcccgtcaacatcgagaccgagccgcccttcggcgaaagctacatcgtggtaggcgccggcgagaaggcgctgaagctgtcctggttcaagcgcgggtcttcgatcggcaagatgttcgaggcaaccgcacgaggtgcacgcaggatggccatactcggagacactgcgtgggatttcgggagcattggcggagtattcacctccgttgggaagctggtgcatcagatctttggtaccgcttacggggtgctgttcagcggcgtgtcctggaccatgaagatcggtatcggtatcctcctcacgtggcttggcttaaacagcaggagcacctctctatccatgacatgcatcgccgtggggatggtcaccttatacctcggggttatggtgcaggctgatagcgggtgtgtcatcaactggaaaggccgagaacttaagtgcggctccggcatctttgtgacgaacgaggtgcacacctggaccgaacagtacaagttccaggctgacagccctaagcggctgagcgccgccataggcaaggcatgggaggagggggtatgcggcatccgctcggccaccagactcgaaaacatcatgtggaagcaaatcagcaacgagctgaaccacatcctactcgagaacgacatgaagttcaccgttgtggtcggggacgccaacggcatattggcccaggggaaaaagatgatccgcccccagcccatggagcacaagtacagctggaagtcctggggcaaggccaaaatcatcggagccgacattcaaaacacgaccttcataatcgacggacccgacacgccagagtgtcccgatggccaacgggcctggaacatctgggaggtggaggactacggattcggtgtgttcaccacgaatatctggctgaagctccgtgactcctatactcagatgtgcgaccaccggttgatgtcagcggccatcaaggactccaaagccgtccacgccgacatgggatattggatcgagagcgagaaaaacgagacctggaagctggctagggcgtcattcatcgaagtgaagacctgtacatggcccaagagccacaccctctggtccaacggggtgctggagagcgagatgatcatcccaaagatctacggcgggccgatctcccagcataactaccgtcccgggtacttcacccagactgccgggccctggcacttaggcaaactcgagcttgacttcgatctgtgcgaaggcacaaccgtcgtggtggacgaacattgcgggaaccgcggtccgagcctccgtaccaccacggtgacgggaaaaatcatacacgagtggtgctgcagatcctgtactctgccgcccttgcgtttccgcggcgaggacgggtgctggtatggcatggagattagacccgtgaaggagaaggaggagaacctcgtacgcagcatggtctccgcaggcagcggggaggtggactcgttctccctggggatattatgtgtaagcattatgatcgaggaggtcatgcggtcccgctggagccgcaaaatgctcatgactgggacgctggccgtgttcctgctgctgatcatgggacagctgacctggaacgacctgatccggctctgtatcatggtgggtgcaaatgcatccgaccgtatgggcatgggcacaacttacctggcattgatggcgacgttcaagatgcgcccgatgttcgcggtagggctattgttccgacggttaaccagccgcgaggttctgttactaacaatcggcctgtccctagtggcctcggtcgagctgcccaactccttagaggaactgggcgacggtttggcgatgggcatcatgatgctgaagctgctcacggagttccaaccccaccagctctggacgacactgctcagcctgactttcgtacggacgactctgtcccttgactacgcctggaagaccaccgccatggcgttgagcatcgtctcactgttccccctgtgcctatctaccacgtcgcagaagaccacctggttaccggtgctcctgggcagcttcggctgcaagcccctgaccatgttcctcatcactgagaacaagatctggggacgcaagtcctggcccctgaacgagggcatcatggcgatcgggatcgtgagcattcttctcagtagcctcctcaagaacgacgtccccctcgccggcccgttgatcgccggcgggatgctgatagcctgctatgtcatctcggggtccagcgcagacctttccctggagaaggctgctgaagtctcctgggaacaagaggccgagcactccggcgcttctcactccatcctggtggaggtgcaggatgacggcactatgaagataaaagacgaagaacgggacgacaccctcaccatccttctaaaagccaccctcctggccgtgtccggcgtgtacccaatgtccatacccgctacgcttttcgtgtggtacttttggcagaagaagaagcaacgctcaggcgtgctctgggacaccccctccccgcccgaggttgagcgggccgtgctagacaatggtatataccggatcctgcagcgggggttgttgggccgctcccaagttggggtaggcgtgttccaggacggtgtgttccatacaatgtggcacgtcacccggggcgccgtgttaatgtaccagggtaaacgcttagagccgtcctgggccagtgtgaagaaggacctcatctcctatgggggaggctggaggtttcaagggtcctggaatacgggggaggaggtccaagtgatcgcggtggagcccggaaagaacccgaaaaacgtccaaacgactcccggcaccttcaaaacgcccgagggggaagtgggcgccatcgcgttagacttcaagcccggcacctccggtagcccgatcgtaaaccgtgaaggcaagatcgtcggtctgtacggcaatggggtcgtgactacgtccgggacctacgtctctgccatcgcccaggccaaggccagccaagaggggccgctccctgaaatcgaggacgaggtgttcaagaagcggaacctgactatcatggatctgcacccgggctccgggaagacccggagatacctcccggccattgtccgtgaggccatcaagcgcaaactacggaccctgattctcgcgcccacgcgcgtcgtggcctcggagatggccgaagccctaaaagggatgcccatccggtaccaaaccaccgccgtcaagtcggaacatactggccgtgagatagtcgacctgatgtgtcacgcgaccttcactatgaggctgctgtcaccggtgagagtgcccaactacaacatgatcataatggatgaggctcacttcaccgatccagcctctatcgccgcacggggttacataagcacacgcgtaggcatgggagaagcggccgccatcttcatgactgctacgccgcccggatccgtggaggccttcccccagagcaatgcggtgatccaggacgaggagcgggacatcccagaacgctcctggaatagcggctacgactggatcactgactttcctggcaaaaccgtctggttcgtgccttccatcaaaagcggcaacgacattgccaactgccttcggaaaaacgggaagagagtgatacagctctcccgaaagacgttcgacaccgagtaccaaaagaccaagaacaatgattgggattatgtcgtgacaacggacatttcggagatgggagccaacttccgcgccgatcgggtcatcgacccccgccggtgcttaaagcccgttatactgaaggacgggccggagagagtgatcctcgcggggccgatgcccgtgaccgctgcatctgcggcccagcggcgcggccgcatcggacgtaaccaaaataaagaaggagaccagtacgtctacatggggcagcccctaaacaatgatgaagaccacgcgcactggaccgaggccaagatgctgttagacaacatcaacacccccgaaggaatcatcccagccctgttcgagcccgagcgcgaaaagtccgccgccattgatggggagtaccggctgcgcggcgaggcgcggaagacctttgtggaactcatgcgacggggagacctgcccgtctggctatcctacaaagtagccagcgaaggctttcagtattcggaccgccggtggtgcttcgacggcgagcgcaacaaccaggtgctcgaggaaaacatggacgttgagatctggaccaaggagggtgagcggaagaaattacgtcctcggtggctggacgccagaacttatagcgacccgctcgcgctgagagagttcaaggagttcgcagctggacgccggtcggtgtccggggacctgatcctcgaaatcggtaagttgccgcagcacctaactctacgcgcacagaatgccctcgataacctggtgatgctacacaactccgagcagggcgggaaggcataccggcacgcgatggaggagctgcccgacaccatcgagacactgatgctcctggccttaatcgccgtgctcacgggcggggtgaccctgttctttctgtccggcaagggcctggggaagacgtcaattggcttactgtgcgtgactgcctcctctgtactcctgtggatggccagcgttgagccgcactggattgcggccagcatcatcctggagttcttcttgatggtgctactgataccggagccggacaggcagcggacgccccaagacaaccagttggcctacgtcgtcatcggtttattatttatgatccttaccgtagccgcaaacgagatgggcctgctggaaacaactaagaaagacttagggatcggctacgtagcagccgaaaatcaccaacacgccactatgctggacgtcgatctacaccctgcctcagcctggaccctctatgcggtggctacgacggtcatcactcccatgatgcgccacaccatcgaaaataccacggccaacatcagcctgaccgccattgccaaccaggccgccattctgatgggcttagacaaagggtggcctatctccaagatggatatcggcgtgcccctgctagccctggggtgctatagccaagtgaatccgcttaccctcacagccgccgttctcatgctggtggcgcactacgcaatcatcggccccggcttgcaggccaaggccacgcgcgaggcgcagaagcggaccgccgcgggcatcatgaagaaccccaccgtggacggtatcgtcgccatcgacctcgaccccgtggtatacgacgcaaagttcgagaagcagttggggcagattatgctgttgatcttgtgcacctcccaaatactgctcatgcgcacgacttgggcgttatgcgagtctattaccctcgccaccggcccgctcacgaccctatgggaagggtccccaggtaagttctggaacaccaccatcgccgttagcatggctaacatattccgaggcagctacctggcaggggcgggtctcgctttctcactcatgaaaagcctgggtggagggcgccgggggacgggcgctcagggggagacgctcggcgagaaatggaagcgccaactgaatcagctgagcaagtcagagtttaatacctacaaacggtccgggataatggaggtcgaccggtcggaggccaaggaaggactcaaacgtggggagacaactaagcatgctgttagccgtggcacagccaagttgcggtggttcgtcgagcgcaacctggtgaaaccagaggggaaggtgatcgatctcgggtgtggccgcggcgggtggtcttactactgtgctgggctcaagaaagtcacggaggtcaagggctacacgaaaggcgggccgggtcatgaggagccgatccctatggccacctatgggtggaacctcgtgaagctacattccggaaaagacgtcttcttcatgccgccggagaagtgcgacacgctcctgtgtgatatcggggagagctccccaaaccccaccatcgaggagggacgcacgctacgggtcctgaagatggtggaaccctggcttcgaggtaaccagttctgcattaagatcctgaacccctatatgccgagcgtagttgagacacttgaacgtatgcaacgcaagcatgggggcatgcttgtgcgtaatcccttgagtagaaatagcacgcacgagatgtactgggtctcctgcggaacgggcaacatagtatcagccgtaaacatgacctcccgtatgttgctgaaccggttcaccatggcgcatcgcaagcctacgtacgagcgagacgtcgacctcggcgccggaacccgccacgtcgccgtggaacccgaggtcgccaacttggacatcatcggccagcggatcgagaatattaaaaacgagcacaagagcacctggcactacgacgaggacaacccgtacaaaacctgggcgtaccacgggagctacgaagttaagccctctggctccgccagctccatggtgaacggtgtcgtgcgcctgctaacgaaaccctgggacgtcattccaatggtgacccaaatcgccatgaccgacactacgccgtttggccaacagcgggtgttcaaggagaaggtcgatacacgcacgccccgggccaagcgcggcaccacgcaaatcatggaagtgaccgccaagtggctttgggggttcctgagccggaataagaaacctcgcatatgcacgagggaagagttcacccgcaaggtgcgctcaaacgccgcgatcggggccgtcttcgtggacgagaaccagtggaactccgcgaaagaagccgtggaagacgagcgcttctgggacctggtccaccgggagagggagctacacaagcaagggaagtgcgcaacgtgcgtgtacaacatgatgggtaaacgggagaaaaagctgggggagttcggcaaggcaaaggggagtcgtgccatctggtacatgtggttgggagccaggttcctcgagttcgaggccttgggcttcatgaacgaggaccactggttctcccgcgaaaacagcctgtccggggtggagggcgaagggttacataaactgggctacattctgcgcgacatcagcaagatcccgggcgggaacatgtacgccgacgacaccgcgggctgggacacccgggtcacggaagacgatctccaaaacgaggccaaaattactgatatcatggagccggagcacgctctgctggccacgtccatcttcaagctgacgtaccagaataaggttgtgcgcgtccaacggccagcgaagaacggcaccgtgatggacgtgataagccgcagagaccagcgtggttccggccaggtcgggacctacggcctgaacactttcacaaacatggaggtgcagctgattcgacagatggagagcgaggggatattcctcccatccgagctagaaaccccgaacctggccgagcgagccctcgactggctcgagaaacacggcgccgagcgattaaagcgcatggccatctccggggacgattgcgtggtcaagccgatcgacgatcggttcgcgacggctctaaccgccctgaacgacatgggtaaggtccgcaaggacatcccgcagtgggagccctccaagggctggaatgactggcaacaagtcccgttctgcagccaccatttccaccagctaatcatgaaggacggccgggagatcgtcgtgccctgccgaaaccaagatgagctcgtgggccgggcccgcgtctcccagggggccggctggtcgttacgcgagacggcttgcctgggaaagtcctatgcacaaatgtggcaactcatgtacttccatcgccgggacctacgcctggctgccaacgccatatgctcggccgtgcccgtggattgggtccccacaagtcggaccacgtggtccatccacgcccaccaccagtggatgaccacggaagatatgctcagcgtgtggaaccgggtatggattgaggagaacccgtggatggaaaacaagacccacgtctccagctgggaggaggtgccctaccttggcaagcgcgaggaccagtggtgtggctccctgatcgggctcaccgcccgggccacctgggcgaccaacatccaggtggccattaaccaggtccgcagactgatcggcaacgagaactacctggactacatgaccagcatgaaacgctttaaaaacgaatccgactctgagggggctctctggtag

SEQ ID NO: 23994 - RNA, 9879 nt, synthetic construct
  misc_feature 1..9879: note = derived and/or modified CDS sequence (opt11) from DENV-1__KJ189363__SS-prME
  source 1..9879: mol_type = other RNA
tccgtgactatgctgctaatgctattaccgactgcgcttgcgttccacctaaccacgcggggaggcgaaccccatatgatagtatccaagcaggaacgcggcaaaagtctcttgttcaaaacctcagcaggcgtgaacatgtgcaccctaattgcaatggacctaggtgaactctgcgaagataccatgacgtacaaatgtccgcgcataacggaagccgaacctgatgacgttgattgttggtgcaacgccaccgatacctgggtgacgtacggtacgtgcagtcagacgggagaacaccgacgcgaaaagaggagtgtagccctggcaccccacgttggcctgggcctcgaaacacgaacagagacgtggatgagcagcgaaggcgcatggaaacaaatacagcgggtagagacgtgggcgttacgacacccaggcttcatggttattgcatttttcctagcgcacgcgattgggacctcaataacgcaaaaaggtattatctttatcctgttgatgctagtaactccaagtatggccatgcgttgtgtcggtatcggaaatcgcgactttgtcgaaggactaagcggggccacatgggtagacgtggtactcgaacatggaagctgcgtgacgacaatggcaaagaacaaacccacactagacatcgagctgcttaaaaccgaggtcacgaacccagccgtcctacgcaagctctgcatcgaagcaaaaataagtaataccaccaccgacagccgctgtccaacccaaggggaagcaacattagtagaagaacaggacgcaaacttcgtatgccgtaggaccttcgtcgacagaggatgggggaatggctgcggactttttgggaaaggatcactgctcacatgcgcaaaattcaagtgtgtgacaaaactagaggggaaaatcgttcaatacgaaaatctgaaatactccgtgattgtgactgttcatacaggcgatcagcaccaagtaggcaacgagacgacagagcacgggactatagctaccatcacacctcaagcccccacgtcagaaatacagctaactgattacggagcgctgacattagactgcagcccgcggacaggattggattttaacgaaatggtgctcctaacaatgaaggagaaaagctggctagtccacaaacaatggtttctggacctgcccttgccctggacgtcaggcgccagcacgtcacaagaaacatggaaccgccaagacctcctagtcaccttcaaaaccgcacacgcaaagaaacaggaggtagtagtactcggaagtcaggaaggggcaatgcacaccgcattgacgggcgccacggaaatccaaaccagtggaaccaccaccattttcgcaggacacctgaaatgccgcttgaagatggacaagctcaccctaaagggaatgtcatatgtaatgtgtactgggtcattcaaattagaaaaagaagtagcggaaacgcaacacggtaccgtactcgtacaggtaaaatatgaaggtactgacgcgccttgtaagattccttttagtacccaagatgagaagggagtgacccaaaatggtcgtctaatcaccgcgaacccaatagtcacagacaaggagaaaccggtaaacatcgaaaccgaaccacccttcggcgagagctacatcgtagtcggagcaggcgagaaagccctcaaactaagctggtttaagagggggagctctattggcaagatgttcgaagcgacggctcggggcgcgcgccgaatggccattctcggtgacacagcgtgggacttcggcagcataggcggagtatttacaagcgtagggaagctagtccatcaaatatttggaacagcgtacggggtactatttagtggagtgagctggacaatgaaaataggcattggaatcctcttgacgtggctcggcctgaactcgagaagtacaagtctaagcatgacttgcattgccgtcggcatggtaaccttgtatttaggcgtcatggtacaggcagattccggatgcgtgatcaattggaaggggagagaactaaagtgtggatccggtatttttgtgacaaatgaggtgcacacatggacagaacagtacaaattccaagcggactcaccaaaaaggttatcagcagcaataggaaaggcctgggaggaaggagtatgcggcatccgaagcgccacacgactggaaaatataatgtggaagcagatatctaacgaactgaatcacatactactggaaaatgatatgaaatttaccgttgtagtaggcgacgctaacggtatcctagcccagggcaagaaaatgataaggccgcaaccgatggagcacaaatatagctggaaatcctggggaaaagctaagatcatcggcgcagacatacagaacactacattcatcatagacggaccggacacgcccgaatgcccagacggtcaacgagcctggaacatatgggaagtagaagactacggcttcggcgtatttacaacaaatatctggctcaaactacgcgactcgtacacccaaatgtgcgaccatagacttatgagtgcagcaataaaagactcaaaagctgtgcacgcagatatggggtactggatagagtctgagaaaaacgaaacatggaagctagcacgagcttcattcatagaggtaaagacgtgcacgtggccgaaatcacacactctgtggagcaacggggtactggaatccgaaatgatcattccaaaaatatatgggggccccatatcgcagcataactacagaccgggctactttacacaaactgcaggaccgtggcacctgggcaaattggaattagactttgacctatgcgagggaacaacggtggtcgtagacgaacattgcggaaaccggggaccaagcctgcggacaacaacagttacaggaaaaataatacacgaatggtgctgcaggagctgcacactaccgcctttacgattcagaggggaagacgggtgctggtacggaatggaaatccgcccagtgaaggagaaagaggagaacctagtgcgctctatggtaagcgcaggaagcggtgaagtagacagcttcagcctcggcatcttatgcgtttccatcatgatagaagaggtgatgaggagccgctggtctcgcaagatgctcatgacagggacactagccgtatttctacttctcatcatggggcaacttacgtggaacgatctcatccggctctgcatcatggttggggccaacgcgtcagaccgcatgggtatgggcacaacgtacctggccctaatggccacgttcaaaatgcgaccaatgtttgccgtcggtcttctcttcagacgtctcacctccagagaggtgttgctactgacaatcggcctgtctctggtagcaagcgtagagctacccaatagtctcgaagaattaggagatggcctcgcgatgggcatcatgatgctgaaattactcacggaatttcagcctcaccaactttggacaaccctcctatccctgacattcgtaaaaaccacactctccctagattacgcctggaaaacgacagcaatggcactttccatcgtatccttgttccctctgtgtttatcaaccacatctcaaaagacaacctggttacccgtcttactcggctcgttcggatgcaaacccctcacgatgttcctaattacggagaacaagatctggggccgaaagagctggcctcttaacgagggtataatggctattggcatagtatccatcctgctgagtagcctactgaaaaatgatgtcccactcgcaggccctttaatcgctggagggatgctgatagcgtgctatgtgatttccggaagttcagcagaccttagcctagaaaaagcagcggaagtaagctgggagcaagaagccgaacattcaggggcatcccacagcattctcgtagaggtgcaagatgacggaacaatgaaaatcaaagacgaggaacgtgacgatacgctgacaatactactaaaggcgacactattggctgtaagcggcgtgtatccaatgagcattcccgcaactctctttgtgtggtatttctggcaaaagaaaaagcagcggagcggggttctgtgggacaccccctcgccacccgaagtagagagggcggtactagacaacggcatttacaggattctacaacgtggcttgctcggacggtctcaggtgggagtaggcgtattccaagacggtgtattccacaccatgtggcacgttacccgcggcgccgtcctgatgtaccagggcaagcgcctagaaccaagctgggcgtctgtgaagaaggacctaatcagctacggcgggggatggaggttccaaggatcgtggaatacgggagaagaggtccaggtaatagctgtagaaccagggaaaaacccaaagaacgtccagacaacccccggcacatttaaaacacccgagggagaagtaggggcgatagccctcgacttcaaaccagggacctcaggctcacctattgtgaacagagagggaaaaatagtgggactctatggaaacggcgtagtgaccacttccggtacgtacgtatcggcaattgcacaggcgaaagcgagtcaagaaggtccactgccagaaatagaggacgaagtgttcaagaaaagaaacttaacgataatggacttacacccgggatcagggaaaacaagaagatacctcccagccatcgtcagagaagcgataaaacggaagctccggaccctgatactagctcccacacgggttgtagcctctgaaatggccgaggcattaaaggggatgccaattcgctaccagactacggcggtgaaaagcgaacacacaggacgtgagatcgtcgatctcatgtgccacgctacgttcactatgcgcctcctatcgccggtccgcgtacccaactacaatatgatcatcatggatgaagcacatttcacggaccctgcatccatagcagcacgcggatacataagcactagagtaggcatgggagaggcagcagcaatctttatgacggcaaccccgccggggtcggtggaagccttcccgcaaagcaacgcagtgatacaggatgaggagagagacatcccggagagaagctggaacagcgggtacgactggatcaccgacttccccgggaagaccgtgtggttcgtccctagcatcaaatccggcaacgacatcgccaactgccttaggaaaaacggaaagcgagtgatacaactatcccgcaagacgttcgacaccgaataccaaaagaccaaaaacaatgactgggactatgtagtgactactgacataagcgaaatgggtgccaacttccgggcggatagagtcattgatcctcgccgatgcctaaaaccggtaatcctaaaagacgggccagaaagggttatcctagcaggaccaatgcccgttacagctgcaagcgctgcacagagacggggccggattggtcgaaaccaaaacaaagagggcgatcagtatgtgtatatggggcaacccttaaacaatgacgaagatcacgcacactggacggaggcgaagatgttgctggataacatcaacacgccggagggaataataccagcactctttgaacccgaacgcgagaaaagcgccgctatagacggggaatatcgactacggggagaagcgagaaagacattcgtagaactaatgagacgtggcgacctgcccgtatggctgtcctacaaagtcgcaagcgaaggatttcagtactccgacagaagatggtgcttcgatggagaacgaaataaccaagtgctagaggaaaacatggacgtcgaaatatggacgaaagagggcgaaaggaaaaagctcaggccaagatggcttgacgcccgaacgtattcggacccgctagcactgcgagagtttaaggagttcgcggcgggacgccgcagcgtaagcggcgacttgatactcgaaataggcaaattgcctcaacatctgacactgagggcccaaaacgcgttagataaccttgtcatgctgcacaactccgaacaaggtggaaaggcctacagacacgcaatggaagaactaccagacacaatcgaaaccctaatgctcctagcactaattgccgtcctaacaggcggagtaactctgttcttcctgagtggcaagggacttggtaaaacaagcatcggattattgtgcgtaaccgcctcaagtgccctattatggatggccagtgtcgagccgcactggattgcggcgagtatcatcttggagttcttcttaatggtgttgctaataccagagccagaccgccagagaacaccgcaagataaccagctggcatacgtggttatcgggttactctttatgattctcacagtggcagcaaacgaaatgggcctgcttgaaacgacaaagaaagacctcgggataggatatgtcgcggcagagaatcaccaacatgcgacaatgctcgacgtcgacctccacccagctagcgcctggaccctatacgctgtggccactacagtaataacaccaatgatgaggcacacgatcgaaaacactacagccaacatatcgttaacagcaatcgccaatcaggcagcaattctcatgggcctagataaaggatggccaatatcgaaaatggacatcggggttccacttttggcgcttggttgctacagtcaagtcaatcccctcacactaaccgccgccgtattgatgctagtggcccactacgcaatcataggcccagggctgcaagcaaaggccacgcgcgaagcccaaaagcgaacggctgcgggcatcatgaagaacccgacagtagacggaatagtggcaatagacctcgacccagtagtctacgacgcaaaattcgagaaacaactcgggcaaataatgctgctgatcctctgcacgtcgcaaatattgctaatgagaacaacatgggcactatgtgaatcaatcaccctcgccacaggaccgctcacgacgttatgggagggatcacccggcaaattctggaacactaccatagcagtatcgatggcaaacatcttcagggggtcatacctcgccggtgcagggctagctttcagcctcatgaaatctctcggaggtggccgtagggggacaggcgcacaaggggaaacattaggcgagaaatggaagcgacaactgaaccaactatcaaaatccgagttcaacacgtataaacggagtggtatcatggaggttgacagaagtgaggcaaaagaaggccttaagcggggcgagacaaccaaacacgccgtaagccggggaaccgcgaagctgcggtggtttgttgagcgtaacctcgtgaaaccggaaggtaaagtgatcgacttgggatgcggaaggggcggatggtcgtactactgcgcaggcttgaagaaagtcaccgaggttaagggttacacgaaagggggaccaggccacgaagaaccaatcccaatggcgacctatggctggaacctagtaaaactccacagcggcaaagacgtattcttcatgccccctgaaaagtgcgacaccctactatgcgatattggggagtcatcaccgaaccccacgatcgaggagggccgaacactaagggtcttgaagatggttgaaccttggcttcgaggcaaccagttctgcataaagatactaaacccgtacatgccgtcggttgtcgaaactttagagaggatgcaacgaaaacatggaggcatgctggtccgaaatccactttctcggaactcgacacatgagatgtactgggttagctgtggtaccggaaatatagtatctgccgtaaacatgacaagcagaatgttgcttaaccgcttcaccatggcccaccgaaagccaacgtacgagagagacgtcgatttaggcgcaggaactcggcacgtggcagtagaacccgaagtcgcgaatctggacattatcggtcagcgaattgagaacatcaaaaacgagcacaagtccacgtggcactacgacgaagacaacccctacaaaacctgggcttaccatggaagttacgaggtaaaaccttcaggctcggccagcagcatggtcaacggggtggtgaggctactaaccaaaccgtgggatgtcatcccaatggtgacccaaatcgcgatgacggatacaactccgttcgggcagcaacgcgtattcaaagagaaagtcgacacacgaacgccgcgcgcaaagcgcggaacaacacaaataatggaggtaaccgccaaatggttgtgggggttcctcagtcgaaacaagaaaccgcgcatatgtacacgagaggagttcacgaggaaggtaagaagcaacgccgcaataggcgcggtgttcgtagatgaaaaccaatggaatagcgcaaaggaagccgtggaagacgagagattctgggatcttgtgcaccgggagagagaactgcacaagcagggaaaatgtgcgacctgcgtgtacaacatgatggggaagcgcgaaaagaagctcggagagttcggaaaagccaaaggatcgagggcaatatggtacatgtggctaggcgccagatttctcgagttcgaggcgttgggcttcatgaacgaagaccactggttttcccgagagaactctctctcgggcgtggaaggagagggcctccacaaacttggatacatcttgagggacataagcaaaatcccaggaggaaacatgtacgcggacgatacggccggatgggataccagagtcacagaggatgacctgcagaacgaggcgaaaataacggacatcatggagcccgagcatgccctacttgcaacctccatcttcaaactgacataccaaaataaggtagtccgcgttcaacgccccgccaaaaacgggacggtaatggacgtcatcagccgcagagatcagcgaggaagcgggcaagtcggtacctacggattgaacacgtttactaacatggaggtacagttgatcagacaaatggaatcagaggggatattcctcccgagcgaactcgagacacccaacctcgccgaacgggcactggactggctagagaaacatggggcggagcgcctgaaacgaatggcgatttcgggcgatgactgtgtggtcaaaccaatcgacgaccggttcgccacagcactgacagcactgaacgacatgggaaaagtgagaaaagacatcccacagtgggagcccagcaagggatggaacgactggcagcaggtaccattttgctctcatcacttccaccagctcatcatgaaggatggccgggaaatagtagttccctgccgaaaccaagacgagctcgtcggccgcgcaagagtatcacagggtgcaggatggagcctgcgagagactgcgtgtctagggaaatcttatgcacaaatgtggcaactaatgtacttccatcgacgagacctccgcctagcagccaacgcaatttgcagcgcagtacccgtagactgggtgcccacaagccgaacgacatggtccatacacgctcatcaccaatggatgacgaccgaagatatgctcagcgtttggaacagggtgtggatagaagagaacccatggatggaaaacaaaactcacgtctcgagctgggaagaagtcccgtatctaggtaagcgagaggaccagtggtgcggctccttaatcggactgacggcgagagcgacttgggctaccaacatccaagtagctataaaccaagtgcggagactgatcggcaacgaaaattacctagactacatgacgtcaatgaaacgtttcaaaaacgagagcgacagcgaaggcgccctatggtag

SEQ ID NO: 23995 - RNA, 9879 nt, synthetic construct
  misc_feature 1..9879: note = derived and/or modified CDS sequence (opt11) from DENV-1__KJ189364__SS-prME
  source 1..9879: mol_type = other RNA
agcgttactatgctcttaatgctgctgcccaccgcactcgccttccacctgactacccggggcggggagccacacatgatcgtgagcaagcaggagcggggtaagtccctcttattcaagaccagcgcaggggtgaacatgtgcaccctgatcgccatggacctgggcgagctctgcgaggacaccatgacatacaagtgcccccgcatcacggaggccgagcccgacgacgtggactgctggtgcaacgcaaccgatacttgggtgacctacgggacctgctcgcagaccggggagcaccggcgggagaaacggtccgtggcccttgcgccccacgtgggcctggggctcgagacacgcacagagacatggatgtcttccgagggcgcatggaagcagatccagcgggtggagacctgggccctgcgccaccccgggttcactgttatcgccttcttcctggcacacgccatcggcaccagtattacccagaaggggatcattttcatcctcctgatgctggtaacccccagtatggccatgcggtgcgtcgggatcggcaatcgtgacttcgtagagggacttagcggggccacgtgggtggacgtcgttcttgagcatgggtcctgcgtaaccaccatggccaagaacaagcccaccctcgacatcgagctcctgaagaccgaagtcaccaacccagccgtgctgcggaagctctgcatcgaggccaagataagcaacacgaccacggacagccgctgcccgacccagggcgaggccaccctggtggaggagcaggatgccaacttcgtctgcaggcgcaccttcgtcgaccgggggtgggggaacggctgcgggctgtttggcaaggggtcgctcttaacgtgcgccaagtttaaatgtgtgacgaaacttgagggcaagatcgtccagtacgagaacctcaagtactccgtcatcgtgaccgtccacaccggagaccagcaccaggtggggaacgaaacgactgagcatggcaccatcgcgacgatcacgccgcaggcccccacgtcggagatccagttgaccgactacggggccttgaccctcgactgttccccgcgcactggcctagacttcaatgaaatggtccttctcacgatgaaagaaaagagctggctagtgcacaaacagtggttcctcgatctccctctgccgtggacctccggtgccagcaccagccaggagacctggaaccggcaggacctgctcgtgacgtttaagaccgcccatgcgaagaagcaggaggtcgtggtgctgggctcccaggagggcgccatgcacacggcgctgactggcgccacagagatccagacgagcggtaccaccacgatattcgcagggcatctcaagtgccgtttaaagatggacaagctgaccctcaaagggatgagctacgttatgtgcaccgggagcttcaagttagagaaggaggttgcggaaacccagcacggcacagtgttggtccaagttaaatacgagggcaccgacgctccgtgcaaaatccccttctccacccaggacgaaaagggtatgacccagaacggccggctgatcaccgctaacccgatagtcaccgataaggagaagcccgtcaacatcgagaccgagccgccattcggggaaagctacatagtcgtgggcgctggcgagaaggcgctcaagttatcctggttcaagagggggagctccatcggcaaaatgttcgaggccaccgcccgcggagcccgccgcatggccattctgggcgacacggcgtgggacttcgggagcatcggcggggtcttcacctccgttggtaagctcgtgcaccagatcttcgggaccgcgtacggggtactattcagcggcgtatcctggaccatgaagatcggaatcggcatcctgctcacgtggctgggcctgaacagccggtccaccagcctctccatgacatgtatcgccgtcgggatggtcacgctatacctgggagtgatggtgcaggccgacagcggttgcgttataaactggaagggcagggagctcaaatgcgggagcggtatcttcgtaacgaacgaggtacatacctggaccgagcagtacaagttccaagccgactcgccaaagcggctgtcggcggcgataggcaaggcctgggaggaaggagtctgtggcatccgatccgctacccggctcgaaaatattatgtggaaacagatcagcaatgaactcaatcacatcctgctagagaatgacatgaagttcaccgttgtggtcggggacgccaatggcattctcgctcaggggaagaaaatgatccgcccccaacctatggagcacaagtactcctggaagtcttggggtaaagccaagatcattggagcggacatacagaacacaaccttcattatcgacgggcccgacaccccagagtgcccggacggccagagagcatggaatatctgggaagtggaggactacgggttcggcgtgtttacaacgaacatctggctgaagctgcgggactcctacacccagatgtgcgaccaccgcctcatgtcggcagccatcaaagactccaaggccgtccacgccgacatgggctactggatcgagagcgagaagaacgagacctggaagctggcacgcgcgtctttcatcgaggtgaagacctgcacgtggcctaagagccacaccctgtggtccaacggggtgctcgagagcgagatgataatcccaaagatctacggcgggccgatctctcagcacaactatcgacccggctatttcacccagaccgctgggccgtggcatctcggcaagctggagctcgacttcgacctgtgcgagggcacgaccgtcgtggtggacgagcactgcgggaaccgcggcccatctctgcggaccaccacggtcacgggcaagatcatccacgaatggtgctgccgatcctgcactttaccaccgctgcggttccgtggcgaggacgggtgctggtacgggatggagatccggccagtcaaggagaaggaggagaacctggtacgcagtatggtgagtgccgggagcggggaggtggacagcttctccttggggatcctctgcgtgagcatcatgatcgaggaggtcatgcgatcccgatggagccgcaagatgctgatgaccgggacgttggccgtgttcctgttgctcatcatgggccagcttacctggaacgacctgatccgactctgcatcatggtgggggccaacgcctccgacagaatgggcatgggcacaacatatctggccctaatggctacgtttaagatgcggccgatgttcgccgtcgggctcctcttcagacgactaaccagccgcgaggtgctcctgctgaccataggtctctccctggtggctagcgtcgagctacccaactccctcgaggaactgggagatggactggcgatgggcatcatgatgctgaagctgctgacggagttccagccccaccaactctggacgaccctgctgagtctcaccttcgtgcggacgacattatccctggactacgcctggaagaccaccgccatggccctcagcatcgtatccctgttccccctgtgtctaagcaccacttctcaaaagactacctggctgccggtgctgttagggagcttcgggtgcaagcccctgaccatgttcttaatcaccgagaacaagatctggggacgcaagagctggcctctcaacgagggcatcatggccatcggaatcgtgagcattctgcttagctcgctgctgaagaacgacgtccccttagccggccccctcatcgccggcgggatgctgatcgcatgctacgtcatctcgggctccagcgccgacctatcactcgaaaaggcggccgaagtaagctgggagcaggaggccgagcattctggggccagccactcgatcctggtcgaggtgcaggacgatggcaccatgaagatcaaggacgaggaacgtgatgacaccctgaccatcttactgaaggccaccttactcgcggtgagcggggtctatcccatgtccatccctgccactctgttcgtgtggtacttctggcagaagaagaaacagaggagcggggtgctgtgggacaccccttccccacccgaagtcgaacgtgcagttctcgacaacggcatctatcgcatcctgcagcggggtttgctcggccgctcgcaagtaggagtcggcgtcttccaggacggagtcttccacaccatgtggcacgtcactcggggagccgtgctcatgtaccaaggcaagcgcctggaacccagctgggccagcgtgaagaaagacctgatctcctatgggggaggttggcgtttccagggcagctggaacacgggggaggaagtacaggtgatcgcggttgaaccgggcaagaacccgaagaacgtccagacgacccccggcaccttcaaaacgcccgagggggaagtcggcgcgattgctctcgatttcaagcccggtaccagcggcagcccgatagtgaaccgcgaaggaaaaatcgtcgggctgtatggcaacggggtggttaccacctccggcacttacgtcagcgccatcgcccaggcgaaagcctctcaggagggtcccctgccggaaattgaggacgaggtgtttaaaaagcgaaacctcaccatcatggacctgcacccggggtccggcaaaacccgccggtacctgccggccatcgtgcgcgaggctatcaagcgaaagctccggaccctgattctggcgcccacgcgcgtcgtggccagcgagatggccgaggccctaaagggtatgcccatccgctaccaaaccactgccgtgaaatccgagcacaccgggcgagaaatcgtcgacctaatgtgtcatgcgacgttcaccatgcggcttctaagtccggtgcgcgtgcccaactacaacatgatcatcatggacgaggcccacttcaccgaccccgcatccatcgccgccagaggctacatcagcactcgcgtcggcatgggggaagcggccgccatcttcatgacggcaacgccgcccggctccgtggaggcgttcccccagagcaacgcggtgatccaggacgaggagcgggacatcccagagcgctcctggaactctggctacgactggatcaccgactttcccgggaagacagtctggtttgtgccgagtattaagagcggcaatgacatcgcaaactgcttacggaagaacgggaagcgcgtgatccaactgtccaggaagacgttcgacaccgagtaccagaagaccaaaaacaacgactgggactacgtcgtgaccacggacatctccgagatgggtgccaatttccgcgccgaccgggtaatcgacccccgccgctgcctcaagcccgtcatcttgaaagacgggcccgagcgcgtcatcctagcaggcccgatgcccgtgaccgccgcctccgccgcccagcggcggggacgcatcgggcggaatcagaacaaggagggcgatcagtatgtctacatggggcagcccctcaacaacgacgaagaccacgcgcactggaccgaagccaagatgctgctggacaacataaatacccccgaaggcatcatcccggcccttttcgagcccgagcgcgagaaatcggccgcaattgatggagagtaccggctacgtggcgaggcgcggaagacgtttgtcgagcttatgcgccggggcgacttaccagtctggttatcctacaaggtcgcaagcgaggggttccagtattccgaccgccggtggtgcttcgacggcgagcgaaacaaccaggttctggaggagaacatggacgtcgagatctggaccaaagagggcgagcgaaagaagctccgcccccggtggctggacgcccggacttatagcgacccgctggccctccgggagttcaaggagttcgcagcgggtcgccggagcgtgtccggcgacctgatcctggagatcgggaagttgccacagcacctcaccctgcgggcccaaaatgccctcgacaaccttgtgatgttgcacaattccgagcagggagggaaggcctaccgtcacgcgatggaggagctgcccgacaccatcgagacgctgatgctgctcgccctgatcgcggtgctgaccggcggggtgacactcttctttctgtccggcaagggactggggaagacgagcataggtttactgtgtgtcacggcctcctcagcccttctctggatggcgtccgtcgagccacactggatcgcggccagcatcatccttgagttcttcctgatggtgcttttaatcccggagcccgaccgccaacggacgccccaggacaaccagttggcctatgtggtaatcgggctcctgttcatgattctgacggttgcggcgaatgagatgggactactggagaccacgaagaaggacctggggatcggatatgtggccgccgagaaccaccaacacgccacgatgctcgacgtcgacctgcacccggccagcgcgtggaccttgtacgcagtggccactaccgtgatcacccccatgatgcgccacaccatcgagaacaccacggcgaacatcagcctgaccgccatcgccaaccaggccgccatcctgatgggcttagacaagggctggcccatctccaagatggacatcggcgtccccctcctggccttggggtgctacagccaggtgaacccgctcaccctgaccgcggcggtgctgatgctcgttgcccactacgccatcatcggaccggggctgcaggccaaggcgacgcgcgaggcccagaagcggaccgcggccggcatcatgaagaaccccactgtggatggcatcgtagcaatcgacttagaccccgtcgtgtacgacgcaaaattcgagaaacagctcgggcagatcatgttgctgatattgtgcaccagtcagattctgctgatgcgcacgacctgggctctatgcgagagtatcaccctagccaccggcccgctgactaccctctgggaggggtcccccggcaagttctggaacacaaccatcgcagtatccatggccaatatcttccggggatcctacctggcgggggccgggctggccttcagccttatgaagtccctcgggggagggcgccggggcacgggcgcccagggggagaccctgggcgaaaaatggaagcgccagcttaaccagctgagcaaaagcgagttcaacacctacaaacggagcgggatcatggaggtcgaccgcagcgaagcgaaagagggactaaagcgaggggagaccacgaaacacgccgtgtcccgcggcaccgccaagctccggtggttcgtcgagcgcaacctggtcaagcccgagggcaaggtgattgacctcgggtgtggccggggaggttggagctactactgcgccgggctcaagaaggtgacggaggtgaaaggctacaccaagggcgggcccggccacgaggagccgatccccatggccacctacgggtggaacttggttaaactgcattccggaaaggacgtgttcttcatgccacccgagaagtgcgacacgctgttatgcgatatcggggagagctcccctaatcccacgatcgaggaggggaggacgctgcgggtgctgaagatggtggagccctggctccgcggcaaccagttctgcatcaaaatacttaacccatacatgccgagcgtagtagagaccctggagcgcatgcagcgcaaacacgggggcatgctggtgcgtaatcctctgtccaggaactcgacgcacgagatgtactgggtgtcctgcgggaccggtaacattgtgagcgcggtaaacatgacctctcgaatgctactaaaccggttcaccatggcccaccgaaagcccacgtacgagcgggacgtggatcttggcgccgggacccgccacgtcgccgtagaacccgaggtggcgaacctggacatcatcggtcagcggattgagaacatcaaaaacgagcacaagagcacctggcactacgacgaagacaacccgtacaaaacatgggcgtaccatgggtcctacgaggtcaagccctcgggctccgctagcagcatggtgaacggtgtggtccgcctcctgacgaagccctgggatgtgatccccatggtcacccagatcgccatgaccgataccacgccatttggccagcagcgggtgttcaaggagaaggtggatacccgcacgccccgggccaaacgaggtactacgcagatcatggaggtcaccgccaagtggctgtggagcttcctctcacgaaataagaagccccgcatctgcacccgagaggagttcacccgtaaggtccggtccaacgcggcgataggggccgtttttgtcgacgaaaatcaatggaactccgcgaaggaggctgtggaagacgagcgcttttgggacctggtgcacagggagcgcgagctgcacaaacagggaaaatgcgcaacctgcgtatataacatgatgggcaagcgggagaaaaagctcggggagttcggaaaggccaagggctcccgcgccatctggtacatgtggctgggcgcccggttcctggagttcgaggcgctcgggttcatgaacgaagaccactggttctcaagagaaaattcactatcaggcgtggagggggagggcctgcacaagctgggctacattctgcgcgacatctccaagattccgggtggcaacatgtacgccgacgacaccgccgggtgggacacccgggtgacggaggacgacctgcaaaacgaggccaagataacggacatcatggagcccgagcacgcattgctggccaccagcatcttcaagctgacctaccagaacaaggtcgtgcgcgtccagcgtcctgccaaaaatggaaccgtcatggacgtgatctcccgccgggaccagcgcgggagcggacaggtgggaacctacgggctcaacactttcaccaatatggaagtccagctgatccggcagatggaatccgagggaatattcctgccctctgagctcgaaaccccgaacctggccgagcgcgctctcgactggctcgagaagcatggtgccgagcggctgaagcgtatggcgatcagtggcgacgattgcgtggttaagcccatcgacgaccggttcgccactgcattgacggcgctcaacgacatggggaaagtccgaaaggacatcccccagtgggagcccagcaagggctggaacgactggcagcaggtaccattctgctcccaccacttccaccaactgatcatgaaggacggccgggagatcgttgtcccgtgccgcaaccaggacgaattagttggacgggcgcgcgtgtcgcaaggagctgggtggtccctcagagaaaccgcgtgcctgggcaagagctacgcccagatgtggcagctcatgtacttccatcgccgggacttgagactggccgcgaacgcaatctgcagcgctgtccccgtagactgggtgcccacgtcccgcaccacgtggagcatccacgctcaccaccagtggatgacaaccgaggacatgctctccgtctggaaccgagtctggattgaagagaacccttggatggagaataagacccacgtgtcatcctgggaggaagttccttacctcgggaaacgcgaggaccagtggtgcggcagcctgatcggcctgaccgcccgggcgacctgggccaccaacatccaagtagccatcaaccaggtgcgccggttgatcgggaatgagaactacttagattacatgacctccatgaagcgattcaaaaacgaatccgattcggagggcgccctgtggtaa

SEQ ID NO: 23996 - RNA, 9879 nt, synthetic construct
  misc_feature 1..9879: note = derived and/or modified CDS sequence (opt11) from DENV-1__KJ189365__SS-prME
  source 1..9879: mol_type = other RNA
agcgtgactatgctgctcatgctgctgcccaccgccctcgccttccacttgaccactcgtggcggtgaaccccacatgattgtaagcaagcaggaacgcggcaagagcctcttattcaagacgagcgcgggggtgaacatgtgcaccctcatcgcaatggacctgggtgaactctgcgaggacaccatgacctataagtgtccccgcataaccgaagcggagcccgatgacgtggactgttggtgcaacgctaccgacacctgggtcacctacgggacctgcagccagaccggcgagcatcgccgcgaaaaacggtccgtggcgctggcgccccacgtgggcctggggctcgaaacccgcaccgaaacctggatgagctccgagggagcctggaagcagatccagagagtcgagacctgggccctgcgccaccccgggttcaccgtgatcgcgttcttcctggctcacgctatcggtaccagcatcacccagaagggaatcattttcattctcctcatgctggtcaccccctcaatggccatgcggtgcgtcggcatcggcaaccgcgactttgtggaggggttgagcggcgccacgtgggtggacgtcgtgttagagcacgggtcgtgcgtgaccaccatggccaagaataaacccaccctggacatagagttactgaagacggaggtaaccaaccccgcggtcttacgcaagctctgcatagaggctaagatcagcaacaccactacggactcccgctgcccgacccaaggcgaagctaccctagtggaggagcaggacgccaacttcgtctgccggcgcacgtttgtggacagagggtgggggaacgggtgcgggctgttcggcaagggcagcctcctgacgtgcgcaaagtttaagtgcgtgaccaagctggaaggcaagatcgtccagtacgagaacttgaagtactccgtgattgttaccgtccacactggcgaccagcatcaggtggggaacgagacgaccgagcatggcactatcgcgaccatcacgccccaggcacccacgtccgagatacagctgaccgactacggggccttgaccctcgactgcagcccccggactggccttgactttaacgagatggtactactcacgatgaaggagaagtcctggctggtgcacaagcagtggttcctggacctcccgttgccctggacctccggggccagcaccagccaggaaacctggaaccggcaggacctgttagtgaccttcaagaccgcccacgcgaaaaagcaggaggttgtcgtgctgggctcccaggagggcgccatgcacaccgccttgaccggggccacggagatccagactagcggcaccaccaccatcttcgccgggcacctcaagtgccgcctgaagatggacaagctgacccttaaaggcatgtcctacgtcatgtgtaccgggagcttcaagttggagaaggaggtggcggagacccaacacggaacggtgctggttcaagtgaagtacgagggcaccgacgccccctgcaagatccccttttccacccaggacgagaagggtgtcacccaaaatggccgtttgataacggccaacccgatagtcacggacaaagaaaagcccgtgaacatagagaccgagccgcccttcggggagagctacattgtggtcggcgccggcgagaaggcgctcaagctgagctggtttaagcggggtagctccataggcaagatgttcgaggccaccgcccgaggggcccgccgtatggccatactgggagacacggcgtgggacttcgggagcatcggcggcgtgttcacctccgtggggaaactcgtacaccagatcttcggcactgcttacggggtgctgtttagcggcgtgtcctggaccatgaagatcgggatcggcatcttactcacgtggctgggccttaacagccggtccacctcactttccatgacctgcatcgtcgtggggatggtgactctatatctgggcgtcatggtccaggcggatagcgggtgcgtgatcaactggaagggccgcgagctcaaatgcggttccggcatttttgtcacgaacgaggtacacacttggacggaacagtacaagttccaagccgacagcccgaagcggctgagcgccgcgatcggcaaagcatgggaggagggggtgtgtggcatccgctccgccacccggctcgaaaatataatgtggaaacagatcagcaacgagctgaaccatatcctcctggagaacgatatgaagttcaccgtcgtggtgggggacgcaaacggtatcctggcgcaggggaagaagatgatccgcccccagcccatggaacataagtactcctggaagtcctggggcaaggcgaaaataataggcgccgacatccagaacactacctttataatcgacgggcccgatacaccggagtgtcccgacggacagcgcgcctggaacatctgggaggtcgaggattacgggttcggtgtgttcacaactaacatatggctgaagctgcgcgactcctacacacagatgtgtgaccaccggttaatgagcgccgccatcaaggactctaaggccgttcacgccgatatgggctactggatagagagcgagaagaacgagacatggaaactggcccgcgcatccttcattgaggtcaaaacctgtacgtggcccaagagccacaccctgtggtcaaacggtgtcttagagagtgaaatgatcatccccaagatctacggggggcccatcagtcaacacaactatcggcccggctattttacccagaccgccgggccttggcacttgggcaaactggagctagactttgacctgtgcgagggcacgacggtggtcgtcgacgagcattgcgggaaccgcggcccgtcgctgcggaccaccactgtgaccgggaagatcatacatgagtggtgctgccgctcctgcaccctaccgcctctgcgtttccgcggcgaggacgggtgctggtacggcatggagatccggccggttaaggagaaggaagaaaacctagtacgcagcatggtgtccgccggtagcggggaggtcgactcattctccctaggcatcctgtgcgtgtctattatgatcgaggaagtgatgcggtcccgctggagccgcaagatgctgatgaccgggacactcgcagtctttctactgctgataatgggccagctgacctggaacgacttaatacggttgtgcattatggtgggggccaacgccagtgaccgcatgggcatgggcacgacctacctggcgctgatggccacgtttaagatgcggcccatgttcgcagtcgggctcctgttccgccggcttacaagtagggaggtcctcctgctgaccatcggcctcagtctggtggccagtgttgagttacccaactcccttgaagagcttggggacggcctggcgatgggcataatgatgctcaaactgctgacggaattccagccccaccagctctggacaacgctgctcagcctgaccttcgtgaagaccacgctgtcgttagactatgcttggaaaaccaccgccatggccctctcaatcgtttcactgttccccctgtgcctcagcaccacttcccagaagaccacctggctgccggtcttgttggggtcttttggctgcaagccattgaccatgttcctgatcaccgagaacaagatctgggggcggaagagttggccactcaacgagggcatcatggctatcgggatcgtgagcatcctcctctccagcctcctgaagaacgacgtgcccctggcgggccccctcatcgctggagggatgctaatcgcctgctacgtgatcagcggctcctccgcggacctgagcctcgagaaggccgctgaggtgagctgggagcaggaggcagagcatagtggggccagccactccatcctggtggaggtccaggacgacggaacgatgaaaatcaaggacgaagagcgcgacgataccctgactatcctcctgaaggccacactgctcgccgtgtccggggtgtatccaatgtccatccccgctacactgtttgtctggtacttctggcagaaaaagaagcagcggagcggcgtgctgtgggataccccctcaccgcccgaggtggaaagagccgtcctcgacaacgggatttaccggattctgcagcgcgggctgctgggacgcagccaggtgggggtgggcgtgttccaggacggggtgttccacaccatgtggcatgtaacccgcggcgctgtcctcatgtaccagggcaaacggctggaaccctcctgggcgagcgttaagaaggacttaatcagttacgggggcggatggcgcttccagggctcatggaacactggggaagaggtacaggtcatagccgtggagcccggaaagaatccgaagaacgtgcagaccacccccggcaccttcaagacgcccgagggggaggtcggagcgatcgccctggacttcaagccaggtacttccggcagcccaatcgtgaaccgggagggcaaaatcgtggggctgtacggcaatggagtcgtgaccacctccggcacgtacgtgagcgcaatcgcccaggccaaggcgagccaagaggggcctttgcccgagatcgaagacgaggtcttcaagaaacgcaatctcaccataatggacctgcaccccgggtccggcaagacacggcgctacctaccagccatagtaagagaagctatcaagcgcaagctccgaacactgatactggcccccacgcgggttgtcgcgagcgagatggccgaggcccttaagggtatgcccattcggtaccaaaccaccgcagtgaagtccgaacataccgggcgtgagatcgtggaccttatgtgtcacgccacgttcaccatgcgcttactcagcccggtccgtgtgcccaactacaacatgatcatcatggacgaggcgcatttcaccgaccccgcttccatcgcagcccgcggctatattagcacaagggtgggcatgggggaggccgcggccatcttcatgacagccacgccgcccggatccgtcgaggccttcccccagagcaacgccgtgatccaggacgaggagagagacatccccgaacggtcctggaacagcggctacgactggatcaccgacttccccgggaaaacggtgtggttcgtgcccagtatcaaatcaggcaatgatatcgcgaattgcctacgcaagaacgggaagcgggtgatccaactgtcccggaagacgttcgacaccgagtaccagaaaaccaagaacaatgactgggactacgttgtcaccacggacatctctgaaatgggcgccaatttccgggccgatcgcgtgatcgacccccggcgttgtctcaagccagtgatcctgaaagacgggcccgaacgggtcattttagccgggcctatgcctgtgaccgcggcctccgcggcccagcgtcgcggccgcatcgggcgaaaccagaacaaggaaggcgaccagtacgtctatatggggcagcccctcaacaacgacgaagaccatgcccactggaccgaggctaaaatgctgctggacaacatcaacacccccgagggcatcatcccggcgctcttcgagcccgagcgagaaaagtccgccgccatcgacggggagtaccgcctgagaggcgaggctcgcaagacgttcgtggagctgatgcggcgcggggacctcccagtgtggctgtcctacaaggtcgcgagcgaggggttccagtactccgaccgaagatggtgtttcgacggcgaacggaacaaccaggtgctggaggagaacatggatgtggagatctggaccaaggagggggagagaaagaagctcagaccccggtggttagacgcccggacctacagcgacccgctggccctccgcgagttcaaggagttcgctgccggccggcgcagcgtgtcgggcgacctgatcctggagatcgggaagctgccacagcatctgacccttagagcgcagaacgccctcgacaacctggtgatgcttcacaactccgagcaaggagggaaggcttatcggcacgccatggaggaactcccggacaccatcgaaacgctcatgctgctcgcgctgatagccgtgctgaccggcggcgttaccctcttcttcttgtccggcaagggcctggggaagacctcaatcggcttgctatgcgttacagccagctctgccctgctctggatggcctccgttgaaccacactggatcgcagccagcatcattctggagttcttcttaatggtcctcctaatcccggagcccgaccgccagcgcaccccccaggacaaccagctggcttacgtcgtgatcgggctcctgttcatgatactgaccgtcgccgccaacgaaatgggcctcttagagaccacgaagaaggacttgggtatcggctatgtggcggcagagaaccaccaacatgccaccatgctcgacgttgacctgcacccggcctcggcctggaccctgtacgcggttgcaactacggtgatcacccccatgatgcggcacaccatcgaaaacaccactgccaacatttccctaaccgccatcgccaaccaggcggccatcctcatgggcctggacaaggggtggcccatatccaagatggacatcggagtgccgctcctggccctcggatgctacagccaggtgaaccccctcacattgaccgcagcggtgctgatgttggtcgcgcactacgccatcataggacccgggttacaggcgaaggccacgcgagaggcgcagaagaggacggctgctggcatcatgaagaaccccaccgtcgacggcatcgtggccatcgacctggaccccgtggtctacgacgccaaattcgagaagcagctcgggcagatcatgctgctgatcctatgcacctcccagatcctattgatgcgaaccacctgggcgctctgtgagagcataacccttgcgaccggccccctcacaactctctgggaggggagtccgggcaagttctggaacaccaccatcgccgtaagcatggctaacatctttcgcggctcctacctggcaggggcaggtctggccttcagcctcatgaagtccctcggggggggccggcgcggcacgggcgcccagggggagacgctgggcgagaagtggaagcgtcagctcaaccagttgagcaagagcgaattcaacacctacaagcgctcagggatcatggaagtcgaccggagcgaggcaaaggagggtctgaagaggggggagactacaaagcatgctgtgtcccggggcaccgccaagctccgctggttcgtggaacgaaacctagtcaagcccgagggcaaggtgatcgatctggggtgcggtcgcgggggctggtcttattactgcgccggtctgaagaaggtgaccgaggtaaagggctacaccaagggcggccccgggcacgaggagccgatccccatggcaacctacgggtggaacctcgtcaaactgcactcaggcaaggacgtgttcttcatgccgcccgagaagtgcgacacgttattgtgcgatatcggggagagctccccgaacccaacaatcgaggaaggcaggacactgcgcgtgctgaagatggtggagccctggctacggggcaaccaattttgcatcaaaatcctgaacccatacatgccgagcgtggtggagacactggagcgcatgcagcggaagcacgggggcatgcttgtccggaaccccctgtcccggaacagcacacacgagatgtactgggtgtcctgcgggaccggcaacatcgttagtgccgtcaacatgactagccgtatgctgctcaaccgcttcaccatggcgcaccggaagccaacatatgagcgcgacgtggacttgggcgccgggacccggcacgtggcagtcgagccggaggtcgccaacctggacatcatcggccagcgaatcgagaacatcaaaaacgagcacaaaagcacctggcactacgatgaggacaacccgtacaagacctgggcctaccacgggtcgtacgaggtgaagcccagcggctccgctagctccatggtcaatggggtggtccggctcctgacaaagccgtgggacgtgatccccatggtgacgcagatcgccatgaccgacaccacgccgttcggacagcagcgcgtcttcaaggagaaggtggacacccggacgccccgggccaagcgcggcaccacgcagatcatggaggtgacggctaagtggctgtgggggttcttgagccgcaacaagaaaccccgcatctgcacccgagaggagttcacccggaaggtacgctcaaacgcagcgattggggccgtgttcgtcgacgagaaccagtggaattccgccaaggaggccgtagaggacgagcggttctgggacctggtgcaccgcgagagggagctccataagcaggggaagtgcgcgacgtgtgtgtacaatatgatgggcaagagagagaagaaactcggggaattcggtaaggccaaaggcagccgggctatctggtacatgtggctgggggcccgctttctggaattcgaagccctcggcttcatgaacgaggaccactggttcagccgggagaactccctttccggtgtcgagggcgaggggctgcacaagctcggctacatccttcgggatatcagtaagatcccgggggggaacatgtacgctgacgacacagcgggctgggacaccagagtgactgaggacgatctgcagaacgaggccaagatcacggacataatggagcctgagcacgccctccttgccacctccatattcaagctgacttaccagaacaaggtagtccgggtgcagcgccccgcgaagaacgggaccgtgatggacgtgatcagccggcgcgatcagcgcgggtccggacaggtgggtacgtacggcctcaacaccttcacaaacatggaggtgcaactgatacggcaaatggagtctgaagggatctttctgccctccgagttggagaccccgaatctggccgagcgggccctggactggctcgagaagcacggcgccgagcgtctgaagcggatggcaatctctggggacgactgcgtcgtgaagcccatcgacgaccgcttcgcgacggccctgactgccctcaacgacatgggcaaggtgcgaaaggatatcccccagtgggagccctccaagggatggaatgattggcaacaggtcccattttgcagccaccacttccaccagctgatcatgaaggatggacgggagatcgtggtgccgtgccgaaaccaggacgagctggtcggccgagcgcgggtttcccagggtgccggctggagcctgcgggagaccgcgtgcctcgggaagtcctacgcccagatgtggcagctgatgtactttcaccggcgcgacttacggctcgcggccaacgcgatctgcagcgccgttccggtggactgggtgcccaccagcaggaccacgtggagtattcatgctcaccatcagtggatgaccactgaggacatgctgtctgtgtggaaccgagtctggatcgacgaaaacccgtggatggagaacaagacccacgtatccagctgggaggaggttccgtacctcggcaagcgggaggaccagtggtgcggctccctgatcgggctcacggccagagccacctgggcgaccaatattcaggtcgccatcaaccaggtgcggcgcctgattggcaacgagaattaccttgattatatgaccagcatgaagagattcaagaatgagtccgactcagagggggcgctgtggtga

SEQ ID NO: 23997 - RNA, 9879 nt, synthetic construct
  misc_feature 1..9879: note = derived and/or modified CDS sequence (opt11) from DENV-1__KJ189366__SS-prME
  source 1..9879: mol_type = other RNA
tcagtgacaatgctgctcatgctgctacccacggcgctcgccttccatcttaccactcgcggcggggagccccatatgatcgtcagtaagcaagaaaggggcaaatctctattattcaagacctcagcaggagtgaacatgtgcacgttgatcgccatggacctgggtgagttatgcgaggacacgatgacatataagtgcccccgtatcgctgaggccgagcctgacgatgtggactgctggtgcaacgccaccgacacctgggtaacgtacgggacatgttctcagaccggcgaacaccggcgcgagaaacggtccgtcgcgctggcgccacacgtgggcctgggcctcgaaaccaggacggaaacttggatgtcgtccgagggagcatggaagcagatccaacgtgtcgaaacctgggcattacgacacccggggttcacggtgatcgcgttcttcctggcccacgccatcggaacctccataacacagaaagggatcatcttcatcttgctgatgctggtgacaccctccatggctatgcggtgcgtcggcatcggtaaccgcgatttcgttgagggcctcagcggcgccacttgggtggacgtcgtcctggagcacgggtcatgcgtcacaaccatggcgaagaataagccaaccctggacatcgaactcctgaagactgaggtcacgaacccggccgtactgcgaaaactatgcatcgaggctaaaattagcaacaccaccacagactcacgatgccccacgcaaggagaggcaactctcgtggaggaacaagatgcgaatttcgtctgccgccgcacctttgtcgacaggggctgggggaacggttgtggcctgttcggcaaggggagcctcctgacctgcgctaagtttaagtgcgtgacgaaacttgagggcaagatcgtacagtatgaaaacttgaagtactccgtgatagtgaccgtccatactggcgaccagcaccaggtggggaacgagaccacagaacacggcacgatcgccacaatcacgccccaagcccctacgagcgaaatccagctgacggattatggcgctctgacactcgactgcagcccacggaccggcttagacttcaacgagatggtcctgctcacgatgaaggagaagagttggctggtgcacaaacagtggtttttagatctccccttgccatggacctctggggcaagcacctcgcaggagacctggaaccggcaggacctcctcgtgaccttcaagacggcgcacgctaagaagcaggaggtcgttgtactggggagtcaggagggggccatgcacaccgccttgaccggggcgactgagatccagacgtcaggcaccacaaccatctttgcagggcacctaaaatgccgcctgaagatggacaagctgacactcaagggcatgtcctacgtaatgtgcaccggtagttttaaactagagaaggaggtggccgaaacacagcacgggacggtcctggtccaggtgaagtacgagggcaccgacgctccctgtaagatcccgttttcaactcaggatgagaagggggtgacccagaacggccggctgatcacggctaatccgattgtcacggataaggagaagcccgtcaacattgaaactgaaccgccattcggggaaagctacatcgtggtcggcgcgggcgaaaaagccttaaagctgtcgtggttcaagcgagggagctccatcggtaagatgttcgaggccactgctaggggtgcccgacgcatggccatactcggagatacggcgtgggactttgggtccatcggcggcgtgttcacttccgtgggtaagctagtccatcagatttttggcactgcctacggggttttgtttagcggcgtgagctggaccatgaagatagggataggaatactcctcacctggttaggcctgaacagccggtccacgagcctctcgatgacttgcattgccgtcgggatggttaccctatatctgggcgtgatggtgcaggccgactcagggtgcgttatcaactggaagggccgcgaactcaaatgcgggtcggggatctttgtcacgaacgaggttcatacgtggaccgagcagtacaagttccaggcggacagccccaagcgtctatcggcagcaataggcaaggcctgggaggaaggagtttgtggcatcagatccgccacacggctggagaacattatgtggaagcaaatctcgaacgaactcaaccatatcctgctggagaacgatatgaagttcactgtggtcgtgggggacgcgaacgggatcctcgctcagggcaagaaaatgatccgcccccagcccatggaacacaagtattcctggaagtcctggggcaaggccaagataatcggcgccgacatacagaacaccactttcattatcgacgggcccgacacgccggagtgcccagatggccagcgggcgtggaacatctgggaggtcgaggactacgggttcggcgtctttaccactaacatctggttgaaactacgcgattcctatacccagatgtgcgaccaccgcctcatgagtgccgccatcaaggatagcaaagccgttcacgccgacatgggctactggatcgagagcgagaagaacgaaacatggaagcttgcgcgcgcctcctttatcgaagtcaagacctgtacctggcctaagagccacacactgtggtccaacggcgtactggaaagcgaaatgatcatccccaaaatatatggcggaccgatttcgcagcacaattacaggcccggctacttcacccagactgccgggccctggcacctgggcaaactggagctggacttcgatctgtgtgagggcactacggtggtcgtcgatgaacactgcggaaatcgcggcccatcactgcggacaactaccgtgaccgggaaaatcatccacgagtggtgctgtagatcttgcaccttaccgccgctccggttccgcggcgaagatgggtgctggtatggcatggagatccggccagtgaaagagaaagaagagaacctggtccgcagcatggtgtcagccggctctggagaagtggacagcttctccctcgggatcttatgcgtaagcatcatgatagaggaggtgatgcgaagtcgctggagtcgcaagatgctaatgactggcaccctagctgtgttccttctgctcataatgggccaactcacatggaatgacctgatccggctctgcataatggtcggtgcgaacgcctccgaccgcatgggaatgggcaccacatatcttgcactaatggcaaccttcaagatgcggcccatgtttgccgttgggctactgttccgccggctgacgagccgagaggtgttgttgctaaccatcgggctgtccctggtcgcgtcagtagagctgcctaacagtctggaggaacttggtgacggactcgcgatgggtatcatgatgttaaagctattgaccgagtttcaaccccaccaactgtggaccacattactgagcttaacctttgtcaaaaccactctgtccctggactatgcctggaagactactgccatggcgctgagcatcgtgtcccttttcccgctgtgcctcagcaccacttcacagaagacaacctggctgccggttctgctcgggagttttggatgcaagccactgactatgttcctgatcaccgagaacaaaatctggggtcggaagtcctggcctctcaacgagggcatcatggcaatcggaatagtcagtatcttgctatccagcctcctgaagaatgacgttcccctagccgggccgctcattgccggcgggatgttgatcgcctgctacgtgatcagcggctcctctgcggacctgtccctagaaaaggcggctgaggtctcgtgggagcaagaggcggaacactcgggggcgagccactccatattagtagaggtgcaggacgatgggacaatgaaaatcaaagatgaggagcgcgatgatacgctaaccatcctcttgaaggcgaccctgctcgccgtctctggggtttatcccatgtccatccctgccaccttgttcgtatggtacttctggcaaaagaagaagcagaggagcggcgttctgtgggacacgccctcaccgcccgaggtagagcgcgcggtgttggacaacggcatctacagaatcctgcaacgcggccttttgggcagatctcaggtgggtgtgggcgtattccaggacggggtcttccataccatgtggcacgtgacgcgcggcgccgtactcatgtaccaaggcaaaaggctggagccgtcgtgggcgagcgtcaaaaaggatctgatctcatacgggggtgggtggcgcttccaaggtagctggaacaccggggaagaggtccaggtgatagccgtcgagcccggcaaaaacccgaagaatgtgcagacgacccccggcacctttaaaaccccggagggggaggtgggggccatcgccctcgacttcaagcccgggacttccgggagcccgatagtcaaccgggaaggcaagatagtgggcctttatggcaacggggtagtcaccacttccggcacgtatgtctccgccatagctcaagctaaggctagccaggaggggcccctgcccgaaatagaagacgaggtcttcaaaaagcggaacctcaccatcatggacctccatccaggcagcggcaagaccaggaggtacctgcccgccattgtccgggaggcgatcaagcgaaaactccgcaccttaatcctggcgcccacccgcgtggtggcgagcgagatggccgaagccctcaagggaatgcccatccgctaccagacaaccgcagtcaaatcagaacacaccggtagagagattgttgaccttatgtgccacgccacgtttacgatgcgcctgttgtccccggtgcgggtccccaactacaatatgatcataatggacgaggcccatttcaccgatcccgcatcaattgccgcgcgcgggtacatcagcactcgggtgggcatgggcgaggctgccgcgatttttatgactgcaactccgccggggtcggtggaggcgtttccccaaagcaacgctgtcatccaggacgaggaacgcgacattcccgaacggtcctggaacagcggctatgactggattaccgacttccccgggaagaccgtgtggttcgtaccctccatcaagagcggcaacgacatcgccaactgccttcgcaaaaacggcaagagagtcatacagctgtcgcgaaagacctttgacacggagtaccagaagacgaaaaacagcgactgggactacgtggtcaccaccgatatctccgagatgggcgcgaacttccgggccgatcgcgtcatcgatccccggagatgcctcaaacccgtaatccttaaggacggtcccgagcgtgtaattttggccggcccgatgcccgtcacggctgccagcgccgcgcagcgccgggggcggatcggccgcaatcaaaataaggagggcgatcaatacgtctacatgggtcagcccctgaacaacgacgaggatcatgcacactggaccgaggcgaagatgctcctcgacaatattaacacccctgaaggaatcatcccggccctctttgagcccgaaagagaaaagtccgcagcgatcgatggggagtaccgcctgcggggcgaggcccgcaagaccttcgttgagctgatgcggcgcggcgatctcccagtgtggttaagttataaggtggcgtcggaaggtttccagtatagcgaccggcgctggtgctttgatggcgagcggaacaaccaggtcttagaggagaacatggacgtggaaatttggacgaaggagggggagcgcaagaagctgaggccacggtggctggacgcgcggacctactcggacccgctggccctcagggaatttaaagaattcgctgccggccgacgctccgtaagcggcgatctgattctggagatcgggaaactcccccagcacctgacgctgagggcgcagaacgccctcgacaacctggtcatgctgcataactccgagcagggcgggaaggcataccgccacgccatggaagaactcccagatacgattgaaaccctgatgctcttggccctcatcgctgttctaaccggcggggttacgctgttcttcctgagcggcaagggtctagggaagaccagcatcgggttactgtgcgtcactgcctcgtcggcactgctatggatggcctcagtcgagccccactggatcgcagcctcaataatcctggagttcttcctgatggtcctcctcatcccggagccggacagacaacgcacgccccaagataaccaactagcctacgtggtgatcggactcctgttcatgatattaacggttgctgctaacgagatgggactgctggagaccacaaagaaagacctggggattggctacgttgccgccgagaaccaccaacacgtgacgatgctggacgtggacctgcaccctgcatcggcgtggaccttgtacgccgtggcaaccaccgtaatcacgcccatgatgcggcataccattgaaaatgcgaccgctaacatctccctcacagccatcgctaaccaggcggccatcctgatgggactggacaaggggtggccgataagcaagatggacatcggcgtccccctactggcactggggtgttacagccaggtcaacccgctcacgttaaccgccgccgtactgatgctcgtagcacattatgccatcattggccccgggctgcaggcgaaggcgacacgcgaggcacaaaagagaacggccgccggcatcatgaaaaatcccactgtcgacggtatcgtggcgattgacctggaccccgtggtctacgatgctaagttcgagaagcagttaggccaaattatgcttctaatcctctgcaccagccagatcctgctgatgcggactacctgggccctctgcgagtcgatcactctggccaccggtccgctgaccacgttgtgggaggggagccccggcaagttctggaatacgaccatagctgtgtccatggcgaacatcttcagagggtcctacttggccggggccggcctggccttctccctcatgaagtcgttggggggcgggcggcgcggtaccggcgcccaaggcgaaacccttggcgagaagtggaagagacagctcaaccagctgtctaagtccgaattcaacacgtacaagcgctcaggcatcatggaagtggaccggtccgaggccaaggagggccttaagagaggcgagaccaccaagcacgccgtgagtcgtggcacggctaagctccggtggttcgtggagcggaatcttgtgaagcccgagggcaaggtgatcgacctaggttgtggccgcgggggatggtcgtactactgcgcggggctgaaaaaggtgaccgaggtgaagggctacaccaagggcgggcccggccacgaagagccgatacccatggcgacatacgggtggaatctcgttaaactgcatagcggcaaagacgtgtttttcatgccgcccgagaagtgcgacacccttctctgcgatatcggtgagagtagcccgaaccccaccgtcgaggagggccgaaccctgagggtcctgaagatggtcgaaccgtggctccgggggaatcaattctgtatcaaaatcctgaacccttacatgccgtccgtggtggaaaccctggagagaatgcagcggaaacacggggggatgctcgtgcgcaaccctctgagccggaattccacccatgagatgtactgggtgagctgtgggactggaaatatagtatctgccgtgaacatgacgagccgcatgcttcttaaccgcttcaccatggcccaccggaagcccacttatgagcgggacgtggatctgggcgccgggacccggcacgtggccgtggaacccgaggtggccaacctggatatcataggccagcgaatcgagaacataaagaatgaacataagtcaacgtggcattatgacgaagacaatccgtacaagacttgggcctaccacgggtcgtacgaggtaaagcccagcgggagcgcatccagcatggtgaacggggtagtgaggctcctgactaaaccctgggatgtgatcccgatggtcacccagatcgctatgacggacacgaccccattcggccagcagcgcgtatttaaggagaaggtcgacactcggaccccccgcgccaagcggggcaccacccagatcatggaagttactgcgaagtggctgtggggcttcctaagccgcaacaagaagccccgcatttgcaccagggaagagttcacacggaaggtgcggtccaacgctgcggtgggcgccgtattcgtggatgagaaccagtggaacagcgcgaaggaggccgtggaggatgagcgattttgggacctagtccaccgcgaacgcgagctgcacaaacagggcaagtgcgcaacctgtgtttataacatgatgggcaaacgcgaaaagaagctcggggagttcggcaaggccaaaggctcccgggccatatggtacatgtggctaggggctaggttcttggagttcgaagccctcggcttcatgaacgaggaccactggttcagccgagaaaactccttatcgggcgttgagggcgagggtctgcacaaactgggatacatcctcagagatatcagtaaaattccgggcggcaatatgtacgccgacgacaccgccggctgggacacgcgcgtaaccgaggacgacctgcagaacgaggccaaaattacggacatcatggagcccgagcatgcgctcctggcaaccagcatcttcaaattaacctaccagaacaaagtggtccgggtccagcgccccgccaagaatgggacggtcatggatgtgatctcccggcgcgaccaacggggcagcggacaggtgggtacctacggcctgaacacctttaccaacatggaggtccagctaatacgccaaatggaatccgagggcatctttctgccaagcgagctcgagacacccaacctggcagagcgcgccctggattggctcgagaagcatggcgcggaacgcctgaagcggatggccatcagcggggacgactgcgtcgtcaagcccatcgacgatcgcttcgccacggcactgaccgcccttaatgacatgggtaaggtaagaaaggacatcccgcagtgggagcccagcaaggggtggaatgactggcagcaggtcccgttttgctcccaccactttcaccagctaatcatgaaggatgggagagagatcgtcgtgccgtgtcggaaccaagacgagctggtcggccgcgcacgcgtgagccagggcgcaggttggtccctgagggagacggcctgtctgggtaagagctacgcccagatgtggcaactaatgtactttcacagacgcgacctccggctggcggccaatgccatctgcagcgctgtgcccgtggattgggttcccacgtcccgtaccacctggagcatccacgcacaccaccagtggatgacaacagaggatatgctgtccgtgtggaaccgcgtgtggatcgaggaaaacccgtggatggagaataagactcacgttagtagctgggaagaggttccttatctcggcaagcgggaggaccaatggtgcgggtcactgatcggtctgaccgcacgtgccacctgggccacgaacatccaggttgccatcaaccaggtccggcgcctgataggcaacgagaactacctggactacatgaccagcatgaaacggttcaagaatgaatcagactccgagggggcgctttggtga

SEQ ID NO: 23998 - RNA, 9879 nt, synthetic construct
  misc_feature 1..9879: note = derived and/or modified CDS sequence (opt11) from DENV-1__JN819417__SS-prME
  source 1..9879: mol_type = other RNA
agcgtgaccatgttattgatgctactgcccacggccctcgccttccacctcaccacccggggcggggagccccacatggtcgttagcaagcaggagcggggcaaaagcctgctcttcaagaccagcgccggggtgaacatgtgcaccctgatagccatggatctgggagagctctgcgaggacactatgacctataagtgccctaggatcactgaggccgagcccgatgatgtcgattgttggtgcaacgccaccgacacctgggtgacctatgggacctgcagccaaactggcgagcatcgacgggacaagagatccgttgccctggcgccccacgtcggcctggggctcgaaacacggaccgaaacatggatgtcatccgagggtgcttggaagcagatccaaaaggtagagacatgggcacttcggcatcctggattcacggtgattgcactgttcctcgcgcacgccataggcacctcgatcacgcagaaggggattattttcatacttctgatgctcgttacccctagcatggcgatgcgctgcgtgggcataggcaaccgcgacttcgtggaggggttgtctggcgcgacatgggtcgacgtggttctcgagcacgggtcctgcgttaccacaatggcgaagaacaagcccacgctggacatcgagctgctgaagacggaagtgaccaaccccgcgattctcaggaagctgtgcatagaggccaaaatcagcaacaccacaactgattcccggtgcccgacccaaggcgaggccacgctggtggaggaacaggacgccaatttcgtctgccgaagaacattcgtggaccgcgggtgggggaatggctgcggcctattcggaaaggggagcttgttaacgtgcgctaagtttaagtgcgtgaccaagctcgaggggaaaatcgtccagcacgagaatctcaagtactccgtgatagtgaccgtccacacaggcgaccagcaccaggtggggaatgaaacgacggaacacggaaccatcgcgaccataacgcctcaagccccaacgtccgaaatccaactgaccgactacggtgccctcactctggactgctcaccccggaccgggctggacttcaatgagatggtcctcctaacaatgaaggaaaagtcctggcttgtgcacaagcagtggtttctcgacctgcccctgccctggacctccggcgcaagcaccagccacgagacctggaatcgtcaggacctactggtgactttcaagaccgcccacgcgaagaaacaggaggttgtggtcctgggctcgcaggaaggcgccatgcacaccgcactcaccggtgcgaccgagatccaaaccagcggcaccaccacaattttcgccggccatctgaaatgccggttaaagatggacaagctcaccctaaagggaatgtcctatgtcatgtgcacagggagcttcaaactggagaaggaggtggcggaaacccaacacggcacggtgctggtccaggtgaagtacgagggtaccgacgccccgtgcaaaattcccttttcaacacaggacgagaagggggtgacccagaacggccgcctcatcactgccaatccgatcgtcaccgacaaagagaaacccgtgaatatcgagaccgagccgcccttcggcgagagctacatcgtggttggtgccggcgaaaaagcgctgaagctgtcatggttcaaaaaggggagctccataggtaagatgtttgaggccaccgcccgcggggcccgccggatggccatcctcggcgatacggcttgggacttcgggtctataggcggcgtatttacctccgtgggtaagctggttcaccaggtgttcggcaccgcctatggggtgctgttcagcggcgtatcctggaccatgaagatcggtatcggaatcctactgacatggctgggtctcaacagcagatccacgagcctgtcgatgacgtgcatcgccgtgggtatggtgacactgtacctgggtgtcatggtgcaggccgacagcgggtgcgtgatcaactggaagggccgcgagctgaagtgcgggtccggcattttcgtcaccaacgaggtgcatacctggaccgagcagtataagtttcaggccgacagcccgaagcgattaagcgctgccattggcaaagcatgggaggaaggggtttgtggcatccgctccgccacccggctggagaacatcatgtggaagcaaatcagcaacgagctgaaccacatcctgctggagaacgatatgaaattcaccgtagtagtgggggacgcgagtggcatcctggcgcagggaaagaagatgatacgccctcagcccatggagcacaagtatagttggaagtcctggggcaaggccaagatcattggcgccgacacgcaaaacacaacattcatcatcgacgggcccgacaccccggaatgccccgacgaccagcgggcctggaatatctgggaggtcgaggattacggcttcgggattttcacgacaaacatctggctgaagctacgggacagctacacccagatgtgcgaccaccggcttatgtccgcggccataaaagacagtaaggccgtgcatgctgatatgggctactggatcgaatccgagaagaatgaaacgtggaagctagcccgcgcgagcttcatcgaagttaaaacgtgcatctggccaaagtcccataccctctggagcaatggcgtcctggagtccgagatgatcatcccaaagatctacgggggcccgattagccagcacaactaccggcctggttacttcactcagactgccggcccgtggcatctggggaagctcgagttagattttgacctgtgcgagggcacgaccgtcgtcgtagatgaacactgcggtaatcgagggccgtccctccggaccaccacggttaccggtaagatcatccacgagtggtgttgcaggagctgcaccctaccgcccctacggttccgcggtgaagacggctgctggtacggaatggaaatccggcccgtgaaagagaaggaagagaacttagtcaggtccatggtgagcgccggaagcggcgaagtggactcctttagcctagggatcctgtgcgtttccatcatgatcgaggaggtgatgaggagccgctggtcccggaaaatgttgatgaccggaacgcttgccgtgttcctgctcctgatcatggggcagctgacctggaatgacctcatcaggctgtgcataatggtcggcgccaatgcgagcgatcgcatggggatgggcaccacctacctggccctcatgggcacgttcaaaatgcggcctatgttcgccgtggggctcctgttccgccggttaacctcacgggaggttctcttactcacgatcggcctgagcctggtcgcctccgtcgagctccccaacagcctagaggaactgggggatggcttggccatgggaatcatgatgctaaagctgctcacggagttccaacctcaccagctgtggacgaccctactctccttaaccttcatcaagaccacgctaagcctcgactacgcgtggaagaccatggccatggtactgtccatcgtgagcctgttccccctatgcctgtccaccacttcgcagaaaacgacctggctaccagtactcctgggttccttcggttgcaagcccttgaccatgttcctaataaccgagaacaagatctgggggcgcaagagctggcctcttaacgagggaatcatggccatcgggattgtctcgatactgctcagcagcttactgaaaaacgacgttcccctcgcgggaccgttaattgctggcgggatgctaatcgcctgctatgtgatctccgggagttccgccgatttaagccttgaaaaagccgccgagatatcctgggaggaggaggcggaacactctggaaccagtcacaacatcctggtcgaggtgcaggacgacggcacgatgaaaatcaaggatgaggagcgcgatgacaccctcactatcctgctgaaggccacactcttggctgtaagcggcgtctaccctatgtcgataccggctacacttttcgtctggtacttctggcaaaagaagaagcagcggagcggcgtgctctgggacaccccctcaccccccgaagtcgagcgagccgtccttgatgacggcatctaccgcatcctgcagagggggttactggggcggagccaggtgggggttggggtgttccaggacggcgtgttccacaccatgtggcacgtcacccgcggggccgtgctgatgtaccagggcaagcgtcttgagccgtcctgggccagcgtgaagaaggacctcatcagttacggcggcgggtggcgcttccagggatcgtggaacacaggcgaggaagtccaggtaatcgctgtggaaccaggaaagaatccgaagaacgttcagaccacccctggcaccttcaagacgccagagggcgaagtgggcgccatcgccctggacttcaagcccgggacatccggcagcccgatcgtgaaccgggagggtaagatcgtcggactgtacgggaacggggtggtgacgacctccggcacatacgtgagcgcaatcgctcaggctaaggcgtcgcaggaggggcccctcccagaaattgaagacgaggttttcaagaagagaaacctaaccatcatggatttacacccggggtccggcaaaacccggcgctatctcccggctatcgtcagggaagccatcaagcgcaagctgcggacccttatccttgcacccacacgcgtagtggcgagcgagatggccgaagcgctcaagggtatgcccatccggtaccagaccaccgctgtgaagtccgagcacactggccgagagatagtcgacttaatgtgccacgccaccttcactatgcgcctcctgtcgccggtccgggtcccaaattacaacatgatcatcatggacgaagcccacttcaccgaccctgcctccatcgcggcacgcgggtacatcagcacccgtgtcgggatgggggaggccgccgccatattcatgacggctacgccgcccggcagcgtggaggcattcccccagagcaacgccgtgatccaggacgaggaacgcgacatacccgagcgctcctggaactcggggtatgattggatcacggacttccccggtaaaaccatctggtttgttccctccattaagagcggcaacgacatcgctaactgcctgcgcaagaacggtaagcgtgtgattcaattaagccgcaagacgttcgacacggagtatcagaaaaccaagaacaatgactgggactatgtggtcaccacggacatcagcgaaatgggagctaactttcgggccgacagagtcattgaccccaggaggtgcctgaaaccggtgatcctgaaggacggacccgagcgggtcatcctagccggaccgatgccggtgaccgtggccagtgctgcccagcgccggggccggataggtcggaaccagaacaaggagggcgaccagtacgtctacatggggcagcccttaaataacgacgaggaccatgcgcactggactgaagccaagatgctactggacaacataaatacacccgagggaatcatcccggccctgtttgaacctgagcgtgagaagtccgcagcaatcgacggtgaatatcgtcttcgaggcgaagcccgcaagacatttgtggagctcatgagacgaggcgacctgcctgtttggctcagctacaaggtggcctctgaggggttccagtactccgaccggcgctggtgcttcgacggcgagcgtaataaccaggtcctcgaggagaacatggacgtcgagatttggacaaaagagggtgagcgcaaaaaactgcgtccccgctggctggacgcccggacctactctgacccgctcgccctacgggagttcaaagagttcgcggcgggtcggcgcagcatctccggcgacctgatattggagatagggaaattgccacaacacctgaccctcagggcccagaacgcgctagacaaccttgtgatgctccacaactccgagcagggcggaaaagcataccgccatgcgatggaggagctgccagacaccatagagacactgatgctcctggccctgatcgccgtgctcaccgggggggtcaccctattcttcctgtccggaaagggcctcgggaaaacatctattggcctgctctgcgttatggcctccagcgcacttctgtggatggcaaatgtggaaccccattggatcgctgcctccatcatccttgaatttttcctcatggtcctgctgatcccggagcctgaccggcagcgcactccgcaggacaatcagctcgcctacgtggttatagggctactgtttatgatcctaactgttgcggccaacgagatgggactgctcgagaccacgaagaaggacctcgggataggccacgtggcagcggagaaccaccaccacgccacaatgcttgacgtggatctgcggccggcgtcggcatggacactctacgccgtcgcaactaccgtgatcacacccatgatgcgtcatacaatagaaaacaccaccgcgaatatctccctgacggcgattgccaaccaggccgccatactgatgggcctggataaggggtggcccatcagcaaaatggacatcggcgtgcccttgctggctctcgggtgctactcccaagtcaacccactcacactaaccgcggccgtgctcatgctagtggcccattacgcgatcatcggccccgggctgcaggcgaaggccacccgtgaggcccaaaagcgcacagctgccgggataatgaaaaatcccaccgtcgacgggatcgtggcgatcgatctcgaccctgtcgtttacgacgccaagttcgagaagcagttgggccagattatgctgctcatactatgcacaagccagatcttgttgatgcgcaccacgtgggccctgtgcgagtccatcaccctggccaccggcccgctcaccaccctgtgggaggggagcccagggaaattttggaacaccaccatcgccgtgtccatggctaacatctttcggggcagttatctcgctggggccggcctcgccttctcgctgatgaagtcgctagggggcggtcgtcgcggcaccggtgcccagggtgagacgctcggcgaaaaatggaaacgacagttaaaccagctgtctaagagcgagtttaacacatataagcgaagcgggatcatggaagtagaccgctccgaagctaaggaaggtttgaagaggggggagaccaccaagcacgccgtgagtcgcggcacggccaagttacggtggttcgtggaacgtaacttagttaagcccgagggcaaagtcatcgacctggggtgcggccgcggcgggtggtcgtactattgcgccgggctcaagaaagtgaccgaagttaaagggtacaccaagggcggaccgggccacgaggaacccatccccatggccacatatgggtggaacctggtcaagcttcacagtgggaaggacgtgttcttcactccgcctgagaagtgcgacacgctactgtgcgacatcggggagtcctcacccaaccccacgatcgaggagggccgtacactccgggttttaaagatggtggagccctggctccgcggcaatcaattctgcattaagatcctaaacccctacatgccaagtgtggtcgaaacccttgaacagatgcaacggaagcacggaggcatgctggtccgcaaccccctgagccggaacagtacgcacgagatgtactgggtatcatgcgggaccggaaacatcgtatcagcagtcaacatgactagcaggatgttgctgaaccgctttacgatggcccaccgcaagcccacttacgagaaggacgtggacctgggggccgggaccagacatgtcgccgtcgaacccgaagttgcgaatctagacatcatcggccagcggattgagaacattaagaacgagcataagtccacctggcactatgacgaagataacccgtacaagacatgggcctatcacgggtcatacgaggtgaagccgtccggcagcgcctccagcatggtgaacggggtggttcgcctgctgaccaagccctgggacgtgatcccgatggtgacccagatagctatgaccgacaccacgccgttcggacagcagcgggtcttcaaagagaaggtggacactaggactccccgggccaaacgtggcaccgcccagatcatggaggtgaccgccaagtggctctgggggttcttatcccggaacaagaagccccgaatctgcactcgggaggaattcacgaagaaggtccgctcaaacgcggcgatcggcgccgtgttcgtggatgagaaccagtggaatagcgcgaaggaagcagtcgaggacgaacggttctgggacctggtgcaccgcgaacgggagctccataagcaggggaagtgcgcgacctgcgtgtacaacatgatgggtaagcgcgagaagaagctgggggaattcggaaaggccaaggggagtcgggctatctggtacatgtggctgggagcccgcttcctcgagttcgaggcactaggctttatgaacgaagaccactggttctcgcgggagaactctcttagcggggtggaaggcgaggggctccataagctgggctatatactaagggatatcagtaagatcccgggcggaaatatgtacgcagatgacacggccggatgggacacacggattacagaggacgacttgcagaatgaggcgaagatcacggacataatggagccggagcacgctctgttagccaccagcatctttaagctaacctaccagaataaggttgtgcgagtccagcggcctgccaagaacggcaacgtgatggacgtcatctctcgccgtgatcagcggggatccggccaagttgggacctacgggctcaacacctttaccaacatggaggttcagctgatccgacagatggagtccgaaggcatctttttgcccagcgagctagagaccccgaacctggccgaacgggtgctcgactggctcgagaaacatggcgccgagcgcctgaagcgtatggccatctctggggacgattgcgtcgtgaagcccatagacgaccggttcgccacggccctcatagccctaaacgacatgggcaaagtccggaaggacataccccagtgggaacccagtaagggatggaatgactggcaacaggtcccgttctgctcgcaccatttccaccagctaatcatgaaggacggtcgcgagatcgtggtaccctgtcggaaccaagacgagctcgtcgggcgcgcgcgcgtgtctcagggggccggatggtccctgcgtgagaccgcctgtctgggcaagagctacgcgcagatgtggcaactcatgtacttccaccggcgcgatctgcggctagcggcgaacgcaatctgttccgcagtgcccgtcgactgggtccccacgagccgtactacttggtccatccacgctcaccaccagtggatgaccaccgaggatatgcttagcgtatggaaccgggtatggatcgaggagaacccatggatggaagataaaacgcacgtcagctcttgggaggaagtgccctacctggggaaacgcgaggatcagtggtgcggcagcctgatcgggttgaccgcccgcgcaacctgggccaccaacatccaagtcgccatcaaccaggtgcgccgcctgataggcaacgagaactatctggactacatgacgagcatgaagcggttcaagaacgagagcgaccccgaaggggctctgtggtga

SEQ ID NO: 23999 - RNA, 9879 nt, synthetic construct
  misc_feature 1..9879: note = derived and/or modified CDS sequence (opt11) from DENV-1__FJ687426__SS-prME
  source 1..9879: mol_type = other RNA
agcgtgaccatgctgctcatgctgatgcccaccgccctagccttccacttaaccacgagaggcggggaaccacacatgatcgtcagtaagcaggagcgcggaaagtcgctactgttcaagaccagcgcgggggtgaacatgtgcaccctgatcgcaatggacctaggcgaactgtgcgaggatactatgacgtataagtgcccccgcatcaccgaggccgagcccgacgacgtcgactgctggtgcaacgccaccgatacctgggtaacttacgggacctgcagccagaccggcgagcaccggcgcgataagaggtcggtggcactcgcgcctcacgtgggcctggggctggagactcgcactgagacctggatgtcatccgagggtgcctggaagcagatccagagggtcgagacctgggcactccgacaccccgggtttacggtgatcgcgttattcctggcgcacgccattggcacctctatcacccagaaggggatcatcttcatactcctgatgctagtgaccccctccatggccatgcggtgcgtcggtatcgggtcccgcgactttgtggaggggctctccggcgccacctgggtggatgtcgtcctggagcacgggagctgcgtgaccacaatggccaaggacaagcctaccctggacatcgagctactgaagacggaggtcaccaaccccgcggtgctccggaagctgtgcattgaggccaagatatccaacacaaccacggactcccgctgcccgacacagggcgaagccaccctggtggaggagcaggacgccaactttgtatgccggcgcactttcgtggaccggggctgggggaatggctgcggcctgtttgggaaggggtcgctcttgacgtgcgcgaagttcaaatgtgtgaccaaactggagggcaagatcgtccagtacgagaacctaaagtactctgtgatcgtgaccgtccacaccggcgaccagcaccaggtgggtaacgagtccaccgagcacggcacgaccgcgaccatcacgccccaggccccaacgacagaaatccagttgaccgactacggggccctgactctcgactgcagcccccgcacgggcctggactttaacgagatggtcctgctcaccatgaaagagaagtcatggttagtccacaagcaatggttcctggacctccccctgccctggacgtctggggccagcacctcccaggagacatggaatcggcaggacctgttggtgacattcaagaccgcccacgcaaagaagcaagaggttgtggtgctggggagccaggagggcgccatgcacaccgccctgacgggggccacggagatccaaacttccggcaccacgaccatctttgccgggcacctcaagtgtcgcctgaaaatggacaaactgaccctcaagggcatgtcgtacgttatgtgcaccgggtcctttaagctggagaaagaggtggcggagacgcagcatggaacagtgctggtgcaaatcaagtatgagggcaccgacgccccctgcaagatccccttcagcacccaggatgagaagggggtgacacagaatggccggctgatcaccgccaatccgatcgtgaccgacaaggagaagcctgtcaacatcgaggccgagccgcccttcggcgagtcttacatcgtgatcggcgccggcgagaaggccctcaaactaagctggttcaaaaagggatcatccattggcaagatgtttgaggccaccgcccgaggagcccggagaatggcgatcctgggtgacacggcatgggactttgggagcattggtggcgtgttcaccagcgtcgggaagctcgtgcaccagatctttggcaccgcctacggggtgcttttctccggcgtctcctggaccatgaagatcggcatcggggtgctgctcacgtggctgggcctgaattctcgtagcactagtctcagcatgacctgtatcgccgtggggctggtcacactctatctcggcgtaatggtacaggccgactccgggtgtgtgataaactggaagggccgagagctgaaatgtgggagcggcattttcgtgacaaatgaggtgcacacctggaccgagcagtacaagttccaggcggacagcccgaagcgcctgtccgccgccataggcaaggcctgggaggagggggtctgcggcatccgctccgccacccgcctagagaatattatgtggaaacagataagcaatgagctaaaccatatcctgctcgagaacgacatgaagttcaccgtcgtagtcggggacgtggcaggaatcctggcccaggggaagaagatgatccggccccagcccatggagtacaagtatagctggaagtcctgggggaaggccaagattatcggcgccgacgtgcagaacagcaccttcatcatcgacggtcccaacaccccggagtgccctgatgaccagagagcgtggaacatatgggaagtcgaggactacgggttcggaatctttaccaccaacatctggctgaagctccgggattcctatacccaggtgtgcgaccaccgtctgatgagcgccgccatcaaggactccaaagcagttcatgccgacatgggctactggatagagagtgagaaaaacgagacctggaagctggcgggcgcgtccttcatcgaagtcaagacctgcatctggcctaagagccacaccttatggagcaatggggtgctggagagcgagatgataatacccaagatctacggtgggccgatatcccagcacaattaccggcccggctacttcacgcagactgctgggccctggcacctgggtaagttggagctggacttcgacctgtgcgagggcaccacagtggtcgtcgacgagcattgcgggaaccgcggcccgtctctacggacgaccaccgtgaccgggaagatcatccacgaatggtgctgcagatcctgcacgctgccgcccctgcgattccgcggcgaggacggctgctggtacggcatggagatccggcccgtcaaagagaaagaagagaacctcgttaagtccatggtgagcgccggctccggggaggtcgacagcttctcactgggactgctctgcatctccatcatgatcgaggaggtgatgcgctcccgttggtcgcgcaagatgctgatgaccgggaccctcgccgtgttttttctcctgataatgggccaactgacctggaacgacctaatccggctgtgcatcatggtcggggcaaacgcctccgaccgaatgggcatgggaacgacctacttggccctgatggcgacctttaagatgcgcccgatgttcgccgtggggctgctgttccggagattaaccagccgggaagttctgctgctcacgataggcctgtccctggtagcgagcgtggaactgcccaactccctggaggagctgggggacggtctagccatgggcatcatgatcctgaagctgctcaccgatttccagagccaccagttgtgggccacactgctatccctgacctttatcaagacgacactgtcactccattatgcctggaaaaccatggcgatggtcctctcgatcgtcagcctgttccccctctgcctgtccacgacgagccagaagacgacctggctgcctgtgctcctggggtccctgggctgcaaaccgctcaccatgttcttaattgcagagaacaaaatctggggacgtaagtcttggcccctgaacgagggtatcatggcagtcgggatcgtaagcatcctcctgtccagcctgctaaaaaacgacgtgcccctggcaggtcccctgatcgcaggcgggatgctcatcgcgtgctacgtcatctccggctcatccgcagacctaagcctggagaaggccgccgaggtctcgtgggaggaagaggccgagcacagcggggcgagtcacaacatcctcgtggaggtgcaggacgatggcacaatgaagatcaaggacgaggagagggacgacaccctgacaattttattgaaagcaaccctgctggccgtgtcaggggtgtacccgctctcaattcccgccaccctgtttgtgtggtatttctggcagaagaagaagcagcgcagcggcgtactgtgggatacgcctagcccgccagaagtggaacgggccgtacttgatgacggcatatacaggatcatgcagcgggggctcctgggccgcagccaggtgggggtcggtgtcttccaggaaaacgtcttccataccatgtggcacgtcactcgcggcgccgtcctgatgtaccagggcaagcgcctcgagccctcctgggccagcgtgaagaaggacctgatatcctacggagggggctggcggctgcaggggtcatggaacaccggcgaagaggtgcaagtaatcgccgtggaacccgggaagaatccgaagaacgtgcagacggccccgggcaccttcaagacgcccgaaggggaggtcggtgccatagcgctcgactttaaacccggtacatccgggagccccatcgtgaaccgcgagggaaagattgtgggtctgtacgggaacggagtcgtgactacctctgggacctacgtgtccgctatcgcccaggccaaggccagtcaggagggaccgcttcccgagatcgaggacgaggttttccggaaacgcaatctcaccattatggacctgcaccccgggtccggcaagacgcggcgttacctgccggccatcgtacgcgaggccatcaaacggaagctccgaaccctgatactggccccaacacgcgtggtcgccagcgagatggccgaggctcttaagggcatgcccatccgctatcagaccacggccgtgaagtccgagcacaccgggaaggagatcgtggaccttatgtgccacgctaccttcaccatgcgtctactcagcccggtccgcgtgccgaactacaacatgatcataatggacgaggcccacttcacagacccctccagcatcgcggcccggggctacatatcaacccgcgttggtatgggcgaggcagccgcaattttcatgactgcgactccgcccgggagcgtcgaggcgtttcctcagtccaatgccgtcatccaggacgaggaacgggacatacccgagcgcagctggaactctggctacgagtggatcacggacttccccggcaagactgtgtggttcgtccccagcatcaaggccgggaacgacatcgccaactgcctgcggaagaacggcaagcgcgtgatccagctgtcacggaagaccttcgacaccgaataccagaagacgaagaataacgactgggactacgtggtaaccaccgacatcagcgagatgggggcaaattttcgggccgaccgggtgatcgacccgcgccgatgcctcaagcctgtgatactgaaagacggtcccgagagggtcatactggccggacccatgccagtgactgtcgcctccgcggctcagcgacggggccggatcggccgcaatcacaacaaagagggcgaccagtacatatacatgggtcagcctttgaacaacgacgaggatcacgcccactggacggaggcgaagatgctcctagataacatcaacacgcctgagggtatcatccccgccctcttcgagcccgagcgggagaagtccgcggctatcgacggagaataccgcctgcgaggagaggcccgtaagacctttgtggagctgatgcgcaggggcgacctcccggtgtggctgtcctacaaagtcgcctccgagggatttcaatacagcgaccggcgctggtgcttcgacggggagcgcaacaaccaggtgctcgaggagaacatggacgtggagatctggaccaaggagggggagcgcaagaagttacgcccacgttggctggatgcccgcacgtactcagaccccctggcgcttcgggagttcaaggagttcgccgccggtcgtcggagcgtctcgggcgacttaatcctggagattggcaagctcccgcagcaccttacccagcgcgcccagaacgcgctggacaacctcgtgatgctgcacaacagcgagcagggcgggcgagcctatcgccatgctatggaggagttaccagacaccatcgagactctcatgctgttagccctcatcgccgtgctgaccgggggggtaaccctgttctttttatccggcaagggcctgggcaagaccagcatcgggctcctctgcgttatggcgtcctccgtgctgctgtggatggcatctgtagaaccccactggatcgcagccagcatcatcctcgagtttttcctcatggtgctgctcatacccgaaccagaccggcagcgcaccccccaagacaaccagctggcgtacgtggtcatcggtctgctcttcatgatcctcactgtggctgccaatgagatggggctgctcgagacgacaaaaaaagacctgggaatagggcacgtggctgtcgagaaccaccaccacgcggcaatgctggatgtagatctccaccccgcgtccgcctggaccttatatgcagtggccaccacgatcattaccccgatgatgcggcacaccatcgagaacactactgccaacatcagcctaaccgccatagccaaccaggctgccatcctcatgggcctggacaaaggctggcccatctccaagatggacatcggggtcccgctcttggcgctggggtgttacagccaggtgaaccccctgaccctcacggccgctgtgctaatgcttgtagcccactatgccatcatcgggccgggcctccaggcgaaagctacacgcgaggctcagaaacggacagccgccgggatcatgaagaacccgactatcgacggcatagttgcgatcgacctagaccctgtggtttacgacgctaaattcgaaaaacaactgggccaaataatgctcctgatcctgtgcacctcacagatcctcctaatgcggacgacctgggcgctgtgcgagagcattacgttagccaccgggccgctgacgaccctatgggaaggctctccgggtaaattctggaataccaccatcgccgttagcatggcgaatatcttccgcggctcctacttggccggcgccgggctggccttctccctgatgaagtcccttggcgggggccggaggggcacgggcgcgcagggcgagaccctgggggagaagtggaagaggcaactcaaccagctctcgaagagcgagttcaacacctacaagcgcagtggaatcatggaggtagaccggagcgaggctaaggaggggttaaagagaggtgagacaacgaaacacgcagtatcccgggggaccgccaagctgcgctggtttgtggagcggaatttagtgaagccggagggcaaggtcatcgacctcggatgcggccgcggcgggtggagctactactgcgccggactgaagaaagtgacggaagtgaaggggtatacaaagggcggtcccggccacgaagagcccatcccgatggcgacatacggctggaacctggtcaagctccattcagggaaagacgtgttcttcatcccacccgagaaatgcgacacccttttgtgcgacatcggcgaatcctccccgaacccgacgatcgaggaggggcggacgctccgggtacttaagatggtcgagccctggctgcggggcaaccagttttgcattaagatactcaacccatatatgcctagcgtggtcgagacgctggagcagatgcagcgcaagcatggcgggatgctcgtccggaatccgttgtcccgcaacagcacccacgaaatgtactgggtttcctgcggaaccgggaacatcgtgagcgccgtcaatatgacctcccggatgctgctgaaccgcttcaccatggcccaccggaagcccacgtacgagagagatgtagatctcggcgccggtacccgccacgtggctgtcgagcccgaggtggctaatctggacataatcgggcagcggattgagaacataaaacatgaacacaaatcaacgtggcattacgacgaagacaacccctacaagacctgggcctaccacggctcctacgaggtaaagccgagcgggtcagctagcagcatggtcaacggcgtggtgaaactgttaacgaagccctgggatgtgatccctatggtaacccagatcgccatgaccgacacgacgccctttgggcagcagcgggtcttcaaagagaaggtggatacacggacccctaaggccaagcggggtaccgcgcagatcatggaggtgaccgcaaagtggctctggggcttcctgtcccggaacaagaagccgcgcatatgcacccgggaggagttcacgcgcaaggtccggagcaacgccgccatcggcgcggtgtttgtggacgagaatcagtggaactctgcaaaagaggccgtcgaggatgatcgcttctgggacctcgtgcaccgagagagggagctgcacaagcagggcaagtgcgcgacctgtgtgtacaacatgatgggtaagcgggagaaaaagttaggcgagttcggtaaggccaaggggagtcgcgcgatctggtacatgtggctcggggcccggtttctggagttcgaggccctggggttcatgaatgaggaccattggttctcccgcgagaacagcctctccggcgtcgaaggggagggcctgcataaattggggtatatccttagagacatcagtaaaatccccggtgggaacatgtacgccgatgacacggccgggtgggacaccaggataacggaggacgacctgcagaacgaggcgaagatcactgacattatggaaccggagcacgccctactcgccaagtccatattcaagctgacgtaccagaataaggttgtgcgggtgcagcgccccgccaagaatggcaccgtgatggacgtgataagccggcgcgatcagcgcggttccggccaggtgggcacgtacggcctgaacaccttcacgaacatggaggcccagctcatccggcagatggagagcgagggaatcttctcccccaacgagttagagacgccaaatctggccgagcgagtgctcgactggctggagaagtacggggtggaacgtcttaagcgcatggccatcagcggcgatgactgcgtcgtgaagccgattgacgacagattcgccaccgccctcacagctctgaacgacatggggaaggtgcgcaaagatattccccagtgggagccctccaagggctggaacgactggcagcaggtccctttctgtagccaccacttccaccagctgatcatgaaggacggccgggagatcgtggtaccgtgcagaaaccaggacgagctggtcggtcgggcgagagtctcccagggtgcagggtggtctctgcgggagacggcctgccttggcaagagctacgcccagatgtggcaacttatgtactttcacagacgtgacctgcgcttggcggccaacgccatctgctccgccgtgcccgtcgactgggtgcctaccagccgtaccacctggtccatccatgcccaccaccagtggatgacgaccgaggacatgctcagcgtctggaaccgcgtttggatcgaggagaacccctggatggaggacaagacccggatctccagctgggaggatgtgccgtatcttggcaagcgcgaggaccagtggtgcggatccctgatcggtctcaccgcgagggccacgtgggccacaaacatccaggttgcgatcaaccaggtccgcagattaatcggaaatgagaactacagtgactacatgacttcaatgaagcgcttcaaaaatgagtccgagcccgagggcgccctatggtga

SEQ ID NO: 24000 - RNA, 9879 nt, synthetic construct
  misc_feature 1..9879: note = derived and/or modified CDS sequence (opt11) from DENV-1__FJ687428__SS-prME
  source 1..9879: mol_type = other RNA
tctgtgacaatgctcctcatgttaatgcccaccgcgctggcattccacctcacaacgcggggcggggagccgcatatgatcgtcagtaagcaggaacggggcaagagcctgttgttcaagaccagcgcgggggtgaatatgtgtactttgatcgccatggacctaggggaactgtgcgaggacactatgacctacaagtgcccccgaataacggaggccgaacctgacgacgtggactgttggtgcaacgcgaccgacacgtgggtaacatacgggacctgcagccagaccggcgagcaccggcgggacaagcgaagcgtagcactcgcgcctcatgtaggcctggggttagagacgcgcaccgagacctggatgagctccgagggcgcctggaagcagatccagcgggtggagacctgggccctccgccacccggggtttacggtgatcgccctcttcctggcgcacgcgatcggcaccagcatcacccagaaagggatcatcttcatcctcttgatgttggtgaccccctccatggcgatgcggtgcgtcggcatcggcagccgagattttgtagaaggtttgtccggtgccacttgggttgacgtggtgcttgagcacggctcgtgcgtgaccaccatggcaaaagacaaacccaccctcgacatcgagctcctgaaaacggaggtgaccaaccccgcggttctcaggaagctctgcatcgaggccaagatcagtaacactacaacggacagtcgctgcccgacccagggcgaggctaccctcgtcgaagaacaagacgccaacttcgtctgccggcggaccttcgtggatcggggctgggggaacggctgtgggctgttcggcaaggggtccctcctgacgtgtgccaaatttaaatgcgtgaccaagctggaaggaaaaatcgtccagtacgaaaaccttaagtacagcgtgatcgtgaccgtacacaccggcgatcagcaccaggtagggaacgagtcgacggagcacggcaccactgctaccatcacgccgcaggcccccacaaccgaaattcagcttaccgactacggggccctaaccctcgactgctcaccccggaccggcctggacttcaacgagatggtcctgctcaccatgaaggagaaatcctggttggtgcacaaacagtggttcctggacctcccgctgccctggaccagcggggccagcaccagtcaggagacgtggaaccggcaggacctgctagtgaccttcaagaccgctcacgcgaagaaacaggaggtcgtggtgttgggctctcaggagggcgccatgcatactgctctgacgggcgcgaccgaaatccagacctccggtaccacgaccatcttcgctgggcacctcaagtgtcggctgaagatggacaagctgactctcaagggcatgagctacgtcatgtgcaccggatccttcaagttagagaaggaggtggcggagacgcaacatggcaccgtactggttcagattaagtatgaagggaccgatgcaccgtgcaagatccccttctcgacccaggacgagaagggggtgactcagaacggtcggctgatcacagcgaacccgatcgtgaccgataaggagaaacccgtcaacatcgaggcagagccgcccttcggggagtcctacatcgtgatcggcgcgggcgagaaggcactcaagctgagctggttcaagaagggatcaagcatcgggaagatgttcgaggccaccgcccgcggtgcccgtcgcatggccatcctgggcgacacggcctgggactttgggtccatcggcggcgtattcacctcagttggaaagctcgtacaccaaatcttcggcaccgcctatggggtgctgttctccggcgtaagctggacgatgaagattggaatcggtgtattgcttacgtggttgggcctgaacagtcgtagcacctcccttagtatgacttgtatcgctgtcgggctggtgactctatacctaggcgtgatggtgcaggccgactccgggtgcgtcatcaattggaagggccgggagcttaagtgcgggagcggcatcttcgttacgaatgaggtgcacacctggaccgagcagtacaaattccaagctgacagcccgaagcgcctgtcagctgccatcggcaaggcctgggaggagggggtttgcggcatccggagcgctacccgcctcgagaacataatgtggaagcagatatctaacgagctgaaccacatcttactcgagaacgacatgaaatttacagtcgtggtcggagacgtggcggggatcctggcccaggggaagaagatgatcaggccccagcccatggagtacaagtattcatggaaaagctggggcaaggcaaagatcatcggcgctgacgtccagaacagcacgtttatcatagacggccctaacaccccggaatgccccgatgaccagcgtgcgtggaatatatgggaggtcgaggactacgggtttggtatctttaccaccaacatatggctcaagctgcgggactcctatacccaggtatgcgatcaccgcctgatgtctgccgccataaaggattccaaggcggtccacgcagatatgggctactggattgagagcgagaaaaacgagacgtggaaactggcgggcgcctctttcatcgaggtgaaaacctgtatctggcccaagtcacataccctctggtccaacggcgtgctggaatccgagatgataatccccaagatctatggaggccctatctcccagcacaactaccggcccggctacttcacgcagaccgccgggccatggcacttaggaaagctcgagcttgacttcgacctgtgcgaggggaccaccgtggtcgtggacgagcattgcgggaaccgtgggccgtcgcttcggacgaccactgtgaccggtaagatcatccacgagtggtgttgtcgctcatgcacgttgccacccctgagattccgcggcgaggatgggtgctggtacggcatggagatccggcccgtcaaggaaaaggaggagaaccttgtgaagtctatggtgagcgccggctccggggaagtagacagcttctcccttggcttattgtgtattagcatcatgatcgaagaggtcatgcggtctcggtggagccgcaagatgctgatgaccgggacgctcgccgtgttcttcctcttaatcatgggccagctgacatggaatgacttaatccgtctctgtatcatggtcggagccaacgcctccgacagaatgggcatgggtacgacatatctggccctaatggccacattcaagatgcgccccatgttcgcggtggggctgttatttcgccggctcacgagccgggaggtgctgctcctgacaattggcctgtccctggtagcgagcgtagagctccccaactccctggaggagctcggagacggcctcgccatgggaatcatgatcctgaagttactcacagacttccagagccatcagctgtgggccacactgctctcactgacgtttatcaagacgacgctttcgctccactacgcgtggaaaaccatggcgatggtcctgtccatcgtgagcctgtttcctctctgcctgtccacgacaagccagaagaccacttggcttcccgtgctgctggggtccttaggctgtaagccgctcaccatgttcctgatcgcagagaataagatctgggggcgcaagagctggcccctaaacgagggtatcatggccgtcgggatcgtgagcatattgctcagttctctgctgaagaatgacgtgcccttggcgggacccctcatagctggcggcatgctaattgcgtgctatgtcatctccggcagcagtgccgatctgagccttgagaaggccgccgaggtttcctgggaagaggaggcagagcacagcggggcctcccacaacatcctcgtggaggtccaggacgacggcacgatgaagatcaaggacgaggagcgggatgacaccctgaccattctgctcaaggctacactgctggccgtcagcggagtatacccactctccattcccgccaccctgttcgtctggtacttctggcagaagaagaaacagcgcagcggcgttctatgggacacgcccagccctccagaggtggagcgagccgtgctggacgatggcatctaccgcatcatgcagcgggggctcctgggaaggtcacaggtgggcgttggggtctttcaggaaaacgtttttcataccatgtggcacgtgacccgcggggccgttctgatgtaccagggcaaacgtttagagccctcgtgggcaagcgttaagaaagacctgatttcctacggcggagggtggcggctgcaggggagctggaataccggcgaagaggtgcaggttatcgccgttgagccggggaagaaccccaagaacgtgcagactgcccccggcaccttcaagactcccgaaggcgaagtaggtgctatcgcgctcgactttaagccgggcacttccggaagccccatcgtgaaccgcgagggcaagatagtgggcctgtacgggaatggcgtcgtgacgacaagcgggacctacgtttccgccatagcccaggcaaaggcttcccaagagggcccgctgcccgagatcgaagacgaggtctttcggaagcggaatctaaccatcatggacctgcaccctggctccggcaagacgcggcgctacctgccggccattgtgcgggaggccatcaaacgcaagctccgcaccctgatcctggcccccaccagagtggtcgccagcgagatggcggaagcgctcaagggaatgcccatccgctaccaaaccactgccgttaagtcggagcacaccgggaaggagatcgtggacctcatgtgccacgccaccttcacaatgagactgctcagccccgtacgagtgcctaactataacatgatcatcatggacgaagcgcacttcacggacccgtccagcatcgcggccagaggatatatatccacccgcgttgggatgggcgaagcggccgcgatcttcatgaccgccacccctcccgggagcgtcgaggccttcccccagtccaacgcggtgatccaggacgaagaacgggacatcccggagcgcagctggaactccggctacgaatggataacggacttccccggtaagacagtgtggtttgtcccttcgatcaaggccgggaacgatatagcgaactgcctgcggaagaacggtaagcgagttattcagctgtcccggaaaaccttcgacaccgaataccagaaaacgaagaataacgattgggactacgtggttacaacggacatcagcgagatgggggcaaacttccgcgccgaccgggtgatcgacccgcggaggtgtctcaagcctgtgatccttaaggacggccccgaacgcgtcatccttgccgggcccatgcccgttaccgtcgcttccgcggcccagcggagaggccggattggaaggaaccacaacaaggaaggggaccagtacatctacatgggccagcccctcaacaacgacgaggaccacgcccattggaccgaggccaagatgctgctggacaacatcaacacccctgaagggataatcccagccctatttgaacctgagcgggagaagtccgcggcaatcgacggcgagtaccgcctgagaggggaggccaggaaaacctttgtagagctgatgcgcagaggggacctgccagtctggctgtcctataaggtcgccagcgagggttttcagtacagcgaccgccggtggtgctttgacggcgagcgcaataatcaagtgttagaggagaatatggacgtggagatttggaccaaggagggcgagaggaaaaagctccgccccagatggctggatgcccgaacgtactccgaccctctggcgttacgggagttcaaggagttcgcagccgggcgccggtccgtctctggcgaccttatcctggagattggcaaactaccgcaacatctgactcagcgcgcgcagaacgcgctggacaacctcgtaatgctgcacaatagcgaacaaggcgggcgggcctaccgtcacgctatggaggagctgcccgacaccattgaaacccttatgctgctggccctcatcgcggtgctcaccgggggagtcacccttttcttcctgtccgggaaaggcctggggaagacctccatcgggctgctctgcgtcatggcgtcctccgttctgctgtggatggcatccgtagagccccactggatcgccgccagcatcatacttgagtttttcctgatggtgctgctcatccccgagccggaccggcaacgcacgccgcaggataatcaattggcctacgttgtcattggtctcctgttcatgatcctgacagtggcagccaatgagatggggctgctcgagacgaccaagaaggacctggggatagggcatgtggccgttgagaaccaccaccacgccgcaatgctggacgtggatctccatccggcgagcgcctggaccctgtacgcagtggccacaacgatcatcacaccgatgatgcggcacacaatcgaaaacaccacggcgaacatcagcctaacggcgatcgccaaccaagccgccatactcatgggccttgacaaggggtggcccatatccaagatggacatcggggtcccactgctcgcgttggggtgctacagccaggtaaaccccctaacgctcacggcggctgtgctgatgctagtcgcccattacgccatcatcgggcctggcttacaggcaaaggccacccgcgaggcccagaagcggactgcggctgggatcatgaaaaaccccaccattgacggcatcgtagcgatcgacctggaccctgttgtctacgacgccaagttcgagaagcagctcggccagatcatgctgctgatcctgtgcacctcccaaatcctgctaatgcgcacgacatgggctctctgcgaaagcatcaccctcgccaccggccccctaacgaccctgtgggagggctcgccggggaaattttggaacaccacaatcgccgttagtatggcgaatatcttccgaggctcctatttggccggcgctgggctcgccttttcgcttatgaaaagcctcggcgggggccgacgcgggacgggggcacagggagagacgctgggggagaaatggaagcggcagttaaaccagctctcaaaaagcgagttcaacacctataaacgctccggaattatggaggtcgaccggtccgaggcgaaggaggggttgaagcgcggcgagaccacgaaacatgctgtcagtcgggggacagccaagctgcgctggttcgtggagcgcaatctggtgaaacccgagggtaaggtaatcgacctcggctgcggacggggcggctggagctactactgtgccggactgaagaaggtgaccgaagtgaaggggtacacaaaagggggacccgggcacgaggagccaattccgatggccacgtatggctggaaccttgtcaagctccactcagggaaggacgtgttctttataccacccgagaagtgcgacaccctcctgtgcgacataggcgaatcaagccctaacccgaccatcgaggaagggcggacactcagagtcctaaagatggtcgagccctggctgcggggcaatcagttctgcattaagatactcaatccttatatgcccagcgtagtggagacgctcgaacagatgcaacgcaagcacggcggaatgctggtccggaacccgctctccaggaactctacccatgagatgtactgggtctcttgcggcaccgggaacatcgtcagcgccgtaaatatgacctcccggatgctgctgaaccgcttcaccatggcccaccggaagcccacgtacgagcgcgacgtcgacctcggcgcgggaaccaggcatgtggccgtagagccagaagtggcgaacctggacataatcggacaacgcatcgaaagcatcaagcacgagcacaagtccacatggcattacgacgaagacaacccctacaagacctgggcctaccacggaagctacgaagtgaagccctccgggagcgcctcatccatggtcaacggcgtggtcaagctactcacgaagccctgggacgtgatccccatggtgacgcagatagccatgacagacaccacccccttcgggcagcaacgcgttttcaaagaaaaggtggacacacggacaccgaaggccaagcgcggcaccgctcaaatcatggaggtgactgccaagtggttgtggggcttcctgagcagaaacaagaagccacgcatctgcacccgggaggagtttacacggaaggtacggtctaatgccgctatcggagcggtgttcgttgatgaaaaccagtggaatagtgctaaggaggctgtcgaggacgaccgcttttgggacctcgtgcaccgggagagagaactccacaagcagggtaagtgcgcgacctgcgtgtacaatatgatgggtaagagggaaaagaagctaggcgagttcggtaaggccaaaggcagccgcgcgatttggtacatgtggctgggagcccgcttccttgagtttgaggcactggggtttatgaacgaggaccactggttcagccgcgaaaactccttatccggcgtcgagggggagggcctgcacaagctggggtacatcttgcgggacatcagtaagatccccggtggcaatatgtacgccgacgatacggcgggctgggacacccgcataaccgaggacgacctgcagaacgaggccaaaataacagacatcatggagccggagcacgcactcttggctaagagcatcttcaagctgacctatcaaaacaaagttgtccgggtccagcgaccggctaaaaacggcacggtcatggacgtgatctcccgcagggaccagcgaggctccgggcaggtcggcacctatggtctaaacaccttcactaacatggaggcccagctgataaggcagatggaaagtgaaggcatcttctcccccaatgagctggagacccccaacctcgcggaacgcgttcttgactggttggagaaatacggagttgagcggctaaagcgcatggcgatctccggagacgactgcgtcgtcaagccaatcgatgaccggtttgccactgccctgaccgccttaaatgacatggggaaagtgcgcaaggatatcccgcagtgggaacccagcaaaggctggaacgactggcagcaagtccccttctgctcccatcattttcaccaactcattatgaaagacggtcgggagatcgtggtgccgtgccgcaaccaggatgaactcgtgggcagggcgcgcgttagccagggggccggttggagcctacgcgagacggcctgcctgggcaagtcctacgcccagatgtggcagctcatgtacttccatcgtagggatttacgccttgctgccaacgcgatctgctcagcagtgcccgtcgactgggtgcccacttctcggactacctggagcatacacgcccaccaccagtggatgactacagaggatatgctctccgtatggaaccgcgtgtggattgaggagaacccctggatggaggacaaaacccggattagctcctgggaagacgtaccttacctgggtaagcgagaggaccagtggtgtgggagcttgatcggtctcaccgcccgggccacgtgggcgacaaacatacaggtggccatcaaccaggtccgccgcctgatcgggaacgagaactactccgactatatgaccagcatgaaacggttcaagaacgaatccgagcccgagggcgccctgtggtga

SEQ ID NO: 24001 - RNA, 9879 nt, synthetic construct
  misc_feature 1..9879: note = derived and/or modified CDS sequence (opt11) from DENV-1__FJ687429__SS-prME
  source 1..9879: mol_type = other RNA
tctgtgaccatgctgctgatgttaatgcccaccgccttagcctttcacctcaccactagaggcggggaaccccacatgatcgtgagcaagcaggaacgaggcaaaagcctgctattcaagactagcgccggggtgaatatgtgcaccctcatcgccatggacttaggcgagctgtgcgaggacaccatgacctacaaatgtccccggataaccgaggccgagccagacgacgttgactgctggtgcaatgcaacggatacgtgggtcacctatggcacgtgctctcagaccggcgagcaccggcgggataagcggtccgtggcccttgcgccccacgtgggcctgggtctggaaacacggaccgagacatggatgagctccgagggcgcctggaagcagattcaacgggtcgagacgtgggcgctgcgccaccctgggtttacggtgattgcgctgttcctggcgcatgctatcggcaccagcatcacacagaaagggatcatcttcatcctcctgatgctggtgaccccatctatggccatgcggtgtgtcggtatcggcagccgcgacttcgtggaggggctctccggagccacgtggattgacgtagtgttagagcacgggagctgcatcacgaccatggccaaggacaagcccacgctcgatatcgaactcctgaagacggaggtaacaaatccggcggtgctacgcaagctctgcatcgaggccaaaatctcaaacaccaccactgacagccgctgtccgacccagggcgaggccaccctggtcgaggagcaggacgccaacttcgtgtgccggcgcacctttgtagaccggggctgggggaacggatgcgggctgttcggcaaaggctccctcttgacgtgcgccaagttcaagtgcgtcaccaagctggagggcaaaatcgtgcagtatgagaacttaaagtactccgtaattgtgacagttcacaccggagatcagcaccaggtggggaacgagagcacagagcatggcaccacggctaccatcacgccccaagcacccacgaccgagatccaactgaccgactatggggccctgaccctcgactgttcgccgcggacgggcctggacttcaacgagatggtcctgctcaccatgaaggagaagtcatggctggtgcacaagcagtggtttctggaccttcccctgccctggacgtctggcgcctcaacctcacaagaaacctggaaccgacaggacctactcgtcaccttcaagaccgcccacgcgaagaagcaggaagtggtagtccttggcagccaggagggcgccatgcacaccgccctgacgggggccacagagatccagacttccggcaccacgacaatcttcgcggggcacctcaagtgccgcctaaaaatggacaaattaacccttaagggcatgagctacgtgatgtgcaccgggtccttcaagttagagaaggaggttgcagaaacgcagcacggtaccgtgctggtccagataaaatacgaaggtaccgacgccccctgcaagatacccttcagcacccaggacgagaagggggtgacccagaacggtcggctgatcacggccaaccctatcgtaacggacaaggagaagccggtgaacatagaggccgagccgcccttcggggagtcctatatcgtaataggcgcgggtgagaaggctctcaagctgagctggttcaagaaggggagcagtatcgggaagatgttcgaggcgactgcgcgcggggcgcggcgcatggcgatcctgggcgacaccgcatgggacttcgggagcattggcggcgtctttaccagcgtggggaagctcgtgcaccagattttcggcaccgcctacggggtccttttctccggggtgtcgtggactatgaagatcgggatcggggtgctgctcacctggctggggttaaactcccgtagcacctccttgtccatgacgtgtatcgccgttgggctggtgaccctgtatctcggcgtgatggtacaggcggactccggttgcgtgatcaactggaagggtcgcgagctgaagtgcgggagcggtatcttcgtgactaacgaggtccacacctggaccgagcagtacaagttccaggctgacagcccgaagcgcctgtccgccgccatcggcaaggcctgggaggagggcgtgtgtggcattcggagcgcgacgcgtctcgaaaacatcatgtggaaacagatctcgaacgagctgaaccacatccttctcgagaacgacatgaaattcaccgtggtagtgggggatgtggctggcatcctagcccagggaaagaagatgatccggccccagcccatggaatacaagtatagctggaagagctggggcaaagcgaagatcatcggcgcagacgtccagaacagcaccttcataatcgacgggcccaacacaccggagtgcccggacgaccagagagcttggaatatctgggaggtggaggattacgggttcggcatcttcactaccaatatctggctaaaacttcgggattcctacacccaggtgtgcgatcaccggttaatgtccgccgccatcaaggactccaaagccgtccacgccgacatgggctactggatagagagcgagaagaacgagacatggaaattggcgagagcctccttcatcgaggtgaagacctgtatctggccaaagtcgcacaccctatggtccaacggagtgctggaaagcgagatgatcatccccaaaatctacgggggcccgatctcccagcataactaccgcccagggtacttcacacaaaccgccggtccctggcacctggggaaactcgagctcgacttcgacctgtgcgaggggaccaccgtcgtggtggatgaacattgcggcaatcgtggaccgtctcttaggacaaccactgtcaccggaaaaattattcacgagtggtgctgccggagctgcacgctgccgcccctgcgcttccgcggggaggacggctgctggtacgggatggaaatccgcccagttaaggagaaggaggaaaacctagtaaagtccatggttagtgccggctcaggcgaggtggatagcttcagcttggggctgctttgtatcagtatcatgatcgaggaggttatgcggtcccgctggtcccggaagatgctgatgaccggcaccttagccgtcttcttcctcctcattatggggcaactgacctggaacgacctcattcgcctctgcattatggtgggcgctaacgcctcagatcgcatggggatgggcacgacttacctagccctcatggctacattcaaaatgagaccaatgttcgcagtgggtcttctgtttcgccggctcactagcagagaggtcctgctgctaacaatcggcttatccctggtggcgagcgtggagctccccaactccctggaagagctgggcgacggtctcgccatgggcatcatgatcctgaagctgctcacggacttccaaagccaccaactatgggccaccctgctctcactgacctttatcaaaactacctttagtctgcattatgcatggaagaccatggcaatggtcctcagcatagtcagcctgttccccctgtgcctctccacgacgagccaaaagacgacctggctccccgtcctgttgggaagcctggggtgtaaaccgctgacgatgttcctcatcgccgagaacaagatctggggccggaagagctggccccttaacgagggaattatggccgtaggcatcgtaagtatcctgttatccagcctgctgaagaatgacgtccccctagccggacccctgatcgctggcggaatgctgatcgcatgctacgtgatctccggcagctccgccgacctcagcctggaaaaggccgccgaggtgagttgggaagaggaggccgagcactcaggtgcttcacacaacatccttgtcgaggtgcaagacgatggaacaatgaagatcaaggacgaagagcgcgacgacaccctcacaatactgctgaaggccacattactggccgtgagcggcgtatacccgctgagtatccccgccaccctcttcgtgtggtacttctggcagaagaagaagcagcggagcggtgtgctgtgggacactcccagtcctcccgaggttgagcgtgccgtactagacgacggcatctaccggatcatgcagcgcggcctgttagggagatcccaggtgggcgtcggggtgttccaggagaacgtgttccacacgatgtggcacgttacgcgcggtgcggtgctgatgtaccaagggaaacggctcgagccctcctgggccagcgtgaagaaggacctcatctcctacggcggcgggtggaggctgcagggcagctggaacaccggggaggaggtccaggtgatcgccgtggagcccggcaagaatccgaagaatgttcagacggcacccgggaccttcaagacccccgaaggcgaggtgggcgccatcgcgctggactttaagcccgggacctcaggcagccccatcgtgaaccgggaggggaaaattgtcggcctctacggcaacggggtagtgacgaccagcggaacctacgtcagcgccatcgcccaggccaaggcgagccaggaggggccgctccccgaaattgaggacgaggtgtttcgcaagcggaacctgacgatcatggacctccaccccgggtccgggaagacacgccggtacctgcccgccattgtgcgagaggccatcaagcggaagctgcgcaccctgatcctggcccccacgcgagtcgtggcctcggagatggcggaggccctcaaagggatgcccattaggtaccagactacggccgtgaaatccgagcacaccggcaaggagatcgttgacctcatgtgtcacgccaccttcaccatgaggctgctgtcgcccgtgcgtgtgccgaactacaacatgatcatcatggatgaggcccactttacggacccctccagcatcgccgcccgagggtacatctccacccgggtcggcatgggggaggccgccgccatcttcatgaccgctaccccgcccggcagcgtagaagccttccctcagtccaacgccgtgatccaggacgaggagcgcgacattccggagcggtcctggaactccgggtacgagtggataacggacttccccggcaagaccgtctggttcgtgcccagcatcaaggctggcaatgacatcgctaactgcctccgcaagaacggcaagcgtgtgatccagctgagtcgcaaaaccttcgacaccgagtaccagaagacgaagaacaatgactgggactacgtagtgaccactgacatctcggagatgggagccaacttccgggccgaccgcgtaatcgacccgcggcgctgcctgaaacccgttatcttaaaggacggacccgagcgagtcatcctggccggccccatgccagtgacggtcgcctccgcggcccagagacgggggcgcatcggccgcaaccacaacaaagagggcgatcagtacatctatatggggcagcctctgaacaacgatgaggatcacgcccattggaccgaagccaagatgctcctggacaacatcaacacccccgagggcatcataccagccttgtttgagccggagcgcgagaagtccgcggccattgacggagagtacaggctccggggcgaggcccgcaagaccttcgtcgagcttatgcggcgcggcgacctgcccgtctggctttcctacaaggtggccagtgaaggcttccaatactctgaccgacgctggtgcttcgacggcgagcgcaataaccaggtgctggaggagaacatggacgtcgagatctggaccaaggagggggagaggaaaaagttgcgacccaggtggctcgatgcccggacgtactcagaccccctggcgctgagggagttcaaggaattcgccgccggacggcgcagcgtatccggggacctcatactggagatcggaaagttaccgcagcacctcactcagcgggcgcagaacgcgctggacaacctggtgatgctccataacagcgaacagggcgggcgcgcgtaccggcacgcaatggaggagctacccgacaccatcgaaacactcatgctcttagccctgatagccgtgctcacgggaggggtgaccctgttcttcctgtccggaaaggggctcgggaagaccagcatcggcctgctgtgtgtaatggcgtccagcgtccttctgtggatggcctccgtcgagccccactggatcgccgcctctattatcctggagttctttctcatggtgctgctgatccccgagccagatcgccaacggacgccccaggacaaccagctcgcctacgtcgtgatcgggttactgttcatgatcctcaccgtggccgccaacgagatgggtctcctggaaacgaccaagaaggatctagggataggccacgtcgccgtggagaaccaccaccacgccgccatgctggacgtagacctgcaccccgcgtccgcatggaccctctacgccgtcgccaccacgataatcacaccgatgatgaggcataccattgagaacaccacggccaacatctcgctgaccgcaatcgccaaccaagccgctatccttatggggctggacaaagggtggcccatatccaaaatggacatcggcgtgcccctgcttgcgctcgggtgctactctcaggtgaatccccttaccctgaccgcagccgtcctcatgttagtggcccactacgccattatcgggccgggactgcaggccaaagctacgcgggaggcccaaaagcgcacggccgccggtatcatgaagaatcccaccattgatgggatagtggcgatagacttggaccccgttgtgtatgacgcaaagttcgagaagcagctgggccagatcatgctactcattctgtgcacctcccagatcctgctcatgcgaacgacgtgggccctgtgcgagagcatcactctggccaccggtcccctcacgaccctgtgggaggggtccccgggcaagttctggaacaccaccatcgcagtgagcatggctaacatcttccgtgggtcctacctggccggcgctggcctcgccttcagcctgatgaagtctctcggcggtgggcgccgcggaaccggggcgcagggcgagacgctcggagagaagtggaagcgccagctgaaccagcttagtaagtctgagttcaatacttacaagcggtccgggataatggaggtcgaccgcagcgaggcgaaggagggcctcaagcggggggagacaacgaaacatgccgtgtcccgcggaaccgccaagctgcggtggttcgtagagcgaaatttggtgaaacccgaagggaaggtgatcgacctgggctgcggacgcggcgggtggagctactactgcgctgggctcaagaaggttacggaggtcaagggttacacaaaggggggccctgggcacgaggagcccatcccgatggccacgtacgggtggaatctggtgaaactgcactccgggaaagatgtgttctttatcccacccgagaagtgcgacaccctcctatgcgacattggggagtcatcccctaacccgaccatcgaagagggccgcacactccgggtcctcaagatggtggagccctggcttcgaggtaaccagttctgcatcaagatcctgaatccctatatgcccagcgtcgtagaaaccttggagcagatgcaacggaagcatggcggcatgctcgtgagaaacccactgagccggaacagcacacacgagatgtactgggtgtcttgcgggaccggcaatatcgtgagtgccgtgaacatgacctccagaatgctcctgaaccggtttaccatggcccacaggaagcccacgtacgaacgcgacgtggacctgggggcaggtacccggcacgtcgccgtggagcccgaggtggcgaacctcgacatcataggccagcgaatcgagaacatcaagcacgagcacaaaagcacctggcactacgacgaggacaacccgtacaagacctgggcttaccacgggagctatgaggtcaaaccgagcggctccgcaagctctatggtgaacggggtggtcaagctgctgaccaagccctgggatgtgatccccatggtgacccaaatagccatgaccgacaccacgcccttcggccagcagcgggtgttcaaggaaaaagtggacacccgcaccccgaaggccaagcgggggaccgcgcagatcatggaggtcactgcccgctggctctggggcttcttgtcgcggaataagaagcctcgcatctgcacccgggaggagttcaccagaaaagtaaggagcaacgccgccatcggcgcggtgtttgtcgacgagaaccagtggaactccgccaaggaggccgtggaagacgaccgcttctgggacctggttcaccgcgagagggagctccacaaacaagggaaatgcgcgacctgtgtttataacatgatgggtaagcgggagaagaagctgggggagttcggcaaggcaaaggggtcaagagccatttggtatatgtggctaggcgcacggttcctcgagttcgaagccctcggcttcatgaacgaggaccactggttctcccgcgagaacagcctgtccggggtggagggtgaagggttacacaagctgggttacatcctgcgtgacatcagcaagatccccggtggcaatatgtacgctgacgatacggctggatgggacacccgcatcaccgaagacgacctccagaatgaggcgaagatcaccgacatcatggagccggaacacgccctgttagccaagtccatcttcaagctcacttaccagaacaaggttgtccgtgtgcagcgccccgcgaaaaacggaactgtcatggacgtcatcagccgccgggaccaaaggggctccggccaagtggggacctacggtcttaacaccttcacgaacatggaggcccagctcatccgtcagatggagtccgagggcatcttctcccccaacgagctcgagaccccaaaccttgcggagcgcgtgctggactggctcgagaagtacggcgtcgagcggctgaaacgcatggccatttctggggacgactgcgtggtgaagcctatcgacgaccggttcgccacggcactgaccgccctcaacgacatgggcaaggtccggaaggatatcccgcagtgggagccctccaaagggtggaacgactggcagcaggtccctttctgcagccaccatttccaccaattaatcatgaaggacggtcgggagatcgtggtcccgtgccggaaccaggacgagctagtgggtagagcgcgcgttagccagggtgccgggtggagcctccgtgaaacggcctgcctgggcaagagctacgcccagatgtggcagctgatgtacttccatcgccgggaccttcgcctggcggccaacgcaatctgctccgccgtgcccgtggattgggtgcccacaagccggaccacctggtcgatacatgcccaccaccagtggatgacgaccgaggacatgctgagcgtttggaaccgcgtgtggattgaggagaacccctggatggaggacaagacccgcatatcatcctgggaggacgtaccatatttaggcaagcgcgaggaccagtggtgcgggtccctgattggcctgaccgcgcgcgccacgtgggccaccaacattcaggtcgcaatcaaccaggtgcgccgtctcatcggcaacgagaactactcagactacatgacatccatgaagcggttcaagaacgagtcggagcccgagggcgccctgtggtga

SEQ ID NO: 24002 - RNA, 9879 nt, synthetic construct
  misc_feature 1..9879: note = derived and/or modified CDS sequence (opt11) from DENV-1__FJ850068__SS-prME
  source 1..9879: mol_type = other RNA
tcagtgacgatgctgctcatgctgatgccgaccgccctcgccttccacctcaccacccgtggcggggagccccacatgatcgtctctaaacaggaaagaggaaagagtctactgttcaagacctcggcgggggtgaacatgtgtaccctgatcgcgatggacctcggcgaactgtgcgaggacacgatgacctacaagtgcccacgcatcaccgaggccgaacccgacgatgttgactgctggtgcaacgccaccgacacttgggtgacctacgggacctgcagccagaccggcgagcaccgacgcgacaagcgctccgtggccctcgcgccgcacgtgggcctggggctggagacgcgcactgagacttggatgagcagtgaaggcgcctggaagcagattcagcgggttgagacctgggccctcaggcaccccggtttcacggtgatcgccttattcctggcgcatgctatcggtacgagcataactcagaagggaatcattttcatcctcctgatgctggtgaccccctccatggcgatgcggtgcgtcggcattggcagcagagacttcgtggaaggcctctcgggcgctacgtgggtggatgtcgtcttagaacacggtagttgtgtgacaaccatggctaaggacaagcccacccttgacatcgagctgctgaagacggaggtcaccaaccccgcagtgcttaggaaactctgcatcgaggccaagatctccaacaccaccacagactcacgctgtccgactcagggcgaggccaccttggtggaggagcaggacgccaatttcgtctgccggcgcaccttcgtagaccgtggctgggggaatgggtgcggtctctttggcaaggggtcccttctgacgtgtgccaagtttaagtgcgtaaccaagctggagggtaagatcgtccagtacgaaaacttgaagtacagcgtcatcgtcacagtccacaccggcgaccagcatcaagtggggaacgaaagcacggagcacggcaccaccgcgaccatcacgccccaggcccccacgaccgagatccagctgaccgactacggggccctcaccctcgactgcagcccccgcactggcttggacttcaacgaaatggtcctgctgaccatgaaggagaagtcctggctggttcacaagcagtggttccttgatctgccccttccctggaccagcggcgccagcacttcccaggagacatggaaccggcaggacctactcgttactttcaagactgcccacgcgaagaagcaggaggtggtggtgctgggcagccaagagggcgccatgcacaccgccctgacgggggccacagagatacagaccagcggtaccacgacaatcttcgccggacacctgaagtgccgcctgaagatggacaagctgaccctcaagggcatgtcatacgtcatgtgcaccgggtcctttaaactggagaaggaagttgcggaaacgcaacacggcaccgtgctggttcagatcaagtacgaagggaccgacgccccttgtaagatccccttctccactcaggacgagaagggggtgacgcagaacggccggctgattacggcgaaccccatcgtgaccgataaggagaagcccgttaacatcgaggccgaacccccctttggggagtcctacatcgtgatcggtgcgggggagaaggccctcaagctgagctggttcaagaagggctccagcatcggcaagatgttcgaggccaccgcccgcggggcccggcgcatggcgattctgggcgacacagcctgggacttcgggagcatcggcggcgtgttcactagcgtcgggaagctcgttcaccagatattcggcacagcctatggggtgcttttctctggcgtcagttggaccatgaagattgggatcggcgtgctcctcacatggctgggcctgaattcacgcagcacctcactctctatgacgtgcatcgctgtcggtctggtcaccctgtatcttggcgtgatggtgcaggccgactcggggtgtgtcatcaactggaagggccgagagttaaagtgcgggagcggcatcttcgtgacgaacgaggttcacacctggacggagcagtacaagttccaggcggacagcccgaaacgtttatcggccgccattggcaaggcctgggaggagggggtctgcggcatccgaagcgccacccgtcttgagaacatcatgtggaaacagatttccaacgagttgaaccacatcctactcgagaacgacatgaagttcaccgttgtggtcggggacgtggcgggaatcttagcccagggaaagaagatgattcggccccagcccatggagtacaaatacagctggaagtcctggggcaaggccaagatcatcggcgccgatgtgcagaatagcacgttcatcatcgacgggcccaatacccccgagtgtcccgatgaccagcgcgcatggaacatctgggaggtcgaggactacggctttgggatcttcacgaccaatatctggctgaagctccgggactcctacacccaggtgtgcgaccaccgactgatgtcggccgcaataaaggactccaaagccgtgcatgcagatatgggctactggatcgagtccgagaaaaacgagacttggaagctggcgggcgcctccttcatagaggtcaagacctgcatctggcccaagagccacaccttatggtcaaacggggtgcttgaatcagagatgatcatccccaagatctacggagggccgatctcccagcataactaccggcccggctacttcacgcagaccgccgggccttggcacctgggcaaactcgaactggacttcgacctgtgcgagggcaccacggtggtcgtggacgagcattgtgggaaccgcggcccgtctctccggacgaccacagtcaccggcaaaattatccacgagtggtgctgccgctcctgcacgctgccgcccctacggttccgcggcgaggacggttgctggtacggcatggagatccggcccgtcaaggagaaggaggagaacttggtgaaatcgatggtgagcgccggctccggggaggtcgatagcttctccctgggcctgctctgtatcagcatcatgatcgaagaggtgatgcgctcccggtggagccggaaaatgcttatgaccggcaccctggccgtgttcttcctcctgatcatgggccaactgacctggaacgacttgatccgattatgcatcatggtcggggcgaacgcttccgataggatgggcatgggcacgacttacctggccctcatggcgaccttcaagatgaggccgatgtttgccgtcggcctgctgtttcggcgcctcaccagccgggaggtattgctgctaacgataggactgagcttggtcgcaagtgtggagctccccaacagcctggaggagctgggggacgggctcgccatgggcatcatgattctgaaacttctcacagatttccagagccaccagctgtgggccaccctgctctcactgacattcatcaagacgacctttagcctgcactacgcctggaagaccatggcgatggtcctctccatcgttagtttgttccccctgtgtctctccaccacgagccagaagaccacctggctgcccgtgctgcttgggtccctgggctgcaagccgctgaccatgttcttaatcgccgagaataagatctggggtcgcaaaagctggccgttgaacgagggcataatggcagtcggtatagtgagcatcttgctatccagcctgctaaaaaacgacgtgcccctcgcgggccccctcatagccggcgggatgctgatcgcgtgctacgtcatctccggctcgtccgccgacctcagcctggagaaagccgccgaagtgtcctgggaggaagaggcagagcacagcggtgcgtcccacaacatcctggtggaggtccaggacgatggcacgatgaagataaaggacgaagagcgggatgacaccttgaccatcctgttaaaggcgaccctgctggcggtgagcggggtttacccgctgtccatccccgccaccctctttgtctggtatttctggcagaagaagaagcagcgcagcggcgtcctatgggacacgccaagcccgcccgaggtcgaacgggccgttttagatgacggcatctacagaatcatgcagcggggactgctcggccgcagccaggttggggtgggcgtctttcaagagaacgtgtttcacaccatgtggcacgtgacccgcggggccgtcctcatgtatcagggcaagcgcctagagccctcctgggcgagcgtgaagaaagacctcatttcctacggcgggggctggcggctgcaggggagctggaacacgggcgaggaggtacaggtcatcgccgttgagcccgggaagaacccgaagaacgtccagacagcccccggcaccttcaagactcccgaaggcgaggtcggggctatagccctggacttcaagcccggcacctccgggagccccatcgtgaaccgcgagggcaagatcgtgggcctctacggtaacggcgtcgtcacgaccagcgggacctacgtgtccgcaattgcccaggccaaggcgagccaggagggcccgctgcccgagatcgaggacgaggtcttccgaaagcgcaacctgactataatggacctccaccccgggtccggcaagacacgtagatatctgccggcgatagtgcgggaggccatcaagcgcaagctgcggaccctcatcctggccccgacccgtgttgtcgccagcgaaatggcggaagcactgaagggcatgcccatccgctaccaaacaacagccgtgaagtccgagcacaccggcaaggagatcgtggacctcatgtgccacgctaccttcaccatgcgtctgctgtcccccgtccgtgtgccgaattacaatatgatcattatggacgaagcccatttcaccgacccctccagcatcgccgcccggggctacatcagtacccgcgtggggatgggcgaggccgccgccatcttcatgaccgcgacgccgcccggcagcgtcgaggccttcccgcagtccaacgccgttatccaggacgaggagagggacatccccgaacgcagctggaactccggctacgagtggatcacggacttccccggcaagaccgtgtggttcgttcccagcatcaaagccgggaatgatatcgcaaattgcttgcggaagaacggcaagcgcgtgatacagctgtcccggaagaccttcgacacggagtaccaaaagacgaagaataatgattgggactacgtggtcaccaccgacatcagcgagatgggggccaacttccgcgccgaccgggtgatagacccgcgacggtgcctcaagccagtgatcctcaaagacggccccgagcgcgtcatccttgccggcccaatgccggtgaccgtcgcctccgcggcccagcggcgaggtcggataggcaggaaccataacaaggaaggggaccagtacatctacatggggcagcccctcaataacgacgaggaccacgcccactggacggaggccaagatgctcctggacaacatcaacacccctgaggggatcatacccgccctgttcgaaccggagcgggagaagtcagcggccatcgacggcgagtatcggctccgcggcgaggcccggaagactttcgtggagctgatgcggcggggcgacttaccagtgtggctctcctacaaggtcgccagcgagggctttcagtatagcgatcggcggtggtgcttcgacggagagcgcaacaaccaggtgctagaagagaacatggacgtggaaatctggaccaaggagggcgagcggaagaaactgcgtcccaggtggctcgacgcccgtacgtactccgaccccctggcgcttcgagaattcaaggagttcgccgcagggcgccggagcgtctccggcgacctcatcctggagatcggaaagctgccccagcacctcacccagcgtgcccaaaatgctctggacaatctggtgatgctccacaacagcgagcagggcgggcgggcctaccgccatgccatggaagagctgccggataccatcgagactctgatgctactggccctgatcgccgtgttgaccggaggcgtcaccctgttcttcttatccgggaagggcctcggcaagactagcatcggcttactgtgcgtcatggcgtcctcagtgctcctgtggatggcatccgtcgaaccccactggatcgctgccagcatcatcttggagttcttcctcatggtgctgctgatccccgagccggaccggcagcgcacgccgcaggacaatcaactcgcctacgtggtaatcggcctgctctttatgatcctcaccgtggctgccaacgagatgggactgctggagacgaccaagaaggatctcggtatcgggcacgtggccgtcgagaaccaccaccacgccgccatgctggatgtggacttacaccccgcgtccgcatggaccctctatgccgtggccaccacgatcatcacccctatgatgagacacaccatcgagaacactacggccaacatcagtttaaccgcgatcgccaaccaggccgccatcttgatgggcctcgacaagggctggccaatctccaagatggacatcggagttcccttgctggcgctcggttgctactcccaagtcaaccccctgaccctgaccgccgccgtgctcatgttagtcgcccactacgccatcatcgggccgggcctgcaggctaaggccacgcgcgaggcccaaaagcggaccgcggccgggatcatgaagaatcccaccatcgacggcatcgttgcgatcgacctcgaccccgtggtctacgacgccaaattcgaaaagcagctgggacaaatcatgctactcatcctgtgcacctcccagatccttctcatgcgcacgacctgggcgctgtgcgagtccatcacactggccaccgggcccctcacgaccctgtgggagggatccccgggtaagttctggaacaccaccatagccgtcagcatggcgaatatcttccgcggctcctacctggccggcgccgggctcgccttttccctgatgaagagcctgggcgggggccggcgcgggactggggcgcagggcgagaccctcggggagaagtggaaacggcagttaaaccagctgtcaaagagtgaattcaacacctacaagcgctccggcatcatggaggtggaccggtccgaggctaaggaggggctcaagcgcggcgagacgacgaagcacgctgtctcgcgggggaccgccaagctgcgctggttcgtggagcggaacctggtgaagcccgagggcaaggtcatcgacctgggctgcgggcgcggcggatggagctactactgcgccggcctcaagaaggtaaccgaggtgaaagggtataccaagggcggtcccggccacgaggagcctatcccgatggcgacgtacggctggaacctggtcaagctgcactccgggaaggacgtgttctttatcccccccgaaaagtgcgacaccctcctgtgcgacatcggggaaagctcccccaatccaaccatagaagaggggcggaccttgcgcgttctcaagatggtcgagccctggctgcggggcaaccagttctgcatcaaaatcctgaacccgtacatgccctccgtcgtggagacgctcgagcagatgcaacggaagcacgggggtatgctggtccggaacccgctgtcccgaaacagcacccatgagatgtactgggtatcctgtggcaccgggaacatcgtgtcggccgtcaacatgacctcccggatgctcctgaaccgcttcaccatggcccaccggaagcccacgtacgagcgcgacgtcgacctcggcgccggcacccgtcacgtagccgtggagcccgaggtggcgaacctcgatatcatcgggcagcggattgaaaacattaaacacgagcacaagagcacctggcactacgacgaggataacccctacaagacctgggcataccacggctcctacgaggtgaagccgagcgggagcgccagctccatggtcaacggcgtggtcaagctgctgacgaagccatgggacgttatcccaatggtgacccagatcgccatgacggatactacgcctttcgggcagcagagagtcttcaaggagaaggtcgacacccggactccgaaggccaagcgcggcactgcgcagatcatggaggtgacggcccggtggctatggggcttcttgtcccgaaataaaaagccgcgtatctgtacccgcgaggaattcacccggaaggttcgctccaacgcagccatcggggccgtgttcgtagacgagaaccagtggaactccgccaaggaggccgtcgaggacgaccggttctgggacctggtgcaccgtgagcgggagctccacaagcaaggcaagtgcgcgacctgcgtgtacaacatgatggggaagcgcgagaaaaagctgggcgagtttgggaaggccaagggctctagagccatctggtacatgtggctgggcgcacgcttcctcgagttcgaggccctaggattcatgaatgaggaccactggttctcccgggagaatagcctgtccggcgtcgaaggggaggggctccataagctgggatatatcttacgcgacatcagcaagatacctggcggcaatatgtatgctgatgacacggccggatgggacacccggatcacggaggacgacttacaaaacgaagcgaaaattacggacatcatggagccggaacacgccctgctggccaagtccatattcaagctcacttaccagaacaaggtggttcgcgtccagcgccccgccaaaaacggcaccgtgatggacgtgatcagccgccgagatcagcgagggtccggccaagtcggcacctatgggctgaacacctttacgaacatggaggcccagctgatccgccagatggagagcgaaggtatcttctccccaaacgagctcgaaacccccaacctcgcggagcgggtgctggactggctcgagaagtacggggtggagagacttaagcggatggccattagcggcgacgattgcgtagtgaagccgattgacgaccgcttcgccaccgccctgacagccttgaacgacatgggtaaggtgcggaaagacataccccagtgggagcctagcaaggggtggaacgactggcagcaagtccccttctgcagccaccacttccaccagctgatcatgaaggacggccgcgagatcgtggtgccgtgccggaaccaggacgagctggtcgggcgcgcgcgggtgtcccaaggggcggggtggagcctccgcgagactgcctgcctgggcaagagctacgcccagatgtggcagctgatgtacttccaccgtcgcgacctccggctggcggccaacgccatctgctccgccgtgcccgtcgactgggtgcccaccagcagaaccacctggtccatccacgcccaccaccagtggatgacgaccgaggacatgctgagcgtgtggaaccgggtctggatagaggagaatccctggatggaggataagacacgcatcagctcctgggaggacgtgccgtatcttgggaaacgggaagaccagtggtgcggttccctcatcggtctgaccgcgcgggcaacatgggccaccaacatccaggtggcaataaatcaggtccgccggctcatcgggaacgagaattactctgactacatgacctccatgaagaggttcaagaacgagagcgagcccgagggcgcgctgtggtga

SEQ ID NO: 24003 - RNA, 9879 nt, synthetic construct
  misc_feature 1..9879: note = derived and/or modified CDS sequence (opt11) from DENV-1__FJ687430__SS-prME
  source 1..9879: mol_type = other RNA
agcgtaaccatgctactaatgctgatgcctacggccctggccttccaccttaccacccggggcggggagccccacatgatcgtcagcaaacaggaacgcggcaagtccctgctgttcaaaacctccacgggtgttaacatgtgcacactcatcgccatggacctcggtgagctttgcgaggataccatgacctacaagtgtcctaggatcaccgaggccgagcccgatgacgtggactgctggtgcaacgccacggacacctgggtcacctatgggacatgcagccaaacgggagagcaccggcgcgataaacggtccgtggcgctcgctccccacgttggcctggggctggagactaggaccgagacatggatgagcagtgaaggcgcttggaaacaaattcagaaagttgagacttgggcactcagacatcccggcttcacggtgatcgcgctattcctggcccacgccatcggaactagtattacacagaaggggataatctttatactccttatgctggtcacgccctccatggccatgcgctgcgtaggcatcggcagccgggacttcgtggaggggttatccggcgccacctgggtggatgtcgttttggagcacggcagctgcgtaaccactatggccaaggacaagccgacgttagatatcgaactcttgaaaaccgaggttacgaatcctgccgtgttacgaaagttgtgcattgaagcgaaaatctccaatacaacgaccgattcgcgctgtccgacccagggcgaagccaccttggtggaggagcaagacgccaacttcgtctgccggcggacgttcgtagaccgcggctgggggaacggctgcgggctattcggtaaaggcagcttaattacctgtgccaagttcaagtgcgtgaccaagctggagggcaagatagtccaatacgagaacttgaagtacagcgtgatcgtgaccgtccacacgggtgaccaacaccaggtggggaatgagtccaccgaacacggcactaccgccacaatcacgccccaggccccaaccactgagatccagctcacggactacggggccttaacgcttgactgcagccctcggacagggctcgacttcaatgagatggttctactgaccatgaaagagaagtcctggctcgtgcacaagcaatggttcttagacctgcccctcccctggacgagcggcgcctcaacgtcccaggagacctggaaccgccaagacctcctggtgaccttcaagacagcccacgccaagaagcaggaggtcgtggtattgggaagccaggaaggcgcgatgcacacggcgctaacaggtgcaacggagatccagaccagcggcaccaccacaatcttcgccggtcacctgaaatgccgacttaaaatggacaaactgaccttaaagggcatgagctatgtcatgtgcacgggatccttcaaactcgagaaagaggtggccgagacccagcacggcaccatcttggtacagatcaaatatgaaggaacagatgcgccctgcaagatcccattcagcacgcaagatgaaaagggggtcacccagaacggccggctgatcaccgcgaaccctatcgtaaccgacaaagagaagccagtgaatatcgaagccgagccaccttttggcgagtcatacatagtaatcggcgcgggtgagaaggcgctgaaactaagctggttcaagaaggggtccagcatcggcaagatgtttgaggccacggcacggggtgctagacggatggccatcctgggggacaccgcttgggacttcggtagtattgggggcgtcttcacctctgtcgggaagctagtccaccagatattcggcaccgcctatggggtgctgttctccggcgtaagctggacgatgaagatcggtatcggtgttctgctgacatggctcggcctgaactcccgcagcacctccctgagcatgacttgtatcgctgtggggctcgttacgctttacctgggcgtcatggtgcaggccgacagtgggtgtgtgatcaactggaaggggagagagttgaagtgtgggagcggcatcttcgtcaccaacgaggtacacacctggactgagcagtacaagtttcaggccgacagcccgaaacggctttccgctgccattggcaaagcctgggaagaaggtgtgtgcggaatcaggtccgccaccaggctcgagaatataatgtggaaacagatctccaatgagctcaaccacatcctgctggagaacgacatgaaattcacggtcgtggtgggggacgttgccggaatacttgcgcaagggaagaagatgattagaccccagccgatggagtataagtattcttggaagtcctggggcaaggcaaagatcatcggtgcagacgtccagaatgccaccttcatcatcgacggccccaatactcccgagtgccccgatgatcagcgagcgtggaatatctgggaagttgaggactacggcttcgggatctttaccacaaacatctggctgaagctccgcgactcatacacgcaggtttgcgaccaccggctcatgagcgccgccatcaaggactctaaagccgtgcacgctgacatgggctactggatcgagagcgaaaagaacgaaacctggaagctcgcgcgagccagcttcatcgaggtcaagacttgcatatggccgaagtcacatacgctgtggagcaacggcgtactcgagtccgagatgatcatccccaagatctacgggggaccgattagccagcataactaccgcccggggtacttcacccagaccgccggcccctggcacctggggaagctagagctcgatttcgacctgtgcgagggcactacggtcgtcgtcgacgagcactgcggcaatcgcggtccttctctacgtaccacaacagtcacgggaaaaattatccacgagtggtgctgtcggtcgtgtacgctcccacccctccgattcagaggggaggatggctgctggtacgggatggaaatccgccccgtgaaggagaaagaggaaaacctggtaaagtctatggtgtctgccggcagcggggaagtggactctttcagcctcgggctgctgtgcatctcaatcatgatcgaggaggtgatgcgctcacggtggtctcgtaagatgttaatgaccggcaccctcgccgtgttttttttattaataatggggcaattgacttggaacgacttgatacggttgtgcatcatggtgggcgcgaacgcctccgacaagatgggcatgggcaccacctacttggctctgatggccactttcaaaatgcgccccatgttcgcagtcggtctccttttccggcggctgacgtcccgcgaggtcctcctgctgacaatcggcctgtcactagtggcgtccgtagagctgcccaacagcctcgaagagctgggcgacggacttgccatggggattatgatcctcaagctgctgactgacttccagtcccatcagttatgggccaccttactgagcctcacgtttatcaagaccactttctcgctccactacgcctggaagaccatggcgatggtgctgtcaatcgtttcgttattcccgctgtgcctgagcactacatcccagaagacaacatggctccccgtgctactgggctcgctcggatgtaaaccgctaacgatgttcctgatcgcggaaaacaagatctggggccgaaagtcctggcccctcaacgagggaatcatggccgtagggatcgtttcgatcctgctgtcatccctcctgaagaatgatgtgccactggccggacccttgatcgcgggcggcatgttgatcgcgtgctacgtaatatccgggagtagcgccgacctgtccttggagaaggctgccgaagtgagctgggaggaagaggccgagcatagtggggcgagccacaacatcctggtggaggtacaggacgacgggaccatgaagatcaaggacgaggagcgggacgataccctgaccattcttttaaaggcaacgctgctcgcagtatccggtgtgtacccgctcagcatacccgccacgctgttcgtgtggtacttttggcagaagaagaagcaacgctccggggtactgtgggacaccccgagcccgccagaggtagagcgcgctgtgttagacgacgggatctatcgtattatgcagcgaggcctgctggggcggtcccaagtaggagtaggggtgttccaggaaaacgttttccatacgatgtggcacgtgacccgcggcgcggtcctcatgtaccaggggaagaggctggagccctcgtgggcctccgtcaaaaaggacctgatcagctacggcggcggctggcgtctccaggggtcctggaatacgggcgaggaggtgcaggtaatagcggtcgagcctggcaagaacccaaaaaacgtgcagacagcccccgggaccttcaaaacccccgaaggagaagtgggagccatcgcgctggacttcaagcccgggacgagcggcagccccatcgtcaatcgggaggggaaaatcgtggggctgtacggaaatggtgttgtcaccacgagcggcacctacgtaagcgccatcgctcaggctaaggcgtcccaagagggcccgcttccggagatcgaagacgaggtctttagaaagcgcaacctaactatcatggatctgcaccccggcagcgggaaaacccgacggtatctccccgccatagtccgcgaagccatcaaaagaaagctgcgcaccctgatcctcgccccgacccgggtggtggcctccgagatggcggaggccctgaaaggaatgcccatccgctaccagacgacggccgtaaagagcgagcacactgggaaggaaatcgtggaccttatgtgccatgccacgttcacgatgcgcttactgtcccctgttcgagtcccgaactacaacatgatcatcatggacgaggcccacttcaccgatccctcatctatagcggctcgcggatatatctcgacccgggtgggaatgggtgaggccgccgccattttcatgaccgcgacgccccccggctccgtggaggccttcccacagtcaaacgccgtaattcaggacgaggaacgcgacattcccgagcggtcatggaacagcgggtacgagtggatcacggatttccccggcaagaccgtgtggttcgtgcctagcattaagagcggcaacgacatcgccaactgcctgcgtaagaacgggaagcgggtcatccagttatcccgcaaaacttttgatacggagtaccagaaaaccaagaacaacgactgggactacgtggtaactaccgacatcagcgaaatgggcgccaacttccgggccgatcgcgtcatcgatccgcgtcggtgcctgaagccggtaattttgaaagacgggcccgagcgggtgatcctagcgggccctatgccggtaacggtggcctccgccgctcagcgccgggggcgtatcggccggaaccacaacaaggagggtgaccaatacatctacatgggacagccactgaacaacgacgaggaccatgcccactggacggaagccaagatgctcctcgacaacatcaatacccctgaaggcatcattcctgcgctgttcgagccggagcgggagaagtcggccgcgatcgacggggagtatcgactccgcggggaggcccgcaagaccttcgtcgagttaatgcggcgtggagacctgccggtgtggctgagctataaggttgcgtcggaaggcttccagtactccgaccggcgctggtgcttcgacggcgaacggaacaaccaagtcctagaggagaacatggacgttgaaatctggacaaaagagggtgagaggaagaagctgcgccctaggtggctggacgcccgtacctactccgaccccttagccctgcgggagttcaaagagttcgcagccggccggaggtcggtgtccggggacttaatccttgagattggcaagctgccgcagcacctaacacagcgggctcaaaatgcactcgataacctggtaatgctgcacaacagcgagcaaggcgggcgcgcgtaccggcatgctctcgaggaactccccgacaccatcgagacgctcatgctccttgctctgatcgccgtactcaccggaggggttacgctgtttttcttgtccggccgcgggttgggcaaaacctctattggcctcctatgcgtcatggcgtccagcgtgttactgtggatggcgtcagtggagccacattggatcgctgccagcatcatactggagttctttctcatggtgctgctcattcccgaaccggatcggcagcgaactccgcaagataaccagctagcctatgtggtgatcggcttgctgtttatgatcctcacagtcgccgcgaatgagatggggctgctggagaccaccaagaaggaccttgggatcggacacgtagccgtggagaatcaccaccatgcctccatgctggacgtagacttgcatcccgccagcgcctggactctctacgcagtggcgacgacgatcattaccccgatgatgcgacacactatcgagaacacgaccgccaacatctccctcaccgccatcgcaaaccaggcagccatcctaatggggttggacaaagggtggcccatctctaagatggatataggggtgcccctgctggccctcgggtgctactcgcaggtcaaccccctgacactgacggccgcggtactcatgctggtggctcactacgctatcatcgggccggggctgcaggcgaaggctaccagagaagcgcagaaacgtacggcggccggaataatgaagaaccccaccgtcgatgggatcgtcgccatagatctagaccccgttgtttacgacgccaagttcgagaagcaactcggccagattatgctgctcatcttatgtacgagccagatcttactcatgcgtacgacttgggcgctgtgcgaatccataaccctggccacgggtcctctaactacactgtgggagggaagcccgggcaaattctggaacaccacgatcgccgtatccatggccaacattttccgcgggagctatctagctggcgcgggtctcgctttcagcttaatgaagtccctcggcggtgggaggagggggaccggggcacagggtgaaaccttgggcgagaaatggaagcgacagctgaaccagcttagcaagtcagagttcaacacttacaagcgcagcgggatcatggaggtcgaccgatccgaggccaaggagggactcaagaggggcgagacgacaaagcatgcggtgtcccggggcaccgccaagctgcgctggttcgttgaaagaaatctggtgaagccagaggggaaggtcatcgatctgggatgcggccgcgggggctggtcctattattgcgccgggctcaagaaggtcaccgaggtgaagggctacactaaaggcgggcctggccacgaggagcccatccccatggccacctacggttggaacttggtcaagcttcactccggcaaagacgtgtttttcatcccgccagaaaagtgcgataccctactctgcgacatcggggagtcgagccccaatccgacgattgaggaggggcggacgctgcgcgtgctcaagatggtcgagccttggctccgaggaaaccagttttgtatcaaaatcctgaacccgtacatgcccagcgtggtcgagacgctcgagcagatgcaacgcaagcacgggggcatgctggtacgtaacccgctgtcccgcaactccacacacgagatgtactgggtgagctgcggaacgggcaatatcgtttctgcggtgaacatgacctcgaggatgctactgaaccgatttacgatggcgcatcggaaaccaacttatgagagggacgtggacctgggggcgggtacccgtcacgtggcagtcgagcccgaggtggccaacctcgacatcattggccagaggattgaaaacataaagcacgaacacaagtccacctggcattacgacgaggacaacccatacaaaacgtgggcctaccacgggtcatacgaggtaaagccgtccggcagcgcgtccagcatggtcaacggggtggtcaaactgctcacgaagccctgggacgtcatcccaatggtgacccagaccgccatgaccgataccactcccttcggccagcaaagagtcttcaaggagaaggtggacacccggaccccgaaagccaagcgcggaaccgcccagataatggaagtcactgcccggtggctctggggcttcttgagccgcaacaagaagccccggatctgcacccgcgaggaattcacacggaaggtccgcagtaacgcggcgattggtgccgtattcgtggacgagaatcagtggaattccgccaaggaggcggtagaggatgagaggttctgggacttggtgcatcgcgaacgtgaattgcacaaacagggaaagtgtgccacctgcgtgtacaacatgatgggtaagagagagaagaagttaggggagttcggcaaagcgaaggggtcccgcgccatctggtacatgtggcttggagctcgctttctagagttcgaagctctaggctttatgaacgaggaccactggttcagcagagagaattcgctgtcaggtgtcgagggcgaggggctccataaactaggctacatcctgcgtgacatatccaaaatccccgggggcaatatgtatgctgacgacaccgccggctgggacaccagaatcacggaggacgacttacagaatgaagccaaaatcaccgacataatggagccggaacatgccctcctggccaagagcatctttaagttaacctaccagaataaggtggttcgcgttcaacggccggccaagaacgggactgtgatggacgtgatctcgaggcgtgaccaacggggctctggccaagttggcacgtacggcctgaacacctttaccaacatggaggcccagctgatacgccaaatggagtccgaggggattttttccccttccgagctcgaaacccccaatttggccgaacgcgtgctcgactggctcgagaagtacggcgttgagcgcctgaaacgtatggccatcagcggggacgactgtgtagtaaagcccatagacgaccgctttgccaccgccctcaccgccctcaacgacatgggaaaggtgcggaaggacatcccccagtgggagccctctaagggatggaacgactggcagcaggtgcccttctgcagccaccattttcatcagttgatcatgaaggatggtagagagattgtcgtgccgtgcagaaatcaagatgagctggtaggccgagcccgtgtgagccagggtgctggttggtcgctgcgcgagacggcgtgtctcggcaagtcctacgcacagatgtggcagctgatgtacttccaccggcgcgatctcaggttagcagccaacgcaatctgctccgccgtgccagtcgactgggtgccgactagccgcactacctggtccattcatgcccaccaccagtggatgaccaccgaagacatgcttagcgtttggaaccgggtctggatcgaggagaacccctggatggaggacaagacgcacatctccagctgggaagacgtgccgtatcttggtaagcgcgaggaccaatggtgtgggtccctgatcggattaaccgcccgagcgacctgggcgaccaacatccaggtagccatcaaccaggtaagacgcctcatcggcaatgagaactacctggactacatgacttcaatgaagcggttcaagaacgagtccgaccctgagggcgccttgtggtaa

SEQ ID NO: 24004 - RNA, 9879 nt, synthetic construct
  misc_feature 1..9879: note = derived and/or modified CDS sequence (opt11) from DENV-1__FJ687432__SS-prME
  source 1..9879: mol_type = other RNA
agcgtgaccatgctgctcatgttaatgcccaccgccctggccttccaccttacaacccggggcggggaaccccacatgatcgtgagcaagcaggaacggggtaagagcttactgttcaagacctccaccggggtgaacatgtgcaccttaattgccatggacctgggcgagctgtgcgaagataccatgacctataagtgcccccggataaccgaggctgagcccgacgacgtggactgttggtgtaacgccactgacacatgggtcacctacgggacgtgttcacagacgggcgagcacaggcgagacaaaaggagcgtggctctcgcgccccacgtgggcttagggctggagacccgcaccgaaacctggatgagctcggagggcgcgtggaagcagatccagaaggtcgagacgtgggccctccggcaccccgggttcaccgtcatcgccctgtttctggcccatgcgatcggcacaagcatcacccagaaggggatcattttcatcctcctgatgctggtcacaccctccatggccatgcgatgtgttgggatcggcagccgggactttgtggaggggctctccggcgctacctgggtggacgtcgtgctggagcacgggagctgcgtgaccaccatggctaaggacaaacccacgcttgacatagagctactgaagaccgaggtcaccaacccggccgtgctgcgtaaactctgcatcgaggccaagatctccaataccacgaccgatagccgttgcccgacccagggcgaggccaccctggttgaggagcaggatgctaactttgtctgtcgccgtacgtttgtggaccgagggtgggggaacggatgcggactcttcggcaaagggtccctcatcacgtgcgccaagttcaagtgcgtgaccaagctagaaggcaaaattgtccagtacgagaacctgaaatacagcgtgatcgtgaccgtccatacgggcgatcagcaccaggtggggaacgagtccaccgagcacggcaccacagccactatcacgccccaggcgcccaccaccgaaatccagctcacagactacggggccctgacgctggactgctcaccccggaccggcctggacttcaacgagatggtcctgctgaccatgaaggagaagtcctggctcgtgcataagcagtggttcctggacctgccgctcccatggactagcggagcctctacgtcccaggaaacgtggaaccgccaggacctgctggtgaccttcaagaccgctcatgccaagaagcaagaggtcgtggtgctcgggagccaggagggcgcgatgcacacagccttaaccggggccaccgagatccagacatccggcacgaccaccatcttcgccgggcacttgaagtgtcggctcaagatggacaagctaacccttaaaggcatgagctacgtcatgtgcacaggttccttcaaactcgagaaggaggtggccgagacccagcacggcaccatcctcgtgcagatcaagtacgagggcaccgatgcgccctgcaagatccccttttccacgcaggatgagaagggagtcacccagaacggccgcctgataaccgccaacccgatcgtgaccgacaaggagaagccagtgaacatcgaagccgagccgcccttcggggagtcctacatcgtgatcggtgccggcgagaaggcgctgaagctgagctggttcaagaaggggtcgagcatcggcaagatgtttgaggccacggcccgtggggcccgccgaatggccatcctgggcgacaccgcgtgggattttgggtccatcggcggcgtgttcaccagcgtgggaaagctggtccaccagatcttcgggaccgcctacggggttctgttctccggcgtgagctggacgatgaagatcgggatcggggtcctgttaacctggttgggcctcaacagccggtccacttccttatccatgacctgcatcgccgtgggtctcgtgactctgtacctgggcgtaatggtgcaggccgacagtggttgcgtgatcaactggaagggccgcgaattaaagtgcgggtccggcatatttgtaaccaacgaggtgcacacctggaccgagcagtacaagttccaggccgacagcccgaaacggctttccgcggccataggcaaggcctgggaggagggtgtgtgcggcatacgctctgccaccaggttagagaacatcatgtggaagcagatcagtaacgagctcaaccacatcttgctggagaacgacatgaagttcacggtcgtggtgggcgacgtcgctggcatccttgcgcaggggaagaagatgatccgcccccagcccatggagtacaagtacagctggaagtcctggggcaaggccaagatcatcggtgccgatgtgcagaacgccaccttcatcatcgacgggcctaacaccccggagtgccccgacgaccaacgggcctggaacatttgggaggtggaggactacggcttcgggatctttaccacgaacatatggctgaagctgcgcgacagctacacccaggtctgcgaccaccggctcatgtccgcagccatcaaagacagcaaggccgtgcacgccgacatgggctactggatagagtccgagaagaatgaaacctggaaacttgcgcgcgccagcttcatcgaggtgaagacctgcatctggcccaagtcccacaccctgtggtcaaacggcgtcctcgagtccgagatgatcatcccaaaaatctacgggggaccaatcagccagcacaactaccggcccgggtactttacccagaccgccggcccctggcaccttgggaagctcgagctcgatttcgacctgtgcgagggcaccacggtcgtcgtcgacgagcattgtgggaaccgcgggccgtccctgcggaccaccaccgttacggggaaaatcatccacgagtggtgctgccgatcatgtaccctgccgcccctccggttccgcggggaggacggctgctggtacgggatggagatccggccggtgaaggagaaggaggagaacttagtaaagtccatggtgagcgccggcagcggcgaggtagacagtttcagcctcgggctgctttgcatctctatcatgatagaggaggtcatgcgcagccggtggtcccgaaagatgctcatgaccggcaccctagcagtattcttcctactcatcatgggacagcttacgtggaacgatctgattcggttatgcataatggtgggagcgaacgcgagcgaccggatgggtatgggcaccacctatctggcgctgatggccacgttcaagatgcgtccgatgttcgccgtcggcctcctgttccggcgcctgacgtcccgggaggttctcctgttgacgattggattgagcctagtggcatctgtcgagcttcccaacagcctggaggagctgggggacggactggccatggggattatgatcctcaagctgctgaccgacttccaatcacaccagctctgggccaccctgctgtcactaacattcatcaagaccaccttctccctgcattacgcatggaagaccatggcaatggtgctgagcatcgtctccttgttccccctgtgtctgagcactaccagccagaagacaacctggcttcccgtgcttctgggcagcctcgggtgcaagccgctgaccatgttcctgattgccgagaataagatctggggacgaaagtcctggcccctaaatgaggggatcatggcggtgggcatcgtaagcatcctgctgagctccctcctgaagaacgacgtgcccctggccgggcccctcatagccggtggcatgttaatcgcttgctacgtgatttctgggtcctcggccgacctgtccctcgagaaagcggccgaggtcagctgggaggaggaggccgagcactctggcgcgagtcacaacatcctggtggaggtgcaggacgacgggaccatgaagattaaagacgaggagcgcgacgacaccctgactatcctcctgaaagccacgctactcgccgtctccggcgtgtacccgctgtctatccccgccacgctgttcgtgtggtacttctggcagaagaagaagcagcgctcaggggtcctctgggacactcccagcccgcccgaggtggagcgggccgttctggacgatggcatctaccgcatcatgcagcggggcctgctgggacgctcccaggtcggagtgggggtgttccaggagaacgtcttccacaccatgtggcacgtgacgcggggcgcggtgctcatgtaccaagggaaacgccttgagcccagctgggcctccgttaagaaagacctgatcagctacgggggcgggtggaggctccagggctcctggaacacgggggaggaagttcaggtgatcgccgtcgaacccggcaaaaaccccaaaaacgttcagaccgcacccgggacattcaagacccccgagggcgaggttggcgccatcgcgctggacttcaagccagggacgagcggctcgcccatcgtcaaccgcgaggggaaaatcgtgggcctatacggcaacggggtggttaccaccagcggcacttacgtgtccgccattgcccaggccaaggcgtcccaagaggggccgctgcccgagatcgaggacgaggtgttccggaagcgcaacctgacaataatggatctgcatcccgggagcgggaagacccggcgctacttaccggccatcgtgcgggaggcgatcaagcgcaagctgcggaccctgatcctcgcccccacacgcgtggtggcctcagaaatggccgaggccttaaaaggcatgccgatccgctaccagactaccgccgtaaagagcgagcacaccggcaaggaaatcgtcgacctgatgtgccacgccaccttcacgatgcgcttactgtcccccgtgcgggttccaaactacaacatgatcattatggatgaggcccactttaccgaccccagcagtatcgccgcccgggggtacatctctacccgcgtgggcatgggggaggccgcagccatcttcatgacggcaactccacccggctccgtggaggccttcccccaaagcaacgccgtcatccaagacgaagaacgggacatccccgagcgcagctggaacagtgggtacgagtggatcacagatttccccggcaagaccgtgtggtttgtgccctccatcaaatcgggcaacgacattgccaactgcctgcggaagaacggtaagcgcgtcatccagctgtctcggaagacctttgacacggagtaccagaagaccaagaacaacgactgggattacgtggtgacaaccgacatcagcgagatgggcgctaacttcagagccgaccgggtcatcgaccctagaaggtgtctgaaacccgtgattctcaaggacggtcctgagcgcgtgatcctcgccggccccatgccggtcactgtggcctccgccgcgcagcggagagggagaatcggccgcaaccacaacaaagaaggcgaccaatacatctacatggggcagcccctgaacaatgacgaggatcacgcccactggacagaggccaagatgctgctcgacaatataaacaccccagagggcatcattcccgccctgttcgagccggagcgggaaaagagcgccgcaattgacggggagtaccgcctgcgcggcgaggcgcggaaaacctttgtcgagttaatgagaagaggggacctgcccgtgtggctgtcctacaaggtggccagcgagggcttccagtactctgaccgccggtggtgcttcgatggcgagcggaataaccaagtcctcgaggagaatatggacgtggagatctggacgaaggagggggagcggaagaagctgcgccctcggtggctggacgcccgcacctactccgacccactcgccctgcgggagttcaaggagttcgcggccggcaggagaagcgtttccggggacctgatactcgagattggtaagctcccccagcaccttacccagcgagcccaaaatgccttagacaacctggtcatgctgcacaacagcgagcaaggagggcgggcgtaccgccatgccttagaggaactgcccgacacaatcgagacgttgatgctcctggccctgatagccgtgctcaccggcggggtgaccctcttcttcctgtccggccgggggctcggcaagacctccatcggcctgctgtgcgtcatggcctcctcggtactcttgtggatggcctccgtggaaccccactggatcgccgccagcatcatactggagttcttcctcatggtcctcctgatccccgagccggaccgccagcggacaccacaagacaaccagctcgcatacgtggtgatcgggctgctgttcatgatcctcacggttgccgcgaacgagatgggcttgttggagaccaccaagaaggacctcgggatcggccacgtggccgtggaaaaccaccaccatgccagtatgctggacgtcgacctgcaccccgccagcgcctggaccctctacgcggtggccacgacgatcatcacccccatgatgcgccacaccatcgaaaacacgaccgccaacatctccctgaccgccattgccaaccaggcggctatcctgatggggctcgacaagggctggcccatcagcaagatggacattggggttccgctgctggccctcgggtgctactcccaagtcaaccccctgacgctgacagctgcggtgctcatgctggtggcccactatgccatcatcggcccggggctgcaggccaaggccacccgggaggcgcaaaagcgcactgccgccggcattatgaaaaaccccaccgttgacgggatcgtagccatcgacctcgaccctgtggtctatgacgccaagttcgagaagcagctgggccagattatgctgctcatcctatgtacgagccagatattgctaatgcgcaccacctgggcgctgtgcgaaagcatcacgctggctacgggccccctaaccactctgtgggagggtagcccgggaaagttctggaacacgacaatcgctgtatctatggccaacatattccggggaagctacctcgctggcgcgggcctcgccttcagcctgatgaagtccctcgggggcgggcggcggggcacaggcgcccagggcgagacccttggcgagaagtggaagcggcagctcaaccagctcagcaagagtgagtttaacacttacaaaagaagcggtatcatggaggtggaccgctcagaggcgaaggaggggctaaagcgcggggagacgaccaagcatgcagtcagccggggcacagccaagctgcggtggtttgtggagcgcaacctagtcaagcccgaggggaaggtaatcgacctgggctgcggtcgcggcgggtggtcctactactgtgccgggctaaagaaggtgaccgaggtcaagggttacaccaagggcggccccggccacgaggagcccatcccgatggcaacctacgggtggaacctggtcaagctccactccggcaaggatgtgttcttcataccgccagagaaatgcgacaccctcttgtgcgacataggagaatccagtccgaacccgaccatcgaagagggcaggacgctccgggtgcttaagatggttgagccctggctgcgcggtaaccagttctgcatcaaaattctgaacccctacatgccctccgtggtggagaccctcgagcagatgcagagaaagcacggcggcatgttggtccgcaacccgctaagccggaactccacccatgagatgtactgggttagctgcggaacgggcaacatcgtgtccgccgtcaatatgaccagccgcatgctcttaaaccggttcacgatggcccaccgcaagcctacctacgagcgcgacgtggatctgggggccggcacccggcacgtggccgtcgagcccgaggtggccaacctcgacatcatcggccagagaatcgagaatatcaagcacgagcacaagtccacctggcactacgacgaggacaacccctacaagacgtgggcctatcacgggagctatgaggtgaaaccctccggcagcgcgagttccatggtcaacggggtggtcaagctgctaaccaagccctgggacgtgatcccaatggtgacccagacggccatgacagacaccaccccgttcggccagcagcgggtcttcaaagaaaaagtggacacgcgtaccccgaaggccaagagagggaccgctcagatcatggaggtaacggcccgctggctttggggttttctcagccggaacaagaagccccgcatttgcacccgggaggagttcacgcgcaaagtcaggtccaacgcggccattggcgccgtgttcgtggacgagaaccagtggaacagcgccaaagaggcggtcgaggacgagcgcttctgggacctggtgcaccgagagcgtgaacttcacaaacaggggaagtgcgcaacctgcgtctacaacatgatgggcaagcgggagaagaagctgggggagttcggcaaggccaaggggtcccgcgccatctggtacatgtggctgggtgcccgttttctcgagtttgaagcgctcgggttcatgaacgaggaccactggttcagccgcgagaactccctgagcggggtcgagggagaggggctccataagctgggatacatcctgagagacatcagcaagatcccaggagggaacatgtacgccgacgacacagccggctgggacacccgcataacggaagacgatctccagaacgaggccaagatcaccgatattatggagccggagcacgccctgctggccaaaagcatcttcaaactcacttaccagaacaaggtcgtgcgggtccagcgccccgccaagaatgggactgtgatggacgtgatctcccgccgggaccagcgcggcagtgggcaggtcggcacgtacggcctgaacacctttactaacatggaggcccagctgatccgtcagatggaatcagaaggaatatttagcccgtccgagctcgagacacccaatctggccgagcgcgtgttggactggctcgaaaagtacggcgtggaacgcctgaagcgcatggccatcagcggtgacgactgcgtcgtgaagccgatcgacgaccgattcgcgacggccctgaccgccctcaacgacatgggcaaggtgcgcaaggacatcccccaatgggagccctccaagggttggaacgactggcagcaggtccccttttgcagccaccatttccaccagctgatcatgaaggacggccgggaaattgtggtgccgtgccgcaaccaggacgagctggtaggccgagcgcgcgtgtcgcagggggccgggtggtcactccgggagaccgcgtgcctgggcaagtcttacgcccagatgtggcagctaatgtatttccaccgccgggatctccgcctggccgccaacgcgatttgctccgccgtgcccgtcgattgggtgcccaccagccggacgacctggtccatccacgcacaccatcagtggatgaccaccgaggacatgctgagcgtatggaacagagtctggatcgaggaaaacccctggatggaggacaagacgcacatatccagctgggaggacgtgccgtacctgggtaagcgggaggaccagtggtgcgggtccctgatcggcctgactgcccgcgccacttgggcgacgaacatccaggtcgccatcaaccaggtccggcggctcattggcaacgagaactacctggactacatgaccagcatgaagcgcttcaagaatgagtccgacccagagggtgccctgtggtga

SEQ ID NO: 24005 - RNA, 9879 nt, synthetic construct
  misc_feature 1..9879: note = derived and/or modified CDS sequence (opt11) from DENV-1__JQ922547__SS-prME
  source 1..9879: mol_type = other RNA
tcggtgacgatgcttctgatgctgctgccgaccgcgctcgctttccacctcaccacccggggcggggaaccgcacatgattgtgtccaaacaggaacggggtaagagcctccttttcaagaccagcgccggggtgaacatgtgtaccttaatcgccatggacctaggggaactctgcgaagacacaatgacctataaatgcccacgcatcaccgaggcggagcctgatgatgtggactgttggtgtaacgccacggacacttgggtgacctacgggacctgcagccagaccggggagcatcgacgagacaagcggtcagtagcgctggctccgcacgtggggctagggctagaaacaagggccgagacctggatgagcagcgagggcgcctggaagcagatccagaaggtcgagacctgggctttgcgccatccggggttcaccgtgatcgctctgttccttgcccacgccatcggcacgagcatcacccagaagggcataattttcatcctgctgatgctcgtaaccccctcgatggctatgcgttgcgtgggcatcggcaacagagacttcgtggaagggttgtcgggcgccccctgggtggacgtcgttttagaacacgggagttgcgtgaccacgatggcgaagaacaaacccaccctcgatattgaactgctgaaaaccgaggtcaccaacccggctgtgctccgcaagctgtgcatcgaggccaagatctcaaacaccaccaccgacagccggtgccccactcagggcgaggctacactcgtcgaggagcaggacgccaactgtgtctgccgacggaccttcgtggatcgcgggtgggggaacggctgtggcttgttcggcaaggggagcttgatcacgtgcgctaagtttaagtgcgtgaccaagctggaaggcaagatcgtacagtacgaaaacctaaagtactccgtgatcgttacggtacacaccggcgatcagcaccaggtggggaacgagaccaccacccatgggacaaccgccaccatcaccccgcaggccccgacgagcgagatccagctcaccgactatggtgccttaaccctggactgctccccgcgtaccggtctggacttcaacgagatggtgttgctcacgatgaaggagaagtcctggctggtgcacaagcagtggttcctggacttgcccctcccttggacctcaggggccagcaccagccaggagacatggaaccggcaggatctgctcgtgacgttcaagaccgcgcacgcaaagaagcaggaggtcgtggtgcttggttcccaagaaggcgccatgcacaccgccctgacaggggcgacggagatccagacatcagggaccactacgatcttcgcagggcacctcaaatgccggctgaagatggacaaattgaccttgaagggtatgagctacgttatgtgtacggggagcttcaagctcgagaaggaggtggccgagactcagcacggcacggtgctggttcaggtgaaatacgagggtaccgacgccccgtgcaagataccgttctcaacccaagatgaaaagggggctacccagaacggccgcttaatcacggctaacccgatcgtgaccgacaaggagaaacccgtcaacatcgaggccgagcccccgttcggggagtcgtacatcgtggtgggggctggcgagaaggccctcaaactgtcgtggttcaagaagggcagttccatcgggaagatgctggaggcaacagcgcgcggggcccgccggatggctattttaggcgacaccgcgtgggacttcgggtccataggaggcgtcttcacgtctatgggaaagctggtgcaccaggtctttggcaccgcctacggcgtccttttctcgggcgtcagttggacgatgaagatcgggatcggtatcctcctgacctggctgggcctcaacagccgcaacacgtcgcttagcatgatgtgcatcgcggtggggatggtgaccctgtacttgggcgttatggtgcaggccgactcagggtgcgtaatcaactggaagggccgcgagctgctgtgcggtaccggcattttcgtgaccaacgaggtgcacacgtggacagacccctacaagtttcaggccgaccctagcaacagactctcccccatcatcggcaaggcctgcgtcatccgggtgtgcggcatccggagcgccacccgcctggagaacatcatgtggaagcaaatcagcaacgagcttaaccatatcctccttgagaacgacatgaagttcactgtggtggtaggcgacgtgtccgggatcctggcgcaaggcgagaaaatgatccggccgcagcctatggagcacaagtacagttggaaaagctggggcaaagccaagatcatcggcgcagacgtacagaacactactttcatcatcgacggccccaacaccccagagtgcccggacaatcagcgcgcgtggaatatctgggaagttgaggattatggtttcggcattttcaccaccaacatatggctcaaacttcgagacagctacacccaggtgtgtgatcaccgcctgatgtctgccgccataaaagacagcaaggccgtccatgccgacatgggttattggatcgagtctgagaagaacgagacgtggaagctcgcccgggcgtcattcatcgaggtaaaaacctgcacctggccaaaatctcacacgctctggagcaatggcgtgctcgagtccgagatgatcatccctaagatctacggcggaccaatcagccagcacaactacagacccggatacttcacccagaccgccgggccctggcacctgggcaaattggagttggacttcgacttctgcgagggtaccacggtagtggtggacgagcactgcggcaatcggggtccttccctccgaacaactaccgtaacaggtaagataatacacgagtggtgctgtcggtcgtgcaccctgccacccctgcgcttcaagggcgaagacggttgctggtatggaatggagatccggccagtgaaagacaaagaggagaatctcgtaaagagcatggtcagcgctggttccggggaggtggacagcttcagtttaggcctgctctgcatctccatcatgatcgaggaggtcatgagaagccgttggtccaagaagatgcttatggttgggacactggccgttttcctcctgttgatcatgggccagctcacctggagcgacctgatccgcctgtgtattatggtgggtgcgaatgccagtgacaggatgggtatggggacgacctacctcgcccttatggccacctttaagatgcgtcccatgttcgccgtaggcctactcttcccgaaacttaccagccgcgaggtcctcctcctcacaatcggcctgtccctcgttgccagcgtcgagctgccttccagcctggaagaactcggggacggtctggccaaggggattatgatgctgaagctccttaccgacttccagtcccaccagctgtgggccaccctcctgtccttaactttcataaagacgaccttttccctccactacgcgtggaaaaccatggctatggtgctgagcatcgtctcactattccccttatgcctgtccaccacgtcccagaagaccacatggctgcccgtgctcctgggcagcctcggctgcaaaccgctccctatgtttcttataactgagaataagatctggggacgtaagagttggcccctgaacgagggtataatggctgttgggatcgtcagcattctcctgagctcgctactcaagaacgacgtgccgctggccggaccgctaattgccgggggcatgctcgtggcctgctacgtaataagcggatccagcgccgacttgtccctggagaaggccgccgaagtgagctgggaggaggaggcggaacactccggcgcgagccacaacatcttggtagaagtccaggacgacggtacgcgtaagattaaagacgaggagcgggacgacacgcttaccatcctgcttaaggccaccctgctggcggtgtctggggtttaccccatgagcatccccgccacactgttcgtttggtatttttggcagaagaagaatcagcgttccggcgtggggttgatcacgccttcgccgcctgaggtggaacgggccgttctcgacgacggcatataccgaatcctgcagcgcggcctactggggcgctcccaggttggcgtgggtgtatttcaggagggcgtattccacacgatgtggcacgtgacacgcggggccgtactcatgtaccaaggaaagcgcctcgagcccagctgggcatccgtgaagaaggacctgatcagttacggaggcgggtggcggttccaggggtcgtggaacacaggggaggaggtgcaagttatcgctgtggagcctggtcgaaaccctaagaacgtgcagacggccccaggcacctttaagacccctgaaggagaggtcggggccatcccgctggatttcaaaccaggcacctctgggtcccccatcgtgaaccgggagggcaagatcgtaggcctctacgggaacggagtcgtgacgaccagcgggacttatgtgtccgccatagcccgagccaaggcttcacaagagggtccattgccagaaatcgaagatgaagtcttccggaagcggaatctgaccataatggacctccatcccgggagtggcaagacgcggcgttacctgcccgccatcgtgagagaggcgatcaagcggaagctgcgaaccctcatactggcgcccaccagagtggttgccagtgagatggcagaagccctgaagggggtgccgattcgctatcaaaccaccgccgtcaagtcagagcataccgggaaggaaatcgtcgacttaatgtgccacgcgaccttcaccatgcggctgttgtcccccgtgcgcgtgcccaattacaatatgatcatcatggatgaggcccatttcacggaccccgcctcgatcgcagcacggggatacatctccacacgcgtcgggatgggagaggcggccgccatcttcatgaccgcaacaccgacggggagcgtggaagcattcccccagtccaacgcgataatccaggatgaggaacgggacatcccagagagaagctggaactccggctacgactggatcaccgattttcccggcaaaactgtatggtttgtcccgagtatcaagtccgggaacgacattgccaactgcctcaagaagaatggcaagcgtgtgatccagttgagtcgcaagacctttgacactgagtaccagaagaccaagaataatgattgggactacgtggtcaccaccgacatatccgagatgggggccaactttcgcgctgaccgcgtgatcgaccctcggcgctgcctgaagccagtcatcctcaaggacggccctgaacgggtgatcctggcggggccgatgccagtgacggtcgccagcgctgcccagaggcgggggcgtataggccgcaatcaaaataaggagggggaccaatacatctacatgggccagccctccaacaatgacgaggaccatgcccactggaccgaggcaaaaatgctgctagacaacatcaacacccccgaggggataatcccggccctgtttgagcccgagcgcgagaagtcagccgccatcgatggcgagtaccggctgcgcggggaggcaaggaagaccttcgtggagttaatgcggcgcggagacctgcccgtttggctatcctacaaagtagcgagcgagggattccaatacagcgatcggcgctggtgcttcgacggggaacggaacaaccaggtgctcgaggagaacaaggacgtggagatctggactaaggagggcgagcgcaagaagttacgtacctgttggcttgacgcccggacgtactccgaccctttagccctgcgagagttcaaggagttcgccgcagggcgccggagcgtctccggtgacctgattctcgagatcggcaagctgccacaacacctcacccagaaagcgcaaaaggccctcgacaacctggtgatgctgcacaatagcgaacaaggagggaaggcttatcgccacgcaatggaggagctccccgacacgattgaaaccttaatgctgttagcgcttatcgccgttctgaccgggggcgtcaccctctttttcctttccggacggggcctgggcaagacaagcatcgggcttctgtgcgtgatggcctcctcagtgttactttggatggctagcgtcgagccccactggatcgcggcgagcatcattttagagttcttcctgatggtcttactcatcccggagccggaccggcaacggacgccccaggacaaccagctggcctacgtcgtcatcggcctgctatttatgatcctgaccgtggccgctaacgagatgggcttgctggagactaccaagaaggacttaggcatcgggcacgtggccgctgagaatcaccaccacgcgaccatgctcgatgttgacctcagacccgctagcgcatggaccctttacgctgtggcgaccacgatcatcacgccgatgatgcgccacaccatcgagaacacgaccgccaacatcagcctaaccgcgattgccaaccaggctgcgatccttatgggcctagataagggctggcccatctccaagatggacatcggggtccccctgctggccctgggctgctacagccaggtcaaccctttaaccttaactgccgccgtgctcatgctcgtcgcacactatgccataatcggtccgggacttcaggcaaaggccactcgcgaggcccaaaagaggactgcggccgggattatgaagaacccaaccgtcgatggcatcgtggcaatcgatctagacccagtggtctacgacgccaagttcgagaagcagctcggtcaaatcatgctgctgatcctctgtacgtcccagatcctgctaatgaggaccacatgggcgctctgcgagtcgatcaccttggcgaccgggccattgaccacgctctgggagggatccccggggcggttctggaataccaccatagcggtgagcatggccaatatctttaggggctcttacctggccggcgccgggctggcgttctctttaatgaaatccctgggcggtggtaggcgggggacgggtgcccagggcgagacgctgggggagaagtggaaacgccagctcaaccagctatccaagtctgagtttaacacgtacaagcggtccggcatcatggaggtagaccgcagcgaagccaaggaggggcttaaacggggcgagaccaccaagcacgccgtctcccgggggacggcgaagctccggtggtttgtggagaggaacctcgtgaaaccggaggggaaggtcatagatctgggctgcgggagaggcggttggagctactactgcgccggcctgaagaaggtgaccgaggtaaaagggtacaccaaaggtggtcccgggcacgaggagcctatcccgatggccacctacggctggaatctcgttaagctgcactccggaaaggacgtgttcttcattccgcccgagaagtgcgacacgctgctctgcgacatcggcgagagctcaccgaatccgaccatagaggagggccgcaccttacgggtgctgaagatggtggagccgtggctcaggggtaaccagttctgcataaagatcctgaacccctacatgcccagcgtggtggagacactggaacagatgcagcggaagcacggcggtatgctcgtgcggaatccgctctcccggaacagtacccacgaaatgtattgggtcagttgcggcacggggaacatcgtgagcgcggtcaatatgacctcccgcatgctgttaaatcgcttcaccatggcacaccgcaagccgacctacgaacgggacgtggacctgggcgcgggcactcgccacgtggccgtcgagcccgaggtggccaacttagacattatagggcagcgtattgagaacattaagaacgaacacaagtccacatggcactatgatgaggacaacccctacaaaacatgggcctaccacggcagttacgaagtcaagccaagcggctccgctagcagcatggtaaatggcgtggtccggctcctgaccaagccctgggacgtgatccctatggtaacgcagatcgctatgaccgacaccactccgttcgggcagcagcgcgtctttaaggagaaggtggacacgagaacccccaaagccaaacgcggcacagcccaaatcatggaagttacggcgcggtggctgtggggctttctctcaaggaataagaaaccccggatttgcacgcgggaggagttcacacggaaggttcgcagtaacgccgcgatcggggctgtgttcgtggatgagaaccaatggaactctgccaaagaagccgtcgaggacgagcggttctgggacctggtgcatcgcgaacgggagttgcacaagcaaggcaagtgcgcgacctgtgtctacaacaagatggggaagcgtgagaagaaactcggcgagttcgggaaggcgaaaggcagtagagctatatggtacatgtggctcggcgcccgcttcctggagttcgaggccctcgggtttatgaatgaggaccactggttttcccgtgagaactccctgtccggagtcgaaggggagggcttacacaagctcggttacatcctgcgcgacatcagcaggatccccggcggcaacatgtacgcggatgacacggccggatgggacacgcgcattacggaagacgacctgcaaaatgaggccaagattaccgacatcatggaacccgaacacgcccttttagctacctccatctttaagttaacctatcaaaacaaggtggtgcgcgtgcagaggccggcgaagaacggcacggtgatggacgctatcagtcgccgggatcagcgcggatccggacaggtgggcacttatgggctcaacaccttcctgcacaaggaggcccagcttattaggcagatggagttcgaagggatctttctcccgtcagagctagagacgcccaacctagccgggcgcgtcctcgactggctggagcagtacggtgtggaacggcttaagcgcatggctatctccggggacgactgcgtggtcaagccaatcgacgaccggttcgcgactgctctaaccgccctgaacgacatgggcaaggttcgcaaagatattccccagtgggagccctccaaaggctggggagactggcaacaggtgcccttttgctcccaccacttccaccagctaatcatgaaggacgtcagggagattgtggtgccctgccgaaaccaggacgagctcgtcggacgggcccgtgtgagccagggggccggatggtccctgcgtgagaccgcctgcctgggcaagagctacgcgcaaatgtggcagctcatgtacttccaccgcagagatctacgactggcggccaacgcaatctgcagcgccgttccagtcgactgggtgcccacgtcacgaactacctggtctattcacgcacaccatcagtggatgacgaccgaagacatgctcagtgtttggaaccgcgtctggatcgaggagaatccttggatggaggacaaaactcacgtgagctcctgggaggacgtcccgtacttgggcaaaagggaagaccagtggtgtgggagcctgattgggctcaccgctcgcgcaacctgggcgaccaatatccaagtcgccatcaaccaggtgcgccgactgatcggcaacgaaaactacttggattacatgacctccatgaaacgcttcaaaaatgagtcggatcccgagggggccctgtggtaa

SEQ ID NO: 24006 - RNA, 9879 nt, synthetic construct
  misc_feature 1..9879: note = derived and/or modified CDS sequence (opt11) from DENV-1__EU482567__SS-prME
  source 1..9879: mol_type = other RNA
agcgtcaccatgctgctgatgctgctcccaactgccctcgcattccacctgaccacccggggcggggagccgcatatgattgtgagcaagcaggagcggggtaagtcactcctgttcaagaccagtgcggggatcaatatgtgcaccctgatcgccatggacctgggagagctttgcgaggatactatgacctataagtgcccccggatcacggaggcagagcccgacgacgtggattgctggtgcaacgcaaccgacacctgggttacttatggaacctgctctcagaccggcgaacatcggcgtgacaagaggtccgtcgcgctggcaccccacgtgggcttagggctcgagacacggaccgagacttggatgagctccgagggggcctggaagcaaatacagaaggttgagacctgggccctaagacaccccgggttcacggtaaccgccctcttcttagcgcatgctattggcacgtctattacgcaaaagggcatcatctttatcctgctcatcctcgtgacgccttccatggccatgcgatgcgtgggcatcggtaaccgagacttcgtcgaaggactgagcggcgctacttgggtggacgtggtcctggagcacgggtcatgcgtgaccacaatggccaaggacaagccaacgctcgatattgagctgctgaagaccgaggtgactaaccccgcggtgctccgcaagctttgcatagaagccaaaatttccaacacaacgaccgattccagatgccccacacagggcgaagccacgctggtggaggaacaagattctaattttgtgtgtcgccggacattcgtcgaccgcggctggggaaacggctgcggcctcttcggtaaagggtccctgctgacgtgtgctaagtttaagtgcgtgaccaaactcgagggcaagatcgtccagtatgagaatttgaaatacagcgtgatcgtcaccgtgcacaccggagaccagcaccaggtcggcaatgagactaccgagcacggcacgatagccaccatcactccccaggcgcccaccagcgagatccagctgacagactacggggcactcaccctggattgctctccccggacgggcctggacttcaacgagatggtcttactgaccatgaaagagaagtcctggctcgtccataagcagtggtttttagatctgccgctgccctggactagcggggccagcaccagccaggagacgtggaaccgccaagatctgttggtgaccttcaagaccgctcacgctaagaagcaggaagtggtcgtgctcggcagccaggaaggcgcgatgcacaccgccctaacaggggccacggaaatccagacctccggcaccacgaccatctttgccggccacttaaaatgccgactgaagatggacaagttgacccttaagggtatgagctacgtgatgtgcacaggctccttcaagcttgagaaggaggtggcggagacgcagcatggtaccgtcctggtgcaggtcaagtacgaaggcacagacgcgccctgcaagataccatttagcgcccaggacgagaagggtgtaacccaaaacggccgcttaatcactgccaacccgattgtgaccgacaaagaaaagcccgttaatatcgagaccgagccgccattcggggagtcctacatagtggtgggcgccggcgagaaggcactgaagttatcatggttcaaaaagggaagttccatcggtaaaatgtttgaggctaccgcacgcggggcccgcaggatggccatcctgggcgacactgcgtgggatttcggatccattggcggtgtcttcacctccgccgggaaactagtgcaccaggtgtttggcgccgcctacggggtcttattctccggtgttagctggaccatgaaaatcgggatcggcatcctcctaacctggctggggttaaactcccgctcgacatcccttagcatgacttgcatcgccgtgggcatggttaccctgtaccttggtgtggtggttcaggccgactccgggtgcgtgattaattggaagggccgcgaattgaagtgcggaagtggcatcttcgtaacaaacgaggtccacacgtggaccgagcagtataaattccaggcagatagcccgaaacggctcagcgccgccatcggcaaggcctgggaagaaggggtttgcggtatccgcagcgcgacacgcctcgagaatatcatgtggaagcagatatccaacgagctcaaccacatcctgctggagaacgacatgaagtttacagtggtcgtgggggacgccaacgggatactggcccagggaaagaagatgatccgaccccagcccatggagcaccggtacagttggaaatcctggggcaaagctaagatcataggggccgacatccagaacgccaccttcatcatcgacgggcccgacacgccggagtgtcccgatgaccagcgcgcctggaatatctgggaggtggaggactatggcttcgggattttcacaacaaacatctggctgaaacttcgggactcatacacccagatgtgcgaccaccgccttatgtccgcagcaatcaaggacagcaaagcagtacacgccgatatgggctattggattgagagcgagaagaacgagacctggaagctggcacgcgccagttttatagaggtgaaaacatgcatctggcccaagagccacaccctatggagcaacggtgtattggagtccgagatgatcatcccaaagatttacgggggcccgatcagccagcacaactaccgccccggctacttcacccaaacggccggcccctggcacttagggaagctcgagttggatttcgatctgtgcgagggaacgaccgtcgtcgtggacgagcactgcggaaatcgcggtccgagcctgagaaccactaccgtcactggcaaaattatacacgagtggtgctgtcggagctgcaccctgccgccgctgagattcaggggggaggatggttgttggtacgggatggagatccgcccggtaaaagagaaggaggagaacctcgtgcggtccatggtcagcgcgggctcaggagaagtggactccttcagcctggggatattatgtgtttccatcatgatcgaggaagtcatgcggagcagatggtccagaaaaatgctcatgacaggtactctggcagtatttctgttactgatcatgggacagcttacctggaaggacctcatcaggctttgcatcatggtgggcgcgaatgccagcgaccggatggggatgggcaccacgtacctggccctcatggcgactttcaagatgcgcccgatgttcgccgtcggactactctttcggcgccttacgtctcgagaggtcttgcttctcaccatcgggttgagcctggtcgccagtgtcgagttgcctaacagtctggaggagctgggcgatggactggcaatgggcatcatgatgctgaagctgcttacggagttccagccccaccagttatggaccaccctcctgagcttaaccttcatcaacacgacgctgtctctggactacgcctggcggacaatggctatggtactgtctattatctctttgttcccactctgcctctctaccacgagccagaagacgacctggctgccggttctcctgggctccttcgggtgcaagccccttaccatgttcttaattacggagaacaaaatctggggccgcaaaagctggcccctgaacgagggcatcatggccatcggcatcgtaagtatcctgctcagcagcctgctcaagaacgacgtgcccctcgccggcccgttaatcgcaggtggtatgctgattgcttgctacgttatctccggaagcagtgccgacctttcgttggagaaagccgcggaagtatcatgggaggaggaggccgagcacagcggtacgtcccacaacatcctcgtggaagtccaggacgacggcaccatgaagatcaaggacgaggagcgcgacgacaccttgaccattcttctgaaggcgactctcctggccgtgagcggggtatacccgatgtccatccccgcgaccctgtttgtgtggtacttttggcagaaaaaaaagcaacggagcggggtgctctgggacactccctccccgcccgaggtggagcgagccgtcctggacgacggcatctataggatactgcagcggggcctgctggggaggagccaggtgggcgtgggggtcttccaggacggcgtctttcataccatgtggcacgtgactcgaggggccgtgctgatgtaccaaggcaagcgactagagcccagttgggcgagcgtaaaaaaggaccttatctcctacggagggggctggcgcttccagggatcgtggaataccggcgaagaggtgcaggtcattgcagtggagcccggtaagaacccgaagaacgtgcaaacaacccccggcacgtttaaaactcccgagggggaagttggtgccatcgcccttgacttcaagcccggcacttccggaagcccgattgtgaaccgggagggcaagatcgtgggcttatacggtaatggtgtcgtgacgacgtccgggacatatgtcagcgccatcgcgcaggcaaagaccagtcaggagggccccctacccgagatcgaggacgaagtcttcaagaagcgcaacttgaccataatggacctgcacccgggctccggcaagactcggcgctacttgccagcaatagtgcgggaagccatcaagaggaagcttcgcacactgatactggcgcccacccgtgtggtcgccagcgaaatggcagaggccctgaagggcatgcccatccgctaccagaccacggccgtgaagagcgaacacaccggacgagaaatcgtagacttaatgtgtcatgcaaccttcacaatgcggctcttaagccctgtacgggtgcccaattacaacatgatcataatggacgaagcccacttcacggacccggcaagtatcgcggctagaggctacatcagcactcgggtggggatgggagaagcggccgccattttcatgacagccacgcctcccgggtccgtcgaggccttcccccagagcaatgcggtgattcaagacgaggagcgcgacatcccggagcggtcttggaacagtggctacgactggatcacggatttcccgggcaagactgtctggttcgttccgtctatcaaaagcgggaatgatatcgctaactgcttgcggaagaacggcaagcgggtcattcagctatcccgcaagacttttgacactgagtatcagaaaactaagaacaatgactgggattacgtggtgaccacagacatctcggagatgggagcaaacttccgggccgaccgcgtgatcgaccccagacgctgtctgaaacccgtaatcctgaaagacggccctgagcgcgtgatcctcgcgggacctatgcccgtgacagtcgctagcgcggcccagcgccggggccgaatcggccgcaaccaaaacaaagagggggaccagtatgtctatatgggtcagccccttaacaacgatgaggaccacgcccactggacggaggcgaaaatgctgttagacaacattaacaccccagaggggatcatcccggccttatttgagcccgagcgggagaagtccgcggccatcgacggcgagtaccgcctgaggggagaggcccgcaagacttttgtcgagctcatgaggcgtggagatctgcccgtctggctatcctacaaagtggcgtccgagggtttccaatactccgaccggcgctggtgcttcgacggggagagaaacaatcaagtgctcgaggagaatatggacgtcgagatctggaccaaagagggtgaacgcaaaaagctgaggccgcgatggctcgatgctcggacttactcggacccgctcgccctgagggaattcaaggagttcgccgccgggcggaggagcgtatccggcgacttaattctagagatcggcaagctgcctcagcacctgaccttgcgggcacagaatgcactggataacctggtgatgctccacaatagcgagcagggtgggaaagcctacaggcatgccatggaggaactgccagacaccatcgagactctgatgttactcgctctgatcgcggttctcaccgggggcgtgacgctgttctttctgagcggtaaaggcctgggaaagacctctatcgggctgttgtgcgtgatggcatccagcgccctcctgtggatggccaacgtcgagccccactggatcgcggcctccattatactagaattcttcttaatggtgttgctgatcccggagccggaccggcagcgaacgccccaggacaaccagctcgcctatgtggtaatcggcctgctcttcatgatcttgaccgtcgccgccaacgagatggggttgctagaaacgaccaagaaggacttaggcatagggcacgtagccgccgagaaccatcaccacgccacaatgctcgacgtcgacctgcgtccggcaagcgcgtggacgctctatgcagtcgcaacgacagtgataacgcccatgatgcgccataccatcgagaatacgaccgccaacatctccctgacggccattgccaaccaggcagccatcctgatgggcttagacaagggatggcccatcagtaagatggacatcggggtcccccttctggctctcggatgctactcccaagtcaaccctctgacactgacggccgcagtgctcatgcttgtggcccactacgccataatagggccaggcttacaagccaaggctacacgggaggcacagaagaggaccgccgccgggataatgaaaaacccgaccgttgacggcatcgtagccatcgacttggaccccgtcgtgtacgatgccaagttcgaaaaacaactgggccagatcatgctgttaatactgtgcacgagccagatactgctgatgcggactacatgggcgctgtgcgagtccatcaccctggccacggggccgctcaccaccctgtgggagggcagcccggggaagttctggaataccacgattgccgtttccatggccaacatatttcggggctcttacctcgctggcgcggggctcgctttctccctgatgaagtccctgggcggaggccgcagagggacgggcgcccagggcgagaccctcggggaaaagtggaagcgccagttaaatcaactatccaaaagcgaattcaacacctataagcggagcggcataatggaggtcgaccgttccgaggcccgggaagggctcaagcgcggcgagacgaccaagcatgcggtgagccgtgggacggctaaactgaggtggttcgtggagagaaatctggtcaagccagagggcaaggtgatagacctggggtgtgggcgcggtggctggtcctactactgcgccggcctcaagaaggtgaccgaagtgaagggctacacgaagggcgggcccgggcacgaggagcccatacccatggccacctacggttggaacctggttaaactttactctgggaaagatgtgttcttcatcccccccgagaagtgcgacaccttgctttgcgacatcggcgaatccagcccgaacccaaccatagaagaggggcgtaccttacgcgtccttaagatggtggaaccttggcttcggggcaatcagttctgcattaagattctaaacccgtacatgccgtccgtagtagaaaccctagagcagatgcagcgcaagcacggaggaatgctggttcggaacccactgagccgcaactccacccacgaaatgtactgggtaagctgcggcaccgggaatatcgtcagcgccgtgaatatgacctcccgaatgctattaaaccgtttcacgatggctcatcggaagcccacgtacgaacgagacgtggatctaggcgccgggacccgccacgtggcggtggagcctgaggtcgccaacctcgacatcatcggccagcggattgagaacatcaagaacgagcataaaagcacctggcactacgacgaggacaacccttacaagacgtgggcctatcacggaagctacgaggtaaaaccgtccgggagcgcgtccagcatggtgaacggcgtagtccgcttattaaccaagccttgggatgtgatccccatggtcacgcaaatagccatgaccgacacgacccccttcggccagcagagggtattcaaagagaaggtggatacccgcactccgagagcgaaacgcggcacggcacagatcatggaggtcaccgccaagtggctctggggcttcctgtcccggaacaagaagccccgcatatgtacccgggaggagttcacccgcaaggttcgcagtaacgcagccatcggcgccgtgttcgtcgacgagaaccagtggaattcagccaaagaagcggtcgaagacgaacgcttttggaacctggtgcaccgagagcgcgagttacacaaacaaggtaagtgcgccacgtgtgtgtacaatatgatgggaaagcgggaaaagaagctgggcgaattcgggaaggccaagggctcccgagccatctggtacatgtggctgggcgcccggttcttggagtttgaggcgctggggttcatgaacgaggatcactggttcagtcgcgagaacagtttcagcggcgtggagggggagggcctgcacaaacttggatacatacttagagacatcagtaagatcccgggcggcaatatgtatgctgatgacaccgcagggtgggacacccggattacagaggacgacctgcagaacgaggccaagataacagatatcatggagcccgagcacgcactgctcgctaccagcatatttaagctgacctaccaaaacaaggtggtccgcgtgcagaggccagcaaagaacggcaccgtcatggacgtcatcagtcgacgggaccaacgcgggagcggccaggtgggcacttacgggctcaatacattcaccaacatggaggtgcagctgatccggcagatggagtccgaggggatcttcctccccagcgagctggagacgccgaacctggctgagcgcgtccttgactggttagagaagcacgggaccgagcggctcaaacgcatggccatctctggggatgactgcgtggtgaaacccgtcgacgaacgtttcgctaccgcactgatcgccctcaacgatatgggcaaggtacgcaaagatatcccccagtgggagccatctaaagggtggaacgactggcagcaggtcccgttctgctcccatcactttcaccagttgatcatgaaggacggtcgggagatcgtcgtgccctgccgcaaccaggacgagcttgtcgggcgggcccgcgtctctcaaggtgccggttggtcccttcgggagactgcctgtctgggcaagagctacgcgcaaatgtggcaacttatgtactttcaccgccgggatctgagactggctgcgaacgccatctgctccgcggtgccagtggactgggtcccgacaagccgcacaacttggagcatacacgctcatcaccagtggatgaccacagaggacatgctgagtgtgtggaaccgggtttggatcgaggagaacccgtggatggaagacaagacccatgtctctagttgggaggaggtgccctacctcggcaagagagaggaccagtggtgtggcagcctgatcggcctgacggcccgggccacctgggcaaccaacatacaagttgccatcaaccaggtacgtcggttgattggaaacgagaactacctcgactacatgaccagtatgaaacgattcaagaacgagagtgaccccgagggcgcactttggtga

SEQ ID NO: 24007 - RNA, 9879 nt, synthetic construct
  misc_feature 1..9879: note = derived and/or modified CDS sequence (opt11) from DENV-1__FJ390378__SS-prME
  source 1..9879: mol_type = other RNA
agcgtcaccatgctgttaatgttgctgcctaccgccctcgcgttccacctgaccacccggggcggggagccccacatgatcgtttccaagcaggagcggggcaagtcccttttgttcaagacctccgcggggatcaatatgtgcaccctgatcgccatggacctgggagaactctgcgaggacaccatgacctataagtgcccccggatcaccgaagccgaacccgacgacgtggactgctggtgcaatgcgaccgacacttgggtgacctacggtacctgttcccagactggcgagcacagacgcgataagcgttccgtcgcactggcgccccacgtgggcctggggctggagaccagaaccgagacctggatgagctccgagggggcctggaagcagattcagaaggtcgagacttgggcgctgagacaccccgggttcacggttaccgccctgttcttggcgcacgctatcgggaccagcatcacccagaaggggatcatcttcatccttctaatgctcgtgacgccctccatggcaatgcgctgtgttggcatcgggaaccgggacttcgtggaggggctgagcggcgccacttgggtggacgtggtcctggaacacgggtcatgcgttaccaccatggccaaggacaagcccacgcttgatattgaactgctgaagaccgaggtgaccaaccccgcggtcctccgcaaactgtgcatcgaggccaagattagcaacaccacgacggactcccggtgcccgacccagggcgaggcaactcttgtcgaggagcaggacagcaacttcgtctgccgacggacgttcgtggaccgcggttggggaaacggctgcggtctcttcggcaagggctccctgcttacttgcgcgaaattcaagtgcgtgaccaagttagagggcaagatcgtccaatacgagaacctgaagtatagcgtaattgtgaccgtgcacacgggcgaccaacaccaggtcgggaatgagacgaccgagcacggcaccatcgcaaccatcacaccccaggcgcccacctctgagatccagctgacggactacggtgcactaaccctggactgcagcccccggacgggcctggactttaacgagatggtgctcctgacgatgaaggaaaagtcctggttagtccacaagcagtggttcttggatctaccgctgccctggacaagcggagcaagcacctctcaggagacgtggaaccgccaggatctcctggtgacatttaagaccgcgcacgccaagaagcaggaggtagtggtgctgggcagccaggagggtgcgatgcacaccgcactaacgggtgccactgagatccagacctcgggcactacgaccatcttcgccgggcacttaaaatgccggctgaagatggataaacttactttgaaaggcatgagttacgtgatgtgtaccggtagcttcaagttggagaaggaggttgcagagacgcagcacggcacagtgttggttcaggtcaagtacgagggaacggacgccccttgcaagatcccattcagtgcccaggacgagaagggggttacccagaacggccgcctcatcacggccaacccgattgtgaccgacaaagaaaagcccgtcaacatcgagaccgagccaccgttcggggagtcctatatcgtggtaggcgccggtgaaaaggcactgaagctgagctggttcaagaaggggtccagtattggcaagatgttcgaggccaccgctcgaggagccaggaggatggcaatcctcggcgatacggcgtgggacttcgggtccataggaggagttttcacctcagtgggcaagctcgtgcaccaggtcttcggcgcggcctacggggtgctgttctccggcgtcagctggaccatgaagatcggaatcggcatactcctgacctggttgggcctcaattcccgcagcacgtcactgagcatgacatgtatcgccgtcgggatggtgactctgtacctcggggtcatggttcaggctgactccggctgcgtaatcaactggaagggtcgcgagctgaagtgtgggagcgggatcttcgtgaccaacgaggtacacacgtggaccgagcagtacaagtttcaggcggacagcccgaagcggttatccgccgccatcggcaaggcctgggaggagggggtatgtggcatccgcagcgccacacggctcgagaacatcatgtggaaacagatctctaatgagctgaaccacatcctgttggagaacgacatgaagttcaccgtggtcgtaggggacgctaacggcatcctggctcaggggaagaaaatgatccgccctcagcccatggagcacaggtatagctggaagtcatgggggaaggccaagatcatcggcgcagacatccagaactcaacctttatcatcgacgggcccgacacgccagagtgccccgatgatcagcgcgcgtggaatatctgggaggtagaggactacggtttcggcatcttcactaccaacatatggctgaagctccgggactcctacacccagatgtgcgaccaccggctgatgtccgcagccattaaggattccaaggccgtccacgcagacatgggttactggatcgagtctgaaaagaacgagacgtggaagctggcgcgggcgtcctttattgaagtgaagacctgcatctggcccaaaagccacaccctctggtccaacggcgtgctggagagcgagatgatcatccccaagatctacgggggccctatttcccagcacaattaccggcccgggtacttcacccagacagcaggcccgtggcacctgggcaagttggaactggatttcgacttatgcgagggcaccactgtcgtggtggacgagcactgcggcaaccgcggcccgagccttaggaccacgaccgtcaccggcaaaataatccacgagtggtgctgtaggtcctgcaccctgccgcccctgcgcttccgcggggaggatggctgctggtacgggatggagattaggccagtcaaggagaaggaagagaacctagtccggtcgatggtttcagccggctcaggggaggttgacagcttttccttagggatcctgtgcgtgagcatcatgatcgaagaagtcatgcgctcccggtggtcgaggaagatgctcatgacggggaccttggcggtgttcctcctcctgatcatggggcagttaacctggaatgacctgatccgcctgtgtatcatggtgggtgcgaacgcctccgaccggatggggatgggtaccacttacctggccctcatggccaccttcaagatgcgaccgatgttcgctgtcgggctgctgttcagacgactgacgtcacgggaggtgctgctgctcaccatcgggctgtccctggtcgcctccgtagagctccccaactccctcgaggagctgggcgacgggctcgccatgggcattatgatgctgaaactgttgacggagttccagccccaccaactgtggaccaccctcctcagcctgacattcatcaaaacgaccctgtccctcgattatgcctggcgcaccatggctatggttttaagcatcgtctcactgttccccctatgcctgagcaccacttcccaaaagacgacatggctgcctgtgctgctgggcagtttcgggtgtaagccgcttaccatgtttctcatcacggaaaacaagatctggggccgaaaatcttggcctctgaacgaggggattatggcgattggcatcgtgtcaatcctgctctcgagtctgctgaagaacgacgtacccctggcgggaccactgatcgccggcggaatgctgatcgcatgttatgtgatctccgggtccagcgccgacctctccctagagaaagcggccgaagttagctgggaggaagaggcggaacactccggcaccagccataacatcttagtcgaggttcaggacgacgggacgatgaaaatcaaggacgaggagagggatgacacgctcaccatcctcctgaaagcaacgctcctggccgtctccggagtctaccctatgagcatccctgcgacgctctttgtgtggtatttctggcagaagaagaagcagcgatcgggggttctctgggacacccccagtccacccgaggtagagcgcgccgtcctggacgacggcatttaccggatcctgcagcgcggcctcctcggccggagccaggtgggcgtcggcgtgtttcaggatggcgtgttccacaccatgtggcacgtcacgcgcggggccgtgctaatgtaccagggcaagcgactggaaccctcgtgggcctcggtgaagaaggacctcatcagctatggagggggatggaggttccaggggagctggaacacgggagaggaggtccaggtgatcgcagtggagcccggcaagaatccgaagaacgtccagaccacccccggtacgtttaagacccccgagggcgaagtaggagcgatcgccttggactttaagcccggcactagcgggtccccgatcgtgaacagggagggcaagatagttggcctgtatgggaacggcgtggtaaccacaagcgggacgtacgtcagcgccatagcccaggcgaagacctcgcaggagggcccgctccccgagatagaggaggaggtgttcaagaagcgcaacctgaccattatggacctgcacccggggtcaggtaagacgcggcgctatctccccgcaattgttcgggaagccatcaagagaaagctgcgcacgctgatcctcgcccccacacgggtcgtggccagtgaaatggcagaggcgcttaaaggaatgcccatccgctaccagacgacggccgtaaagagcgagcacacagggagggaaatcgtagacctgatgtgccatgccaccttcacaatgaggctcctgtccccggtgcgcgtgcctaattataacatgatcatcatggacgaagcccacttcactgatccggcgagcatcgccgcccgcgggtacatctcgaccagggtcgggatgggtgaggccgccgcaatcttcatgaccgccacgcctcccgggagcgttgaggccttcccccagtccaacgcagtgatccaggatgaagaacgcgacatccccgagcggagctggaactccggctacgactggatcacggacttccccggcaagaccgtctggttcgtgccctctatcaagtccggaaacgacatcgccaactgtctacgtaagaacggcaagcgggtgatccagctatctcgcaagaccttcgacaccgagtaccagaagacgcggaacaacgactgggactatgtcgtgacaaccgacatctccgagatgggggcgaatttccgagccgaccgagtcattgacccccgccggtgcctgaagcctgtcatcttgaaagacggtcccgagcgcgtgatcctcgccgggccgatgcccgtgaccgtcgcctccgcggcccaacggcgcggccgcatcggcaggaaccagaacaaggagggcgaccagtacgtgtacatgggccagcccctgaataacgacgaggaccacgcccactggacggaggccaagatgctgctcgacaacatcaacacacccgaggggatcatcccggccctattcgagcccgagcgcgagaagtccgcagccattgacggcgaataccgcctgcgcggggaggccaggaagacctttgtcgagctcatgcgacggggagatctgcccgtgtggctgagctacaaagtggcctccgagggctttcagtactcagaccgtcggtggtgcttcgacggggagaggaacaaccaggtccttgaggagaatatggatgtggaaatctggaccaaagagggcgagcggaaaaagctgcgcccacggtggctggacgccagaacgtatagcgacccgctggcgctgagagaatttaaggaatttgccgccggccgccggtccgtgagcggcgacctgattctcgagatcgggaagctcccccaacacctgaccctacgcgctcagaacgccctagacaacttggtcatgctccacaattccgaacagggcgggaaggcgtaccggcacgccatggaggagttacccgacaccatcgagaccctgatgctcctagccctgatcgccgtgctaaccgggggcgtgacgctgttcttcctgagcgggaaggggctcggcaagacctctatcgggctgctgtgcgtcatggccagctccgccttactgtggatggcgaacgtggagccgcactggatcgccgccagcataattctggagttcttcctcatggtgttactgatcccggagcccgaccgccaacggacgccacaggacaatcaactcgcttacgtcgtcatcggcttgctgttcatgatcctcaccgtggcggccaacgagatggggctgctggagacgaccaaaaaggatctcggtatcggttacgtggccgccgagaaccagcaccacgcgaccatgttggacgtagacctgcgcccggcctccgcctggacactctacgccgttgccacgaccgtgatcacccccatgatgcgccacaccattgagaacacgacggcgaacatcagcctcaccgccatcgcgaaccaagcggccatcctaatgggcctcgataagggctggcccatctccaagatggacatcggggtgcccctgctggcgctcggatgctactcccaggttaacccgctgaccctcacggccgccgtcctcatgctggtggcccactacgcgatcatagggcccggcctgcaggccaaggcgaccagagaggcccaaaaacgtacagccgcagggatcatgaagaaccccacggtggacggcattgtcgccatcgacctcgaccccgtggtttacgacgccaagttcgagaagcagctgggccagatcatgctgctaatcctttgcacgtcccagatcctgctgatgcggaccacctgggccttgtgcgagtctataaccctggctaccggtcctctaacaaccctgtgggagggcagccccgggaagttttggaacacgactatcgcagtttcgatggccaacatcttccgcggctcctatttggccggagccgggctcgcctttagcctgatgaagtccctgggcgggggccggcgcgggaccggcgcgcagggcgagaccctcggggagaagtggaagcggcagctgaatcagctgagcaagtctgagttcaatacctacaagcgctccggcatcatggaagtggaccggagcgaagctaaagaagggctcaagcggggcgagacgacaaagcacgccgtctcccggggtaccgccaagttacgctggttcgtcgagagaaacctagtaaagcccgagggcaaggtgatcgatctgggctgcgggcgcggcgggtggtcatactactgcgcggggctcaagaaggttaccgaagtcaaggggtatacgaagggcggccccgggcacgaggaacctatacccatggccacttacggctggaacctggtgaaactttactccgggaaggacgtcttcttcactccgcccgagaaatgcgacacactcctgtgcgatatcggcgagtcatccccaaaccccactattgaggaagggcgtacgctgcgcgtgctcaaaatggtggaaccctggctgcggggcaaccagttctgcatcaagatcttaaatccctacatgcctagcgttgtggaaacactcgagcagatgcagcgcaaacacggcgggatgttggtgcggaaccctttgtcccgaaacagcacccacgagatgtattgggtatcctgtggtaccgggaacatcgtgtcggccgtgaacatgacgtcccgcatgctattaaaccggttcaccatgacccaccgcaaacccacctacgagcgggacgtcgacctgggcgccggcacgaggcacgtggccgtggagcccgaggtcgcgaatctcgacatcatcgggcagcggattgagaacataaagaacgagcacaagagcacctggcactacgacgaggataacccgtacaaaacctgggcctaccacggcagttatgaggtcaagcccagcgggtccgcaagctctatggtgaacggcgtcgtgagactgctgacgaagccctgggatgtcatccccatggttacgcagatcgccatgaccgataccaccccgttcggccagcagagagtgttcaaagaaaaggtcgatacgcggacaccccgggccaagcgcggcaccgcgcagatcatggaggttaccgccaaatggctatggggcttcctgagccggaacaagaagccccgcatctgcacgcgagaggagtttacccgcaaagtgcggagcaatgccgccatcggggccgtcttcgtggacgagaaccagtggaactccgcgaaggaggccgtggaagacgaacgcttctgggatctggttcatcgggagcgcgagctccacaaacagggcaagtgtgcgacctgcgtctacaacatgatggggaagcgggagaagaagctgggcgagttcggtaaggccaagggcagccgcgccatctggtatatgtggctgggcgcccggttcctcgagttcgaggcgcttgggttcatgaacgaagaccactggttctctcgcgagaactccttctccggggtggagggggaaggccttcacaagctcgggtacatcctgcgcgacatcagcaaaatcccgggcggcaacatgtacgcagacgacaccgccgggtgggatacgcgcattaccgaggacgacctgcagaacgaggcgaagatcaccgacattatggagcccgagcacgccttactggcaacgtccatcttcaaactgacttaccagaataaggtcgtgcgcgtacaacggcccgccaaaaacggaaccgttatggacgtgatcagccgccgagaccagcgcgggtccggtcaggtgggcacctacgggctcaacaccttcacgaacatggaggtccagttaatccgtcagatggagagcgagggtatctttctgccctccgaactagagaccccgaacctggccgagcgcgtgctgaactggctcgagaagcatgggaccgaacgtctgaagcgcatggcgatcagcggcgacgactgtgtggtgaagcccgtggatgaccggttcgctaccgcactgatcgcattgaacgacatgggcaaagtccgcaaagacatcccacagtgggaaccctcgaagggctggaacgactggcagcaggtaccgttctgcagccaccattttcatcagctgatcatgaaggacggccgggagattgtagtgccctgccgcaaccaggatgagctggtcggacgtgctcgcgtgtcccagggcgcagggtggagcctacgcgagacggcctgtctaggcaagtcttacgcccagatgtggcaactgatgtatttccaccgtcgggacctgcgcctggccgccaatgcgatctgtagcgccgtgccggtcgactgggtaccgaccagccgcactacatggtccattcacgcgcaccaccagtggatgactacggaggatatgctgagcgtgtggaaccgggtctggatcgaggaaaacccgtggatggaggacaagacccatgtgtccagctgggaggaggttccctacctcgggaagcgcgaggatcaatggtgcggttccctgatcggcctgaccgcccgggcgacctgggccacgaacatccaggtggctatcaatcaggtgcggcggttaatcggcaacgaaaattacctggactacatgaccagcatgaagcggttcaagaacgagagtgacccagagggcgccctgtggtga

SEQ ID NO: 24008 - RNA, 9879 nt, synthetic construct
  misc_feature 1..9879: note = derived and/or modified CDS sequence (opt11) from DENV-1__FJ205872__SS-prME
  source 1..9879: mol_type = other RNA
tccgtgaccatgctgctcatgctgctgcccactgccctcgcattccacctaaccacccgaggcggagagccccacatgatcgtttccaagcaggagcggggaaaatccctcctctttaagacctccgctgggataaatatgtgcacgttaatcgcaatggacctcggcgagctctgcgaggacacaatgacctacaagtgcccccggatcaccgaggccgagccagacgacgtggactgttggtgcaatgccactgacacctgggttacgtacgggacctgcagccagaccggcgagcaccgtcgcgacaagcgatccgtcgcccttgcgccccacgtgggcctggggctcgagactcgcactgagacttggatgagctccgagggcgcctggaagcagatacaaaaggtggagacctgggccctgcggcaccccgggttcacggtgactgccttctttctcgcgcacgccatcggcaccagcatcacccagaaagggataatctttatcttgctgatgctggtcacccccagcatggccatgcgttgcgtaggcatcggcaaccgggacttcgtcgaggggctcagcggcgccacctgggtggacgtcgtattggagcacgggtcctgcgttaccacgatggccaaggacaagcccacgctggacatcgagctccttaagaccgaggtgaccaaccccgcggtcttacgcaagctctgcatcgaggccaagatcagcaacaccacgaccgactcccggtgcccgacccagggcgaagccaccctggtagaggagcaggactctaacttcgtctgccgccggacatttgtcgatcgcggctggggtaacggctgcgggctattcggcaaggggtccctcttaacttgcgccaagttcaagtgcgtgacaaagctggagggcaagatcgttcagtacgaaaacctcaagtacagcgtcatcgttaccgtacacacgggcgaccagcaccaggtcgggaacgaaaccaccgagcacggcaccatcgccaccatcaccccccaggcgcccacttccgagatccagcttaccgactacggggccctgaccctcgattgctccccccggacgggtctggacttcaacgagatggtgctgctcacaatgaaggagaagtcctggctcgttcacaagcagtggttcttagacctccccctgccctggaccagcggcgcaagcacctcccaggagacgtggaaccgtcaggacctgctcgtgaccttcaagactgcccacgccaagaagcaggaggtggtcgtgctgggcagccaagagggcgcaatgcacaccgccctgaccggggccactgagattcagacctctgggaccacgaccatattcgctgggcacctcaagtgccgcctgaagatggacaagctgaccctcaagggaatgagctacgtgatgtgcaccgggtccttcaaactggagaaggaggtcgccgagactcagcacggaaccgtcctggtgcaggtgaagtacgagggcacagacgcaccttgcaaaatccccttcagtgcccaggacgagaagggggtgacacaaaacggcagactaatcacggccaacccgatcgtgaccgacaaggagaagcccgtcaatatagaaaccgagccgcccttcggcgagagctacatcgtggtgggtgccggcgaaaaggcgctgaagctgagctggttcaagaagggatcctcgatcggcaagatgttcgaggctacggccagaggggcccgcagaatggcgatcctgggcgatacggcttgggacttcgggtccattggcggcgtcttcaccagcgtagggaagctcgtgcaccaagtcttcggcgccgcctacggggtgctgttctccggcgtttcatggaccatgaagatcgggatcggcatcctgctaacctggctgggcctgaattcccgcagcacgtccctcagcatgacctgcatcgccgtcgggatggtgaccctgtacctgggcgtgatggtccaagccgactccgggtgcgtgatcaattggaagggccgcgagctcaagtgcgggagcggcatcttcgtgacgaacgaggtccacacgtggaccgagcagtacaagttccaggcggacagcccgaagcggttgtccgccgctatcggcaaggcctgggaggagggagtgtgcggcatccggagcgcaacccggctggaaaacataatgtggaagcagatttcaaacgagctcaatcatatcctgttggaaaatgacatgaagtttaccgtcgtggtcggggacgccaatggcatcctcgcccagggcaagaaaatgatcaggccacagccaatggaacaccggtacagctggaagtcctggggcaaggccaagatcatcggggccgacatccaaaacagcaccttcatcatcgacgggcccgatacgccggagtgccccgatgaccaacgcgcgtggaacatctgggaggtggaggactacggcttcgggatcttcacaacgaacatctggctgaagctgcgggactcctacacccaaatgtgcgatcaccgcctaatgtcagcagcaatcaaggactccaaggcggtccacgccgacatgggctactggatcgaaagcgagaaaaacgagacgtggaagctggcgcgggcgtccttcatcgaagtcaagacctgcatctggcccaagagccataccctgtggagtaacggcgtgctcgagagcgagatgatcatccccaagatctacgggggcccgattagccagcacaattaccgccctgggtacttcacccagacggccggcccgtggcacctggggaaactggagctcgacttcgacttatgcgagggcaccaccgtggtggtggacgagcactgcggaaaccgggggccgtcgctacgcaccacgaccgtcaccggtaagatcatccacgagtggtgctgcaggtcctgcaccctaccgcctctgcgattccgcggagaggacggatgctggtacggcatggagatccgccccgtgaaagagaaggaggagaacttagtgcgaagcatggttagcgccggctccggtgaggtggacagcttttccctcgggatcctgtgcgtgagcattatgatcgaagaggtgatgcgctcccggtggtcgcgcaagatgctgatgacgggcaccctagccgtctttttgctgctcatcatggggcagctgacctggaacgacctgatccgcctctgcatcatggtgggcgcgaacgcatccgaccggatggggatgggcaccacgtacctggccctgatggccaccttcaagatgcgcccgatgttcgctgtcggcctcctgtttcggagactgaccagccgggaggtcctcctgctgaccatcggcctctccctggtggcgagcgtggagctgccaaactccctcgaggagctgggcgacggactggccatgggcatcatgatgctcaaactgctgacggaattccagcctcaccagctttggactactctgctgagccttaccttcatcaagacgacgctatccttagactacgcttggcgcaccatggccatggtgctcagcatcgtctccctgtttcccctatgcctaagcaccacgtcccagaagaccacctggctgccggtgctactcggctcttttggctgtaagcccttaaccatgttcctgatcacggagaacaagatctggggacggaaatcctggcccctcaatgaagggatcatggcgatcggcatcgtgagcatactgctgagctctctcctgaagaacgacgtccccctcgctgggccactcatagccggcggtatgttgatcgcctgctacgtgatcagcgggtcgagcgccgacttatcgctcgagaaggcggccgaggtgagctgggaagaggaggcagagcactcaggcacgtctcacaacatcctggtcgaggtgcaggatgacggtactatgaagatcaaggatgaggagcgcgacgacactctgaccattctcctgaaagctactctgctcgctgtgtccggcgtctaccccatgagcatcccggcgaccctgttcgtgtggtacttctggcagaagaagaaacagcggtccggggtcctgtgggacacccccagcccgcctgaagtcgagagagccgtgctcgacgacggcatctaccggatcctgcagcgcggactgctggggcggtcccaggtgggcgtcggggtgtttcaagacggcgtgttccacaccatgtggcacgtcacgcgcggggccgtgcttatgtaccagggtaaacggttggagcccagctgggcatccgtgaagaaggacctgatcagctacggcgggggctggcgcttccaggggtcctggaacacaggcgaagaggtccaggtgatagctgtggagccggggaagaacccgaagaacgtccaaaccacacccggaacgttcaagactcccgagggcgaggtgggggctatagccctcgactttaagcccggcaccagtgggtccccgatcgtgaaccgtgagggcaaaatcgtcggtctgtatgggaacggcgtcgtgaccacgagcgggacctacgtaagtgccatcgcccaggccaagacatcccaggagggtcccctgcccgagatcgaggaggaggtgttcaagaagcgcaacctcaccattatggatttgcacccgggaagcggtaagacgcggcgctacctgcccgcgatcgtccgggaggccatcaaacgcaaactcagaacgctaatcctggcccctactcgggtcgtggccagcgagatggcggaggccttgaaggggatgcccataagataccagacgacggccgtcaagagcgagcacactggtcgggagatcgtcgacctgatgtgccacgccaccttcaccatgcgtctgctctccccggttcgggtccccaactacaacatgatcatcatggacgaggcccacttcaccgaccccgcgtcaatcgccgccagggggtacatttccacacgcgtcgggatgggggaggccgccgcgatcttcatgacggccacgccgccggggagcgtcgaagccttccctcagtcaaatgccgtgatccaggacgaggagcgcgacatccccgaaagaagctggaactccggttacgactggatcacggacttccccggaaagacggtctggttcgtgcccagcatcaagtccgggaacgacatcgccaactgtctgcgcaagaacggaaagcgggtcatccaattaagccggaagactttcgacaccgagtaccaaaagacgcggaacaacgactgggactacgtcgttaccaccgacatcagcgagatgggggccaacttccgcgctgaccgggtgattgacccccgccggtgcctgaaacccgtcatcctgaaggacgggcccgagcgcgtgatccttgccgggcccatgcccgtgaccgtcgccagcgcggcccagcggcgcggccgcattggccggaaccagaacaaggagggggaccagtacgtgtacatgggccagcccctcaacaacgacgaggaccatgcccactggacggaggccaagatgctgctggacaacatcaacacccccgagggaatcatcccggccttattcgagcccgagcgcgagaagagtgccgccatcgacggcgagtaccggttgcgcggggaggcacggaagaccttcgtcgagctgatgcgccggggcgacctccccgtgtggctgagctacaaagtggcatcggagggtttccagtactcggaccgccggtggtgcttcgacggggagcgcaacaaccaagttttagaggagaacatggacgtggagatatggacaaaggagggcgagcggaagaagctacggccccgttggctggacgcaaggacgtacagcgacccgctggcgctgcgtgagttcaaggagttcgcggccgggcgccggtccgtgagcggcgacttgatcctggagatcggcaagctaccccagcacctgaccttacgcgcccagaacgccctcgacaacctagtaatgctgcataactccgagcagggcgggaaagcgtaccggcacgccatggaagaactccccgacaccatcgaaaccttaatgctgctcgctctgatcgccgcgctgaccggaggcgtgaccctcttcttcctgagcgggaagggcctgggcaagacctccatcgggttgctgtgcgtaatggccagttccgccctgctctggatggccaatgtcgaaccccactggatcgccgccagcatcatcctggaatttttcctcatggtactcttgatcccggagcccgaccgccaacgaacgccccaggacaaccagctcgcctacgtggtcatcggcctcctgttcatgattctgaccgtggcggccaacgagatggggctcctggaaacgacaaaaaaggacctgggcatcgggtacgtagctgcagagaatcagcaccacgccacgatgctcgacgtcgacctgcgcccggcctccgcctggaccctgtacgccgtggctacgaccgtaatcacccccatgatgcgccacaccattgaaaacaccaccgccaacatcagcctcaccgccatcgcaaatcaggctgcgattctgatgggtctggacaagggctggccaatctccaagatggacattggggtcccactcttagccctgggctgctacagccaggtgaacccgctcaccctgacggccgccgtgctgatgctcgtcgcgcattacgccatcattgggccgggcctgcaggccaaagccacacgggaggcccagaagcgcacagcggccgggattatgaaaaaccccaccgtggacggcatcgtggccatagacctggaccccgtcgtgtacgacgccaagtttgaaaagcagctcggccagataatgctgctgatcctctgcacgtcccagatccttctgatgcggaccacctgggccctctgcgagagcatcaccttagcgacgggcccgctgaccaccctctgggaggggtccccggggaaattctggaacacgaccatcgccgtgagcatggccaacatctttcgcggctcctacctggcgggtgccggcctggcattcagcctcatgaagtccctgggcggaggtcggcgcggcactggcgcccaaggcgagaccctcggcgaaaagtggaagcggcagcttaaccaattgtctaagagcgagttcaacacttataagcgctccggcatcatggaggtcgaccggagcgaggcaaaggaggggctaaagcgcggagagacgaccaaacacgccgtgtcaagggggaccgccaagctccgctggttcgtggagcggaacctggtcaagcccgagggcaaggttatcgatctgggctgcggacgcggggggtggagctactactgcgccggtctgaagaaggtgaccgaggttaaggggtacacaaagggcggcccgggccacgaagagccgatacctatggccacctatggttggaacctcgttaagctgtactccgggaaggacgtgttcttcacaccccccgagaagtgcgacaccctgctctgcgacatcggagaaagcagtccgaaccccaccattgaggagggcaggacgctgagagtcctgaaaatggtggaaccctggctccggggcaaccaattttgtattaagattctgaacccctacatgccgtcggtggtcgagacgctggaacaaatgcagaggaagcatggcgggatgctcgtgcggaaccccctgtcccgcaacagcacccacgagatgtactgggtgtcctgcggcaccggcaacattgtcagcgcagtgaatatgacgtcccgtatgcttctcaaccggttcaccatgacccaccgcaagcccacctacgagcgggacgtggacttgggcgccggcactcggcacgtcgcggtggagcccgaggtggccaacctggacattatcgggcagcggatcgagaacattaagaacgagcacaagagcacctggcactacgacgaggacaacccgtacaagacctgggcctaccacggctcctacgaggtaaagccctccggctcggcttcatccatggtaaacggagtggtccgtctcctcaccaaaccctgggacgtgatccccatggtcacgcagatcgccatgaccgacaccacgccgtttgggcagcaacgggtgttcaaggagaaggtggacactcgtacgcccagagctaagcgcggaactgcccaaatcatggaggtcaccgccaagtggctgtggggcttcctctcacggaacaagaagccccgcatatgcacgcgggaggagttcacacgcaaggtgcggagcaacgcagccatcggggcggtgtttgtcgacgaaaaccagtggaacagcgccaaggaggccgtggaggacgagcgcttctgggatctggtgcacagagagcgcgagctgcacaagcagggcaagtgcgcgacgtgcgtatacaacatgatggggaagagagagaaaaagctcggcgagttcgggaaggcgaagggatcacgcgcaatttggtacatgtggctgggcgctcgcttcctggaattcgaggccctcgggtttatgaacgaagaccactggttctctcgcgagaacagcttctccggcgtggagggggagggtctgcacaagctggggtacatcctccgtgacatcagcaagatccctggcggcaacatgtatgccgatgacacggcggggtgggacacgcggatcactgaggatgacctgcagaacgaggccaaaataaccgacataatggagcccgagcacgccctgctagccacatccatctttaagctgacgtaccagaacaaagtggtccgggtgcagcggccggcgaagaacggcaccgtgatggacgttatctcccgccgggaccagcgcgggtcaggccaggttggcacctacgggctgaacaccttcacgaacatggaggtgcagttaatccgacagatggagagcgaggggatatttctgccctctgagttggagactccgaacctcgcggagcgcgttctgaattggctggagaagcacgggaccgagcgcctcaagcgtatggccatctcgggtgacgactgcgttgtgaagcctgtcgacgaccggttcgcgaccgccctgatcgccctgaacgacatggggaaagtgaggaaggacatcccccagtgggagccctccaagggctggaacgactggcagcaagtgccgttctgcagccaccacttccaccagctgatcatgaaggacggacgggagatagtcgtgccctgccgcaaccaggacgagctggtggggcgggcgcgcgtttcccagggcgccgggtggagcttgcgggagaccgcctgcttaggcaagtcctacgcgcaaatgtggcagctgatgtacttccaccgccgggatctgcgtctcgcagcgaacgcgatctgtagcgccgtgcccgtggactgggtccccaccagccgcacaacctggtccatccacgcccaccaccaatggatgaccacggaggatatgctcagcgtatggaaccgcgtgtggatagaggagaacccctggatggaggacaaaacccacgtctcctcctgggaggaggtcccctacctgggcaagcgcgaggaccaatggtgcggctccctcataggcttaacggcgcgggccacttgggcgacgaacattcaggtcgccatcaaccaagtccgccggctgatcgggaacgagaactaccttgactacatgacaagcatgaagagattcaagaacgagagcgaccccgagggcgccttatggtga

SEQ ID NO: 24009 - RNA, 9879 nt, synthetic construct
  misc_feature 1..9879: note = derived and/or modified CDS sequence (opt11) from DENV-1__FJ205873__SS-prME
  source 1..9879: mol_type = other RNA
agcgtgaccatgctgctcatgctgcttccgaccgcactcgccttccacctaaccacccggggaggggaaccccacatgatcgtgagcaagcaggaacggggcaaaagcttgttgttcaaaacctcggccgggattaacatgtgtacactgatcgcaatggacctaggcgagctctgcgaggacactatgacctacaagtgcccccggatcaccgaggccgagcccgacgacgtggactgctggtgcaacgccaccgatacctgggtgacctacggcacttgtagtcaaaccggagagcaccggcgggacaagcggtccgtcgcactagcgccccatgtgggcctgggcctcgagacccgcaccgaaacttggatgagctcagagggcgcgtggaaacagatccagaaagttgagacctgggccctgcggcatcctgggttcacggtaaccgccctgttcctcgctcatgccatcggcaccagcataacccagaaggggatcatctttattctgctgatgctagtgacgcccagcatggccatgcgctgtgtgggcataggcaaccgggacttcgtcgaggggctgtccggcgctacctgggtggacgttgtcctggagcacgggtcctgcgtaacaactatggccaaggacaaacccacgctggatatcgagctgctgaagaccgaggtgaccaaccccgccgtcctccgcaagctttgcatcgaggccaagatctcgaacaccacgaccgactcccggtgcccgacccagggcgaagccacccttgtggaggagcaggacagcaacttcgtatgtcgccggacgtttgtcgaccgcggctgggggaacggctgcggccttttcggcaaggggtccctgctgacttgcgcaaagttcaaatgtgtcaccaagctcgagggaaagatcgtgcagtacgaaaacctaaagtacagcgtgatcgtgaccgtgcatacgggcgaccagcaccaggtcgggaacgaaaccaccgagcacggcaccatcgccaccatcacacctcaggcgcccacctccgagatccagttgactgactatggggccttgaccctggactgcagcccacggacgggcctggacttcaacgagatggtgctactgaccatgaaggaaaagtcctggctggtccacaaacagtggttcctggacctcccgctgccttggacctctggggccagcacctcccaggagacatggaaccgccaggatctccttgtgaccttcaagaccgcccacgcgaagaaacaagaagtagtcgtgctgggcagtcaggagggcgcgatgcatacggccctcaccggggcaacagaaatccagacctcgggcaccacgaccatcttcgcggggcacctgaagtgccggctgaagatggacaagctcacactgaagggcatgtcttacgtgatgtgcaccgggtccttcaaacttgagaaggaagtcgccgagacacagcacggcacagtactggtgcaggtcaagtacgagggaaccgacgcgccctgcaagatacccttcagcgcccaggatgagaagggggtgacccagaacggccgcctcataacggccaatccgatcgtgaccgacaaagagaagcccgtgaatatagagaccgagccgcctttcggggagagctacattgttgtgggcgctggcgaaaaggctctgaagctgagctggtttaagaaggggtccagcataggcaagatgtttgaggccacggcccgcggggcccgccggatggccatcctcggggatacggcgtgggatttcgggtccatcggcggcgtcttcaccagcgtgggcaagctggtgcaccaagtctttggcgccgcatacggagttttgttcagcggggtgagctggaccatgaagatcgggatcggcatactcctgacctggctaggccttaactcccgtagcacgtccctatcgatgacctgcatcgccgtggggatggtgaccctttacctcggggtgatggtccaggccgactccgggtgcgtgatcaactggaagggccgcgagctgaagtgcggaagcggcattttcgtaacaaacgaggtgcacacgtggacagagcagtacaagttccaagcggacagcccgaagcggctgtccgccgccatcggcaaggcctgggaggagggggtatgcggcatccgttctgcgacccgactcgaaaacatcatgtggaagcagatttccaacgaactgaatcacattctgctcgagaacgacatgaagttcaccgtcgtcgtgggggacgcgaatggcatcttggcccaggggaagaagatgatacgcccgcaacccatggaacaccggtacagctggaagtcctggggcaaagccaagataataggagccgacatccagaacagcaccttcatcatcgacggacccgacacgccggagtgccccgacgatcagcgcgcgtggaacatctgggaggttgaggactacggcttcggtattttcaccacaaacatctggttgaagcttcgggactcctacacccaaatgtgcgaccaccgcctgatgtctgccgcaataaaggattccaaggccgtccacgcagacatggggtactggattgagagcgagaagaacgagacctggaagttggcgcgggcctccttcatcgaggttaagacttgcatttggcccaaaagtcacaccctctggagcaacggcgtgttagaaagcgagatgatcataccgaagatctacgggggcccgatcagtcagcacaactaccgccctgggtacttcacccagacggccggtccctggcatctggggaagcttgaacttgacttcgatctgtgcgagggcaccaccgtcgttgtggacgagcactgcggcaaccggggcccgagcctccgcaccacgaccgttacgggtaagatcatccacgagtggtgctgccggtcctgtaccctgcccccattgcgcttcagaggggaggatggctgctggtacgggatggaaatccgccccgtgaaggagaaggaggagaacctcgtgcggagtatggttagtgccgggtcgggcgaggtggatagcttctctctggggatcctctgcgtcagcatcatgatcgaggaggtaatgcgctccaggtggtctagaaagatgctcatgacgggcaccctcgccgtgttcctgctcctgatcatggggcagctgacatggaacgacctcatccgcctatgtataatggttggggccaacgcatccgatagaatgggaatgggaaccacgtacctcgccctaatggccacctttaaaatgcgacccatgttcgctgtcgggttgctattccgtaaacttaccagccgggaggtgctgctgctcaccatcggactttcgctcgtggcgagcgtcgagctccccaattccctcgaggagctgggcgacgggcttgccatgggtataatgatgctgaaactactcacggagttccagccccaccagttgtggaccaccctgttaagcctgaccttcatcaagacaaccttatccttagactatgcctggcggaccatggccatggtgttatcgatcgtatccctgttccccctttgcctgtctacaacgtctcagaagaccacatggcttccggttctcctgggcagctttgggtgcaaaccccttaccatgttcttgatcacggagaacaagatatggggacgcaaatcctggcccctaaacgaggggatcatggcgatcgggatagtgagcatcctgctaagcagcctgctgaagaatgacgtccccctagccggcccgctgatcgcaggcgggatgctcatcgcctgctacgtgatctcggggtcgagcgccgacttgtccctggaaaaagcggcggaggtgagttgggaggaggaagccgagcactccggcaccagccacaatatcctagtcgaggtgcaggatgacggtaccatgaagatcaaggatgaggagcgggacgatacgttaacaatattgctgaaggcaacgctgttggccgtgtctggcgtctaccccatgagcatccccgcgaccttgtttgtgtggtatttctggcagaaaaagaagcagcggtccggggtactttgggacacccccagtcctcccgaggtcgagagagctgtgctggacgacggtatctaccgaatcctgcagcggggcttgctggggcgctcccaggtaggagtcggggtatttcaggacggtgtgttccacaccatgtggcacgtgacgagaggggccgtactgatgtaccaaggcaagcgactcgagccaagttgggccagtgtgaagaaagacctcattagctatggcgggggctggcgtttccaggggagctggaacaccggtgaggaagtacaggtgatcgctgtagagccgggaaagaacccgaagaatgtccagaccacccccggcacgttcaagacccccgagggcgaggtgggggcaatcgctctagacttcaagcccggcacctccggatccccgatcgtgaaccgcgagggcaaggtggtgggcctgtacgggaacggcgtggtcaccacgagcgggacctacgttagcgccatcgcccaggccaaaacctcccaggagggccccctccccgagatcgaggaggaggttttcaagaagcggaatctgacgattatggacttacacccgggtagcggcaagacgcgacggtacctccctgcgatcgtccgggaggccatcaagcgcaagcttcgcacactgatcctcgctcccacccgcgtggtagcatctgaaatggcggaagccctgaagggtatgcccatcaggtaccagactaccgccgtcaagagcgagcataccgggcgcgagatcgtggacctgatgtgtcacgccacctttaccatgcggctcctctcccccgtacgtgtccccaactataatatgatcatcatggatgaggcccatttcaccgatcccgcgagcatcgccgcccggggctatatctcaactcgcgtcgggatgggcgaagcggccgcgatcttcatgacagccacgccgccagggagcgttgaggctttcccacagagtaacgccgtaatccaggacgaggaacgggacattcctgagcgcagctggaactctggctacgactggatcactgactttcccggcaagactgtgtggtttgtgccaagcatcaaatccggcaacgacattgccaactgtttgcggaaaaacggcaagagggtcattcagctctcgcggaagaccttcgacaccgagtaccaaaagactcgcaacaacgactgggactacgtggtcaccacagacatctccgaaatgggggctaacttcagagccgaccgagtcatcgacccccggcgctgcctgaaacccgtgatcctgaaggacggccccgaacgggtgattctcgcgggtccgatgcctgtaaccgtggcctccgcggcccagcgccggggccgtattggccgcaaccagaacaaggagggcgaccagtacgtctacatgggccaaccactaaacaacgacgaggatcacgcacactggacggaggcgaaaatgctgctcgataacatcaataccccggagggtattatcccggctctgttcgagcctgaacgggagaagtccgcggccatcgacggtgagtaccgcctccgcggagaggctcggaagacctttgtggaactcatgcggcgcggcgacctgcccgtgtggcttagctataaggtcgcctccgagggctttcagtacagcgaccggcgctggtgctttgacggtgagcgcaacaaccaggtcctcgaggagaacatggacgtggagatctggaccaaggagggcgaacgtaagaagctgcggccaagatggctggacgcccggacatacagcgacccgctcgccctgcgcgagtttaaggagttcgccgccgggcggcggtccgtctctggcgatctgatccttgaaatcggcaagctgccccagcatctgactctgcgggcccagaacgccctggacaatctggttatgctccacaattccgaacagggcgggaaggcctaccgccacgccatggaagagctacccgataccatcgaaacccttatgttactggccctgatcgctgtgctcacaggcggggtcacgctgttctttctatccgggaagggcctcgggaagacatccatcggactgctgtgcgtaatggcgtcatccgccctcctgtggatggccaacgtggagccccactggatcgcagccagcataatcctggagttcttcttaatggtcctgctgatcccggagccagaccggcagcgaacgccccaggacaaccagctcgcgtatgtggtcatcggcctgctgttcatgatactcaccgtcgccgccaacgagatgggtctgttagagacgaccaagaaggacctgggcattgggcatgtggccgccgagaaccagcaccacgcgaccatgctggacgtggacctgaggccggcctccgcctggactctctacgccgtcgctacgaccgtgatcacgcccatgatgcggcacaccatcgaaaacacgaccgcgaatatcagcttgaccgccatcgccaatcaggccgccatcctgatgggcctcgacaagggatggcctatctccaagatggacatcggggtacccctgctggcgctcggctgctatagccaggtcaatccgctgaccctgacggcggccgtactcatgctggtagcgcactacgcgatcatcgggcccggcctgcaggccaaagccacgcgcgaggcccaaaagcggaccgccgctggtatcatgaagaatcccaccgtcgacggcatcgtggcaattgacctcgatcccgtggtgtacgacgccaaatttgagaagcagctcgggcaaattatgctgctcatactgtgtacgtcccagattttgttgatgcgcaccacttgggccctatgcgaaagcatcaccctcgccactgggccactcaccacactgtgggagggctcccccgggaaattctggaacacgaccatcgcggtgagcatggccaatatcttccggggctcctacctggccggcgcggggctcgcctttagcttgatgaagtcgctcggcgggggccgcagagggaccggagctcagggggagaccttaggggagaagtggaagcgccaactgaaccaactgtctaaaagcgagttcaatacctacaagcggtcaggaatcatggaggtggaccgcagcgaagccaaggaagggctcaagcggggcgagacgactaagcacgccgtctcccgcgggaccgcaaaattgcggtggttcgtggagcgcaacctggtgaagcctgagggcaaggtcatcgatctgggatgcgggcgtggcggctggagctattactgcgcgggactcaagaaggtgaccgaggtgaaggggtatacgaaaggaggccccgggcatgaagagccgatccccatggccacttacggctggaacctggttaagttgtactctgggaaggacgtgttcttcacgccgcctgaaaagtgcgacaccctcctgtgcgacataggcgaaagcagtccgaaccctaccattgaggagggtagaacgctgcgggtgttgaagatggtcgagccctggctgcgagggaaccagttttgcatcaagatcctgaacccctacatgccgagcgtggtcgaaaccctagagcagatgcagaggaagcacggcggaatgctggtcagaaaccccctttcccgaaacagcacccacgaaatgtactgggtgtcctgcggcaccgggaacatcgtgagcgccgtaaacatgacgtcccgcatgctcctgaaccgattcaccatgacccaccggaagcccacctacgagcgcgacgtggacctgggggctggcacgagacacgtggccgtagagcccgaggtagcgaatctcgacatcatagggcaacgcatcgagaacatcaaaaacgagcacaaaagcacatggcactacgacgaggataacccctataagacctgggcctaccacggcagctacgaggtaaagccaagcgggagcgccagctccatggtaaacggagtggtcaggctgctaaccaagccctgggacgtgatccccatggtcacacaaatagccatgacggacaccacgccgttcggacagcaacgcgtcttcaaagagaaagtggacacgaggacgccccgagccaagcggggcacagctcaaataatggaggtgacggccaagtggctctggggcttcctgagcaggaacaagaaaccacggatttgcacgcgtgaagagttcacccggaaggtacgcagcaacgccgccatcggggccgtgtttgtggatgagaaccagtggaactccgcgaaggaggccgttgaggacgagcggttttgggatctggtgcacagagaacgggagctccacaagcagggcaagtgcgcaacctgcgtgtacaacatgatggggaagagggagaagaagttgggcgaattcgggaaggcgaagggctcccgggcgatctggtacatgtggcttggcgccaggtttctcgagttcgaggccctggggttcatgaacgaggaccactggttttcccgggagaacagcttctccggcgtcgagggggagggcctgcacaaattaggttacatcctgcgcgacatcagcaagattccgggtggcaatatgtacgccgacgataccgctgggtgggacacgcgcatcaccgaggacgacctgcagaatgaggccaagattaccgacatcatggaacccgaacacgccttactggcaacatccatcttcaagctcacgtatcaaaacaaggtagtgcgggtccaacgccccgcgaaaaacggcacagtaatggacgtgatcagccggcgggaccagcgcggctccggccaggtcggtacctacgggctcaatacgtttactaacatggaggtgcagctgatccgccagatggagagcgagggcatctttctgccctccgaattagagaccccgaacctggcggagcgggtgctgaactggctcgagaagcatggtaccgagcgcctgaagcggatggcgatcagcggcgacgactgcgtcgtcaagcccgtggacgaccgctttgccaccgcgctgatcgccctcaacgacatggggaaggtccggaaggacatcccacagtgggagccttctaaaggctggaacgactggcagcaggtcccgttctgtagccaccacttccaccagctgatcatgaaggacggccgcgaaatcgtcgtcccctgccggaaccaagatgagctggtggggcgcgcccgggtgtcccagggtgcgggttggagcttgagagagacagcctgtcttggcaagagctacgcccagatgtggcagttaatgtacttccatcggcgcgacctccggctggccgccaacgcgatctgcagcgccgtgcccgtggattgggtgcccaccagcagaaccacgtggtccatccatgcccaccaccagtggatgaccacggaggacatgcttagcgtctggaaccgcgtgtggatcgaagagaatccgtggatggaggacaagacccacgtgtccagttgggaagaggtcccctacctcgggaaacgggaggaccagtggtgtggctccctgatcggcctgactgcccgcgctacttgggcgaccaacatccaggttgccataaaccaggtgcggcgcctgatcgggaacgagaactacttggattacatgacctctatgaagcggttcaagaacgagtccgaccctgagggtgccctgtggtag

SEQ ID NO: 24010 - RNA, 9879 nt, synthetic construct
  misc_feature 1..9879: note = derived and/or modified CDS sequence (opt11) from DENV-1__FJ390379__SS-prME
  source 1..9879: mol_type = other RNA
tccgtcaccatgctgctcatgctgttgcccaccgcccttgcgttccatctgactacccggggcggcgagccgcatatgatagtgtccaagcaggagcggggaaagagcctcctgttcaagacgtctgccggcattaatatgtgtaccctgattgccatggacctcggcgagctctgtgaggacacgatgacctacaagtgcccccggattaccgaggccgagcccgacgacgtggactgctggtgcaacgccaccgacacctgggtgacctacgggacctgcagccaaacaggcgagcaccggagggacaaaagatccgtggccctggcgccccacgtaggactggggttagagacacgcactgagacttggatgagctccgaaggcgcgtggaaacagatccagaaggtcgagacctgggccctgcggcatcccgggttcacggtaacggccttattcctcgctcacgccatcggcaccagcattacccagaagggaatcatcttcatcctcctcatgctcgtgactccctccatggcgatgcgctgcgtgggcatcggtaaccgggattttgtcgaggggctgtcaggcgccacctgggtggacgtggtcctggagcatgggagctgcgttaccaccatggccaaggataagcccacgctcgacattgagcttctcaaaaccgaggttacaaaccccgcagtcctacgaaagctgtgcatcgaggccaaaatcagcaacacaactaccgatagccggtgccccacccagggcgaggccacccttgtagaggagcaagacagcaattttgtgtgccgccggacctttgtggaccgcggctgggggaacggctgcggcctcttcggcaagggctccctgctgacctgcgccaaattcaagtgcgtgaccaaattggagggcaaaatcgtgcaatacgaaaatttaaaatactctgtcatcgtcaccgtgcacactggtgatcagcatcaggtcggcaacgagacgacggagcacggcaccatcgccacgattacgccccaggcccccacctcagagatccaactgaccgactacggggctctcaccttggactgcagcccccggacgggcctggacttcaacgaaatggtcctcctgaccatgaaggagaaatcgtggctggtccataagcagtggttcctggacttgccactgccctggaccagtggagcaagcacctcccaggaaacttggaaccgccaggacctactggtgacattcaagaccgctcatgcgaagaagcaggaggtggtggtgcttggcagccaggagggcgcgatgcacactgccctcacgggggccaccgagatacagacctccggcaccacgacgatcttcgccgggcatctgaaatgccggctgaagatggacaagctcaccctgaaaggcatgagctacgtgatgtgtaccgggtccttcaagctggagaaggaggtcgcggagacgcagcacggcacggtgctggtgcaggtcaagtatgaaggcaccgacgcgccctgcaaaatccccttcagtgcccaggacgagaagggagtgacccagaacggccgcctcatcacggccaaccctatcgtgaccgataaggaaaagcccgtaaacatcgagaccgagccacccttcggggagtcctacatagtggtgggcgcaggcgaaaaagccctgaagctgtcatggttcaagaaggggagcagcatcggcaagatgttcgaggctacagccagaggggcccgccggatggccattttgggcgacacggcctgggacttcggttccatcggaggcgttttcacctctgtgggaaagctggtacaccaggtgttcggcgccgcctacggggtgctgttctccggcgtgagctggacaatgaaaatagggatcggcatcctcctaacctggctgggcctcaattcccgcagcacgtccctgagcatgacctgcatcgcagtagggatggttaccttgtacctaggcgtcatggtccaggccgactccggttgcgtgatcaattggaagggccgcgagctgaaatgcgggagcgggatcttcgtgactaatgaggttcacacttggaccgagcagtataagttccaagcggacagccccaagagactgtcggcggccatcggcaaagcctgggaggagggggtgtgtggcatccgcagcgccacccggctcgagaacatcatgtggaaacagatctcgaacgagctcaaccacattttgctagaaaatgacatgaagtttacagtggtcgtaggggacgcgaacggcatcctggcccaagggcgcaagatgatccggccccagcccatggagcaccgctactcttggaaatcctggggcaaggccaaaatcataggcgccgacattcagaatagcaccttcataatcgacgggcctgatactccggagtgccccgacgaccagcgggcgtggaacatctgggaggtggaggactatggttttgggatcttcaccactaacatctggctcaaacttcgcgactcctacacccagatgtgcgaccatcggttaatgagtgccgcgatcaaggattccaaggctgtccacgctgatatgggctactggatcgagtcggagaagaatgagacgtggaagctagcgcgcgcctccttcatcgaggttaagacatgcatctggcccaaatcccacacgctgtggtccaatggcgtactggagtctgagatgatcatacctaaaatctatggtggtccgatcagtcagcacaattatcggcccgggtacttcacccagaccgccggcccatggcatctggggaagctagagttagacttcgacctctgcgagggcaccaccgtcgttgtggatgagcactgtggcaaccgcgggccgagcctgaggacaacgaccgtaaccggcaagataattcacgaatggtgctgccgctcctgtaccctgccacccctacgatttcgcggggaggatggctgttggtacgggatggagatccggcccgtgaaagagaaagaggagaacctagttcgcagcatggtcagcgccggctccggcgaggtggacagcttctccctggggatcctgtgtgtgtcgatcatgatcgaagaagtgatgcggagtaggtggagcagaaaaatgttaatgacaggcacactcgccgtatttctgctcctgatcatggggcagctcacttggaacgacctcattcggctgtgcatcatggtcggagcgaacgcctccgacaggatggggatggggaccacgtatctagccctcatggccacttttaagatgcggccgatgttcgccgttggcctgctttttagacgtctcacctcgagagaagtgttactgctcacgataggactgtccctcgtggcgagcgtagagctccccaactcgctggaggaactgggcgacggtctcgccatgggaatcatgatgctaaaactccttacggagttccagcctcaccagctgtggaccaccctgttgagcctaaccttcataaagacgacgctctcccttgactacgcgtggcggacaatggccatggtcttgtcgattgtctccctgttccccttatgtctgtctaccacgtcccagaagaccacatggctgcctgtcctgctgggctccttcgggtgcaagcccctgaccatgttcctcatcacagaaaacaaaatatggggcaggaaatcctggcccctgaacgagggtatcatggcgattggcatagtgtctatccttctctccagcctgctgaaaaatgacgtccccctcgccgggccgctcatcgctggcggaatgctcattgcatgttacgtaataagcggcagtagcgccgacctttccctggaaaaggcggccgaggtgtcatgggaggaggaggccgaacatagtggtaccagccacaacatcctcgtcgaggtgcaggacgatggcaccatgaagatcaaggacgaagaacgggatgacaccctcaccatcctactgaaggctaccctcctggcgatctccggcgtgtatcccatgagcatcccagcgaccctgttcgtatggtatttctggcaaaagaagaaacagcgctccggggtgctatgggacactccgagtccacccgaagtagagcgggccgtgctggacgacggcatctatcgcatactgcagcgtggcctgctcgggcggtcccaagtgggagtgggggtcttccaagacggcgtgttccacaccatgtggcatgtaacgcgcggggccgtactgatgtaccaagggaagcgcctggagccctcttgggcctccgtgaagaaggacctcatatcttacggcggtggctggcggttccaagggagctggaacaccggcgaagaggtgcaggtcatcgccgtggagccggggaagaacccgaaaaacgtgcagaccaccccgggtacgttcaaaacacccgagggcgaggtcggtgcaatcgccctggacttcaaaccgggtacctccggctcacccatcgtgaaccgcgagggaaagatcgtggggctgtacgggaacggcgtcgtcaccacgagcgggacgtacgtgagcgcaatcgcccaggcgaagacgtcccaggaaggaccactccccgagatcgaggaagaggtgttcaaaaagcggaacctgaccatcatggacctccatcccgggagcggcaagacgcgccggtacctcccagcgatcgtgcgcgaggccatcaagaggaaactacggacactcatcctggcacccacacgcgtggttgcctccgagatggctgaggcactaaagggtatgcccatccggtaccagaccactgcggtcaagagcgagcataccgggagggaaattgtggatcttatgtgtcacgccacattcaccatgagactactgtcccctgtccgcgtccccaactataatatgatcatcatggacgaggctcacttcactgatccggcgtccatagcagcccgggggtacatatcaacacgtgtcgggatgggcgaagccgcagcgatttttatgaccgccacgccacccgggagcgtagaagccttcccacagtccaacgccgtaatccaggatgaggaacgtgacatcccagagcgcagctggaactctggctatgactggatcacggacttccccgggaagaccgtgtggtttgtccccagcatcaagtccgggaacgacatcgcaaactgtctgcgaaagaacggcaagcgagtgatccagctaagccggaagaccttcgacaccgagtaccagaagacacgcaacaacgactgggactacgtggttaccacggatatatccgagatgggggctaacttcagggcggaccgcgttatcgatcccaggcgctgtctgaaaccggtaatcctcaaggatggaccggagcgcgtgatcctggccgggcccatgcccgtgacagtggcctccgcggcgcagagacgcggacggatcggccgtaaccagaacaaggagggggaccagtacgtctacatgggccaacccctgaataatgacgaggaccacgcccactggacggaggccaagatgctgttagacaacattaacacccccgaggggatcatcccggctctttttgaacccgaacgggagaagtccgcagccattgacggcgagtatcgtctacgaggggaggctcgcaaaacgttcgtggagctcatgcgacggggcgatctgcccgtctggctcagctacaaggtggcctccgagggcttccagtacagcgaccggcgctggtgcttcgatggtgagcgcaacaaccaggtgctcgaagagaacatggacgtcgagatctggaccaaggagggcgagcgcaagaagctccgaccccgttggctggacgcccggacgtactctgatcctctggcgctgcgcgagtttaaagagttcgccgccgggcgccgttccgtctctggtgacctgatcctcgagataggcaagctgccccagcatttaacattaagggcccagaacgccctggataaccttgtgatgctacacaactctgaacagggcggtaaagcgtaccgccacgccatggaggagttgccagataccatcgagacccttatgctcctagccctgatcgcagtcttaaccgggggcgtgacgctattcttcctgtccgggaagggcctcggcaagacgtccatcgggttactgtgcgtcatggcgagctccgccctcttatggatggcgaatgtcgaaccgcattggatcgcagccagcatcatactggaatttttcttgatggtgctgttaatccctgagcccgaccggcagcgcacgcctcaggataaccaacttgcgtacgtggttataggcctgttatttatgatcctcaccgtggcagcaaacgagatgggtctgctggagacgacgaagaaggaccttggaatcgggcatgtcgccgcagagaaccagcatcacgccaccatgctggacgtcgacctgcgcccggcatccgcgtggacactctatgccgtcgccacgaccgtcataaccccgatgatgaggcacaccatcgagaacactaccgcgaatatcagccttaccgccatcgcgaaccaagccgccatcctgatggggctcgataagggctggcccatctccaagatggacatcggggtccccctcttggccttgggctgttacagccaggtgaacccactcaccctaaccgctgcagtgctcatgttagtcgcccactacgcgatcatcggtcctggcctgcaggccaaggccacccgcgaagcgcagaagcggacggccgcggggatcatgaagaatcccactgtcgacggcatcgtcgccattgacctggatcccgtcgtgtacgacgctaagttcgagaagcagctgggccagatcatgctgctgatcctgtgcacaagtcagatcttactcatgcgcacgacctgggccctgtgcgagtctatcaccctggccaccgggccgttaaccaccttatgggaaggatcccctgggaagttctggaacaccacgattgcggtgtcaatggccaacatcttccggggctcataccttgccggtgcgggtttggcctttagtctgatgaaatccttaggaggaggccgtcggggcaccggtgcgcaaggcgagaccctcggggagaaatggaaacgccagcttaaccagctgagcaagagcgagttcaatacctacaaaaggtccggcatcatggaggtcgaccgcagcgaggctaaggaagggctcaagcgaggcgagaccactaagcacgccgtgtcgcgcggcaccgccaagctgaggtggttcgttgaacgcaacctggtcaagccagagggcaaagtgatcgacctcgggtgtggtcggggcgggtggtcctactactgtgctggcctcaagaaggttaccgaggtcaaagggtacacgaagggaggccccggtcacgaggagccggtgcccatggccacctatggctggaacctagtgaagctgtactcggggaaagatgtcttcttcacaccgccagaaaagtgcgacacgctcctgtgcgacattggagagagctccccgaacccgacaatagaagagggacgcacgctgcgcgttctcaagatggtggagccgtggctacgcggcaaccagttttgcataaagatcctgaacccttacatgccgagcgtcgtggagaccctggagcagatgcaacggaagcacggcgggatgctggttcgtaaccctctgtcccgcaattcgacccacgaaatgtactgggtctcgtgtggcacagggaacatcgtaagcgccgtgaacatgacaagccggatgctgcttaaccgcttcaccatgacccaccggaagcccacctatgagcgcgacgtcgacctaggcgccggcacgcgtcacgtagccgtggagccagaagtcgcgaacctcgacatcattggacaacgcatcgagaatattaagaacgaacacaagtccacctggcattacgacgaagacaacccatacaagacctgggcgtaccacgggagctatgaagtgaagcccagtgggtcagcaagctccatggtgaacggcgtcgtgcggttactgaccaagccctgggacgtcatccctatggtcacccagatcgccatgacagataccacaccgttcggtcagcagagggtgttcaaagaaaaagtagatacacggacaccccgcgcaaagcggggaaccgcccagataatggaagtgacagctaagtggctctggggcttcctgagccgaaacaagaagccccgaatctgcaccagggaggagttcacgcggaaggtgcgctctaatgccgccatcggcgcggtctttgtagacgagaaccagtggaactccgctaaggaagccgtggaagatgagcggttttgggacttggtacaccgggaacgtgagctccacaagcagggcaagtgcgcgacctgcgtatataacatgatggggaagcgcgagaagaagctgggggagttcgggaaggcaaagggctcgcgcgcgatttggtacatgtggctgggggcgcgcttcctcgagttcgaggctctggggtttatgaacgaagaccattggttctccagggagaacagcttttccggtgtggagggggagggcctgcacaaattggggtacatccttagggatataagtaaaatcccgggcggcaatatgtatgccgacgacacggccggctgggacacgcgcataaccgaggacgatctacagaacgaggcgaagatcaccgacatcatggaacctgagcacgccctcttagcgacctccattttcaagctgacgtaccaaaataaggtagtgcgggttcagcgccccgccaagaacggcaccgttatggatgtgattagccggcgggaccagcgtggatccggccaggttggcacctatgggctcaatacctttacaaacatggaggtccagttgatccgccagatggagtcagaaggcatcttccttccatcagaactcgagaccccgaatttagccgagagggtacttgactggcttgagaagcacgggaccgagagactgaagcgaatggcaatcagcggcgacgactgtgtggtcaaacccgtagacgatcgtttcgccaccgcgctgatagcacttaacgatatggggaaggtgcgaaaagacatccctcagtgggaaccatcgaagggctggaacgactggcagcaggtaccgttctgtagccaccacttccatcagctgatcatgaaagacggccgcgaaatagtggtgccctgccggaaccaggacgagctggttgggcgcgccagggtgtcccagggggcgggatggagtcttcgagaaacggcgtgtcttggtaaatcctatgcccaaatgtggcagcttatgtactttcatcgtcgcgacctccgcttggccgccaacgcgatctgcagtgccgtaccagtggattgggtgcccaccagccgaaccacttggtccatccatgcccaccaccagtggatgacgactgaggatatgttgtcggtctggaacagggtgtggatcgaagagaacccgtggatggaggacaagactcacgtttccagctgggaggaggtgccgtatttaggaaaacgggaggaccaatggtgcggctccctgatcggcttaacggccagagcgacctgggccacgaatatccaggtggcgattaaccaagtccgacgtttaatcgggaacgaaaactatctcgattatatgaccagcatgaagcgtttcaagaacgaaagtgatcccgaaggcgccttatggtaa

SEQ ID NO: 24011 - RNA, 9879 nt, synthetic construct
  misc_feature 1..9879: note = derived and/or modified CDS sequence (opt11) from DENV-1__FJ390380__SS-prME
  source 1..9879: mol_type = other RNA
agcgtgactatgctgctcatgctactacccaccgccctcgcctttcacctgaccacccggggcggggaaccccacatgatcgtgtccaagcaggaacggggcaagagcttactgtttaaaacttccgccgggatcaacatgtgtacactgatcgccatggacctgggcgagctctgcgaagacaccatgacctacaaatgcccccggatcaccgaggccgagcccgacgacgtggactgctggtgcaacgccaccgacacatgggtgacttacgggacctgctcacaaaccggcgagcaccggcgcgacaaaagatccgtcgcacttgctccccacgtgggcctaggcctggagacacgcaccgagacctggatgtcatccgaaggcgcctggaaacagattcaaaaggtggagacctgggccttacggcaccccggctttacggtgaccgcactgttcctggcgcatgccatcggcactagcattacccagaaggggataatattcattctattgatgctcgtgacgccctctatggccatgcgctgcgtcgggatagggaaccgagacttcgtcgagggactaagcggtgccacctgggtggatgtggttctggagcacggttcctgtgtgactacaatggccaaggacaagcccactctcgacatcgagttactaaagaccgaggtgacaaaccccgcggtgctgcggaagctgtgcatagaggccaagatttcgaacactacgaccgactcccggtgcccgacccagggcgaggccaccctggttgaggagcaggatagcaacttcgtgtgccgccggacgttcgtcgacagagggtgggggaacggctgcggcctgtttggcaagggctcactgctgacctgcgccaagttcaagtgcgttacgaagctcgagggcaagattgtgcaatatgagaaccttaagtatagcgtcatcgtcacagtgcacacaggcgaccagcaccaggtcgggaatgagaccaccgagcacgggactatcgccacaatcacgccccaggcgccaacctccgagattcagctgaccgactacggggccctcaccttggactgctcaccccggacgggactggacttcaatgagatggttttgctgacgatgaaggagaagtcctggctggtccacaaacagtggttcctcgatttaccgttgccctggaccagcggggcctctacctcccaggagacgtggaaccgccaggacctcctggtcacattcaagaccgcccacgccaagaagcaagaggtggtagtgctggggtcgcaggaaggcgcgatgcacaccgccctcaccggggccacagaaatccagacctcgggcaccacgaccatcttcgccgggcacctgaagtgccggctgaagatggacaagctcaccttaaaagggatgagttatgtgatgtgcaccgggtcctttaagttggagaaggaagtcgctgagacgcagcacggaaccgtgctggtacaggtgaagtacgagggcaccgacgctccctgcaaaatacccttcagcgcccaggacgagaagggcgtgacccaaaacggccgcctcatcacggcaaacccaatagttaccgacaaagagaagccggtcaacatcgagacagaaccgccctttggggaatcctacatcgtggtgggcgcgggcgagaaagcactgaagctgagctggttcaaaaagggatccagcataggtaagatgttcgaggccaccgcccgcggggctcggcggatggccatcctcggcgacacggcgtgggatttcgggtccatcggaggcgtcttcaccagcgtggggaagctggtgcaccaggtcttcggcgccgcttacggcgttttgttcagtggagtgagctggaccatgaagattggcatcggcatcctcctgacctggctcggtttaaacagcagaagcacttcccttagcatgacctgcatcgccgtcgggatggtgaccctgtacctgggagtgatggtccaggcggactccgggtgcgtgattaactggaagggtcgcgagctgaaatgcgggtctggcatcttcgtgaccaacgaggtccacacgtggaccgagcagtacaagtttcaggcggatagcccgaaacggctgagtgccgccatcggcaaggcctgggaggagggggtgtgcggcatccgcagcgctacccggctagagaacattatgtggaagcaaatctctaatgagctgaaccacattctgctcgagaacgacatgaagttcaccgtggtcgtgggtgatgcgaacggtatcctggcccaggggaagaagatgatccgcccccagcccatggagcaccggtatagctggaaaagctggggcaaggccaagatcatcggcgccgacatacagaatagcacgttcattatcgacgggcccgacacgccggagtgccctgacgaccagcgcgcgtggaacatctgggaggtcgaggactacggtttcggaattttcaccactaacatctggctgaagctgcgagactcctacacccagatgtgcgaccaccgcctgatgagcgcggccatcaaagacagtaaggcagtccacgccgacatgggctactggatcgagagcgagaaaaacgagacctggaagttagcgcgcgcatccttcatcgaggttaaaacctgcatctggcccaaatcacacacactatggagtaatggcgtgctggagagcgagatgatcatcccaaagatctacggagggccaatctcccaacacaactaccggcccggatactttacccagacggccggcccgtggcacttaggcaagctcgagctggacttcgagctttgcgaaggcaccaccgtcgtggtggacgagcattgcggcaaccgggggcccagcctcagaaccacgaccgtcaccggcaagattatccatgagtggtgctgtcggagttgcaccctgcctccactgcgattccgcggggaagacggctgctggtacggtatggagatcaggcccgttaaggagaaggaggaaaacctcgtgcggagcatggttagcgccggctctggcgaggttgacagcttctcactggggatcctgtgcgtgtctatcatgatcgaggaggtaatgcgctcccggtggagccgcaagatgctaatgactggcaccctggtggttttcttcctgctcatcatggggcagctgacatggaacgacctgatccgcctatgcatcatggtcggcgccaatgcgtccgaccggatgggaatgggcacgacgtacctggccctgatggccaccttcaagatgcgcccgatgtttgcggttgggcttcttttccggcgcctaacgtcccgggaggtgctcctgctgaccattgggctcagccttgtcgcatctgtggagttgcccaactccttagaggagctcggagacgggctagccatgggtatcatgatgctcaagctgctgacggagttccagccccatcagctctggaccaccctgttaagcctaacctttatcaagacgaccctgtccttggactatgcctggcggaccatggccatggtcctctcaatcgtgtctttgttccccctgtgcctcagcactacttcccaaaagaccacctggttacctgtgctcctcggctctttcgggtgcaagcccctgaccatgttcttgatcacggagaataagatctggggccggaagtcatggcccctcaatgaggggataatggcgatcggcatcgtctctatcttactgagctccctactgaagaacgacgtgcccctggcggggccactcatcgccggcggcatgctgatcgcctgctatgtaatttctggctccagcgcggacctgtccctggagaaggcagccgaggtcagctgggaggaggaggccgagcattcgggcaccagccataacattctggtagaggtacaggatgacgggaccatgaagataaaagacgaggagcgcgacgacaccctcacaatactccttaaggccacgctgctagctgtctcaggcgtctatcctatgagcatccccgccaccttcttcgtgtggtacttctggcagaagaagaagcagcgctccggggtcctgtgggacacaccctccccgcctgaggtggagcgcgcggtgctggacgacggaatttaccggattctccaaagaggtctgcttggccggtcccaagtcggcgtgggggtgttccaggacggcgtcttccacaccatgtggcacgtgacgcgcggggccgtactgatgtatcaaggcaagcggctcgagccctcttgggccagcgtcaagaaggacctgatcagctacggcgggggatggcgcttccaggggagttggaacaccggcgaggaggtccaggtgatcgccgtggagcccggtaaaaacccgaagaatgtacaaactacccccggcacgttcaagacaccggaaggtgaggtgggggccatcgcgctggacttcaagcccggcacttccggttccccaatcgtcaatcgggaaggcaagatcgtaggcctctacgggaacggtgtggtcaccacgagcggaacctacgtgtcggccatcgctcaagccaagacctcccaggagggtccgcttccagagatcgaggaggaggttttcaagaagcgaaaccttaccattatggacctccacccggggagcggtaaaacacggaggtacctgccagccatcgtccgggaggcaatcaagagaaagttgcgcacactcatattagcccccacccgggtggtagcctccgagatggccgaggcgttgaagggcatgcccattcgctaccagaccacggccgtcaaatcagaacataccgggcgtgagatcgtggacctcatgtgccatgccaccttcaccatgagactcctgtctcccgtgagggtaccgaattacaacatgatcattatggacgaggcccacttcactgaccctgccagcatcgcggcccgcggatacatctccacccgggtggggatgggtgaggcggctgccatcttcatgaccgcgacgccacccgggagcgttgaggcatttccccaatccaacgccgtcatccaggacgaggagcgcgacatccctgagcggagctggaactccgggtacgactggatcacggacttccccggaaagaccgtgtggttcgtccccagcattaagtccgggaacgacatcgccaactgcctgagaaagaatggcaagagagttatacagttaagccgcaagaccttcgacaccgagtaccagaagacacggaataacgattgggactacgtggtgaccaccgacatctccgagatgggggccaacttccgcgcggaccgggtcatcgaccctcgccggtgcctgaagccagtgatcctcaaggacggccccgagcgggtgatcctggcagggccgatgccggtcaccgtggccagcgccgcgcagagaagaggccgaatcggacgaaatcagaataaggaaggggaccaatacgtatacatgggccagcccctgaacaacgacgaggaccacgcacactggacggaggccaagatgctcctggacaacatcaacacgcccgaagggattatccctgccctgttcgagccggagcgcgagaaatccgcagcgatagacggcgaatacagactacgcggagaggcccggaagaccttcgtggagctgatgcgcagaggtgaccttcccgtgtggctcagttataaggtcgcatccgagggcttccagtattcagacaggcggtggtgcttcgatggtgaacgcaacaatcaggtcttggaggagaacatggacgtggagatttggaccaaggagggcgagcggaaaaagctgcgcccccggtggctcgacgcccgcacgtacagcgacccgttggcccttagagagttcaaggagttcgcagcaggacgccgctccgtgagcggcgacctcattctggagatcggcaagctgccccagcacctgaccctacgagcgcaaaacgccctggacaacctcgtgatgctacacaattccgagcagggcgggaaagcctacagacacgctatggaggaactgccggacaccatcgagaccctcatgctgttagcactcatcgccgtgctgaccggtggcgtcactttgttcttcctcagcggtaagggactgggcaagacctccatcggattactttgtgtcatggcgagctccgcgctgctgtggatggctaacgtagagccccactggattgccgccagcatcatcctcgagtttttcctgatggtcctgctcatcccggagcccgaccgccagcggacgcctcaggacaaccaactggcatacgtggtgatcggactactcttcatgatactgaccgtcgctgccaacgagatggggctgctcgagacaaccaagaaggacctggggatcgggcatgttgccgccgagaaccaacaccacgccaccatgctggacgtggacctccgccccgcgtccgcctggaccctgtacgccgtcgccaccactgttattaccccaatgatgcgccacacaatcgagaacacgacagccaatatcagtctgaccgcgatcgccaaccaggccgcaatcctcatgggcctagacaaaggatggcccatctccaagatggacattggggtgcccctgctcgccctgggctgctactcacaagtcaacccgctgaccctcaccgcagctgtcctgatgctggtagcccactacgccatcatcggacccggcctccaggcgaaggccacccgggaggcccaaaagcgcaccgcggccgggatcatgaaaaacccgaccgttgacggtatcgtcgcgatagacctcgaccccgtggtctatgacgcaaagttcgaaaagcagttgggccagatcatgctgctgatcctgtgcacttcccagatcctcctgatgcgaaccacctgggctctgtgcgagtccatcacccttgctacggggccgctgaccaccctgtgggaaggcagtcccgggaaattctggaacaccacaattgccgtgagcatggcgaacattttccggggaagttacctcgccggtgccgggctggcctttagcttaatgaagtcacttggcgggggccggcgcgggaccggagcccagggcgagaccctgggggagaagtggaagcggcaacttaatcagctaagtaagagcgagtttaacacctataagcgctccggcattatggaggtggaccggagtgaggctaaggaggggctgaaacgcggcgagacgacaaaacacgccgtctctagaggtaccgctaagctgaggtggttcgtggaaagaaacctcgtgaagccagagggcaaagtcatcgacctgggctgcggcagaggtggatggagctactattgcgccggcctgaagaaagtgactgaggtgaaggggtacacaaagggcggccccgggcacgaggagccgatccccatggccacctacggctggaacttagtcaagctctactctgggaaagacgttttctttacgccgccagaaaagtgcgacaccctgctgtgcgatatcggcgagtccagtccaaaccccactatcgaggaggggcggacgctccgcgtgctgaagatggtcgagccatggctgcggggcaaccagttctgcatcaagatactcaacccttacatgccgagcgtggtggaaaccctggagcagatgcagcgcaagcacggcgggatgctggtacggaaccccctctctaggaacagcacccacgagatgtattgggtgtcctgtggcacagggaacatcgttagcgcagtaaacatgacgtcacgcatgctgctgaatcggtttaccatgacccatcgcaagcccacctatgaaagggacgtggacctcggcgccggtacgagacatgtggccgtcgagcctgaggtggccaacctcgacatcatcgggcaacggatcgagaacatcaagaacgagcacaagtccacctggcattacgacgaggataatccgtacaagacctgggcgtatcacggctcctatgaggttaagcccagcgggtccgcaagctcaatggtcaatggtgtggtccggctgctcaccaagccatgggatgtgattcctatggtgactcagatcgcaatgaccgacacaaccccgttcgggcagcagagagtctttaaggagaaggttgacacccgcacgcctcgtgccaagcgcggtaccgcacaaatcatggaagtgacagcgaagtggttatggggcttcctcagccggaacaagaagccccgcatttgcacgcgggaggagttcacgcgcaaggtacgtagcaacgccgctattggggccgtattcgtggacgaaaaccagtggaactccgccaaggaggccgtcgaggacgagcgcttctgggacctcgtgcaccgcgagcgcgagctgcacaagcagggcaagtgtgctacatgcgtgtataacatgatggggaagagggagaagaagctgggcgagttcggaaaggccaaggggagccgcgccatctggtacatgtggctcggagcgcggttcctggagtttgaggcactggggtttatgaacgaagaccactggttctcccgagagaacagcttttccggcgtggaaggggagggcctgcataaattaggttacatcctgcgcgacattagcaagatcccgggcggaaacatgtacgcggatgacaccgccgggtgggacacccgcatcaccgaggacgatctccagaacgaggccaagatcaccgacatcatggagcctgaacacgcgctgctggccacctccatcttcaaattgacgtaccagaacaaggtggttcgcgtccagcggcccgccaaaaacggtactgtgatggacgtgatctcaaggagagatcaaagaggctccggccaggttggcacctatgggctgaacaccttcactaacatggaggtgcagctgataaggcagatggagagcgagggtatctttctcccctccgagctagaaacgccgaacttagcggaacgggtcttaaactggctggaaaagcacggtaccgagcggctgaagcgcatggccatcagcggcgacgactgcgtggtcaagcccgtggacgaccggttcgccaccgccctcatcgccctcaatgacatggggaaggtcagaaaagacatcccccagtgggagcccagcaagggctggaacgactggcagcaggtcccgttctgctcgcaccatttccatcagctcattatgaaagacggccgcgagatcgtggtgccctgccgcaaccaggacgagctcgtggggagagcacgtgtgtcccagggcgcgggctggagcctgcgagagaccgcgtgcctgggcaagtcatatgcccagatgtggcagctcatgtacttccaccgtcgagacctgcgcttggccgcaaacgccatctgcagcgcggttcccgtggactgggtgcccacgagccgcaccacctggtccatccatgcccatcaccagtggatgaccaccgaggacatgctcagcgtctggaatcgggtgtggatcgaggagaacccgtggatggaagacaagacccatgtgtcgagctgggaggaggtcccctacctggggaagagagaggaccagtggtgcggctccctgatcggcctaaccgccagagccacctgggcgacgaacatacaggtggccataaaccaagttcgccgcctgatcgggaacgagaactatcttgactacatgacctcaatgaagcgcttcaagaacgagtccgatcctgagggcgccctctggtga

SEQ ID NO: 24012 - RNA, 9879 nt, synthetic construct
  misc_feature 1..9879: note = derived and/or modified CDS sequence (opt11) from DENV-1__FJ205874__SS-prME
  source 1..9879: mol_type = other RNA
tcagtaaccatgcttctaatgttacttcccacagtgctggccttccacttgacgacacggggaggggaaccccacatgatagttgggaaacaagaacggggcaagagcttactattcaaaacctccgcgggagtcaacatgtgtacgctcatagctatggacctcggcgagctgtgcgaagatacgatgacatataaatgcccacgcataacagaggcggaaccggacgacgtggattgctggtgtaacgccacggatacatgggtcacctacgggacatgctctcaaacaggtgaacatcgccgcgacaaacgctccgtagccttagcgccccacgtaggcctggggctagagaccaggacagaaacatggatgagtagcgaaggcgcatggaaacaaatacaaaaagtagaaacgtgggcactgagacacccaggattcacagtaatagccttctttttagcgcacgccattggaacctcaatcacacaaaaaggtataatattcatcctcctcatgctagtaacaccctctatggcaatgcgatgcgtgggaatagggaaccgagactttgtggagggtctaagcggagcgacatgggttgacgtcgtactcgaacacggcagctgcgtcactaccatggccaaaaataaaccaacactagatatcgaacttctcaaaaccgaggtcaccaaccccgcagtactaagaaaactgtgtatcgaagcaaaaataagtaatacgaccacagactccagatgcccaacccaaggggaggccaccctggtggaagaacaggacgcgaacttcgtgtgtcgtcgcacgttcgtagaccgcggatggggcaacggctgcgggttattcgggaaaggaagcctcttaacatgtgctaaattcaaatgcgtgactaaactggagggtaagatcgtgcaatatgaaaatttgaaatactccgtcatcgtcactgtgcacacaggagatcaacaccaagtgggaaacgagacaaccgagcacggcaccatcgcgactataacaccacaagcaccaacaagtgaaatccaattaacggactacggcgcactcacacttgactgttcaccgcgcacgggcctagactttaacgaaatggtcctattaaccatgaaggaaaagagctggctcgtgcacaaacagtggttccttgatctaccattaccatggacaagtggagccagtacatcacaggagacttggaaccgacaggaccttctagtcaccttcaaaactgcacacgcgaagaaacaagaggttgtggtactaggatcacaagaaggagctatgcacacagcccttacgggagcgacagaaatccaaaccagtggtaccacaacaatattcgcgggccacctaaagtgccgtcttaagatggacaaacttacactaaaaggcatgagctacgtgatgtgtacgggcagttttaagctcgagaaagaggtggcagaaacgcaacacggaaccgtgctcgtacaagtcaagtacgaagggacggatgcaccttgcaagatcccgctgtcaactcaggacgagaagggagtaactcaaaacggacgcctgataaccgcgaacccaatcgtgacagacaaagaaaagccggtcaacatagaaacagagcctccttttggagaaagctacatcatcgtcggggccggagaaaaggcgctcaaactcagctggttcaagaaagggagttctatcggaaaaatgttcgaggcaacagcgcgtggggcaagaagaatggccatcctaggagacacagcatgggacttcgggagcataggcggggtgttcaccagcgtaggaaagctagtccaccaggttttcggcactgcctatggcgtcctctttagcggcgtctcctggaccatgaaaatcggaatcgggatccttctaacctggcttggactgaatagccgaagcgcatctctcagtatgacgtgcatcgcggttggaatggtaaccttgtacctcggtgttatggtacaagcagacagtggctgcgtaattaattggaagggaagggagctcaagtgcggatcgggaatcttcgtgacaaatgaggtccacacctggaccgagcaatacaaattccaagctgacagccctaaacgactatctgctgcaataggcaaggcctgggaagagggagtctgcggcgtccgaagcgctacccggctggagaacatcatgtggaaacaaataagcaacgagctgaaccatatcctactcgaaaacgacatgaaattcactgtggtcgttggcgacgccaacggcatcttagcgcaggggaaaaagatgatccgaccccaacctatggagcacaaatactcctggaaatcttggggcaaggcaaaaataatcggcgcagacatacagaacacaacattcatcatagacgggccggacacacctgagtgccccgacgaccaacgagcatggaatatctgggaggtggaggactatggcttcggaatcttcactaccaacatatggttgaagctacgcgactcctacactcaaatgtgcgatcaccggctcatgtcggcagccataaaggacagcaaagctgtacatgcagacatggggtactggatcgagagcgaaaagaacgagacctggcgacttgcacgggcctcattcatagaagttaagacctgcatctggcccaaaagccatacattatggtcaaacggcgtcctagaatccgaaatgataatcccaaagatctacgggggacctatttcacagcacaactacagaccaggctatttcacacagactgccggtccgtggcacctaggaaagctagagctggattttgatctctgtgagggaaccacagtcgtcgtggacgagcactgcggtaatcgcggcccatctctacggactaccacagttacagggaaaatcatccatgagtggtgctgcagaagttgcacgctaccacccctacgcttcaggggcgaagacggatgctggtatgggatggagatacgcccagtaaaagaaaaagaagagaatctggtaaggagcatggtatcggcggggagcggcgaagtggactctttctcactaggcatactatgcttaagtataatgatagaggaagtcatgcgctcccgctggtcgcgcaaaatgctaatgactgggactctcgcagtatttttgctgttaatcatgggacaactgacatggaacgacttgataaggctgtgcatcatggtcggcgccaacgctagtgacaggatggggatgggaacaacctatcttgcgcttatggcaacctttaaaatgcgcccgatgttcgccgtcgggctcttgttcagacgtcttacgagccgggaagttctgttgttgacaattggtctgtccctagtcgcatcagtcgagctacccaacagcctagaagaacttggagacgggctggcaatgggtataatgatgctcaagctactgacagagttccaaccgcaccagttgtggacgacgctacttagcctgaccttcataaaaactaccctgtcactagactatgcatggaaaacgatggcaatggtcctcagtatcgtatcgcttttccccctctgcctttccaccaccagtcagaaaactacctggctgccggtgcttctaggtagttttggctgcaaaccgctaacaatgttcctcataaccgagaacaaaatctgggggaggaaatcatggccactcaacgagggtataatggcaataggaatagtcagcatactcctgtcaagcctcctgaagaacgacgtacccctagccggacccctcatagctgggggcatgctcatagcgtgctatgtgattagtggcagcagcgctgaccttagtctcgagaaagcagcagaggtaagctgggaagaagaggcagagcacagcggcacgtcacacaatatactggtcgaggtgcaagatgacggcacgatgaaaatcaaggacgaggaaagggatgacaccctgacgattctcctcaaggcgacgttgctcgctgtgtccggagtctaccccatgagtatcccagccacacttttcgtatggtacttctggcaaaagaagaaacagcgaagcggcgtattatgggacaccccgtccccaccagaagtggagcgcgctgtcctagacgacggcatataccgcatcctacagcgcgggctgttaggtcgctcgcaagtgggggttggagtctttcaagacggagtattccataccatgtggcatgtgacgcgaggggcagtactgatgtaccagggcaaaagattagagcccagctgggcgtcagtgaaaaaggacctaattagttacggaggtgggtggcggttccaaggcagctggaacaccggggaagaagtgcaggtcattgccgtagaaccaggcaaaaatcccaaaaacgtgcagaccacaccaggaaccttcaaaacgcccgaaggcgaagtcggggcagtcgcattagacttcaagcccggtacgagcggctctcccatcgtaaaccgagaaggaaagatcgtcggcttatacggcaatggagtagtcacgacaagtggaacatatgtaagtgcaatcgcacaggccaaagcgtcacaagagggaccactaccagagattgaggacgaggtgttcaagaaaaggaatctcacgataatggacctgcatccaggctctggcaaaacgcgccgttacctacccgcgatcgttcgagaagcgataaaaaggaaactgcgaacactaatcttagcgccgacccgagtggtggccagtgaaatggcagaagccctaaaaggaatgcctatacgataccagacaacagccgtaaagagcgagcacaccggacgcgagattgtagacttgatgtgccacgctacatttacgatgagactgctaagcccggtaagggtaccgaactacaacatgattattatggacgaggcgcactttacagatcccgcttccatagcggcgcgtggatatataagcacgcgcgtgggcatgggagaggccgctgcgatcttcatgacagccaccccaccgggtagtgtggaagcgttcccccaaagtaacgccgtaatccaggatgaggaaagagatatcccggagaggtcgtggtctagcgggtacgactggataacagacttcccaggtaagacggtctggttcgtcccctcaattaaaagcggcaatgacatcgccaactgccttaggaagaatggaaagcgtgttatccaactctcaagaaaaacattcgataccgagtaccagaaaacgaaaaataacgactgggactacgttgttactaccgatatcagcgaaatgggggccaacttccgcgccgacagagtgatagacccgcggaggtgtttaaagccggtgatactaaaagatggaccagagcgcgtcatcctagctgggccgatgccagtgacagttgcatctgcagcacagcgcagaggccgaatcggccgcaaccagaacaaagaaggagaccaatatgtgtatatggggcaacccctaaacaatgatgaagaccacgctcactggactgaggcgaagatgctgctggacaacatcaacacaccagagggaataatccccgccctattcgaacccgagcgcgaaaagagcgccgctatagacggagagtacagactgcgaggagaagcgcgcaaaactttcgtggaactaatgaaaagaggagacctacccgtatggctatcatacaaggtagcatccgagggctttcaatacagtgaccgccgatggtgcttcgacggagaacgtaataatcaagtgttagaggagaacatggacgtagaaatatggacgaaagaaggggaacgtaagaaactccgcccgcgctggctagatgcgagaacatacagtgaccccctcgctttgagagaatttaaagagttcgcagcgggccgccgctcagtgtctggggacctcattctcgaaataggcaaacttccacagcacctcacactacgggcgcagaacgcattagacaacctcgtgatgttgcataactccgagcagggcggcaaggcctaccgtcacgcaatggaggaactccccgatacaatcgagaccctaatgctgctggcactgatcgccgttctaacgggcggggtcatgctattcttcttaagcggcaagggtctcggcaagacatcgatcggcctcctatgcgtgatggccagttcagcccttctatggatggcatcggtcgaaccgcactggatagcggcaagcattatactcgagttcttcctgatggtgctacttatacctgaacccgatcggcaacggacccctcaggacaaccaactagcatacgtcgtcatagggcttctcttcatgatactaacagtggccgcaaacgaaatgggattgctagaaaccaccaaaaaggatctcgggataggtcatgtcgccgccgaaaaccaccaccacgtaacaatgctggacgtcgacctaagacctgcctccgcctggacgctatatgccgtagcgaccacagtaataacgcctatgatgcgacacacaatagaaaatacgacagccaacatcagcttaaccgcaatagcaaatcaggccgcgatccttatgggcttagacaaaggatggccgatatcaaaaatggacatcggcgtccccctcctcgccctcggctgctactcccaagtcaaccctctaaccctaacagccgccgtcctgatgctcgtggcacactatgcaatcataggcccaggcttgcaggcaaaagccaccagagaagcacagaaaaggacagcagcaggaatcatgaagaacccaaccgtagacggcatagtagcaatcgatctggacccagttgtttacgacgctaaattcgaaaagcagctagggcaaataatgctcttaatcttatgcacctcacaaatactgctcatgcgtacgacctgggcattgtgcgaaagtatcacgctcgccacaggacctctcaccaccctgtgggaaggctcccccgggaaattctggaacacaaccattgcagtcagcatggctaacatcttccgcgggagttacctcgcaggggcggggttagcgttcagcctgatgaaatccctgggcggcggtcgcagaggaaccggcgcccaaggcgaaacacttggtgagaaatggaagagacaattgaaccagctgagtaaatcagaatttaacacgtacaaacgaagcgggatcatggaagtcgacagatcggaagctaaggagggtctcaaaagaggcgagaccactaaacacgccgttagtcgcgggacagcaaaactacgttggttcgtagaacggaacctcgtaaaaccagagggaaaggttatcgacctggggtgcggtagaggaggctggagttactattgtgccgggctcaaaaaggttacagaggttaaaggctacaccaagggtggaccggggcatgaggagccaattccgatggccacctatggttggaacttagtgaagctgcattcaggaaaagacgtatttttcacaccaccagaaaagtgcgacacactcctttgcgacatcggggaatcgagtccaaatcctacgatagaggaagggcgaaccctacgagttctaaaaatggtggagccatggctaagggggaaccagttctgtataaaaatacttaacccttatatgccctcagtcgtcgagaccctagaacaaatgcaaagacgccacggcggcatgctagtacgaaatccgctcagcagaaattcgacccacgagatgtactgggtatcatgcgggaccggcaacattgtctcagcagtaaacatgacctcccggatgctgctcaacagattcactatggcccaccgaaaaccaacatacgagcgcgatgtggacctaggagccggcacgagacacgtcgcggtggaacccgaggtagccaacctgggcataataggacaaagaatcgaaaacataaagaacgaacacaaaagtacgtggcactatgacgaagacaacccctacaaaacctgggcatatcacggatcctacgaagtcaaaccatccggatccgcaagctctatggtgaacggagtagtacgattactcacaaagccctgggacgttatccccatggtaacacaaatagccatgacggacacaacaccatttggacaacaaagagtgttcaaggagaaggttgacacgagaactccccgagcgaaaagggggaccgcccagatcatggaagtcacggccaaatggttatgggacttcttgtcacggaataagaaaccccgaatatgcacgcgagaggaatttatcaggaaggtgagaagcaacgcagccattggggcagtcttcgtagacgaaaaccaatggaacagcgcaaaggaggcggttgaagatgagcgattctgggacctcgtgcacagggaacgcgaactccacaaacaaggcaagtgcgcgacgtgcgtatacaacatgatgggtaaacgagagaagaaactcggtgagttcggtaaagccaaaggctcaagggcaatctggtacatgtggctaggagcgagattcctcgagttcgaggccctaggattcatgaacgaggaccattggtttagtagggaaaattcgctctctggagtcgagggagaagggttgcacaaactagggtacatactcagagatataagcaaaatccccggaggaaacatgtatgcggacgacacggccggttgggacacacgcataacagaggatgacttacagaacgaagcaaagatcacggatatcatggagcccgaacatgctctactcgcgaccagcatcttcaaactgacctatcagaacaaggtcgtgcgtgtacagagaccggccaaaaatggcactgttatggatgtcatttcgagaagagaccaaagagggtccgggcaagtcggtacatacgggctgaatacctttaccaacatggaagtccaactaatccgacaaatggagtcagaaggtatcttcctcccgtccgaactcgaaacaaccaaccttgcggagcgggtactagactggctggagaagcacggagtcgaacggttaaaacggatggcaatcagtggggacgactgcgtggtgaaaccgatagacgaccgattcgccacggccctcatcgcattgaacgatatgggcaaggtcaggaaggatatcccacagtgggaaccatcaaaaggctggaacgactggcaacaagtgccgttctgttcacatcatttccatcaattgatcatgaaagatggacgcgaaatcgtcgtgccctgcaggaatcaggacgagcttgtcggcagagcaagagtttcccagggagcaggctggagcctgagggagacagcatgcctcgggaagagttacgctcaaatgtggcagctgatgtatttccataggcgggatttgcgcttagcagccaacgctatctgtagcgcggtcccggtagactgggtaccgacatcccgtaccacctggagtatacatgcgcaccaccaatggatgacaactgaagacatgttaagcgtatggaaccgcgtgtggattgaggagaacccatggatggaagacaaaactcacgtaagttcgtgggaagaggtaccgtacttaggcaagcgagaagaccaatggtgcggatcactcatagggcttaccgcccgcgcaacctgggcaaccaacatccaagtagccatcaatcaagtgcgccggttaataggaaacgaaaactacttggattatatgacctcgatgaaaaggttcaaaaacgagtccgacccagagggcgcactgtggtag

SEQ ID NO: 24013 - RNA, 9879 nt, synthetic construct
  misc_feature 1..9879: note = derived and/or modified CDS sequence (opt11) from DENV-1__FJ205875__SS-prME
  source 1..9879: mol_type = other RNA
agtgtgacaatgctgttgatgctgctgcccacagctctcgcctttcacctcaccacgcgtggcggggagccccacatgattgtgagcaagcaggagcggggtaagagcctcttgtttaagaccagcgccgggatcaacatgtgcacactgatcgccatggacctaggggagctctgcgaggacaccatgacctacaagtgcccccggataaccgaagccgaacccgacgacgtggactgctggtgcaacgccaccgacacctgggtgacctacgggacctgtagccagaccggcgagcaccggcgcgacaagcggtccgttgccttagctccccacgtgggactgggtctcgagacccggaccgagacctggatgagcagcgagggcgcctggaagcagatccagaaggtggaaacgtgggctctgcggcaccctggattcacggtgatcgccctgttcttagcgcacgccattggcacctcgatcacccagaaggggatcatcttcatcttgctgatgcttgtgaccccctccatggcaatgcgctgcgttgggatcggcaaccgggacttcgtcgaggggctgagcggagccacgtgggtagacgtggtcctggagcacgggtcctgcgtgacaactatggccaaggacaagcccacactcgacatcgagctactgaagacggaggtgactaatcccgcgattctgcgcaagctgtgtatcgaagccaagatcagtaacaccaccacggactctcggtgcccgacccaaggcgaagcgaccctggtcgaggagcaggacgccaacttcgtgtgccgccggacttttgtggatcgcggctgggggaacggctgcggcctattcggcaaagggagcctgctgacgtgtgccaagttcaagtgcgtcacaaaactagaaggcaagatcgtccagtacgagaacttgaagtactccgtcatcgtcaccgtgcatacgggggaccagcaccaggtcgggaacgagacgacggagcacggcactatcgccacaatcacgccccaagcccccaccagcgagatccaactgaccgactatggggccctcaccctggattgctctcctcggaccggcctagactttaacgagatggtcctcctgacgatgaaggagaagtcttggctggtccacaagcaatggtttctggacctccccctgccctggacgtccggggcctcaaccagccaggagacttggaaccgtcaggacctcctcgtcactttcaagaccgcccacgcgaaaaagcaggaggtcgtggtgctggggtcccaagagggcgctatgcataccgcgctcactggggccacggagatccagaccagcggcacaaccacgattttcgcggggcacctcaagtgccggctaaagatggacaaactcacactgaagggcatgtcctacgtgatgtgcaccgggagcttcaaattagagaaggaggtggcggaaacccagcacggcacggtgctggtccaggtgaagtacgaaggcaccgacgccccctgcaagatccccttctccacccaggacgagaagggtgtcactcagaacggccgcctcatcacggccaacccgatcgtgactgacaaggagaagcccgtgaacatcgagacagagccgcccttcggcgagagctacatcgtcgtgggcgccggtgaaaaggcgctgaaactttcatggttcaagaaggggagctccatagggaaaatgttcgaggctaccgccagaggggcacgtcggatggctatcctcggagacacggcgtgggactttgggagcatcggaggcgtattcacgtccgtcgggaagttagttcaccaggtgttcggcaccgcctacggtgtcctgttcagcggcgtgtcctggacgatgaagatcgggatcggcatactgctgacgtggttaggcctcaacagccgctccacgagcttatccatgacctgcatcgcagtggggatggtcaccctatacctgggtgtgatggtccaggccgacagcgggtgtgtcatcaactggaagggccgagagctcaagtgtgggtccggcattttcgtgacgaacgaggtgcacacttggaccgagcagtacaagttccaggctgatagcccgaaaaggctaagtgcggcaatagggaaggcctgggaggagggggtctgcgggatacggtccgccacccggctcgagaacatcatgtggaaacagatcagcaacgagctgaatcacatcctgttagagaacgacatgaagttcaccgtggtggtcggagacgccaacggcatcttggcgcaggggaagaaaatgatccgcccccagccaatggagcacaagtactcctggaagtcctggggcaaggcaaagatcatcggcgcggacatccagaacacgaccttcatcatcgacgggcccgacacaccggagtgccccgatgaccagcgggcctggaacatttgggaggtggaggactacggcttcggtatcttcaccacgaacatttggctgaagctccgggactcctacacccagatgtgcgatcaccgactgatgtccgcagccatcaaggactcgaaggcggttcacgcagacatgggctactggatcgaatctgagaagaacgaaacctggaagctggcccgcgcgtcattcatcgaagtcaaaacttgcatctggcccaagagccacacgctctggtccaacggcgtgttagagagcgaaatgataatccccaagatctacgggggccccatatcccagcacaactaccggcccgggtacttcacccagaccgcaggcccctggcacctagggaagctggagctggatttcgacctgtgcgagggcaccacggtggtagtggacgagcactgtggtaatcgcgggccgagcctccggacgactaccgtgacgggcaagattatacacgagtggtgttgtcgctcctgcaccctgccgcccctgcgtttccgcggggaggacggctgttggtatgggatggagatccggcccgtcaaagagaaggaggagaacttagtgcgcagcatggtgtcagcaggcagcggcgaagtcgactctttttcgctggggatcctgtgcgtgagcatcatgatcgaggaggtgatgcgttcccgctggtccaagaaaatgctcatgactggcaccctggccgtcttcttactcctgatcatggggcagttgacgtggaacgacctcatccggctgtgcataatggtgggcgccaacgcgtccgaccgcatggggatgggtaccacctacctggcactcatggccaccttcaagatgcggccgatgttcgccgtggggctgctattccggcgcctcacgagccgggaagtactgctgctcacaatcggtctgtccctggtggctagcgtggagctcccaaattccttagaggagttgggcgacggtctcgcgatgggcatcatgatgctgaagttactcaccgagttccagccccaccagctgtggacgacgctactctccctgaccttcatcaagaccaccctttccttagactacgcctggcgcacgatggcgatggtcctctcaatcgtatccctgttcccactgtgcctgtcaaccacctcccagaagacaacgtggctgccggtcctcttaggcagcttcgggtgcaagcccctgaccatgttcctcatcaccgagaacaaaatttggggccggaagtcgtggccactgaacgaagggattatggccatcggcatagtaagcatactcctctcatcgttactgaagaatgacgtacccctcgctggtccactgattgccggcggcatgctaattgcctgctacgtgattagcgggtccagcgccgacctcagtttggagaaggccgcggaggtgagctgggaagaggaggccgagcactcaggcacctctcataacattctggtggaggtccaggacgacgggacgatgaaaatcaaggacgaggagcgcgacgacacactcacaattctgctgaaagccacactcctggcagtatccggagtgtaccctatgagcatcccagccacactcttcgtctggtacttctggcagaagaagaagcagagatccggggtgctctgggacacgcccagcccacccgaggtggagcgcgcggtcctggacgatggcatctaccggatccttcagcgcggcctcctcgggagatctcaagtgggcgtaggggtctttcaggacggcgtgttccacaccatgtggcacgtcacccgcggggccgtactgatgtatcagggcaagcggcttgagcccagctgggctagtgtgaagaaggatctcatcagctacggcgggggctggaggtttcaggggtcctggagcacaggcgaggaggttcaggttatcgcagtggagcccgggaagaacccgaagaacgtgcagacgacccccggaactttcaagacacccgaaggcgaagtcggggcgatcgcgctagactttaaaccgggcacatccgggtcgccaatcgtgaaccgggagggcaagatcgtgggcctgtacgggaatggcgttgtgaccacctccgggacctacgtgagcgccattgcacaggccaagaccagccaggagggcccgctcccggagatcgaggacgaggtcttcaaaaagcgcaacctgaccataatggacttacacccgggatccggcaagacgcggcgctacctccccgccattgtgcgggaggccatcaagcgcaaattgcgcaccctaatcctcgcccccactcgcgtggtcgccagtgagatggccgaggctcttaagggcatgcccatccgctaccagacaaccgccgtgaagtcggagcacaccgggcgggaaatcgtggaccttatgtgccacgccacgttcacaatgcggttactgagcccagtccgggtgcccaattacaacatgatcatcatggacgaggcccacttcaccgacccggcctccatcgctgcccgcggctacatctcgacccgggtcgggatgggagaggccgccgccatattcatgacggcgacgccgcccgggtccgtcgaggccttcccccagagcaacgccgtgatccaggacgaggaacgcgacatccccgaacgaagctggaacagcggctacgattggattaccgattttcccggaaagaccgtgtggttcgtgccttccatcaaatcagggaacgacattgccaactgtctgagaaagaatggcaagcgggtgatccagttatcccgtaaaacgttcgacaccgaataccaaaagacgaagaacaacgactgggactacgtggtcaccacggacatctctgaaatgggggcaaatttccgggccgaccgcgtgatcgaccccaggcgctgcctcaagcccgtgatactaaaggacggccccgagcgggtcatcttggccgggccgatgcccgtgaccgtggcatcagccgcacagcgaaggggccgcattggccggaatcagaataaagagggggaccagtacgtctatatgggccagcccctgaacaacgacgaagaccacgcccactggaccgaggccaagatgttactcgacaacatcaacacacccgaggggatcatccccgctctgtttgagccagagcgcgaaaagagtgccgcaatcgacggcgagtaccgcctgagaggggaggcccgaaaaacgttcgtagagctcatgcggcgcggcgatctacccgtctggctgtcctacaaagttgcctcggagggtttccagtactccgatcggcgctggtgcttcgatggggagcggaacaaccaggtgcttgaggagaatatggacgtcgaaatctggaccaaggagggggagcgcaagaagctgcgcccccgctggctggacgcccggacctacagtgacccgctcgcactgcgcgagttcaaggagttcgctgccggccggcgctcggtatccggcgacctaatcctcgagatcggcaaactgccccagcaccttaccctccgtgcccagaacgcgctggacaacctcgttatgctccacaactcagagcagggcgggaaagcctaccgccatgcgatggaggaactgcctgataccattgaaacgctgatgctcttagcgcttatcgccgttctcacagggggcgttaccctattctttttgtccgggaaggggctcggtaagaccagcattggattactgtgcgtcatggcttcgtctgcgctcctttggatggcgaacgtcgaaccccactggatcgcagcctctatcatcctggagttctttctaatggtgctgctgattccggagccggatcggcagcgcacgccccaggacaaccagctggcgtatgtggtgatcggcctgctgttcatgatcttaaccgtggcggccaacgagatggggctgctggagaccaccaagaaggacttaggcatcgggcatgtagcagccgagaatcaccaccacgccacgatgctggacgtcgacctgagaccggccagcgcctggaccttgtacgccgtggcgaccacggttatcacgcccatgatgcgccacaccatcgaaaataccaccgccaacatctccctaacagcgatcgccaaccaggccgctatcctgatgggactcgacaagggctggcccatctctaagatggacattggggtgcccctgctggccttgggctgctactcacaggtgaatcctttgaccctgaccgcggctgtgctcatgctggtcgcccactacgccatcatcgggcccggcctgcaggcaaaggccacccgtgaagcccagaaacgcactgccgccgggataatgaaaaatcccaccgtggacggcatcgtggctatcgatctggaccccgtcgtgtacgacgcgaagttcgaaaagcagctgggacagatcatgctgctcatcctatgcacctctcaaatcctgctcatgcgtaccacttgggcattgtgcgagagtattaccctggccaccgggccactcaccacgctatgggagggcagccccggaaagttctggaatactaccatcgccgtgtcaatggcgaacatctttcggggcagctacctggccggcgccgggttagccttctccctgatgaaaagcctgggcgggggccgacgggggaccggtgcccagggtgagacgttgggtgagaagtggaaacgccagctgaaccagctgagtaaaagcgagtttaacacctacaagcgaagcggcatcatggaggtcgaccgctccgaggcgaaagagggactcaagagaggggaaaccaccaaacatgcggtgagcagaggcacggcgaagctgcggtggctggtagagcgcaatctggtcaagcccgaaggcaaggttatcgacctcggctgcggccgtggcgggtggtcctactactgtgccggcctgaagaaggtgaccgaggttaaggggtataccaagggaggccccgggcacgaggaaccgatccccatggccacctacggatggaacctagtgaagctctactcagggaaggatgtgttcttcacgccgcccgagaagtgcgacacactgctgtgcgacataggcgaatcctcacctaatccaaccattgaagaagggcgcaccttgcgggtccttaaaatggtggagccctggcttcgcggcaaccaattctgcatcaagatcctcaacccctatatgccgtccgtggtcgagaccctggaacagatgcaacggaagcacggcgggatgctggtacgcaaccctctcagccggaacagcacgcacgaaatgtactgggtgtcttgcggtacaggtaatatcgtctccgccgttaatatgaccagccgtatgctgctaaaccggttcacaatggtgcaccgcaagcccacgtacgagcgcgacgtcgacctcggggcgggaacccggcacgtggccgtggaacccgaggtcgccaatctggacatcatcggacagcgcatagagaacattaagaacgagcacaagtccacgtggcactatgacgaggacaacccttacaaaacgtgggcgtaccatggcagctacgaggtgaagccctccgggtcagcctccagcatggtaaatggagtcgtgcgtctgctcactaagccctgggacgtcatcccaatggttactcagatcgccatgaccgacaccacgccattcgggcagcagcgcgtcttcaaggagaaggttgacacccggacgccccgggccaaacggggcacggcccagatcatggaagtaacggctaagtggctgtggggcttcctgtcccgcaacaagaagccccggatatgtacgcgcgaggagttcacgcggaaggtgcgaagtaacgcggccatcggtgccgtcttcgtagacgagaaccagtggaacagcgccaaagaggcggttgaggacgagcggttctgggacctcgtccaccgcgagcgggagctgcacaaacagggcaaatgcgcaacctgcgtgtataacatgatgggaaaacgcgagaagaaactgggcgagttcggcaaggccaaaggttcccgggcgatctggtatatgtggcttggcgcgcgcttcctggagttcgaagccctggggttcatgaacgaggaccactggttcagccgggaaaattccttctcgggggtagagggagacggcttacacaagctgggttacatcttgcgcgacatctccaagatcccgggcggcaacatgtacgctgacgacacggccgggtgggatacgcggatcacggaagatgatcttcagaacgaggcgaagatcacagacataatggagcccgagcacgcgctgcttgccacgtcaatcttcaaactcacataccagaacaaggtcgtcagagttcagcgacctgctaagaacggcacggtcatggatgtgatctcccggcgtgaccaaagagggagcggccaggtgggcacctacgggttaaatactttcactaacatggaagcccaactgattaggcaaatggagtccgaaggcatattcctccccagcgagctggaaactcctaacctggccgagcgggtattagactggctggagaagcacgggaccgagcgcctgaagcggatggcgatctccggcgacgattgcgtcgtgaagcccgtggatgaccgcttcgccacggccctcaccgcgctgaacgacatggggaaagttcggaaggacattccccaatgggaacccagtaagggctggaacgactggcaacaggtgccgttctgctcgcaccactttcaccagctcatcatgaaggacggccgcgagattgtcgtgccctgccggaaccaggacgagctcgtggggagagcgcgggtcagccagggggcggggtggtctctgcgcgagaccgcctgcttgggcaagagttacgcccaaatgtggcagctcatgtatttccaccggcgcgaccttcggctagctgccaacgcgatctgctcagcagtgcccgtcgactgggtgcccaccagccgcaccacgtggagcatccacgcccatcaccagtggatgacaacagaggacatgctctccgtatggaaccgggtgtggatcgaggaaaatccgtggatggaggacaagacgcacgtcagctcctgggaggaggtgccgtatctggggaaaagagaggatcagtggtgcggtagcctgatcggcctcacggcccgcgcgacctgggccaccaacattcaggtagcgatcaaccaagtccggcgcctgatcgggaacgagaactacctggactacatgacctccatgaagcgcttcaagaacgaaagcgaccccgaaggtgccctttggtga

SEQ ID NO: 24014 - RNA, 9879 nt, synthetic construct
  misc_feature 1..9879: note = derived and/or modified CDS sequence (opt11) from DENV-1__FJ410173__SS-prME
  source 1..9879: mol_type = other RNA
tctgtaaccatgctgctcatgctacttcccacagccctcgccttccacctgacgacccggggtggggaaccccatatgatcgtcagcaagcaagagcggggcaagagcctcctgtttaagaccagcgcagggatcaacatgtgcacgctgatcgcaatggacctgggggagctctgcgaggacaccatgacctacaagtgcccccggatcacagaggcggagccagacgacgtggactgctggtgcaacgccaccgacacgtgggtcacctacgggacctgcagccagaccggcgagcaccggcgggacaagcggtccgtcgccctggcgccccacgtgggcctggggctcgagacgcgcaccgaaacgtggatgtcaagtgagggcgcctggaaacagatccagaaggtggagacctgggccttacggcaccccgggttcacggtcaccgccctgttcttggcgcacgccataggcacctccatcacccagaaagggataatcttcatcctgctgatgctcgtgacgccatccatggccatgcgctgcgttggtatcgggaaccgggattttgtcgaggggctgagcggtgccacctgggttgacgtggtcctggagcacggtagttgcgtgacgaccatggcaaaggacaaacccacgttggacatcgagttattaaaaactgaggtgaccaacccggcggtcctccgcaagctgtgcatcgaggccaaaatcagcaacaccacaactgacagtcggtgccccacacagggcgaggccaccctggtggaggagcaggactcaaacttcgtgtgccgccggactttcgtcgaccgtggctgggggaacggctgcggcctcttcggcaaggggtccctactgacctgcgctaaattcaagtgcgtgaccaagctcgagggcaagatcgtgcagtacgagaacctgaagtattcagtcatagtgactgtgcacactggcgaccagcaccaagtcgggaatgagactaccgaacacggcactatcgccaccatcacgccccaggcgcccaccaccgagatccagctgaccgactacggggccctcactctggattgcagcccacggaccggcctggactttaatgagatggtgctcttgaccatgaaagagaagtcttggctggtccacaagcaatggtttctcgacctgccgctgccctggacctccggggcctccacgagccaggagacctggaaccgccaggacctcctggtgaccttcaagacggcgcacgccaagaagcaggaggtggtcgtgttgggctcccaggagggcgcaatgcacacggcgttgaccggggccaccgagatccaaaccagcgggacgaccaccatcttcgccgggcacctgaagtgtcggctgaagatggacaagctcaccctgaagggaatgtcctatgtgatgtgcacggggagctttaagctggagaaggaggtcgccgagacgcagcacggaaccgtgctggtgcaggtaaagtacgagggcaccgacgcgccgtgcaaaatacccttctccgcccaggacgagaagggggtgacgcagaacggccgcctaatcaccgccaatccgatcgtgaccgacaaagaaaagcccgtcaacatcgagacggaaccgcccttcggcgagagctacattgttgtgggcgccggcgaaaaagccctgaagctgtcctggttcaagaaggggagctcgattggcaagatgttcgaggccacggcccggggggcccgccgcatggccatcctcggcgatacagcgtgggactttgggagcatcggcggggtcttcacctcggtggggaagctcgttcaccaggtcttcggcgccgcctacggggtgctattcagcggcgtgtcgtggacaatgaagatcgggatcggaatcttacttacgtggcttggcctcaacagccgttccaccagcctgtccatgacctgtatcgccgtcgggatggtgacgctgtacctcggcgttatggtccaggccgacagcgggtgcgtgatcaactggaaggggcgtgagctgaagtgcgggtccggcatcttcgtgacgaacgaggtccacacgtggacagagcagtacaaatttcaggcggacagtccgaagcggctgagcgccgccattggcaaggcctgggaggagggtgtgtgtggcatccgcagcgccacgcggctcgagaatatcatgtggaagcagatctcaaacgagctgaaccacatcctgctcgaaaacgacatgaagtttaccgtggttgtgggagacgcgaacgggatcctggcgcagggcaagaagatgattcgcccccagcccatggaacaccggtacagctggaagtcctggggcaaggccaaaatcatcggcgccgacatccagaacagtacattcatcattgacgggcccgacaccccggagtgccccgacgaccagcgtgcatggaacatctgggaagtggaggactacggcttcggaatctttaccactaacatctggctgaagctccgggactcgtacacgcaaatgtgcgaccatcgcctgatgagtgccgccatcaaggacagcaaggccgtccatgcagacatgggctactggatcgagagcgagaaaaacgagacctggaagctggcgcgggccagcttcatcgaagtgaaaacctgcatctggcccaagtcccacacgctctggagcaacggcgttctagagtccgagatgatcatccccaagatctacggtggcccaattagccagcacaactacagacccgggtacttcacgcagaccgcaggcccctggcacctggggaagctcgagctggactttgacctgtgcgagggcaccaccgtcgtggtcgacgagcattgcggcaaccgggggccgtcgctccgcacaaccaccgtcaccggcaagatcatacatgagtggtgctgccggagctgcacgctgccccccctgcgtttccgcggggaggacggctgctggtacgggatggagatccgccctgtgaaggaaaaggaggaaaacctcgtgcggtccatggtcagcgccggcagcggcgaggtggactccttcagcctggggatcctgtgcgtgtccatcatgatcgaggaggtaatgcgcagccggtggtcacggaagatgctcatgaccggcactctggccgtgttcctgttgctgatcatggggcagctgacctggaacgacctcatccgcctgtgcatcatggtgggcgcgaatgccagcgatcggatggggatgggcacgacctacctggcactcatggcgaccttcaagatgcgcccgatgttcgccgtcgggttactgttccggcgcctcacctcccgggaggtgctgttgctcacgatcgggttaagcctggtggcgtcagtcgagttgcccaacagcctggaagaactgggcgacgggctggccatgggcatcatgatgctgaagcttctcaccgagtttcagccgcaccagctgtggaccaccctgctctcccttacgttcataaagaccacactgagcctcgattacgcctggcggacaatggccatggtgttgtccatcgtatcactgttccccctctgcctgtcgaccacgtcacaaaagacgacgtggctgccggtgctcctgggctccttcgggtgcaaaccgttaacaatgttcctcattacggagaacaaaatctggggccgcaagagctggcccttaaacgaggggatcatggctatcggcatcgtgagtatcctgctcagcagcctgctgaagaacgatgtccccctcgccggaccgcttatcgcaggcggcatgctgatcgcctgctatgtgatctccgggtccagcgccgacctttcgctggagaaggcagccgaggtatcctgggaggaagaggccgagcattcaggcacctcccataacatcctggtggaggtgcaggatgacgggactatgaagataaaggacgaggagcgcgacgacaccctcacgatcctgctgaaggccactctgctggcggtaagcggcgtctaccccatgtcgatcccggcgacctttttcgtgtggtacttctggcagaaaaagaaacagcggtctggggtgctgtgggacaccccctccccgcccgaggtcgagcgcgcggtgctcgatgacggtatctacagaatactccagcgcgggctgctcgggcgtagccaggtgggcgtcggggttttccaggacggggtgttccacacgatgtggcacgtcactcgcggtgcagtgctaatgtatcagggcaagagactggagcccagctgggccagcgtgaagaaagacctgatttcctacggaggaggctggcgcttccaggggagttggaacaccggcgaggaggtccaggtgatcgccgtggagcccgggaagaaccctaaaaacgtacagacgacgcccggcaccttcaagacccccgagggagaggtgggggcgatagccttggacttcaagcccggcacctccgggagtccgatagtgaaccgcgaaggaaaaatcgtcggcctgtacgggaacggcgtggtgacgacctccggaacatatgtcagcgccatcgcccaggccaagaccagccaggagggccccctgcccgagatcgaggaggaggtgttcaagaaacgaaatctcacaatcatggacctgcacccggggtccggcaagacccggcgctacctgccagcgatcgtgcgggaggccataaaacgcaagctccgcaccttaatcctggcacccacccgggtcgtggccagcgagatggccgaggccctcaagggcatgcccatccggtaccagacgacagccgtgaagagcgagcacaccgggcgagagatcgtagacctgatgtgccatgccaccttcacgatgaggctgctcagcccggtgcgggttcccaactacaacatgattatcatggatgaggcccactttactgaccctgcgtccatcgccgcccgcggctacatcagcacccgggtcggcatgggcgaggctgcggcgatcttcatgaccgctacgcccccgggatccgtagaggccttcccacagagcaacgccgtgatccaggacgaggagcgcgacatacccgagcggagttggaacagcggctacgactggatcacggacttccccggcaagactgtctggttcgtgccgtccatcaagtcgggaaacgatattgcaaactgcttacgcaagaacggcaagagggtgatacagctgagccgcaagaccttcgacactgagtaccagaagacccggaacaacgactgggactacgtcgtaaccaccgacatctcagagatgggggcgaactttcgcgccgaccgggtgattgacccccggcggtgcctcaagcccgttatcctgaaggacggccccgagcgcgtcatcctggctgggccgatgcccgtgacggtcgcctccgcggcccagcggcgcggccgcatcggccggaaccagaacaaggagggcgaccagtacgtatacatgggccagcccctcaacaacgacgaggaccacgcccactggaccgaggccaaaatgctgttagacaacatcaatacccccgagggcatcatcccggcactgttcgagcccgagcgcgagaagtccgcggcgatagacggcgagtaccggcttaggggggaggcccggaagacattcgtcgagctgatgcgcagaggtgacttaccggtgtggctgtcctacaaggtggccagcgaggggtttcagtactccgatcgccgttggtgcttcgacggggagcgcaacaaccaggtcttagaagagaatatggacgtggagatttggacgaaggagggcgagcggaagaagctccgcccccggtggctagacgcccgcacctactcggacccgctggcgctccgggagttcaaggagttcgccgccggtcgccggtcagtgtcgggagacctgattctggagattggcaagctcccccagcatctgaccctgcgcgcccaaaacgccctggacaacctggtaatgctgcacaacagtgagcagggaggcaaggcgtaccgccacgcgatggaggagctccccgacaccatcgagaccctgatgctgctcgccctgatcgccgtcctgaccgggggggtgaccctcttcttcctgtcgggtaaggggcttggcaagacgagtatcgggctcctgtgtgtcatggcgagttctgccctgctttggatggccaacgtggaaccccactggatcgccgcctccatcatcctggagttcttcctgatggtgctcctgatcccggagcccgaccgccagcggacgcctcaggacaaccagcttgcctacgtggtgataggcctgctgttcatgatcctgacggtggccgccaacgagatgggcctcctggaaaccaccaagaaagatctgggcatcggccatgtagccgcggagaaccagcatcacgcgaccatgctcgacgtggacctgcgcccggccagcgcctggacgttatatgccgttgccaccaccgtcataacccctatgatgcgccacaccatcgagaacaccaccgctaatatcagcctcaccgccatcgccaaccaggccgccatcctgatgggcctggacaagggatggcctatcagcaagatggacatcggggtgccactcctcgctctgggctgctactcccaggttaacccgctcacgctgaccgcagccgtcctaatgttagtggcccactacgcgattatcgggcctggccttcaggccaaggccacccgggaggctcagaagcgcactgccgcggggataatgaagaaccccacggtggacggcatcgtagccatcgacctggatcccgtggtttatgacgccaagttcgagaagcagctcggccagatcatgctgctgatcctctgcaccagtcagatattactgatgaggaccacatgggcactctgtgagtccatcacgctggccaccgggccgttaaccaccctctgggaggggagcccagggaagttctggaacacgactattgcggtctccatggccaacattttccgcggcagctacctggccggcgccgggctggccttctccctcatgaaaagtctgggcgggggacggcgcgggaccggcgctcaaggcgagaccctgggggagaagtggaagcggcaattgaaccagctgtccaaaagcgagttcaacacgtacaagcgcagcggcatcatggaggtggatcggtccgaggccaaggaggggctaaagcgcggcgagaccactaagcacgccgtgagccgggggaccgccaagctccgctggttcgtagagcggaacttggtgaagccagaaggaaaggtgatagatctgggctgcgggcgaggcggctggagctactactgcgcgggcttaaagaaggtcaccgaggtgaaggggtataccaaaggcggcccgggtcacgaggagccgatcccaatggccacctacggctggaacctcgtgaagttatactctgggaaagacgtctttttcactccgcccgaaaagtgcgatacactgctgtgcgacatcggcgagtccagccctaaccccaccatagaagaggggcggaccctgcgcgtgttaaagatggtagagccctggctcaggggaaaccaattctgcatcaagatcctgaatccctatatgccttcagttgtggagaccctggagcagatgcaacgcaaacatggtgggatgctcgtgcggaaccccctgagccgcaactccacccacgagatgtactgggtgagctgcggcaccgggaacatcgtgtccgccgtgaacatgaccagtcgcatgctgctaaaccggtttaccatgacccaccgcaagcccacttacgagcgggacgtggacctgggcgccggcacccgccacgtggcggttgagccagaggtcgccaatctagacatcattgggcagcggatcgagaacatcaagaatgaacacaagtccacctggcactacgacgaggacaacccatataagacctgggcctaccacggcagctatgaggtgaagccctccgggtcggcctcaagcatggtgaacggtgtcgtgcgcctccttacgaagccctgggacgtcatccccatggtgacccagatcgccatgaccgacaccacgccgtttgggcagcagcgagtgttcaaggagaaggtcgacacccgcacgccgcgtgccaagcgtggaaccgctcagatcatggaagtgacggccaaatggctctggggcttcctctcccggaacaaaaagccccgtatctgcacccgggaggagttcaccaggaaggtgcggagtaacgctgccatcggggccgtcttcgtggacgagaaccagtggaatagcgcaaaagaggccgtggaggacgagcgcttctgggacctggtccacagagagcgtgagctgcacaagcagggcaagtgcgcgacctgcgtgtacaacatgatggggaagcgggagaagaagctcggcgagttcgggaaagccaagggctcccgcgcgatatggtatatgtggctgggcgcccggttcctggagttcgaggcccttgggttcatgaacgaggaccactggttcagccgcgagaattcctttagcggggtggagggggagggtctccacaaactggggtacatcttgcgcgacatatccaagatcccaggcggcaatatgtacgccgacgacacagccgggtgggacacccggatcacagaggacgatctgcaaaacgaggccaagatcacggacatcatggagccggagcacgccctgctggccacgagcatatttaagctgacctaccagaacaaggtcgtgcgggtgcagcggcccgccaagaacggaaccgttatggacgtgatttcccgcagggatcagcgcgggagcggccaggtggggacctacgggctgaacacgttcactaacatggaggtccagctcatccggcagatggagtccgagggcatcttcttaccctcagagctggagaccccgaacctcgccgagcgtgtgctgaattggctggagaaacacgggaccgagcggctcaagagaatggcgatctccggcgacgactgcgtggtcaagcccgtggacgaccggttcgccactgccctaatcgcgctgaacgacatggggaaggtgcgcaaggacatcccccagtgggagcccagcaagggctggaacgactggcaacaagttccgttctgctcccaccacttccaccagctcataatgaaagacggccgtgagatcgtggtgccctgccgcaaccaagatgaactggtcgggagagcccgggtgagccagggtgcagggtggtccctgcgggagacagcctgtctcggcaagagctacgcacaaatgtggcagctgatgtacttccaccgccgggatttaaggctcgccgccaacgcgatttgctccgccgtccccgtcgactgggtgcccaccagccgcacaacgtggagcatccacgcccaccaccagtggatgacgacagaggacatgctgtccgtgtggaaccgggtctggatcgaggagaacccgtggatggaggacaagacgcacgtgagcagctgggaggaggtgccctacctggggaagcgcgaggaccagtggtgcggcagcctcataggcctaacggcccgggcgacgtgggctaccaatatccaggtcgcgattaaccaggtacgccggctgatcggcaacgagaactacctcgattacatgacctctatgaagcgcttcaagaacgagtcagaccccgaaggggccctgtggtga

SEQ ID NO: 24015 - RNA, 9879 nt, synthetic construct
  misc_feature 1..9879: note = derived and/or modified CDS sequence (opt11) from DENV-1__FJ410174__SS-prME
  source 1..9879: mol_type = other RNA
agcgtgacaatgctgctcatgctgctgccgaccgcgctcgcttttcacctgaccacacgcggcggagagccgcatatgatcgtctcgaagcaagaaagggggaagtcactgctattcaagaccagcgccgggatcaacatgtgcaccctgatcgccatggacttaggcgagttgtgtgaggacaccatgacctacaaatgccccaggatcacagaagccgagcccgacgacgtggactgctggtgtaatgccaccgacacttgggttacgtacgggacgtgctcacaaaccggagagcaccgacgggacaagcggtccgtggccctggcgccccatgtgggcctggggctcgagacccggactgagacctggatgagctccgagggtgcctggaagcagatacagaaggtcgagacctgggccttacggcacccggggtttaccgtcacagccctgtttctcgcgcacgccattggcacctcaatcacgcagaagggaatcatcttcattctgctgatgctggttacgccctcaatggcgatgcggtgcgtgggcatcggcaaccgggacttcgttgaggggttatcaggcgccacgtgggtggatgtggtattagagcacggatcttgcgtgaccactatcgctaaggacaagcccacccttgacattgagctactgaagaccgaggtgactaaccccgcggtgctccgaaagctctgcatcgaggccaagattagcaacacaacgaccgacagtcgatgtcccacccaaggtgaggctaccctggtggaggagcaggacagcaactttgtgtgtcgccggacgttcgtcgaccgcggctgggggaatggctgcggcctgtttggcaaggggtcgctcctgacctgcgcaaagtttaagtgcgtgacaaagctcgagggtaagatcgtgcagtatgagaacttgaagtacagcgtcatagtaaccgtgcacacgggagaccagcaccaggtcggcaacgagacaactgaacacggcactatcgccaccatcaccccccaagcccccacgagtgagatccagctgacagactacggggcactcacgcttgactgcagcccgcggacgggcctggactttaacgagatggtgctcctaaccatgaaggaaaagtcctggctggtccacaagcagtggttcctcgacctgccactgccatggaccagcggggccagcacatcacaggaaacctggaaccgccaggaccttctggtgactttcaagacagcccacgcgaaaaagcaagaggtggtcgttctgggctcccaagagggggcaatgcacacggctctaacgggggcgaccgagatccagaccagtggtacaacgaccatcttcgccggtcacctgaagtgccgtctgaagatggacaagctaactcttaagggtatgtcctacgtgatgtgcacggggtcctttaaattagagaaagaggtcgccgagactcaacatggtaccgtgttagttcaggtcaaatacgagggcacagacgcaccatgcaagatccccttcagcgcacaggacgaaaagggtgtgactcagaacggccgtctgataactgcgaacccgattgtgacagacaaggagaaacctgtcaatatcgagaccgaaccgccctttggggagtcctacatcgtggtaggggccggcgagaaggcgctcaagctaagctggttcaaaaaagggagcagcattggaaagatgttcgaggccaccgcacgtggagccagacggatggccattctcggcgacacggcgtgggatttcggatccattggcggcgtctttaccagcgtcggtaaactggtgcatcaggtgttcggcgccgcttatggggtgttgttctcgggcgtgagctggaccatgaagatcgggattggaatactcttgacatggctgggcttaaactcccgcagtacatccctgagcatgacgtgtattgccgtcggcatggtgaccctgtatttgggcgttatggtccaggccgactccggttgcgtgatcaactggaagggccgcgaactgaagtgcgggtcgggtatcttcgtgaccaacgaagttcatacttggactgagcagtacaagttccaagcggactcgcccaagagactctccgccgccatcgggaaggcctgggaggaaggcgtgtgcgggatccgcagtgcaacgcgcttggagaacataatgtggaagcagatctcgaacgaactgaaccacatattgctcgagaacgacatgaaattcaccgttgtcgtaggcgacgcgaacggcatactcgcgcagggtaaaaagatgattcgtccgcaacccatggaacatcggtactcatggaagagttggggcaaggccaagatcatcggcgccgacattcagaacacaacattcataatcgacgggcctgacaccccggagtgccccgatgaccagagggcgtggaacatctgggaggtcgaggactatggcttcgggatcttcaccacgaatatatggctgaagctccgagacagctacacacagatgtgtgaccacagactgatgtcagccgccataaaggactcaaaggccgttcacgccgacatgggctactggatcgagagtgagaaaaatgagacttggaagctggcccgcgcctcattcatcgaggtgaagacctgcatttggccaaagtcacacaccctatggagtaacggcgtgctggagtccgagatgatcatcccgaagatctacgggggccccatctctcagcacaactaccgccccgggtacttcacccagaccgccggcccctggcacctcggcaaacttgagctggactttgacttgtgtgaggggacgacggtcgttgtggacgagcactgcggtaaccgggggccgtcacttcgcactaccacggtcacgggcaaaatcatccacgagtggtgttgccggagctgcacgcttcctcctctgcgcttccgcggcgaggacggctgctggtatgggatggaaattcgccccgtgaaagagaaggaggagaatctcgtgcggtccatggtctccgccggcagcggcgaagtcgactccttcagcctcgggatcttgtgcgtcagcatcatgatcgaggaggtgatgcgcagcaggtggtcccgcaagatgttaatgacggggaccctggccgttttcttactcctgattatgggacagctgacctggaacgacctgatcagattgtgcatcatggtgggcgccaacgcctcagaccggatggggatgggcatcacgtacttggccctgatggccacgttcaagatgcgccccatgttcgccgtcggcctgttattccgaagactgacctctagggaggtgctgctgctcacgatcgggctgagcctggtggcgtccgtggagctacccaactcactagaggagctgggggacggcctcgcaatgggcatcatgatgctgaagctgctcacggagttccagccgcaccagttgtggactaccttgctctccctgaccttcattaagacgaccctaagcctcgactacgcgtggaggaccatggcaatggtgctgtccatcgtaagcctgttccccctttgcctgagtaccacaagccagaagacgacctggctgcccgtgctcctggggtcctttggttgcaagccgctgaccatgtttctcattacagagaacaagatctgggggagaaagagctggcccctgaacgaaggcattatggctataggcatcgtctccatcctgctctcctctctgctgaaaaacgacgtgccactagccgggcctctaatcgccggcggtatgctgatcgcctgctacgtgatctccggatctagcgccgacctatcgctggagaaggcggccgaggtatcctgggaggaagaggcagagcatagcggcaccagccacaacatattagttgaggtgcaagacgacgggactatgaaaatcaaggatgaagagcgcgacgataccctcaccatactgctgaaggccacgctgcttgcggtgagcggcgtataccccatgtccatccccgccactttgttcgtgtggtacttctggcagaaaaagaagcagcggagcggcgtcctttgggatacgccatccccgcccgaagtagagagagcggttctggacgatggcatctaccgcatcctgcagcggggccttctcgggcggagccaggtaggggttggggtgttccaggacggcgtcttccacaccatgtggcacgtcactcgcggggccgtgcttatgtaccagggcaagcggttggaaccctcgtgggccagcgtgaagaaggacctcatctcctacggcgggggatggcgattccagggtagctggaacactggggaagaagtgcaagtaatcgcggtcgagcccgggaagaatcccaaaaatgtccagacaacccccggcacttttaagacacccgagggcgaggtgggggcgatcgctctggacttcaagcccggcacgagtggcagccccattgtgaaccgcgaaggcaagattgtcggcctgtacggaaacggcgtggtgaccacttccgggacttatgtctcggcaatcgcgcaggcaaaaaccagccaggagggccccctccctgagatcgaggaggaagtgttcaagaagagaaacctgacaatcatggacctacaccctgggtctggcaagaccaggcgatacctccccgcgatcgtgcgggaggccattaaacgcaagcttcgtaccctgatcttagcacccacgcgggtcgttgccagcgagatggctgaggccttaaagggcatgcccatccgttatcagaccacggctgtgaaatcggagcacaccggaagggaaatcgtcgatctgatgtgccacgcaacctttacgatgcgactccttagcccggtgcgggtgcccaactataacatgatcataatggacgaggcccatttcactgaccccgcgagtatcgccgccaggggttacatatcaactcgtgtcgggatgggcgaggccgccgccatcttcatgacggccactccgcctggttccgtcgaggcattcccccagtcgaacgccgtgatccaggacgaggagcgcgacatacctgagcggtcctggaatagcggctacgactggatcacggacttcccgggcaagaccgtgtggttcgtgccctccatcaagagcggaaacgacatagccaactgcctgaggaagaatggcaagcgggtgatccagctctcccgcaagaccttcgacacggagtatcagaaaacaaagaacaacgactgggactacgttgtcaccaccgacatctcagaaatgggggcgaactttcgggccgatagggtaatcgacccgcgccggtgcctgaagccagtcatcttaaaggacgggcctgaaagagtaatcctcgcagggccgatgcctgtcactgtcgcatccgcggcccagcgccggggtcgcatcggccgcaaccagaacaaagagggtgaccagtatgtgtacatgggccaacccctgaataacgacgaggaccatgctcactggacggaggcaaagatgttactcgacaacataaacacccccgaggggatcatcccggccctttttgaacccgaacgggagaagtccgcggccatcgacggggagtatcgcctgcgcggggaggcccgcaagacctttgtggagctaatgagacgtggcgaccttccggtgtggctgtcgtacaaggtggcctccgaaggcttccagtactcggatcgacgctggtgcttcgatggcgagcggaacaatcaggtcctagaagaaaacatggatgttgagatatggaccaaggaaggagaacgtaagaagctgcggccccggtggctggacgcacgtacgtacagcgaccctctcgcgttgcgcgagttcaaggagttcgccgccggccggcgctcggtgtcaggggacctcatcctcgaaattggcaagctgcctcagcatctgaccctccgggcccaaaacgcattggacaacctggtcatgctacacaattcggagcaaggcgggaaagcgtaccgacacgccatggaggagctccctgatacgatcgagaccctgatgcttctggccctgatcgctgtcctgaccggaggagtgacactgttctttttatcgggtaagggcttaggaaagacctcaataggcttactgtgtgtcatggcgtctagcgccctcctatggatggcaaatgttgagcctcattggatagctgccagcattattctggagttcttcctcatggtactgctgattccagagcctgacagacagaggacaccgcaggacaaccagttggcgtacgtggtgattgggctgctgttcatgattctcaccgtcgccgcgaacgagatggggcttcttgagacgacgaagaaggacctcggtatagggcacgtcgccgccgagaatcagcaccacgccaccatgctggacgtagatctgcgcccggcgagcgcctggaccctatacgccgtggccacgaccgtcatcaccccgatgatgcgccacaccatcgagaataccactgcgaacatatctctgacggccattgccaaccaagcggctattctcatgggtctcgacaagggctggcccatctctaagatggatatcggggtgcccctgctggcgctcggctgctattcgcaggtgaacccactgaccctgacggctgcagttctcatgctggtggcccactacgcgatcatcgggcccggcctgcaggccaaggccacccgcgaagcacagaagagaaccgccgctgggatcatgaagaaccccaccgtcgacggcatcgttgcgatcgacctcgaccccgtggtctacgacgcgaaattcgagaagcagctgggccagatcatgctgctcatcctgtgcacgagccagatccttctcatgcgcacgacgtgggccctttgcgaaagtataaccctagccactggtccgctaacgaccttgtgggagggctcccccgggaagttttggaacactacgatcgcggtctccatggcaaacatcttcagagggagctacctggccggcgccgcgctcgcgttctcactgatgaagtctctagggggtgggcgccggggcaccggggcccagggggagactctcggcgaaaagtggaagcgacaactgaatcagctctctaaaagcgagttcaacacctataagagaagcggaataatggaggtggaccgttccgaagcgaaggagggactaaagagaggggagacaaccaagcacgctgtttccagaggaaccgcaaaactgcggtggttcgtcgagcgcaacttagtcaaacccgagggcaaggtgatcgacctgggttgcggcaggggcgggtggtcctactactgcgccgggctcaagaaagtgaccgaggtgaagggctacacgaagggcgggcccgggcacgaagagccaattcccatggccacctacggttggaacttggtgaaactgtacagcggtaaggacgtcttcttcacgccgcccgagaaatgtgacaccctcctttgcgacataggggagtccagcccgaatccgaccatagaggagggtcgcacgctgcgtgttcttaaaatggtcgagccatggctacgcgggaaccagttttgcatcaagatcctcaacccctacatgccgtccgtcgtcgagactctcgagcagatgcaacggaagcacggcggaatgctggtgcgcaatcctctgagccggaactccacacatgagatgtactgggtcagctgcgggaccggaaacatcgtatccgccgtcaatatgacgagccgcatgctcctgaaccgcttcacaatgacccaccggaaaccgacctatgagcgcgacgtcgacttgggcgcaggcacgcggcacgtggcggtagagcccgaagtcgcaaatctcgacatcatcggccagcgcatcgagaatatcaagaacgagcacaagtccacctggcattacgacgaggacaacccgtataagacctgggcctaccatggcagctacgaggtgaagccatcgggtagcgccagctcaatggtgaacggggtcgtgcggctgctgactaagccatgggacgtcataccaatggtgacgcagatcgcaatgaccgataccaccccgtttggacaacagcgcgtgtttaaagagaaggtcgacacacggacgccacgggcgaaacgggggaccgcccagataatggaggtgaccgccaaatggctctggggcttcctgtcgcggaacaaaaagccccggatttgtacgcgcgaggagttcacccggaaggtgcgaagcaacgcggcgattggagccgtcttcgtggacgagaatcagtggaacagcgccaaggaagcagtggaggacgaacgcttctgggatctggtccaccgtgagcgtgaattacacaaacaagggaagtgcgcgacctgtgtgtacaacatgatggggaaacgggagaagaagctgggggagttcggcaaggcgaagggctcccgggccatctggtacatgtggttaggcgcacgctttcttgagttcgaggccttgggcttcatgaacgaggaccattggttctccagggagaactccttcagcggggtggagggggagggacttcacaagctcggatacatcttacgcgacatctccaagatccccggggggaacatgtacgcggacgacaccgcgggctgggacacgcgcatcaccgaggacgacctacagaacgaagccaagattacggatattatggaagccgaacacgccctcctggcgacaagcatctttaagctgacgtaccaaaacaaggtcgttcgggtgcagcgcccagcgaagaatggaaccgttatggatgtgatctcccggcgcgaccagcggggaagcggccaggttgggacctatggcctcaatactttcacgaacatggaagtccagctgatccgacagatggaatccgaggggatcttcctgccctccgagctggagaccccaaacctcgccgagcgggtcctggattggctggagaaacacggcaccgagcgcctgaagcgtatggccatctctggggatgactgcgtggtcaaaccagtggacgaccgcttcgccaccgcgctgatcgcgctcaacgacatggggaaagtgcggaaggatatcccccagtgggagcccagcaaagggtggaacgactggcagcaggttcccttttgctctcaccatttccaccagctgatcatgaaagacggccgcgagattgtggtcccatgccggaatcaagacgagctggtaggcagggcgcgtgtcagccagggagccggctggtccctccgcgaaacggcctgcttgggcaagagctacgcccagatgtggcagctaatgtatttccaccgccgcgatctccggctcgcggcaaatgccatctgctccgcggtgcccgtcgactgggtgcccactagccgcacaacgtggtcgatccacgcgcaccatcaatggatgacgacggaggacatgctgtccgtgtggaaccgggtctggatcgaagagaacccctggatggaagacaagacccacgtgagctcctgggaagaggtaccatacctcggcaagcgggaggaccaatggtgcggctctctcatcggcctcaccgctcgcgccacttgggccacaaacattcaagtggccattaaccaagtccggcgcctcatcggtaatgagaactacttagattatatgacctccatgaagcggttcaaaaatgaaagcgatcctgagggggcgctatggtaa

SEQ ID NO: 24016 - RNA, 9879 nt, synthetic construct
  misc_feature 1..9879: note = derived and/or modified CDS sequence (opt11) from DENV-1__FJ410175__SS-prME
  source 1..9879: mol_type = other RNA
tcggtcaccatgctcctcatgctcttgcccaccgccctagctttccatcttacgactcggggaggagagccccacatgatcgtgagcaagcaagagagaggcaaaagcctattattcaaaaccagcgctgggatcaatatgtgcaccctgatcgccatggatctgggcgaactttgcgaggacacgatgacctacaaatgcccccgcatcaccgaggccgagcccgatgacgtggactgctggtgcaatgccaccgatacgtgggtgacctatggcacatgtagccagaccggtgagcacaggcgggacaaacggtccgtagcactcgcgcctcatgtgggtctgggcctggagacgcgcacggagacctggatgagctccgaaggagcctggaagcaaatccagaaagttgagacgtgggccctacggcacccggggtttacagtcacggccttgttcctcgcacatgccataggcaccagcataacccagaaggggatcatcttcatcctcctgatgctagtgacgccctccatggctatgcgctgcgttgggattggaaaccgtgatttcgtggagggactaagtggcgccacctgggtggatgtggtactggagcacggttcctgcgtaactacgatggctaaagacaagccgacgttagacatcgagctgctgaagaccgaagtgaccaatcccgccgtcctcagaaaattgtgtatcgaggcaaagataagcaacaccaccaccgactcacggtgcccgactcaaggcgaggccacattagtggaagaacaggacagtaattttgtttgccgccgaacattcgtcgaccggggctgggggaatggctgtgggttgttcggcaagggatcgctgctgacatgcgccaaatttaagtgcgtaacaaaacttgaaggcaagatcgtacagtacgagaatctaaagtacagcgtcatcgtgaccgtacacacgggggaccagcatcaagttggcaacgaaaccaccgaacacggtaccatcgcgacaatcacgccgcaggcaccaacttccgaaatccagctgaccgactacggagccctcaccttagattgcagcccccgaacgggcctggacttcaacgaaatggtgttactcacgatgaaggagaaaagctggcttgttcataagcagtggttcttagacctcccgctcccctggacctccggggcatcgacttcccaggaaacgtggaacaggcaggatctgctggtgacctttaagacggcccacgccaaaaagcaggaggttgtagtgttgggaagccaggagggcgctatgcataccgcgttgacgggggccactgagatccagacctcgggtaccacgaccatctttgccgggcacctgaagtgtcggttgaagatggacaaactcaccctcaaaggcatgagctacgtgatgtgcaccggatccttcaagctggagaaagaggtcgccgaaacccaacatggcacggttcttgtacaggtcaagtacgaaggcaccgacgcgccctgcaaaatcccgttcagcgcccaagacgagaagggagtgacccagaacggccgcctgatcacagccaatccgattgtcaccgacaaggagaagcccgtcaacatcgagaccgagccgccattcggggagagctacatcgtggttggtgccggcgaaaaagcgctgaaacttagctggttcaagaaggggtccagcatcggcaagatgttcgaagcaactgcccgcggggcccgccgcatggccatactaggcgacactgcctgggatttcgggtccatcggaggcgtcttcactagcgtggggaagttggtccaccaggtcttcggagccgcttacggggtactgttctccggcgtgagctggactatgaagatagggatcggaatcttactgacatggctcggccttaattctcggagcacgtccctgtctatgacctgtatcgcggttggtatggtgaccctatatctcggcgtgatggtccaggccgactctgggtgtgtaataaactggaagggtcgcgaactgaagtgcggtagcggcatcttcgtgactaacgaggtacatacttggaccgagcagtacaaattccaggcggacagcccgaagcggctgtccgctgcgatcggaaaggcttgggaggagggagtctgcggaatcaggagcgccacacggctcgagaacataatgtggaagcagatatccaacgaactgaaccacatactcctcgagaacgatatgaaattcaccgtggtagttggggatgcaaacggcatccttgcacaggggaagaagatgatccgacctcagccgatggagcaccggtacagctggaagtcctggggcaaggccaagatcatcggtgcagatatccagaataccactttcatcatagatgggcccgacaccccggagtgcccagacgaccagcgcgcatggaacatctgggaagtggaggactacggcttcgggatctttaccaccaacatctggctgaagctccgtgatagctacacgcaaatgtgcgatcaccgccttatgtcagccgccataaaggatagcaaggcagtacacgccgacatgggctactggatcgagtctgagaaaaatgagacctggaaactggcgcgagcaagtttcatagaggtgaagacttgtatctggcccaaatctcacactctctggtctaacggcgtgctggaaagtgaaatgattataccgaagatttacggcggcccgatcagccaacacaattacaggcccggatatttcacgcagaccgccggcccttggcatctggggaagctagagcttgacttcgatctgtgtgaggggacgactgtcgtggtggatgaacattgcggcaacaggggtccgtcgctccgcacaaccacggtgaccggcaaaatcatccacgaatggtgctgccggtcgtgcacgctgccgcctctgcgctttcgcggggaggacggctgctggtacggtatggagatccgcccagtgaaggagaaggaagaaaatctagtacggtcaatggtgagcgccggatcgggcgaggtcgactcttttagtctgggaatcctgtgcgtctccatcatgatagaggaagttatgcgctcgagatggtcccgcaaaatgttaatgaccggcaccctggccgtgtttctgctcttgattatggggcagctcacctggaacgatcttatcagactgtgtatcatggtgggtgcgaacgccagcgacagaatggggatgggcaccacatacttagccctcatggccacattcaaaatgcgcccaatgtttgccgtaggcctcctttttcgaagactaacatctcgggaggtcttgcttttgaccatcgggctgtctctggtggcgtccgtagaactccccaacagtctggaggagcttggcgacgggctagccatgggcatcatgatgctaaagctgctaaccgagtttcagccacaccagctctggaccaccctgctctccctgactttcatcaaaaccacccttagcctagattatgcctggcgcaccatggcaatggtccttagcatcgtaagtctgttccccctctgcctgtccacgacctctcagaagaccacatggctgccggtgctattaggctccttcggctgcaagcccctgacgatgttcttgataaccgagaacaagatctggggaagaaagagctggccactgaacgaggggatcatggcgatcggcatagtctccatcttactcagcagcctgctgaagaacgacgttccactcgccgggccgctgatcgcaggcgggatgctcatcgcttgctatgtcatatctggaagctccgcagatttgagcctggaaaaggcagccgaggtcagctgggaggaggaagctgaacacagtggcaccagccacaacatcctggttgaagttcaagacgacggaacaatgaagattaaagatgaggagcgggacgacaccctcacaatactgctgaaggcgaccctcctggccgtgagcggtgtatatccgatgtccatccctgcgaccctgtttgtgtggtacttctggcagaagaagaaacagcggagtggggtcctgtgggacaccccgtccccgcccgaggtagagcgtgccgttctagacgacggtatctaccgtatactccagcgcggtcttctcgggcggagccaagtaggagtaggcgtttttcaagatggtgtattccacaccatgtggcacgtcacgagaggagccgtcctgatgtaccagggcaaacggcttgagccctcctgggcctctgtgaagaaggatctgatctcctacggcgggggctggcgttttcaggggagctggaacacaggcgaggaggtccaggtgattgccgtggagcctggtaagaatccgaagaacgtccagaccacgcccggcactttcaagaccccagagggcgaagttggtgcgattgccttggacttcaagcccggcacttccgggtcaccaatcgtgaatcgggaggggaagatcgtcggtctatacgggaatggcgtggtcacgacctcggggacctacgtcagtgccatcgcccaggcaaagaccagccaggaaggacctctgcccgaaatagaagaagaagtgtttaaaaagcgcaatctaacgatcatggatctccaccctggatccggcaagacacggaggtacctccccgcgatagtcagggaggccatcaagcgtaagctgcgcaccctgatactcgccccaacccgggtcgtggcctcagagatggcggaggcactgaagggtatgcccattcgctaccaaacgacagctgtgaagagtgagcataccgggcgcgagatcgttgacctaatgtgccatgctaccttcacgatgcgcctcctgagcccggttcgtgtgccaaattacaacatgatcatcatggacgaagcccactttacggaccccgcctccatagccgcccgaggctatatcagtacccgagtcggcatgggcgaagccgccgcgatattcatgaccgcaacaccgcctgggtcagtggaggccttcccccagtcgaacgccgtgatccaggacgaggagcgagacatacccgagcggtcctggaactcaggctatgactggatcaccgacttccccggtaaaactgtctggtttgtcccctccatcaagtcggggaacgatatagccaattgcttacggaaaaatggtaaaagagtgatccaactctcccgcaaaaccttcgatacggagtaccagaagacaaagaacaatgactgggattacgtcgtgacaaccgacatctccgaaatgggggcgaacttcagagcagaccgcgtaattgacccgcggcggtgcctgaaacctgtaatactgaaagacggccccgagcgtgttatcttagctgggccgatgccagttacggtcgcatccgcggcacaacgacggggcagaattggccgcaatcagaacaaagagggagatcaatatgtgtacatggggcagcccctaaacaacgacgaggaccacgctcattggactgaggcaaaaatgctcctcgacaacattaacaccccagaaggcatcataccggcgttgttcgagcccgaacgggaaaagagcgccgcaattgacggcgaataccgcctgcgaggagaggcccgcaaaacctttgttgagctcatgagacgcggcgatctgccggtttggctgtcctacaaagtggctagtgagggcttccagtactccgaccgacgatggtgcttcgacggagagcggaacaatcaagtactagaggaaaatatggatgtggaaatctggacgaaggagggcgagagaaagaaactccggccccgctggcttgacgcgagaacttactctgacccattagcgctgcgcgaatttaaagagttcgcagccgggcgccgtagcgtctccggcgatttaatcctggagataggcaagctgccgcagcaccttacgctcagagcccagaacgccctggataacctggtcatgctccacaatagcgaacagggcgggaaggcatacaggcacgccatggaggagctgcccgacaccatcgaaaccttgatgctcctagccctgatcgcagtgctaacaggaggcgtgacgctatttttcctgtcgggaaaagggttggggaagacgagcatagggctgctgtgcgtcatggcgagtagcgccctcctgtggatggcgaacgtggaaccgcactggattgccgcctctatcatactagagttcttcctaatggttctgcttatccctgagcccgaccggcagcgcacgcctcaagacaaccagctggcgtacgtcgtgataggcctgctgttcatgatcttaacggtggccgccaacgagatgggtttgttagagaccacgaagaaagatctcgggatcgggcacgtcgccgccgagaaccagcaccacgcaacgatgttggacgtagacctacgacctgccagcgcttggacgctttacgcggtggcgaccacggtcataacccctatgatgcgccatacgatcgagaacacaaccgcgaacataagtctgactgctatcgccaaccaagccgcgatcctgatgggcctcgacaagggctggcccatctcgaaaatggacattggggtgcccctactggctcttggctgttactcgcaagtgaacccccttacacttaccgccgcggtcttgatgttggtagcccactacgctataatcgggcccggactgcaggctaaggcaactagggaggcccagaaacggactgcggctgggatcatgaagaacccgacggttgacggtatagtcgcgatcgatctcgaccccgtagtgtacgacgccaagttcgagaagcagcttggccaaattatgctgctgattctgtgcaccagccagatcctgcttatgagaactacttgggccctgtgcgagtccataactctggccacagggccgctgactaccctgtgggagggaagccccgggaaattctggaacaccaccatagcggtcagtatggcgaacatttttcgcgggagctacctggcaggcgcaggtcttgctttctccttgatgaaatccttaggaggcggccgccggggaaccggggcgcagggcgagacgctcggagaaaagtggaagcggcaactcaaccagctgagcaagtcagaatttaacacgtacaaaagatccggcattatggaggtggatcgctccgaggcgaaggaaggcttaaagcgcggtgagactaccaaacacgccgtgagccgcggaacagcaaagctgcggtggttcgtcgaacgcaacctggttaagccagagggcaaggttatcgatcttggatgtgggcggggtggctggagttactactgtgcgggcctgaagaaggtcacggaggtgaaaggttataccaaaggcggccctgggcacgaggagccaatccccatggcgacatatgggtggaaccttgtgaagctgtactctgggaaggacgtgttctttaccccgccggagaagtgtgacacgctcctgtgcgatatcggggagtccagcccgaacccaactatcgaggaaggacgcactcttcgggtcttaaagatggtggaaccctggctacgaggcaaccagttttgcatcaagattctgaacccttatatgccatccgtcgttgagaccctcgaacagatgcaacggaaacacggcgggatgctggtgaggaaccccctgagccggaactccacacacgagatgtattgggttagctgtgggaccggcaacatcgtttccgccgtcaacatgacgagccgcatgctcttaaaccgtttcaccatgacccacaggaaacccacgtacgagagagacgtcgacctgggcgctggcaccaggcacgtggcggtggagcccgaggtcgctaatctcgacatcatagggcagagaatcgagaacatcaagaatgagcacaaaagtacgtggcactacgatgaggacaacccctacaaaacctgggcctatcacggctcctatgaggtcaagccgtccgggtcagccagctctatggttaatggggtcgtcagactgctaacgaagccttgggatgtgatccccatggtgacccagattgcaatgactgacacgacccccttcgggcagcaacgggttttcaaggagaaggttgacacacgcacgccgcgggcgaagcggggtactgcgcaaataatggaggtaacggccaagtggctatggggctttctgagtcgcaacaagaagcctcggatatgtacgcgggaagagttcacccgaaaagtccgcagcaacgctgcaatcggtgctgttttcgtcgatgagaatcagtggaacagcgcaaaagaggccgtagaagacgagaggttctgggacttggtccaccgcgagcgtgagctccacaaacaagggaaatgcgctacttgcgtgtataacatgatggggaagagggagaaaaagctgggcgagttcgggaaagctaaaggctcccgtgccatctggtatatgtggctgggtgccaggttcctcgagttcgaggccttagggtttatgaacgaggaccactggttttcccgtgagaactccttcagtggagtggagggtgagggcctgcataagctcgggtacattttacgagatatttccaaaatcccgggtggcaacatgtatgcagacgatacggcgggctgggatacgaggattacagaggatgacctgcagaatgaagcgaggattactgatattatggagccagagcacgcactcctggccacgagcatcttcaagctcacataccagaataaagtcgtgcgcgttcagcggccagccaagaatggcactgtcatggacgtgatctcgcgcagggaccagcgcggctcgggccaagttggcacttacggtctcaataccttcaccaatatggaagtccagctgatccgccagatggagtccgaggggatcttcctgcccagcgagttagagaccccaaatctggcggagcgcgtgctggactggctagagaagcacgggactgagcggctgaagcgcatggcgatctccggcgatgactgcgtggtcaaacctgtggatgacagatttgccacagccctgatcgccctgaatgacatgggaaaggtgcgaaaggacattccgcaatgggagccctctaagggctggaacgactggcaacaggtgccgttctgctcccaccactttcaccaattgatcatgaaggacggccgggaaatcgtagtgccgtgtcggaaccaagacgaacttgtgggacgcgcgagggtgtcccagggcgcagggtggtcattgcgggagactgcgtgcctgggaaaatcctacgctcagatgtggcaactgatgtatttccaccggagggatctaaggctcgccgcgaacgccatctgctccgcggtgcccgtcgactgggtgcccacctcacgtactacctggagcatccacgctcatcaccagtggatgacgacagaagacatgctgtccgtgtggaaccgtgtctggatcgaggaaaatccatggatggaagacaagacacacgtcagctcctgggaggaggtgccgtaccttggaaagcgcgaggaccaatggtgcggcagcctgattgggttaaccgccagagccacgtgggctacgaacatccaggtggccatcaaccaagtgagacggctaattggaaacgagaattacttagactacatgacgtcgatgaagcgcttcaaaaacgagtctgaccccgaaggcgcattatggtga

SEQ ID NO: 24017 - RNA, 9879 nt, synthetic construct
  misc_feature 1..9879: note = derived and/or modified CDS sequence (opt11) from DENV-1__FJ562105__SS-prME
  source 1..9879: mol_type = other RNA
agcgtaaccatgctgctcatgctcctgcccaccgttctcgccttccacctcaccacccggggcggcgagccccacatgatcgttggcaagcaagagcgtggcaaaagcctcctattcaagaccagcgccggggtaaacatgtgcaccctgatcgccatggacctgggagaactctgcgaggacacaatgacctacaagtgcccccgcatcaccgaggcggaacccgacgacgtggactgctggtgcaacgcgaccgacacatgggtgacctacgggacctgttcccagaccggcgagcaccggcgggacaagcgctcggtggccctggcgccccacgttgggctgggcctcgaaactcgcaccgagacctggatgtccagcgagggggcatggaagcagatccagaaggtggaaacctgggctctgcggcatccgggattcaccgtgatcgccttcttcttggcccacgcgatcgggacctccatcactcagaagggcatcatcttcatcctactgatgctggtcacccccagcatggctatgaggtgcgtgggcatcgggaaccgggacttcgtggagggcttgtcgggggctacgtgggtcgacgtagtgctggagcacgggagctgtgtcaccaccatggccaagaacaagccgactcttgatatagagttgttaaagacggaggtgaccaaccccgccgtgctccgcaagctctgcatcgaggcgaagattagtaacaccaccacagactcgcggtgccccacccagggcgaggccacgctggtcgaggagcaggacgccaacttcgtttgccgcagaactttcgtggaccgcgggtggggcaacgggtgcggactgttcgggaagggctccctcctgacgtgcgccaagttcaaatgcgtaaccaaactggagggcaagatcgtccagtacgagaacctcaagtactcggtgatcgtcaccgtgcacaccggagaccagcaccaagtcggcaacgagacgaccgaacacgggactatagccacaatcacgccccaagctcccacctccgagatacagctgaccgattacggcgcgctgaccctcgactgcagccccagaacggggctggatttcaacgagatggtcctgcttacgatgaaggagaaatcctggctggtgcacaagcagtggttccttgacctccccttaccctggaccagcggcgcctccacgagccaagagacctggaaccgccaggatctgctcgtaacattcaagaccgcccacgctaagaagcaagaggtagtggtcctgggcagccaggagggggcgatgcacaccgcactgaccggcgctacggagattcaaacctccgggaccaccacgatattcgccgggcacctcaagtgtcggctgaagatggacaaactcaccctcaaagggatgtcttacgtcatgtgcaccggctcgttcaagctggagaaggaggtggccgagacccagcacggcacggtccttgtccaggttaagtatgaagggaccgatgctccctgcaagatccctctgagcacccaggacgaaaaaggcgtcactcagaacgggcgcctcatcacggccaacccgatcgtgacagataaggaaaagcccgtgaacatcgagaccgagccgcccttcggcgaatcctacatcatcgtcggcgccggggagaaagccctgaagctgtcatggttcaagaagggctcctctataggcaagatgttcgaggcaaccgccagaggcgctcgccggatggctatactcggagatacggcctgggacttcggctctattggcggggtgttcacaagcgtgggtaaacttgtccaccaagtattcgggacagcgtacggcgtgctgttctccggggtcagctggaccatgaagatcgggattggcattctcctcacttggctgggtctaaactcccgcagcgccagcctgagcatgacctgcatcgcagtgggcatggtgaccctgtacctcggcgtcatggtgcaggccgattccggctgcgtgatcaactggaaggggcgggagctgaagtgcggcagcggaatcttcgtcaccaatgaggtgcacacatggaccgagcagtataagtttcaggccgactcccccaagcggctgagcgcggccatcgggaaggcatgggaggaaggcgtgtgcggggtccgcagcgcaaccaggctcgagaacattatgtggaagcagatctccaacgaactcaaccacatcctgttggaaaatgacatgaagttcaccgtggtggtcggtgacgcaaacgggatcctggcgcaggggaagaagatgattcgcccccagcccatggagcataagtacagctggaagtcatggggcaaggccaagatcattggggccgacatccaaaacaccacgttcatcatcgacggacctgacaccccggagtgccccgacgaccagagggcatggaacatctgggaagtggaggactacggtttcggcatcttcaccaccaacatctggctgaagctccgcgactcgtacacgcagatgtgcgaccacagactgatgagcgcggccatcaaggactcaaaggctgtgcacgcggacatgggctactggatcgagtccgagaagaacgagacttggaagctggcccgcgcgtcattcatagaggtcaagacatgcatctggcccaagagtcacaccttatggtccaacggggtgctggagagcgagatgatcatccccaagatctacggcggtccgataagccagcacaactaccggcccggatacttcacgcagaccgccgggccctggcacctgggcaagttagagctcgacttcgacctgtgcgagggcactaccgtggtggtggacgagcactgcgggaaccgcggcccgtcactccggacgacaaccgtcaccgggaagatcatccacgagtggtgctgccgcagctgcacgctgccgcctctgcggttcagaggagaggatgggtgttggtacggaatggagatccgccccgtcaaggagaaggaggagaatctcgtgcgctcgatggtgagtgcgggttccggggaggtcgacagctttagcctgggtattctgtgcctctcgatcatgattgaggaagtgatgcggagccgctggtcccggaagatgctgatgactgggaccctggccgtgttcctcctactgataatggggcagcttacctggaacgacctgattcgcctgtgcatcatggtaggcgccaacgccagcgaccgcatgggcatgggcacaacctacctcgcgctgatggccactttcaagatgcggccgatgttcgccgtgggtctcctgtttcgccggctgacttcacgtgaggtgctgctcctgacgatcggcttaagcctcgtcgccagtgtggagttgcccaacagcctagaagagctaggggacggcttagcgatgggcatcatgatgctgaagcttctgaccgagttccagccccaccagctgtggacgaccctcctgtccctaacgttcattaagaccacccttagcctggactacgcctggaaaaccatggccatggttctgtccatcgtgagcctcttccccctgtgcctgagcacgaccagccagaagaccacctggctcccggtgctgctggggtctttcggctgcaagcccctcacgatgttcctgatcacggagaacaagatctgggggagaaaaagctggcccctgaacgagggcatcatggccatcgggatcgtctccatcttgttgagctccctgctcaagaacgatgtgcccctggcgggccccctgatcgccggcgggatgctcatcgcctgctacgtgatcagcgggtcatccgccgatctgagcctggagaaggctgcggaggtttcctgggaggaggaggccgagcatagcgggacctcccacaacattctcgttgaggtgcaggacgacggtaccatgaagatcaaggatgaggagcgcgatgacaccctgacgatcctgctcaaggcgaccctgctggccgtcagcggggtgtaccctatgagcatcccagctaccctctttgtctggtatttctggcaaaagaagaagcagcggagcggcgtcctgtgggacacccccagcccacccgaggtggagcgcgcggtgctagacgatggcatataccggatcctgcagagggggttactgggccggagccaggtcggggtgggcgtgttccaggatggtgttttccacacgatgtggcatgtaacgcgcggcgccgttctgatgtaccagggcaagcggttagagccctcttgggcgagcgtcaagaaggacctgatctcctatgggggcggatggcgcttccagggcagctggaacaccggggaggaggtacaggtgatagccgtcgagcccggcaaaaacccaaaaaacgtacagactacccccggcaccttcaagacccccgagggtgaggttggcgccgttgcattggacttcaagcccggaacctccggcagcccgatagtcaaccgcgagggcaagatcgtgggtctatacggcaacggtgtcgtgacgacctccggcacctatgtgagtgccatcgcgcaggcaaaagcctctcaggagggtcccctccccgagattgaggacgaggtcttcaagaagcgcaacctgaccatcatggacctccacccgggcagcggcaagacgcgacgctacctgcccgcgatcgtacgggaggccataaagcgcaagctgcggactctcatcttggccccgacacgcgtagtcgccagcgagatggcagaggccctgaaggggatgccaatccgctaccagaccacggccgtgaagtccgagcacaccggccgggagattgtcgacttaatgtgccacgcgaccttcaccatgcgcttactgagcccggtgcgggttcccaactataacatgatcatcatggatgaggcccacttcacggaccccgcgtccatcgccgcccgggggtacatctcgacacgggtgggcatgggggaggccgcggcgatcttcatgaccgctacgccgcccgggtcagtcgaagcctttcctcagagcaatgccgtgatccaggacgaagagcgcgatatccccgagcggagctggaacagcggatacgactggatcacggacttccctggcaagaccgtgtggttcgtgccctccatcaagagcggcaatgacatcgccaattgcctgcgcaagaatgggaaacgggtgatccagctgtcccgcaaaaccttcgacaccgagtaccagaaaacgaagaacaacgactgggactacgtggtcaccacggatatcagcgagatgggcgcgaacttccgggcagatcgcgtgatcgacccaaggcgctgccttaagcccgtgatcctcaaggatgggccagagcgggttatcctggccggccccatgcccgtgacggtcgcctcagcggcgcagcgccgtggccgcataggacggaatcagaacaaggaaggagaccagtacgtctacatggggcagcccctgaacaatgacgaagaccacgctcactggacggaggccaagatgctcttggacaacatcaacacccccgagggcatcatcccggcgctgttcgagccggagcgcgagaagtccgcggccatcgacggggagtatcggctccggggcgaggcgcggaagaccttcgtggagctgatgcggcgcggcgacctgcccgtctggctctcctacaaggtggcctcagaggggttccaatattccgatcgtcgctggtgttttgacggcgagcggaacaaccaggtgttggaggagaacatggacgtcgagatttggacaaaggagggggagcgcaagaagctgcgaccacgctggctcgacgcaaggacgtacagcgatcctctggcgctgcgcgaattcaaagaattcgccgccggccggcgctctgtgagcggcgacctcatacttgagatcggaaagttgccccagcacttaaccctacgggctcagaacgccctggacaacctggtgatgctgcacaacagcgaacagggggggaaggcgtaccgccacgccatggaggagctgcccgacaccatcgagaccctcatgctgttagccctcatcgccgtcctgacaggcggagttatgctgttcttcctctccggcaagggcctgggcaagacgagcataggcctgctctgcgtgatggcgtcctcagccctcctgtggatggcctccgtcgaaccccactggattgccgcttcaatcatcctggagttcttcctgatggtcctgctaattccggagcccgaccggcagcgcacgccccaggacaatcagctggcgtacgtggtgatcgggctcctgttcatgatcttgacagtggccgccaacgagatgggcctgctcgagaccacgaagaaggacctcgggatcggccacgtggccgccgaaaaccatcaccacgttactatgcttgacgtggacctacggccggcgtccgcttggaccctgtacgctgtggccaccacagttattacccccatgatgcgccacaccatcgagaataccacggccaatatcagcctgaccgcgatcgccaaccaggccgccatcctcatgggcctcgataaggggtggcccatttccaagatggacatcggtgtccccctgctcgcgctggggtgttatagccaggtgaaccctctgaccttgaccgctgcggtcctgatgctggtggcccactacgcaatcataggccccgggctccaggcgaaggcaacgagagaggcccagaagcgcactgccgcaggcattatgaagaatccaaccgtggacggcattgtcgctatcgacctggaccctgtggtgtatgacgccaaattcgaaaagcagctggggcagatcatgctcctaatcctgtgcacctcgcagatcctcctgatgcgcacgacttgggccctgtgcgagtccatcaccctcgccaccgggccgctgacgaccctctgggaggggtcccccggcaaattctggaacaccaccatcgccgtctctatggcgaacatcttccggggctcctacctcgccggcgcgggcttagccttctcgctaatgaagtctctcggcggcggtcgccggggcacgggcgcccagggagagaccctgggcgaaaaatggaagcgccagctgaaccagttgagcaaatccgagtttaacacctacaagcggagcgggatcatggaagtggataggagtgaggcaaaggagggcctgaagcgcggagagaccacgaaacacgccgtgtcccgcggcaccgccaaactacggtggttcgtagagcgcaacctggtgaagcccgaaggcaaggtgatagaccttgggtgcgggcgcggtgggtggagctattactgcgctgggttaaagaaggttaccgaggttaaagggtacaccaagggcgggcccgggcacgaggagccgatccccatggcgacctacggctggaacctggttaaactccactccggcaaggacgttttcttcacgccgcccgagaaatgcgacaccctgttatgcgacatcggggagagctccccgaaccccaccatcgaagagggacgcaccttacgggtgctgaagatggtggagccctggctgggcgggaaccagttctgcataaagatcctcaacccctacatgccgagcgtcgtggagacgctggagcagatgcagcgcaagcacggcgggatgttggtgcggaaccccctctctcgcaactcgacccacgaaatgtactgggtctcctgtggcaccgggaacatcgtgagcgcagtgaatatgacgtcccgaatgctgctcaaccgcttcacgatggcccaccggaagcccacctacgagcgcgacgttgacctcggggccggcactcgtcacgttgccgtggaacccgaggtcgcgaatctgggcatcattggccagagaatcgagaacatcaagaacgagcataagtccacatggcactacgacgaggacaacccatataagacgtgggcttaccacgggtcctacgaggtgaagcccagcggctccgcctcgtcgatggtcaatggtgtggtgagactgctcaccaagccctgggacgtcatccccatggtgacgcagatagccatgaccgacacgacccctttcgggcaacagcgggtgttcaaagagaaggtcgacacccgcacgcccagggctaagcgcggcacggcgcagatcatggaggtgaccgccaagtggctgtgggacttcctaagccggaacaagaagccccgcatctgcaccagggaagagttcatacggaaggtgcggtccaacgcggccatcggggccgtctttgtggacgagaaccagtggaactccgcgaaagaggccgtggaggacgaacgcttctgggacctcgtccaccgggagcgcgagctgcacaagcagggcaagtgcgcgacctgtgtgtataacatgatggggaagagggagaagaagctgggcgagttcggcaaagccaaggggagcagagcaatctggtacatgtggctcggtgcccggttcctggagttcgaggcgctggggtttatgaacgaggaccactggttctccagagagaacagcctatccggcgtggagggcgagggtctgcacaaattgggctatatcttacgtgatatctctaaaatccccggaggcaacatgtatgccgacgacaccgccgggtgggacaccagaatcacggaggacgacctgcagaacgaggccaaaatcaccgacatcatggagcccgaacacgccctgctcgccacatccatctttaagctgacttaccagaacaaggtcgtgcgggtgcagcgccccgccaagaacggcaccgtcatggacgttatcagcagacgggaccagcgcggctccgggcaggtgggcacttacgggctcaacacgttcaccaacatggaggtccagctcatccggcagatggagagcgagggcatctttctgccttccgagctggagaccaccaacctcgccgaacgcgtactggactggctggagaagcacggggtggaaaggctcaagcgaatggcgatcagcggcgacgactgcgtagtgaaaccgatcgatgaccgtttcgccactgccctgatcgccctcaacgatatgggcaaggtgcgcaaagacataccccaatgggaacccagcaaggggtggaacgactggcaacaggtccccttctgctcgcaccacttccatcagctaatcatgaaggacggccgggagatcgtagtgccgtgccggaaccaggacgaattggtcggacgggcccgcgtctcccagggcgcggggtggagcctgagagagaccgcctgcctcggcaagtcgtacgcccagatgtggcagctgatgtatttccaccgccgggaccttcgcctggcagccaacgctatctgcagcgctgtgcccgtcgactgggtgccaacctcgagaaccacgtggagcatccacgcgcaccaccagtggatgacgaccgaggacatgttgagcgtatggaaccgcgtctggatcgaggagaacccctggatggaggacaagacccatgtctcaagctgggaggaagtgccgtaccttggcaagcgggaggaccagtggtgcgggtccctcatcggactaaccgcccgcgcaacgtgggccaccaacatccaggtcgcgatcaaccaagtgcgccggctcatcgggaatgaaaactaccttgactacatgaccagcatgaagcgcttcaagaatgaatccgaccccgagggcgccctgtggtga

SEQ ID NO: 24018 - RNA, 9879 nt, synthetic construct
  misc_feature 1..9879: note = derived and/or modified CDS sequence (opt11) from DENV-1__FJ562106__SS-prME
  source 1..9879: mol_type = other RNA
tccgtgactatgcttctcatgctgctgcccaccgcactcgccttccatctgacaacccggggcggagagccacacatgatcgtgtccaagcaggagcggggcaagagtctgctgttcaaaaccagcgcgggggtgaacatgtgcaccctcatcgccatggacctgggcgagctctgcgaggacacgatgacctacaagtgcccccggatcaccgaggccgagcccgacgacgtagattgctggtgcaacgccaccgacacgtgggtgacctacgggacctgcagccagaccggcgaacaccggcgcgacaagcggtccgtggccctggcgccccacgtgggcctggggctcgagaccaggaccgagacctggatgagctccgagggcgcttggaagcagatccaaaaggtggagacctgggcccttaggcaccccgggtttacagtgatcgccctgtttctcgcgcacgccatcggcaccagcatcacccagaaggggatcatcttcatcctgctgatgttagtgaccccctccatggccatgcgctgcgtcggaatcggcaaccgggatttcgtggaggggctcagcggcgccacatgggtggacgtcgtgctggaacacgggtcatgcgtgaccaccatggctaagaacaagcctaccctcgacatcgagctgctgaagaccgaggttaccaaccccgcggtgttacgcaagttatgcatcgaggccaagatcagcaacaccaccacggactcccggtgcccgacccagggcgaggccaccctggtggaggagcaggacgccaacttcgtctgcaggcggaccttcgtggaccgcgggtgggggaacggctgcggcctcttcggcaaggggagcctgctcacgtgcgccaaattcaagtgcgtgaccaagctcgagggtaagatcgtgcagtacgagaacctgaagtactccgtgatcgtgaccgtccacaccggcgaccagcaccaggtggggaacgagacgaccgaacatggcacaatcgcgacaatcacgccacaggcacccacgagcgagatccagctgaccgactacggggccctcacgctggactgcagcccccggaccggcctggacttcaacgagatggtactcctgacgatgaaagagaagtcctggctggtgcacaagcagtggttcctcgacttgccgctgccctggacctccggggcaagcaccagccaggagacctggaaccgccaggacctcctggtaacgttcaagaccgcccacgcgaagaagcaggaggtcgtggtgctgggctcccaggagggcgccatgcacaccgcgctgactggggctacggagattcagaccagcggcaccacgacgatcttcgccgggcacctgaaatgtcgactcaagatggacaagctcaccctgaagggcatgtcatacgtaatgtgcacggggagcttcaagctggagaaagaggtggccgagacccagcacggcacggtgctggtccaggtgaagtacgaaggcaccgacgccccctgcaagattcccttctccacacaagacgagaagggggtgacccagaacggccgcctcatcacggcaaatccgattgtcacagacaaggagaagcctgttaacatcgagaccgagccgcccttcggggagtcatatatcatggtgggcgccggagagaaagccctgaagctgtcctggttcaaaaaggggagctccatcggcaagatgtttgaggccaccgcccgcggggcgcgccggatggccatactcggcgacacggcgtgggacttcgggagcatcggcggcgtgtttacctccgtggggaaactggtgcaccaggtgttcggcaccgcctacggggtgctgttctcgggcgtgtcgtggaccatgaaaatcgggatcggcatcctactgacgtggctgggactcaactctcgctccgcctctctgtcaatgacctgcatcgccgtcgggatggtgacactgtacctcggcgtgatggtccaggccgacagcgggtgcgtgatcaactggaagggccgggagctgaagtgcgggtccggcatcttcgtgaccaacgaggtccacacgtggaccgagcagtataagttccaggcggactccccgaagcggctgagcgcagctatcgggaaggcctgggaggaaggggtgtgcggcatcaggtccgcaacccgtcttgagaacatcatgtggaagcagatcagcaacgagctgaatcacatccttctcgagaacgacatgaagttcaccgtcgtcgttggggacgcgaatggcatcctggctcaggggaagaaaatgattcgcccccagcccatggagcataagtactcatggaagtcctggggcaaggccaagatcatcggcgctgacatccagaacaccacgtttatcatcgacgggcccgacaccccggagtgccccgacgaccagcgggcgtggaacatctgggaagttgaggactacggcttcgggatcttcaccaccaacatctggctgaagctccgcgacagctacacgcagatgtgcgaccatcggctgatgagcgccgccatcaagaactctaaagccgtccacgccgacatgggctactggatcgagagcgagaaaaacgaaacctggaagctggcgcgcgcctccttcatcgaggtgaaaacctgcatctggcccaagagccacaccctctggtccaacggcgtactagagtcggagatgattatacccaagatctacgggggcccaatctcccagcacaactaccggcccgggtacttcacgcagaccgccggcccttggcacctggggaaacttgagttagatttcggcctgtgcgaaggcaccaccgtcgtggtggacgagcattgcgggaaccgaggcccctctcttcggacgacgacagtcaccgggaagatcatccacgagtggtgctgccgctcctgtacgctaccgccactgcggttccgcggtgaggatgggtgctggtatggcatggagatccggcccgtgaaggagaaggaggaaaacctcgtgcgcagcatggtctccgcaggcagcggggaggtggacagcttctccctgggcatcctgtgcgtgtccatcatgatcgaggaggtgatgcggtccagatggtcgaggaagatgctcatgaccgggaccctggccgtgtttctgctcctgatcatgggccagctgacctggaacgacctcatccggctgtgcatcatggtgggggcgaacgcctccgaccgcatggggatgggcacgacctacctggcactcatggccaccttcaaaatgcgcccgatgttcgccgtagggttgctattccgccggctcaccagccgcgaggtgctgctgctcacgattggcctgtccctggtggcgagtgtcgagctacccaattcactggaggagctgggggacggcctcgctatgggcatcatgatgctgaagctgctcaccgagttccagccccaccagctgtggaccaccctgctcagcctgacgttcatcaagaccaccttctccctagactacgcctggaaaacaatggctatggtgctctctatcgtctcgctattccccctgtgtctcagcacgacctcccagaagaccacctggctgccggtgctgctcgggagcttcggctgcaagcccctgactatgttcctgatcaccgagaacaagatctgggggcggaagtcctggcccctcaacgagggcatcatggcgatcggcatcgtgagcatcctgctgtccagcctcctcaagaatgacgtccccctggccggcccgctcatcgccggcgggatgctgatcgcctgctacgtcatttcgggctcaagcgccgacctgtccctcgagaaggcggccgaggtgagctgggaggaggaggccgagcactcaggtaccagccacaacattctcgtcgaggtgcaggacgacggtactatgaagattaaggacgaggagcgcgatgacaccctgacgatcctcctaaaggccaccctgctcgccgtgtccggggtctacccaatgagcatccccgcgaccctgttcgtgtggtacttctggcagaagaagaaacaacggtccggcgtgctgtgggacacacccagtcctcccgaggtggagcgcgccgtgctcgatgacggcatctaccggatcctgcagcgcgggctcctgggccggtcccaggtgggagtcggcgtgttccaggacggggtgttccatacgatgtggcacgtaacccgcggcgccgtgctcatgtaccagggcaaacgtctggagcccagctgggccagcgtgaaaaaagacctgatcagttacgggggcgggtggcgcttccagggctcctggaacaccggggaggaggtccaggtgatcgccgtggaacccgggaagaacccaaagaacgtccagactactcccggcacgttcaagacccccgagggggaggtgggggcgatcgccctagacttcaagcccggcaccagcggctccccaatcgtcaaccgggagggcaagatcgtcgggctgtacggcaacggcgtggtgacgacctcaggcacctacgtctccgctatagcccaggccaaggcaagccaggaggggcccctgcccgagatcgaggacgaggtgttcaagaaacgcaacctcaccatcatggacctgcaccctggcagcggcaaaacgcggcgctacctgcccgccattgtgcgggaggcaatcaagcgcaagctccggacactaatcctggcccccactagagtcgtggcctccgagatggccgaggccctcaaggggatgcctatccgctaccagaccacggccgtcaagagcgagcacaccggccgggagattgtcgatctaatgtgtcacgccaccttcaccatgcgcctgctctccccggtgcgggtgccgaactacaatatgatcatcatggacgaggcgcacttcacggaccctgccagcatcgccgctagagggtacatctccacccgtgtcggtatgggggaagccgcggccatcttcatgaccgccacgccacccggcagcgttgaggccttcccccagtccaacgcagtgatccaggacgaggagcgggacatccctgagcggagctggaactccggctacgactggatcacggacttcccggggaagaccgtctggttcgtgcccagcattaagtccggcaacgatatcgcgaactgtctgagaaagaacggaaagcgggtgatacagctaagccgcaagaccttcgacaccgagtaccagaagacaaagaacaacgattgggactacgtcgtgaccaccgatatctccgagatgggcgccaacttccgggcagatcgcgtgatcgacccgcggcgctgtttgaagcccgtcatcttgaaggacgggcctgagcgggtaatcctggcaggccctatgcccgtgacagtcgcgagcgccgcccagaggagaggccgcatcggaaggaaccaaaacaaggagggcgaccaatacgtgtacatggggcagcccctcaacaacgatgaggatcacgcacactggacggaggccaagatgttgctggataatatcaacacccccgagggcataatcccggccttgttcgagcccgagcgcgagaagtccgccgcgatcgacggggagtatcgcctgcggggcgaggcccgcaagaccttcgtcgagctgatgcggcgaggcgacctccccgtgtggctgtcctacaaagtggcctccgaagggttccagtacagcgaccggcgctggtgcttcgacggcgagcggaacaatcaggtcctcgaggagaacatggacgtggagatctggaccaaggagggggagcgcaagaaattacggcccagatggctggacgcgcggacgtactcggacccgctggccctacgcgaattcaaggagttcgccgccggccggcgcagcgtcagcggcgacctgatcctggagatcgggaagctcccccagcacttaaccctgcgggcccagaacgcgctcgacaacctggtcatgctgcacaactccgagcagggcgggaaggcctaccgccacgccatggaggagctccccgacaccatcgagaccctgatgcttctcgccctgatagctgtgctgacaggcggggtcaccctatttttcctgtccggcaagggcctcgggaagacctcgatcggcctcctctgcgtcatggccagctccgcgctgctatggatggcctccgtggaaccccactggatcgccgcgtccatcatcctggagtttttcctgatggtgctccttatcccggaaccggaccggcagcgcacgccccaggacaaccagttggcctacgtggttatcgggctcctgttcatgatcctgaccgtggccgcaaacgagatgggcctcctggagacaaccaagaaggacctgggaatcggccacgtggccgcggagaaccaccaccacgccactatgctcgacgtggacctgaggccggccagcgcctggaccctgtacgccgtggccacaacggtcatcacccccatgatgcgccacaccatcgagaacacgaccgccaacatctccctcaccgccatcgccaaccaggccgcgatcctcatgggcctggacaaggggtggcccatctctaaaatggacatcggcgtgcccctcctggccctggggtgctacagtcaggtcaatccgctcaccctgaccgccgccgttctaatgctagtggcgcactatgccatcatcggccccgggctgcaggccaaggccacccgggaggcccagaagcgcaccgcggcaggcatcatgaagaaccccaccgtagacggcatcgtcgccatcgacctggaccccgtagtttacgatgccaagttcgagaaacagctcgggcagatcatgctgctgatcctctgcacgagccagatcctgttgatgcgcaccacctgggccctatgcgagtccatcaccctggccacaggcccgctgaccaccctctgggaggggagccctggtaagttctggaacaccacgatcgccgtctccatggccaacatcttccggggcagctatctggccggggctggcttggcgttctccctcatgaagtccctcggaggcgggagacgggggaccggcgcccagggggagaccctcggcgagaagtggaagcggcagctcaaccagttgtccaagagcgagttcaacacctacaagcggagcgggattatggaggtggaccgctccgaggccaaagagggcctgaagcgcggggagacgaccaagcacgccgttagccgcggcaccgcgaagctgcggtggttcgtcgagcgcaacctggtcaaaccggagggtaaggtgatcgacctggggtgcggacgcgggggctggtcctactactgcgccggtctaaagaaggtcaccgaggtgaagggctacacgaagggggggcccggccacgaagagccgattcccatggccacctatgggtggaacctcgtgaagctgcacagcggcaaggacgttttcttcacgccgcctgagaagtgcgacacccttctatgcgacatcggggagtccagcccgaaccccaccatcgaggagggccgcaccctgcgggtgctcaagatggtggagccctggctccgcggcaaccagttctgtatcaaaatcctgaacccctacatgcctagtgtagtggagacgctggagcagatgcaaagaaagcacgggggcatgctcgtccgcaacccactgagcagaaactctacccacgagatgtactgggtcagctgcgggaccggcaacatcgtgtccgccgtgaacatgacgagccgcatgctgctcaaccggtttacaatggcccaccgcaagcctacctatgaacgtgacgtcgacctgggcgcggggaccaggcacgtagccgtggagcctgaggtcgccaacctggacatcatcgggcagcgcatcgagaacattaagaacgagcacaagtccacgtggcactacgacgaggacaacccgtataagacctgggcataccacgggtcgtacgaggtgaagccctccggcagcgcctccagcatggtgaacggagtcgtgcggctcctgaccaagccctgggacgtcatccccatggtgacccaaatcgccatgacggacactaccccgttcggccaacaacgcgtgttcaaggagaaggtcgacaccaggacgccccgcgcgaagcggggcaccgctcagatcatggaggtgaccgccaagtggttgtgggggttcctctcccgaaacaagaaaccgcggatttgcacacgcgaggagttcacccggaaggtgcgcagcaacgccgcgatcggcgcagtcttcgtagacgaaaaccagtggaacagcgccaaagaggccgtggaggacgagcggttctgggacctggtacaccgcgagcgggagctgcacaagcaggggaaatgcgcgacctgtgtctataacatgatgggcaagcgcgagaaaaagctcggggagttcggcaaagccaagggctcccgggcaatttggtacatgtggctgggggcccgcttcctagagttcgaagccctcggcttcatgaatgaggaccactggttcagccgagagaactccctgagcggggtggagggcgaggggctgcacaagctcgggtacatcctgcgcgacatctccaagataccgggcggtaacatgtacgccgatgacaccgccggctgggacacccggatcactgaggacgacttacagaacgaggccaaaatcacggacattatggagcccgagcacgcactcttggccacaagcatcttcaagctgacctaccaaaacaaggttgtgagagtacagcggcccgcgaaaaacgggactgtcatggacgtaatttcccggcgcgaccagcgaggaagcggccaggtggggacctacggtctcaacacgttcaccaacatggaagtccagctgatccgccagatggagtccgaggggatcttcctgccctgcgaactcgagacgccgaatctggccgagcgtgtgctggactggctcgagaagcacggggccgagcgtctgaagcggatggccataagtggggacgactgcgtggtcaagcccatcgacgaccgcttcgccaccgcgctgatcgccctcaacgacatgggcaaggtgcggaaggacatcccccagtgggagccttccaagggctggaacgactggcagcaggtcccgttctgctctcaccattttcaccagctgataatgaaggatgggcgcgagatcgttgtgccctgccggaaccaggatgagctggtgggcagggcccgggtctcacagggggccggctggagcttgcgcgagaccgcctgcctcgggaagtcctacgcacagatgtggcagttaatgtacttccaccggcgcgacctccggctggccgcgaatgccatctgcagcgcagtaccagtggactgggtcccgacctcccgcacgacatggagcatacacgcccaccaccaatggatgaccaccgaagacatgctgagcgtgtggaaccgggtgtggatcgaggagaacccgtggatggaggacaagacccacgtctccagctgggaggaggtcccatacctcggcaagcgcgaggaccagtggtgcggctccttgatcgggctgacgacccgcgccacctgggcaaccaacatccaggtggccatcaaccaagtgcggcgcctaattggcaacgagaactacttagactacatgacgagcatgaagcggtttaagaatgaatccgaccccgagggggcgctgtggtga

SEQ ID NO: 24019 - RNA, 9879 nt, synthetic construct
  misc_feature 1..9879: note = derived and/or modified CDS sequence (opt11) from DENV-1__FJ410179__SS-prME
  source 1..9879: mol_type = other RNA
tccgtaaccatgctgctcatgctgctgcccacggccctcgccttccacctgaccacgcgtggcggggagccccacatgatagtgtctaagcaggagcggggcaagagcctcctgtttaaaacctctgctgggataaatatgtgcacgctgatagcaatggatctgggcgagctctgcgaggatacgatgacctacaagtgcccccggattacggaggcggagcctgacgacgtagattgctggtgcaacgccacggacacttgggtgacttacgggacgtgcagccagaccggcgagcatcggcgcgacaagcgatccgtcgctctggcgccccatgtgggcctagggttggagacccgcaccgagacgtggatgtcctccgagggcgcctggaaacaaatccaaaaggtggagacctgggcactgcggcaccccgggttcacggtgaccgccttgttcctagcccatgccatcggaaccagtatcacccagaaggggataatattcatcttattgatgctcgtgacgccgagcatggccatgcgctgcgtggggataggaaaccgcgatttcgtggaaggcttgtcgggcgccacctgggtggacgtggtcctggaacacggttcctgcgtcaccacaatggcgaaggacaagcccacgctagacattgagctgttgaagaccgaggtgaccaacccggcggtcctccgcaaactatgcatcgaagccaaaatcagtaacaccaccacggactccaggtgtccgacgcagggcgaagccaccctggtggaggagcaagactccaacttcgtgtgccgccggaccttcgtcgaccgcggttgggggaacggttgtggcctcttcggaaagggctctctgctgacctgtgccaagttcaagtgcgtaactaaactcgagggcaaaattgtacagtacgagaatttaaaatacagcgttatcgtcaccgtacacacaggcgaccagcaccaagtcgggaacgagaccacggaacatggaaccatcgcgaccatcacgccccaggcgcccacctccgagatccagctgacggattacggggccttgaccctggactgctcgcctcgcacgggcctggacttcaacgagatggtgctactgaccatgaaagagaagtcctggctggtccacaagcaatggttcctcgacctgcccctgccctggacaagcggggccagcacctcccaggaaacgtggaaccgacaagacctgctggtgaccttcaagacggcccatgcgaagaaacaggaggtggtcgtactgggtagccaggaaggcgcgatgcatactgccctcacaggggccaccgagatccagacctccggcaccaccaccatattcgcagggcacttgaagtgccggttgaagatggacaaattaactctgaagggcatgagctacgtgatgtgcaccgggagttttaagctagagaaggaagtcgccgagacgcaacacggaaccgtgctcgtccaggtcaagtacgagggcaccgacgcgccgtgtaagatacccttcagcgcccaggacgagaagggtgtgacccaaaacggtcgcttaatcacggccaatccgatcgttacggacaaagagaagcctgtcaacatcgaaacggagccgcccttcggtgagtcctatatcgtggtcggcgcaggagaaaaggcactgaagctgagctggttcaagaagggttctagcataggtaagatgtttgaggccacagcccgcggggcgcgacggatggccattctcggtgacacggcgtgggacttcgggtccataggcggtgtattcactagcgtcggcaagctcgtgcatcaggtattcggcgctgcctacggagtgttgttcagtggcgtgagctggactatgaagatcgggatcggcatcctcctgacctggctgggcctcaactcccgttcgacgagcctgagcatgacctgtatcgcagttgggatggtgaccctgtacctcggcgtaatggtccaggctgatagcggttgcgtgattaactggaaaggccgagagctgaagtgtgggtcgggaatctttgtgacaaacgaggtccacacgtggacggagcagtacaagttccaggcggacagcccgaagcgtctttccgccgcgatcggcaaggcttgggaggagggggtttgcggcattcgcagcgccacgcgtctcgagaacattatgtggaaacagatcagcaacgagttgaaccacatccttttagagaacgacatgaagtttactgtggtcgtgggggacgctaacggcatcttagcgcaagggaagaaaatgatccggccccagcctatggagcacaggtacagctggaagtcctggggaaaggccaagatcataggcgccgacatccaaaacagtaccttcatcatcgacgggcctgacacgcccgaatgccccgacgaccagcgcgcgtggaatatctgggaagtagaggactacgggtttgggatttttacgaccaacatttggctgaagcttcgggactcctacacccagatgtgtgaccaccgcctgatgagcgcagccatcaaagactccaaggccgtccacgcagacatggggtattggatagagtcggaaaaaaacgagacttggaagctagcgcgcgcctccttcattgaggtaaagacctgcatctggcctaagtcgcacaccctctggtccaacggggtgctggagagtgagatgatcatccccaagatgtacggaggtccgatttcccaacacaactaccgccccgggtacttcactcagaccgcgggcccgtggcatctgggcaagctcgagctggacttcgacctgtgtgaaggtacaactgtcgtagtcgacgaacactgcggcaaccggggcccgtcgctccgcactacgaccgtcactgggaaaatcatccatgaatggtgttgtcggtcctgcacgctgccgccgctgcgcttccgcggtgaggacggctgttggtacgggatggagatccgccccgtgaaagagaaggaggagaacttggtgcggtcaatggtaagcgcagggtccggggaggttgacagcttcagccttgggatcctctgtgtgagcataatgatcgaggaggtcatgaggtccagatggagcagaaaaatgctgatgacgggcaccctggcggtgttcctcctcttaatcatggggcagctcacttggaacgacttaataaggctgtgcattatggtgggggcgaacgcctccgaccgaatggggatgggcaccacgtacttggccctcatggccacctttaagatgcgccccatgttcgccgtcgggctgctgttccggcggctcacctctcgggaggtgctgctcctcaccatcgggctgtcgctggtggcctcggttgagcttcctaacagtctggaggagctgggtgacgggctagccatgggcatcatgatgctcaagcttttaacggagtttcagcctcaccaactgtggaccaccctactcagcctgacgttcatcaagaccaccctgtccctcgactacgcctggcgcaccatggccatggtgttgagcatcgtctccctgttccccttgtgcctatcgaccacctcccagaagactacctggctgccagtgctcctgggctcgttcgggtgcaagcccctgaccatgttcctcatcactgagaacaagatatggggcagaaagagttggccgctgaacgaaggcattatggcaatcggcatagtgagcatcctgttgagctccctgctgaagaacgacgttcccctcgccgggccacttatcgctggtggcatgcttatcgcctgctacgtcatctcgggatcgagtgcagacctctccctagagaaagcggccgaggtgagctgggaggaggaggcggagcactccggcacctcgcataacattttagtcgaggtgcaggatgacggcacgatgaagatcaaggacgaggaacgcgatgacacactgaccatcctgctgaaggctacgttactggccatctccggcgtgtaccccatgagcattcctgcgacactattcgtatggtacttctggcagaagaaaaagcagcggtctggagtcctctgggataccccaagcccgcccgaggtggagcgggccgtcttggacgacggcatttaccggatcctgcagcgcggtctcctcgggaggtcccaggtgggagtgggtgtcttccaggacggtgtattccatacgatgtggcacgtgacgcgcggggccgtgctgatgtatcaaggcaagagactggagccctcatgggcctccgtgaagaaggacctaatcagctacggcggaggctggcggttccaaggctcctggaacaccggcgaggaggtgcaagtcatcgccgtggaacccgggaagaacccgaaaaatgtgcagaccacccctggcacgttcaagactcccgagggcgaggtcggagcgatcgcccttgacttcaaacctggcaccagtggctcccccatcgtgaacagagagggcaagatcgtgggcctgtacgggaatggcgttgtaaccacgagcggcacctacgttagcgccattgcccaagcaaaaacctcccaggagggccccctccccgagatagaggaggaggtcttcaaaaagagaaacttgaccatcatggacctacaccccgggtcaggcaaaacgagaaggtacctccccgcgatcgtacgggaggctatcaagcgcaagctgcgcaccctgattctcgcccctacgcgtgttgtcgcctccgagatggcggaggcactgaagggtatgccaatccgctaccaaaccactgctgtcaagtccgagcataccgggcgagagatcgttgacctgatgtgccacgccaccttcaccatgcgcctgctatctccggtccgggtgcccaactacaacatgatcatcatggatgaggcgcattttactgaccccgcgtcgatcgccgccagaggttacatctccaccagagtgggtatgggcgaggccgctgcgatcttcatgacggcgaccccgccagggagcgtcgaggcctttccccagtccaacgccgtaatccaggacgaggagcgcgacatccccgagcggagctggaactctggttatgactggatcacggacttccctggcaagaccgtgtggttcgtccccagcatcaagtccgggaacgacatagctaactgcctgcgcaagaatggcaagcgtgtgatccagctcagccgcaagacgtttgacacggagtaccagaaaacgcggaataacgactgggactacgttgtaaccaccgacatttccgagatgggggcgaacttccgcgcggaccgagtgatcgacccccgccggtgcctgaagcccgtgatattaaaggacggccccgagcgcgtcatcctcgccgggccaatgcccgtgaccgtggcaagcgctgcccagcggcgcggacgcatcggccggaaccaaaacaaagagggggatcagtacgtttatatggggcaacccctgaacaacgatgaggaccacgcccactggacggaggccaagatgctgctcgacaacatcaacacccccgaagggatcatcccggctctgttcgagcccgagcgtgagaagtccgcggccatcgatggtgagtaccgtctgcgcggggaggctcggaagaccttcgtggagctcatgcgcaggggcgacctgcccgtttggcttagctataaagtggccagcgaaggatttcagtatagcgaccgccgatggtgcttcgacggggaacgcaacaatcaagtcctcgaagagaacatggacgtagagatctggactaaggagggcgagcggaagaagttgcgcccacggtggctggatgctcgcacgtactcagaccctctcgcgctgcgtgaattcaaggagttcgccgctggtcgcagatcggtgagcggcgacctgatcctcgagataggcaagctgccccagcacctgaccctccgcgcgcagaacgcactagacaacctggtcatgctccacaactccgagcagggcgggaaggcgtacaggcacgccatggaggagttgccggataccatagagacactgatgctactggcgctcatagcggtcctcaccggcggcgtgactctgttcttcctgagcggcaaaggcctcggcaagacctccatcgggctgctgtgcgtgatggcgagcagtgcgctcctgtggatggccaacgttgagcctcattggatcgccgccagcatcatcttagaatttttcctcatggtgcttctgatccctgagccggacaggcagcggaccccccaggacaaccaattagcctacgtggtcatcggactgctgttcatgattctcaccgtggccgcaaacgagatgggtctgctagaaacgaccaagaaagacctcggcatcggtcacgtggccgccgagaaccaacaccacgccaccatgctggacgttgatctgcgcccggcctcggcctggacgctgtatgccgtggccacaacagtgatcacccctatgatgcgccatacaatcgaaaacacgactgctaacattagcctgacggccattgctaaccaggccgccatcctgatgggcctcgacaagggctggcccatctcgaaaatggacatcggggtaccactgctggcgctcggctgctactcgcaagtgaaccctctgactttaactgccgccgtgctcatgctggtcgcccattacgcgattatcggccccggactgcaggccaaagcgaccagagaagcccaaaagcgcaccgccgccgggatcatgaagaaccccacagtggacggtatagtcgccatcgacttggaccccgtcgtgtacgacgccaagttcgagaagcagctgggccagataatgctgttgatcttatgcacgtcccaaatacttctgatgcggacgacctgggccttgtgcgagagcatcaccctggccacggggcctttaactactctatgggagggctcccccgggaagttttggaatacgacaatcgcggtgagcatggcaaacatcttccgaggatcctacctggcaggcgccgggcttgcatttagcttaatgaagtccctgggagggggccggcgggggaccggcgcgcagggcgagacgctcggcgagaaatggaagcggcaactgaatcagctctcgaagagcgagttcaacacctacaaacgctcagggatcatggaggtcgaccggagtgaggccaaagaggggctcaagcgcggcgagacgactaagcacgccgtctcccgggggaccgccaagctgcgctggttcgtggagcgtaacctggtcaagccggaaggtaaggtgatagacctgggatgcgggaggggcggttggagctactattgcgcgggcctcaagaaggtgacggaagtcaaggggtacacgaaaggcggccccgggcacgaggagccgatcccgatggccacctacggatggaaccttgttaagctgtactccgggaaggacgtgttcttcacgccgcccgagaaatgtgacaccctactatgcgacatcggcgagagctccccgaatcccaccatcgaggaggggcggacgcttcgcgtcttgaagatggtggagccatggctgagaggcaaccagttctgcattaagattctgaacccctacatgccgagcgtcgttgagaccctcgagcagatgcagcgcaagcacggcggtatgctggtgcggaaccccctgtcccgcaactcgacgcacgagatgtactgggtatcatgcggtaccggcaacattgtcagcgccgtaaacatgacgtcccgcatgttgctgaacagatttactatgacccaccgcaagccgacctacgagcgggacgtggacctcggcgccggcacgcgccatgttgcggtcgaacctgaggtcgctaacctcgacatcatcgggcaacggatcgagaacatcaagaatgagcacaagtctacctggcactatgacgaagacaacccttacaagacctgggcatatcacggctcctacgaggtcaagccctcaggatccgcaagctcaatggtaaacggcgtggttcggctgctgacaaagccctgggacgtaatccccatggtcacgcaaatagccatgaccgacaccaccccgtttggacagcagcgggtgttcaaggaaaaagtggacacgcgcacgcccagagccaaacgagggaccgcccagataatggaggtcaccgccaagtggctctggggtttcctgtctcggaacaagaaaccgcgcatctgcacgagggaggagttcacacgcaaggtgcgcagcaacgccgccattggtgccgtgttcgtcgacgagaatcaatggaactcagctaaggaagcggtggaggacgagagattctgggaccttgtgcatcgggagagggagctccacaagcagggcaagtgcgcgacctgcgtctacaacatgatggggaagcgagagaagaagctgggagagttcgggaaggctaagggcagccgcgccatctggtacatgtggttaggcgcccggtttctcgagttcgaggctctggggttcatgaacgaggaccactggttctcccgcgaaaacagcttctccggcgtggagggggagggactgcacaagctcgggtacatcctgagggatataagcaagatcccaggcggcaacatgtatgccgacgataccgccggttgggacacgcggatcaccgaggacgacctgcaaaacgaggcgaagatcactgacattatggagcccgagcacgcgctcttagcgacctccatcttcaaactgacgtaccagaacaaggtggtcagggtgcagcggccggccaagaacggcaccgtgatggacgtcatcagccggcgtgaccaacgggggtccggccaagtaggcacctacgggctcaacaccttcacgaacatggaagtgcagctgatacggcaaatggagtccgaaggaatcttcctgccgtccgagctcgaaaccccgaatctggcggagcgcgtgttggactggctggaaaaacacgggactgagcggctgaagcgcatggcgatctcaggagacgactgcgtggtgaagccggtcgacgaccggttcgccaccgctctgatcgctctcaatgatatggggaaggtgcggaaggacatcccccagtgggagccctcaaaaggctggaacgactggcagcaggtcccattttgctcccaccacttccaccagctgatcatgaaagatggcagggagatagtcgtgccgtgccgcaaccaggacgaactagtagggcgcgcccgcgtatcccagggcgcggggtggtctctccgggagacagcctgcctgggcaagtcctacgcccagatgtggcagcttatgtacttccaccgccgagaccttcgcttagcagccaatgcgatttgcagcgccgtgccagtcgattgggttcccaccagccgcaccacctggtcaatccacgcacaccaccagtggatgacaaccgaggacatgcttagcgtgtggaaccgcgtgtggatcgaggagaacccgtggatggaggacaagactcacgtctctagctgggaggaagtaccatacctggggaaacgcgaggaccaatggtgtggaagcctgatcggcttgaccgcccgggcgacctgggccacgaatatccaggtcgctatcaatcaagtacgacgtctcataggtaacgaaaactatttggattacatgacctccatgaaaaggttcaaaaacgagtccgatccagagggggccctctggtag

SEQ ID NO: 24020 - RNA, 9879 nt, synthetic construct
  misc_feature 1..9879: note = derived and/or modified CDS sequence (opt11) from DENV-1__FJ410181__SS-prME
  source 1..9879: mol_type = other RNA
tcggtgacaatgcttctcatgctgctccccacggctctcgccttccatctcaccacacggggcggagagccccacatgatcgtctcaaagcaggagcgggggaagagcctgctgttcaagacgtcggttgggatcaacatgtgcaccttgatcgccatggacctgggtgagctctgcgaggacaccatgacgtacaagtgcccccgaatcacggaggctgagcccgacgacgtggactgctggtgcaacgcaaccgacacgtgggtaacgtacggcacctgttcgcagaccggggagcaccggcgggacaagcggtccgtggccctggcgccccacgtgggcctgggcctcgagacaaggactgagacatggatgagctccgagggcgcttggaagcagatacagaaggtcgagacttgggctctccggcaccctgggttcaccgtgaccgccctgttcttagcccacgcgatcggcaccagcatcacccagaaggggataatcttcatcttactcatgctcgtgacgccctccatggccatgcgctgtgtcggtattggcaatcgggacttcgtggaggggttgagcggcgccacctgggtggatgtcgtgctggagcacgggtcctgcgtgactacgatggcaaaagacaaacccacgctcgacatagagttactgaaaaccgaggtcaccaaccccgccgtactccggaagctgtgcatcgaggctaagatttccaatacaaccacagacagccggtgtcccacgcagggagaggccaccctggtggaggagcaggacagcaacttcgtctgccgccggacgtttgtggaccgcggctgggggaacggctgcggcctcttcggcaagggcagcctgctgacctgcgccaagttcaagtgcgtcacgaagcttgagggcaagatcgtccagtacgagaacctgaagtactcagtgatcgtgacagtgcacacaggcgaccaacaccaggtggggaacgagaccaccgaacacggcactatcgccaccattacgccccaggcccctacgtccgagatccagctgaccgactacggggcgctcaccttagattgttctccaagaacgggtctggacttcaatgaaatggtcctcctgaccatgaaggagaagtcgtggctggtgcacaagcagtggttcctagacctaccgctgccctggaccagtggggccagcacgtcccaggagacgtggaatcggcaggacctcctggttacctttaagaccgcccacgccaagaagcaagaggtcgtggtgctgggatcccaagagggtgcgatgcacaccgctctcacaggggccacagagatccagacctcaggcacgactaccatcttcgccggccacctgaagtgcaggctgaagatggataagctcaccttgaaaggtatgagctacgtcatgtgcaccggctccttcaagctggagaaggaagtagccgagacgcagcacgggacggtgctcgtccaagtgaaatatgagggtaccgacgcaccgtgtaaaatcccgtttagcgcgcaagacgagaagggggtgacccagaacggccgactcatcacggccaacccgatcgtcaccgacaaggagaagccggtgaatatcgaaacggagccgcccttcggtgagtcatatatcgtgatcggcgccggcgagaaggccctcaagctgtcatggtttaagaaagggtccagcattggcaagatgttcgaagcgaccgcaagaggggcccgccgcatggctatactcggcgacacggcctgggacttcgggtcgatcggcggcgtcttcacaagtgtagggaagcttgtgcaccaggttttcggcgccgcctatggggtgttattttctggcgtgtcatggaccatgaaaatcgggatcggcattctgctgacctggcttggcctaaactcccgtagcacatccctaagcatgacatgcatcgcggtggggatggttacgctgtatctcggggtgatggtccaggccgattccgggtgcgtgattaactggaagggcagagagctgaagtgcggcagcggcatctttgttaccaacgaggtccatacgtggaccgaacagtacaaatttcaagccgatagcccaaagcggctgtccgcggctatcggcaaggcctgggaggaaggggtctgcggcatccgctctgccacccggctcgagaacataatgtggaagcagatctctaacgagctgaaccacatcctgctcgagaatgacatgaaattcaccgtggtagtgggtgacgcgaacggcatcctggcgcaggggaagaagatgattcgcccgcagcctatggagcataggtacagttggaagtcctggggcaaggccaaaattatcggcgccgatatccagaacaccacctttatcatcgacggtccggacaccccggagtgtcccgacgatcagcgtgcctggaacatctgggaggtagaggactacggtttcgggatcttcactactaacatctggcttaagttgcgagactcctacacgcaaatgtgcgatcaccgcctgatgtcagcggccatcaaggatagcaaggccgtccacgccgacatgggctactggatcgaatcagaaaagaacgagacttggaagctagcccgggccagtttcatcgaagtgaagacctgtatctggcctaagtctcacaccttgtggagcaacggcgtgctggaaagtgagatgatcatccccaagatctatgggggccctatctcacagcacaactaccgcccagggtactttacgcagacagcaggcccctggcacctggggaagctcgaactggacttcgacctgtgcgaggggactaccgtggtggtggacgagcactgcggcaatcggggcccgtccctccgcacgacgacagtcacgggcaaaatcatccacgagtggtgctgccggagctgcacgctaccgcctctgcgattcagaggcgaggacggctgctggtacgggatggagatccgcccggtgaaggagaaggaggaaaacctcgtgcggtccatggttagcgccggcagcggcgaggtggactccttcagcctggggatcctgtgcgtttccattatgatcgaagaggtcatgcgcagccgttggtcccgtaagatgctaatgaccggtaccctggctgtcttccttctgctgatcatgggtcaactaacctggaacgatttaatcaggctatgcattatggtaggggccaacgcgagcgacagaatggggatgggcacgacctacctggctctgatggccacgttcaagatgcgccccatgttcgccgtcggtctgctatttcggagactcacctcccgggaggtgctactgctcactattgggctatcactggtggcgtcggttgagctcccaaactcactggaggagctgggggacgggctcgcaatggggatcatgatgctgaagctgctgaccgagttccagccccatcagctgtggaccaccctgctctcccttacgttcatcaagaccaccctttcacttgactacgcatggagaaccatggccatggtcctgagtatcgtcagcctgtttccgttgtgcctgagcacgacctcccagaagaccacctggctgccggtgctcctgggctccttcgggtgtaaacccttgacgatgttcctcatcacggagaacaagatctggggccgcaagagctggcccctgaacgagggtatcatggccatcggcatcgtctccattctcctgagtagtctgctgaagaacgatgtccccctcgctgggccgctgatcgccggcggaatgttaatcgcgtgttacgttatttccgggtcctccgcagacctcagcctggagaaggccgcggaggtgtcatgggaggaagaggctgagcacagcggcacatcccataacattctggtcgaggtgcaagacgacggcaccatgaaaattaaggatgaagagcgcgacgacactctcacgatattattgaaggccaccctcctggccgtgtcaggcgtctaccccatgtcaatcccggccaccctgttcgtttggtatttctggcagaagaagaagcaacggtcaggggtgctctgggacacccccagcccccccgaggtcgagagagcagtcctggacgacggcatctaccggatcctgcaacgtggcttgttaggtcgatctcaagtgggagttggggttttccaagacggcgtgttccatacgatgtggcacgttacccgcggggccgtgctcatgtaccaaggcaaaaggctagagccttcctgggcctcagtgaagaaggacctcatatcttacggcgggggttggaggttccagggttcgtggaacactggagaggaggtccaggtgatcgcagtggagccggggaagaatccgaagaacgtccagaccacgcccggaaccttcaagacccctgagggcgaggtgggtgccatcgcgttagacttcaagccaggcacctccggatcgcctatcgtgaaccgtgaggggaagatagtcggactgtacggtaacggcgtagtcaccacctccgggacatatgtctcggccatcgcccaggccaaaacctctcaagaaggccccttacccgagatcgaagacgaggtgttcaagaagcggaatctgacaattatggatctgcacccggggtccggcaagaccaggcgctacctccctgcaatagtccgggaggcgatcaagcgcaagctgcgcacactcatcttggcccccacccgggtcgtggcgagcgagatggccgaggcgttgaagggcatgcccattcgctaccagacaaccgcagtgaagtccgagcacaccggacgggaaatcgtagacctgatgtgccacgccacattcacgatgcgtctcctgagccccgtaagggtgcccaactacaatatgatcatcatggacgaggctcacttcactgatcccgcttctatagcggcccgcgggtatatcagcacccgggtcgggatgggcgaggccgccgccattttcatgacggccacgcctccggggtcggtggaggccttcccccagagcaacgctgtgatacaggacgaggagcgcgacatacctgagcggtcctggaacagcggctacgactggatcaccgactttcccgggaagaccgtatggttcgtgccctccatcaagtcggggaacgacatcgccaactgccttcgcaagaacggcaaacgggtgatccagctctcccgaaagaccttcgacacggagtatcagaagactaaaaacaacgactgggactacgtggttacaacagacatcagcgagatgggggcgaacttccgagctgacagagtgatcgacccccgacgctgccttaagccggtcatcctgaaggacggcccggagcgggtgatcctcgcagggcccatgcctgtgacagtcgcatccgctgcccagcgccggggcagaataggccgcaatcagaacaaggaaggggaccagtacgtgtacatgggccagcccttgaacaatgacgaggaccacgcacactggaccgaggcaaaaatgctgttggacaatattaacacccccgaggggatcattccggcgctgttcgaacccgagcgggagaagtccgctgcgatagacggcgagtaccgcctgcgcggggaggctcgcaagaccttcgtcgaactaatgcgccgcggggacttacccgtgtggctgtcctacaaggtggctagcgaggggttccagtactcagacaggcggtggtgcttcgacggggagcgcaacaaccaggtcctcgaagagaacatggacgtggagatttggacgaaggagggcgagcgcaagaaactcaggccccgctggctagacgcccgaacttatagtgatccgctcgcactgcgcgaattcaaagagttcgccgccggacggaggtctgtctcaggagatctgatcctcgagattggcaagctgccccagcaccttacactccgggcccagaacgcactagataacttggtcatgctccacaactccgagcagggtgggaaagcctaccgccatgcaatggaggagctgcctgacaccattgagaccttgatgctcctggccctgatcgccgtgctcaccggcggggtgaccctgttcttcctgtccggaaaggggttaggcaagacatcaatcgggctgctgtgcgtcatggcttcgagcgcgctcctgtggatggctaacgtggaaccccactggatcgcggcctccatcatcttggagtttttcttgatggtgctgctgatccccgagcccgacagacagcgtacgccccaggacaaccagctcgcctacgtcgtgattggcctgttgtttatgatcctcacggtcgcagcgaacgagatgggactgctggagaccaccaagaaggacctcgggatcgggcacgttgcggctgagaaccaacaccacgcaaccatgctggatgtggatcttcggccggcatcggcatggactctctacgccgtcgcaaccaccgtcatcacccccatgatgcgccacacgatcgagaacaccaccgctaacatctccctgaccgcaattgctaaccaggctgccattctcatgggcctcgacaagggatggcctatcagcaagatggatatcggagtgcccctgctggccttgggctgctattcccaggtgaacccgctcacgctgaccgctgccgtgctcatgctcgtcgctcactatgccatcatcggccccggactgcaggctaaagccacccgtgaagcacaaaaacgaaccgccgccggtatcatgaagaaccccactgtggacggcatagtcgcaatcgacctcgaccccgtggtctacgatgccaagttcgagaagcagttaggccagatcatgctgctcatattatgtacaagccaaatcctgctcatgcgcactacctgggccttatgcgaatcgatcacgctggccaccgggccgctaactaccctctgggaaggcagccccgggaagttttggaacactactattgccgtcagcatggcgaatatcttccggggcagctacctggcaggcgccgggctcgccttttccctcatgaagtccctcggcggtggacgacggggaacgggcgcccagggcgagaccttgggggagaagtggaagcggcaactgaaccaactgagtaagagcgagtttaatacgtacaagcgtagcggcatcatggaggtggaccgctccgaggcgaaggaagggttaaagcggggcgagaccaccaagcatgcagtgagccgagggaccgccaagctgcgttggttcgtggagcgcaacctggtgaaacctgagggcaaggtgattgacctgggatgtggtcggggagggtggtcatactattgcgccggccttaagaaggtcacggaggtgaaggggtacactaagggcgggcccgggcacgaggagccgatccccatggcgacctacggctggaacttagtgaagctgtacagcggaaaggacgtcttcttcacgccgcccgagaagtgcgataccctactctgcgatatcggtgagtccagccctaaccccaccatcgaggagggccgcacactgcgggtgcttaagatggtggagccctggctgcgcggtaaccagttttgtatcaagatcctgaacccctatatgccgtccgtcgtggagacactcgagcagatgcaaaggaagcacggcggaatgttagtgcgaaatcccttgagccggaattccacacacgagatgtactgggttagctgcggaacggggaacattgtttccgccgtgaacatgacgtctcggatgctcttaaaccgcttcaccatggcccacaggaagcccacctacgaaagagacgtcgacttaggagccggcactcggcacgtggccgtggagccagaagtggcgaacctcgacatcattggtcagcgcatcgagaatatcaaaaacgagcacaagtccacctggcactacgacgaggacaacccgtataagacatgggcctatcacggaagctacgaagtgaagccttccgggagcgcatcgagcatggttaatggcgtcgtgagactgctgaccaagccctgggatgtcatccccatggtgacgcagatcgccatgaccgacaccacccctttcgggcaacagcgcgtgttcaaagaaaaggtcgacacgcggacgccccgggccaagaggggcacagcgcagattatggaagtcaccgccaaatggctctggggtttcctgtcccgtaacaagaagccccggatatgcacgagagaagaattcacccggaaagtgagaagcaacgcagccatcggggcagtcttcgtggacgagaaccagtggaacagcgcgaaggaagccgtggaagacgagcggttttgggacctggtttaccgcgagagagaattacacaagcaaggcaagtgcgcgacctgcgtctacaacatgatggggaagcgcgaaaagaagctgggcgagttcgggaaggccaagggctcgcgggcgatctggtacatgtggctgggcgcgaggtttctcgagttcgaggccctgggatttatgaatgaggaccactggtttagccgggagaactccttcagcggcgtggaaggggaaggcctgcacaagctgggatacatcctgcgcgacatctccaagatccccggtgggaacatgtacgccgatgacaccgccgggtgggacacgcgcatcactgaggacgacctgcagaacgaggcgaagatcaccgatataatggagccggaacacgcattactggccacttccatcttcaaacttacataccagaacaaggtagtgcgggtgcagagaccggctaagaatggcacagtcatggatgtgatctcccggcgcgatcagcgtgggagcggacaggttggcacctacgggctcaacaccttcacgaacatggaggtacagttgatacggcagatggagtctgaggggatcttccttcccagcgagctcgagacccctaacctggccgaaagagttctcgattggctcgagaagcacgggaccgaacgactgaagagaatggcgatcagtggcgacgactgcgtggtcaagcctgtggatgaccgctttgccaccgcccttatcgcgctgaatgacatggggaaggtgcgaaaagatatcccccaatgggagcccagtaaaggctggaacgattggcagcaggtcccattttgcagtcatcacttccaccagctgatcatgaaggacggccgagagatcgtcgtgccctgtaggaaccaagacgagctggtcgggcgcgcgcgggtgagccagggcgcggggtggtccctacgcgagacggcctgtctgggaaagagctacgcccagatgtggcaactgatgtactttcacagacgcgatctccggctggcagcaaacgccatctgctccgccgtgcccgtcgattgggtgcccaccagccgcactacctggagtatccacgcgcaccaccagtggatgaccacggaagacatgctttctgtttggaaccgcgtctggatcgaagagaacccgtggatggaggataagacccacgtgagcagttgggaggaggtgccgtacctcgggaaacgggaggaccagtggtgcggcagcttaattggcctgacggctcgagcgacctgggccaccaatatacaagtcgccatcaaccaggtgaggcgcctcatcgggaatgagaactacctggactacatgacttcgatgaaacggtttaaaaatgagagcgaccctgagggcgccctgtggtga

SEQ ID NO: 24021 - RNA, 9879 nt, synthetic construct
  misc_feature 1..9879: note = derived and/or modified CDS sequence (opt11) from DENV-1__FJ547086__SS-prME
  source 1..9879: mol_type = other RNA
tccgtgaccatgctgctcatgctgctgccaaccgcccttgccttccacctgaccacccggggcggggagccgcatatgatagtgtcgaagcaggagcgcggcaagagcctcctctttaagaccagcgctggtgtgaacatgtgcacgctgatcgccatggacctgggcgagctctgtgaggataccatgacctacaagtgcccccggatcaccgaggccgagcccgacgacgttgactgctggtgcaacgccaccgacacgtgggtgacctacggcacctgctcgcaaacgggagaacaccggagagacaagcggtccgtggccttagctccgcacgtgggacttgggcttgagactcgcacagagacatggatgagctccgagggcgcctggaagcagatccaaaaggtcgagacctgggccttgcggcaccccgggttcacggtcatcgccttctttctggcgcacgccatcggcaccagcatcacccagaagggtattatctttatcctcctgatgttggtgaccccctccatggccatgcgctgcgtcggtatcgggaaccgggacttcgtggagggactcagcggggccacgtgggtggacgttgtgctggagcacgggtcctgcgtgaccaccatggccaagaacaagcccaccctggacatcgagctcctgaagacggaggtcaccaacccggcagtgctgcgcaagctctgcatcgaggctaaaatcagcaacaccaccactgactcccgatgcccgacccagggcgaggcgaccctggtcgaggagcaggacgccaacttcgtctgccgccggaccttcgtggatcgcggctgggggaatggatgtgggctgttcggcaaggggagcttactgacgtgcgccaagttcaagtgcgtaaccaaactcgagggcaagatcgtgcaatacgagaacttaaagtactccgtaatcgtcaccgtccacaccggcgaccagcatcaggtggggaacgagacgaccgagcacggcaccattgcgaccataacgccccaggcccccacaagcgagatccagctcacggactacggcgctctgacattggactgcagcccaaggaccggcctggatttcaatgagatggtcctgctcacgatgaaggagaagtcctggctggtgcacaagcagtggttcctggacctcccgctgccctggactagcggggccagcacaagtcaagaaacgtggaaccgccaggatctgctcgttacgttcaagaccgcccacgctaagaagcaggaggtggtggtgctgggctcccaggagggagccatgcataccgccctaaccggggcgacggaaatccagaccagcggcaccaccacaattttcgccgggcacctcaaatgtcgcctaaagatggacaagttgaccctcaagggcatgtcctacgtgatgtgcaccgggagcttcaagctggagaaagaggtagcggaaacccagcacggcactgtcctggtacaggtcaagtacgagggcaccgacgccccctgtaagatacccttctccacccaggacgagaagggtgtgacccagaatggccgccttatcacggccaatccgatcgtcactgacaaggaaaagccagtgaacatcgaaactgaaccgcctttcggggagtcttacatcatggtgggcgctggcgagaaagccctcaagctgtcctggttcaaaaaggggagctcgatcggcaagatgtttgaggccaccgctcgcggcgccaggcgaatggccattctgggcgacaccgcgtgggacttcgggtcaatcggcggcgtcttcacctcagtggggaaactcgtgcaccaggtctttggcactgcctacggagtactgttcagcggcgtttcctggaccatgaagatcggtatcggcatcctgctcacgtggctgggcctgaacagccgctccgccagcctctccatgacctgcatcgccgtcggtatggtcaccctgtacctgggcgttatggttcaggccgacagcgggtgcgcgatcaactggaagggccgcgagctcaaatgtgggtccggcatctttgtgaccaatgaggttcacacgtggaccgagcagtacaagtttcaggccgacagcccgaaacggttgtcagccgccatcggcaaagcatgggaggagggggtatgcggtattcgctctgctacccggcttgagaacatcatgtggaagcagataagtaacgagctcaaccacatcctgctggagaacgatatgaaatttaccgtggtggtcggggacgccaacggcatcttggcccaggggaagaagatgatccgcccccaacccatggagcacaagtactcttggaaatcatggggcaaggccaagatcattggcgcggacattcagaatactacattcatcatcgatgggcccgacaccccggagtgccccgacgatcaacgggcctggaacatctgggaggttgaggactacggcttcgggatcttcaccaccaacatctggttgaagctgcgcgactcctatacgcagatgtgcgaccaccgactcatgagcgccgccatcaaagactccaaggctgtgcacgccgacatgggctattggatcgagagcgagaagaacgagacctggaagctggcccgcgcctcctttatcgaggttaagacttgcatctggcccaaaagccacaccctttggtccaatggtgtgctcgagagcgagatgatcatccccaagatctacgggggccctatcagtcagcataactatcggcccgggtacttcacgcagaccgccggaccctggcatctagggaagttagagctcgactttgacttatgcgagggcaccaccgtggtcgtggacgagcattgcggcaaccgcgggccgagcctgcgtacaaccaccgtgaccggcaagatcatacatgagtggtgttgccggtcctgcactctgccgcccttacggttccgcggggaggacggctgctggtacggaatggaaatcagacccgtcaaggagaaggaggagaacctggtgcgctccatggtgtctgcgggatctggcgaggtagacagcttcagtctcggcatcttgtgcgtctcaatcatgattgaggaggtgatgcggtcccgctggagccggaagatgttaatgaccggcaccctcgcggtctttttactgctaataatggggcagctcacctggaacgacctgatccgcttatgcatcatggttggggccaacgcctccgacagaatggggatgggcacgacctatctggccctgatggcaacattcaaaatgcggcctatgttcgcggtgggcctgctgttccgccggctgacttcccgcgaggtgttactcctgacgatcgggctctccctggtcgccagcgtggagctgcccaattccctcgaagagcttggcgacgggttagcaatgggcatcatgatgctcaagcttctgaccgagttccagccccaccagctctggaccaccctactgagcttgactttcattaagactaccctgagcctggactacgcctggaaaacgatggcgatggtcctcagcatcgtgtccctgttccccctgtgcctctcaacaacttcacagaagacgacctggctgcctgtacttttaggcagcttcggctgcaagcccctgacgatgttcctgatcaccgagaacaagatctggggccggaagtcctggcccctcaacgaggggattatggccatcggcatcgttagcatcctgctgtccagcctactgaaaaacgatgtgcccctggccgggccgctcatagccgggggcatgctgatcgcctgttatgtcatctctgggtccagcgcggacctgtccctcgagaaagccgccgaggtatcttgggaggaggaggccgagcactcgggcaccagccacaacatcctggtggaggtccaggacgacgggaccatgaaaatcaaggacgaggagcgcgatgacactttaactatcctcctgaaggctaccctgctcgcggtgtccggcgtataccccatgagcatccccgccaccttattcgtctggtacttctggcagaagaagaagcagcggtccggggttctctgggacaccccctcaccgcccgaggtggagcgcgccgtcctcgacgatgggatataccggatcctgcagaggggcctgttggggcggtcccaggttggcgtgggggtctttcaggacggcgtgttccacacgatgtggcacgtgacccgcggggccgtcctcatgtatcaaggcaagcggttggaacccagctgggcctccgtgaagaaggacctgatcagctatggggggggatggagattccaggggtcctggaacaccggggaggaagtccaggtcatcgcggtggaacccgggaaaaacccgaaaaacgtgcagaccacgccaggcacctttaagacccccgagggcgaggtcggggccatagctctcgattttaagccaggcaccagcgggtcaccgatcgtgaaccgggagggaaagatcgtaggcctgtacgggaacggtgtcgtgacaacctccgggacctacgtgagtgctattgcacaggcgaaggccagccagcaaggccccctgcccgagatagaagacgaggttttcaagaaacgcaacctgaccatcatggacctgcacccggggagcggcaagacgcgacgctacctgcccgccatcgtgcgggaggcaataaagagaaagttgcggacgctgattctggcgcccacgcgcgttgtagcctccgagatggccgaagccctcaagggcatgcctatccgctatcagaccacggccgtcaagagcgagcacaccgggcgtgagatcgttgatttgatgtgccacgcgaccttcaccatgcgcctgctctcccccgtccgggtgcccaactacaacatgatcatcatggacgaggcccatttcacagaccccgcaagcatcgccgccagaggctatatatccacccgggtggggatgggcgaggcggccgcgatcttcatgaccgcaacgccaccagggagcgttgaggccttcccacagtccaacgctgtgatccaggatgaagagagagacatccccgagcggagctggaattccggctatgactggatcacggacttccccggcaagaccgtgtggttcgtgcccagcataaagtccgggaacgacatcgccaattgcttgagaaagaatggcaagcgggtaatccaactgtctcgcaaaaccttcgacaccgagtaccagaaaaccaagaacaatgactgggactacgtggtcaccacggacatctccgagatgggggccaacttccgggccgatcgcgttatcgacccccggcgctgtctcaagcccgtaattctgaaggacggccccgagcgggtcatcctggctggaccgatgcccgttaccgtggccagcgccgcccagcgccggggtcgaatcggcagaaatcagaacaaagagggggaccagtacgtttacatgggccagcccttgaacaacgacgaggaccacgcccactggacggaggcgaaaatgctgctagataacatcaatacccccgaagggattatcccggccctcttcgagcccgagcgcgaaaagtccgccgccatcgacggcgagtaccggctcaggggcgaggcccgcaagaccttcgtggagcttatgcggcgcggcgacctccccgtctggttaagctataaggtggcgtccgaaggcttccagtacagcgaccggagatggtgcttcgacggggagcggaacaaccaggtgctggaggagaacatggacgtcgagatttggaccaaggagggcgagaggaagaagctccggccccggtggctagatgcccggacctactcagacccactggccctccgcgagttcaaggaattcgctgccgggcggcgcagcgttagcggggatttgatcctggagatcgggaagctcccccagcacctgacactgagagcgcaaaacgccctggacaacctggtgatgctgcacaattccgagcagggcggcaaagcataccgccacgctatggaagaactccccgacaccatcgagacccttatgcttctcgcgctaatcgccgtgctgaccgggggcgtgactctcttcttcttgagcgggaagggcctgggaaagacctccatcgggctactgtgcgttatggctagctccgccctgctttggatggccagcgtcgagccccactggatcgccgcctccatcatacttgagttcttcctgatggtgctcctgataccggagcctgaccggcaacgcacgccgcaggacaaccaactggcatacgtcgtaatcgggctcctgttcatgatcctgacggtagccgcaaatgagatgggtctcctggagacgaccaagaaggacctgggcattgggcacgtggcagcggagaaccatcaccacgcaaccatgctcgacgtggaccttcggccggccagcgcgtggactctgtacgcggtggccactaccgtgatcacccccatgatgcgccacaccatcgagaatacgaccgccaacatctccttaaccgccatcgccaaccaggcggccatcttaatgggcctggacaagggctggcccatcagcaagatggacatcggggtccccctcttggccctgggttgctactcccaggtgaacccgctcaccctgacggccgctgtgctgatgctcgtcgcccactacgcgatcataggacccggcttacaggccaaggccacccgggaggcgcagaagcgcactgccgccgggatcatgaagaaccccaccgtcgacggcatcgtggccatcgacctggaccccgtcgtgtatgacgccaagttcgagaagcagctcggacagatcatgctgctgatcttatgcacgagccagatcctcctgatgcgcaccacttgggcgctctgcgagtccatcacccttgccacggggccgcttaccaccctctgggagggcagcccggggaagttctggaacaccacgatagccgtttccatggccaacatcttccggggctcttacctggccggcgcgggcttagccttctccctcatgaaaagcctgggcggaggccgccgagggaccggcgcccagggcgagaccctgggggaaaagtggaagcgccagctcaaccagctgtccaagagcgagttcaatacttacaagcggagcggcatcatggaagtcgaccgctccgaggctaaggaggggctgaagcggggcgagacgactaagcacgcggttagccgcgggaccgccaagctccggtggttcgtggagcgcaacctggtaaagcctgagggtaaggtgatcgacctgggatgcgggcggggcgggtggtcctactactgcgccggcctgaagaaggttaccgaggtcaaggggtacacgaagggcggacccggtcacgaggaaccgatccccatggccacctacggctggaacctcgtgaagctacacagcgggaaggatgtgttctttacgccgcccgagaagtgcgacactttgctctgcgatattggcgagtcaagccccaaccccaccatcgaggaggggcgcacgctgcgggtcctgaagatggtggagccctggctccgaggcaaccaattctgcatcaagatcctgaacccgtacatgccgtccgttgtagagaccctggagcagatgcaacggaaacatggcggcatgctcgtgcgaaaccccctgtctcggaactctactcacgaaatgtactgggtaagctgcggcaccgggaatattgtctccgccgttaacatgacgagccgcatgctgctcaaccggtttaccatggcccaccgaaagcccacttacgagcgcgacgtggatctaggcgccggcaccagacacgtcgccgtggagcccgaggtggccaatctggacatcatcggtcagcggatcgagaacattaaaaatgagcacaagtccacatggcactatgacgaggataacccatacaagacctgggcataccacggtagctacgaggtcaaaccctccgggagcgcgagttcgatggtgaacggcgtagtccggctcctgaccaagccttgggacgttatccccatggtcactcagatcgccatgacggacaccaccccgttcgggcagcagcgcgtgttcaaagaaaaggttgacacacggaccccccgcgccaagcggggtaccgcccagatcatggaggtcaccgccaagtggctctggggcttcctctctcgtaacaagaagccccggatctgcacccgcgaagagttcactcggaaggtgcgcagcaacgctgccatcggggctgtgttcgtcgacgaaaatcagtggaacagcgccaaggaggcagtggaggatgagcggttctgggatctggtgcaccgcgagcgggagctgcacaagcaaggcaagtgcgcaacctgcgtctacaatatgatggggaagagggagaagaagctcggcgaattcgggaaggcgaagggcagccgcgccatctggtacatgtggttaggggcccgcttcctggagttcgaagcgctcgggttcatgaacgaggatcactggttcagccgggagaactcgctgagcggggttgagggggagggcctgcataaattgggctatatcctgcgcgacatctctaagatcccgggcggcaacatgtatgccgacgacaccgccgggtgggatacccggatcactgaggatgacctgcagaacgaggctaagatcaccgacattatggagcccgagcacgcactcctggcgaccagcatctttaagttaacataccagaacaaggtggtccgcgtgcagcgccccgccaagaatggcacggtaatggatgtcatctcccggcgcgaccaacgggggagcgggcaggtgggcacctacgggttaaacaccttcaccaacatggaggtgcagctgattcgacagatggagtccgagggaatcttcctgccctgcgagctcgagacgcccaacctcgccgagcgggtcttagattggttggagaagcacggggccgagcgcctcaagcggatggccatcagcggcgacgactgcgttgtgaaacccatcgacgaccgcttcgcgaccgccctgatagccctcaacgacatggggaaagtacggaaagacatcccccaatgggagccttccaaaggctggaatgactggcagcaagtcccgttctgcagccaccacttccaccagctgatcatgaaagacggccgcgagatagtggtcccctgccggaaccaggacgaactggtggggcgcgcccgggtgtcccagggtgccgggtggagcctgcgcgagaccgcttgcctgggcaagtcttacgcccagatgtggcagctgatgtacttccaccgaagagacctccgacttgccgctaacgcgatctgttccgccgtacccgtggactgggtgcccaccagccgcactacctggagcatccacgctcaccaccaatggatgaccaccgaagacatgctgagcgtctggaaccgggtgtggattgaggagaacccctggatggaggacaagacccacgtctcttcctgggaggaggttccctacctcgggaaacgcgaggaccagtggtgcggctccctgatcggcctgaccgccagagcgacctgggcgaccaacatccaggtggccataaatcaggtccgtcgcctcatcgggaacgagaactacctggattatatgaccagcatgaaacggttcaagaatgagtctaacccagagggcgccctgtggtga

SEQ ID NO: 24022 - RNA, 9879 nt, synthetic construct
  misc_feature 1..9879: note = derived and/or modified CDS sequence (opt11) from DENV-1__FJ410183__SS-prME
  source 1..9879: mol_type = other RNA
tccgtgactatgctgctcatgttattacccactgccctcgcattccacttgaccaccaggggcggcgaaccccatatgatcgtgtccaagcaggagcggggtaagagcctcttgtttaagacatccgccgggatcaatatgtgtaccctgatcgcgatggacctgggggagctctgcgaggacaccatgacctataagtgtccccgcatcaccgaagcagagccggacgatgtggactgctggtgtaatgcaaccgacacctgggtaacgtacgggacgtgcagtcagaccggcgagcaccgccgggacaagcggtccgtcgccctggcgccccacgtgggcctggggctcgaaacgcgtaccgaaacgtggatgagctccgagggcgcatggaagcagatccagaaggttgagacgtgggctctgcggcaccccgggttcacggtcactgccttcttcctggcgcacgccatcggcaccagcatcacgcagaaggggatcatctttatcctcctgatgctggtgacgccttcaatggccatgcgctgcgtggggatcggcaaccgggacttcgttgaaggccttagcggtgcaacctgggtggacgtggtcctggaacacgggtcctgcgtaaccaccatggctaaggacaagcccaccctggacatcgaactcctgaagaccgaagtgactaatcccgctgtactgcgcaaactctgcatcgaggccaagatcagcaacaccacgaccgactcacggtgcccgacgcagggcgaggccaccctggtcgaggagcaggactcgaatttcgtctgccgccgcacgttcgtcgatagaggctgggggaacggctgcggtctgttcggcaaggggtccctcctgacatgcgccaagtttaagtgcgtgaccaagctggagggcaagatcgtgcagtacgagaacctcaagtacagcgtaatcgtgacagtgcacacgggcgaccagcaccaggtcgggaacgagaccaccgagcacggtacgatcgccactataacgccccaggcgcccacctccgagatccagctgacggactatggggccctgaccctcgactgcagcccccggacaggcctggacttcaatgagatggtcctgctcactatgaaggagaaatcgtggctggtccataagcagtggttccttgacttgccgctgccctggaccagcggggcaagcacctcccaggagacatggaaccgccaggacctgctcgtgaccttcaagaccgcccacgccaagaaacaggaagtggtcgttttggggagccaggagggcgcgatgcacaccgcgctgacgggtgccaccgagatccaaacctccggtaccacaacgatcttcgccgggcacctcaagtgtagactaaaaatggacaaacttacgctaaagggcatgagctacgtgatgtgcaccgggtccttcaagctggagaaagaggtcgccgaaacgcaacacggcaccgttctggtacaagtcaagtacgagggaaccgatgccccttgcaagatacctttcagcgcccaggatgagaagggtgtgacccagaacggacgcctgatcacggccaatccgatcgtgaccgacaaggaaaaacccgtgaacatcgagaccgagccgccctttggcgaatcctacatcgtggtgggggccggggagaaggcattaaaacttagctggttcaaaaagggctccagcatcggcaagatgttcgaggccaccgcgcgcggggcccgccggatggcgatcctaggcgatacagcctgggacttcgggtccatcggaggcgtcttcaccagcgtggggaaactcgtgcatcaggtgttcggggcagcctacggggtgctgttcagtggtgtgagttggaccatgaagatagggatcggcatcctgctcacttggctggggctaaattcccgcagcacttcccttagcatgacctgcatcgctgtcgggatggtgaccttatatctgggagtgatggtgcaagccgactcgggctgcgtcatcaactggaagggccgcgagctcaagtgcgggagcggaatcttcgttaccaacgaggtccacacatggactgagcagtacaagttccaggcggacagcccgaagaggttgtccgccgccataggcaaggcctgggaagaaggagtgtgcggcattcgctcggcaacgcggcttgagaatataatgtggaagcaaatctccaacgagctcaaccacatcctactcgagaatgacatgaagttcaccgtggtcgtgggtgacgcgaacggaatcctcgcacagggcaagaagatgatccgtccccagccgatggagcaccgttatagctggaagtcctggggcaaggccaagatcatcggagccgacatacagaacaccaccttcattatcgacgggcccgacacccctgagtgcccagatgaccagagagcgtggaacatctgggaggtggaggactacggctttgggatcttcaccaccaacatttggctgaagctgagggactcatacacgcagatgtgcgaccaccgcctcatgtccgccgccatcaaggacagcaaagccgtacacgccgatatgggctattggatcgagtccgagaagaacgagacctggaagctggctcgggctagcttcatcgaagtgaagacatgtatctggcccaagtcgcacaccttgtggagcaatggcgtgctggagtcagagatgatcatacccaagatgtacgggggcccgacgagccagcacaattatcgcccggggtacttcacccaaaccgccggcccctggcacctggggaagttggagctcgacttcgacctgtgcgagggcaccacggttgtggtcgacgagcactgcggaaatcggggtccgtccctgcgcaccaccacagtcaccgggaagatcatccacgagtggtgctgtcggagctgcaccctgccgcccctccgattccgcggggaggacgggtgctggtatgggatggagatccgcccggtgaaggaaaaggaggaaaacttggtgcggtccatggtgagcgctggcagcggtgagatggactccttcagcttaggaatcctttgtgttagcatcatgatcgaggaggttatgcgcagccggtggtccagaaagatgctgatgaccggcaccctcgccgtgttcctgctactaatcatgggtcagctcacgtggaatgacctgatccgactctgcatcatggtcggcgctaatgccagcgaccggatggggatgggcacgacttatttagccctgatggctactttcaagatgagaccaatgttcgccgtgggtctcctgttccggcgcttgacgtcccgggaagtcctcctgcttaccatcgggctcagcctcgtggcttccgtggagctgcctaacagcctcgaggagctaggcgacggactggctatggggatcatgatgctgaagctgctgaccgagttccagccccatcaactctggaccacgttactgtccctcacctttatcaagacgaccctgagcttggattacgcctggcgcaccatggccatggtgctttccatcgtgagcttgttccccctgtgcctctccaccaccagccagaagacaacgtggcttccggtcctgctcggctccttcggatgcaagccactgaccatgttcctgatcaccgagaacaagatttggggccgaaagagctggcctctcaacgaggggatcatggcgataggtatcgtgtccatcctgctcagctcgctcttaaagaatgacgtgcccctggccgggcctctaatcgccggcggcatgctgatcgcatgctacgtcatctccggcagctctgccgatctgtcactcgaaaaggcggcagaggtgtcctgggaggaggaggccgaacacagcggcacctcccacaacatcctggtggaggtccaagacgacgggaccatgaagatcaaggacgaggaacgcgacgacacgctgaccatcctcctgaaggccaccttactggctgtaagcggcgtgtaccccatgtccataccagcgaccctgttcgtttggtacttctggcagaagaagaagcagcggagcggggtgctgtgggacacaccctcaccccctgaggttgagagggcagtcttggacgacggcatctaccggatcctgcagcgcggcctgcttgggcggagccaggtgggcgtaggggtcttccaggacggtgtgttccatactatgtggcacgtgactcgcggggccgtgctcatgtatcagggtaagcggctagaaccttcctgggccagcgtgaaaaaggacctgatttcctacggcgggggctggagattccagggcagctggaataccggcgaggaggtgcaggtcattgccgtggagcccggtaagaaccctaaaaacgtgcagacgacacctggcactttcaagacaccagagggcgaggtcggggcaatcgcgctcgacttcaagcccggtacgtccggttcgccgatcgtgaaccgggagggcaagatagtgggcctttacgggaatggggtcgttacaacctctgggacctatgtgtccgccatcgcccaagctaagacgtcccaggagggcccgcttcccgagatcgaggacgaggtattcaagaaacgcaacctcaccatcatggacctgcacccggggtccgggaagacccggcgctacctgcccgctatcgtgcgggaagctataaagcgcaagttacgcaccctaatactcgcccccacccgggtggttgccagcgagatggcggaagccctcaagggcatgcccatccgctaccaaacaaccgccgtgaagtccgagcacacaggaagggagatcgtggatttaatgtgccacgccacattcacgatgagactgttaagccctgtccgggttcccaactacaacatgataatcatggacgaggcgcactttactgaccccgcgtcgatcgccgcccgcggctacatatccacccgggtggggatgggcgaagccgctgctatatttatgacggcgacaccgcccgggtccgtcgaggcgttcccccagagcaacgcagttatccaagacgaagaacgtgacataccggagcgctcctggaactcgggatacgactggatcaccgacttccccggcaagaccgtgtggtttgtaccctccatcaaatctgggaatgacatcgcgaattgcctgaggaaaaacgggaagcgggtcatccagctctcgcgaaagacgttcgacaccgagtaccagaagaccaagaacaatgattgggactacgtggtaaccacggacattagcgagatgggggcgaacttccgggccgaccgggtgatcgatccccgccgctgcctcaagccagtgatccttaaggatggccccgagcgggtcatcttagccggcccgatgccggtgaccgtggcctccgcggcccaacgccgggggcgcatcggccgcaaccagaacaaggagggggaccagtacgtctacatgggccagcccctcaacaacgacgaggaccacgcccactggaccgaggccaaaatgttgttggacaacataaacaccccagaaggaatcatcccggcgctctttgagcccgagcgggagaaatccgcggcgatagatggcgagtacaggctgcggggcgaggcccgcaagacgtttgtggagctgatgcgtcggggcgacctcccggtctggttgtcctataaggtggccagcgagggctttcagtactccgaccgtcgctggtgcttcgacggggagcggaacaaccaagtgttagaagagaacatggatgtcgaaatctggactaaagagggcgagcgcaagaagctccgccccaggtggttagacgcccggacctacagcgacccgctggcgctccgcgagtttaaggagtttgccgccgggcggcgcagtgtctccggagatctgatcctggagataggcaaactcccccagcacctaaccctgcgggcccagaacgccctagacaacttggtgatgttgcacaacagtgaacagggagggaaggcgtaccggcacgcaatggaggagctaccggacaccatcgagaccctgatgctgttagccctgatcgcggtactgaccgggggcgtgactctattcttcctgtccgggaagggcctgggcaagaccagcatcgggctcctgtgcgtgatggcgagtagcgcccttctctggatggccaacgtagagccacattggattgccgcctccattatcctggagttcttcctgatggtgctcctgatcccggagcccgaccggcagcggacgccccaggataaccagttagcgtacgtggtaatcggcctcctgttcattatcctgacggtggccgctaatgaaatggggctcctggagaccactaagaaagacctgggcatcggtcacgtggccgccgaatcacaacatcacgccacgatgctcgacgtcgacctacggccggcctccgcctggaccttgtacgccgtggccaccactgtaatcacgccgatgatgcgccacaccatcgagaacaccaccgcgaatatatctcttaccgccatcgccaaccaagccgcaatcctgatgggcctggacaaaggatggcccatctccaagatggacatcggggtcccccttctggcgctgggctgctatagccaggtgaatcctctcaccctgaccgcagccgtgttgatgctagtcgcccattacgcgatcatcgggcccgggctgcaggccaaggccacccgagaagcccagaagcggacggcagcggggatcatgaagaatcccaccgtcgacggtatcgtcgccatagatctggaccccgtcgtgtacgacgcgaagttcgagaagcagctcgggcagattatgcttcttatcctctgcacctcccagatcctcctgatgcgcaccacgtgggccctctgcgagagcatcacgctggccaccggtccactgaccacgttatgggagggctcccccggcaagttttggaacaccaccatagcagtcagcatggcaaacatcttccggggctcctatctggccggcgccggactggccttcagcctcatgaagtccctaggagggggccgtcgggggaccggcgcgcagggcgagacgctgggggagaagtggaagcgccagctcaaccagctgagcaagagcgagttcaacacctacaagcggtccggcatcatggaggtcgaccgcagcgaggccaaagagggactaaagcggggcgagaccaccaagcacgccgtgtcccgcgggaccgccaagctccggtggttcgtggaacgcaatctggtcaaacccgagggaaaggtaatagacctgggctgtgggagaggcgggtggagctactactgcgcgggcctgaagaaagtgaccgaggtaaaggggtataccaagggcggccccgggcacgaggagcccatcccgatggccacatacgggtggaacttggtgaagctgtactccgggaaagacgttttcttcacgccgcccgagaagtgcgacacgctgctctgcgacatcggcgagagctctccgaaccccactatcgaggaggggcgcaccctgcgggttcttaaaatggtagagccctggctccgtggcaaccagttctgcatcaaaatcctgaacccctacatgccgtctgtcgttgagaccctggaacagatgcagcggaagcacggagggatgctggtgcgtaatcccctgtccagaaattccacgcacgagatgtactgggtgtcctgcggcacagggaacatcgtgagcgccgttaacatgacctcccgcatgctgttaaaccgcttcacgatggcccatcggaagcccacgtacgagcgcgacgtggacctgggcgccggcacacgccacgtcgcggttgaacccgaagtagccaacttagacatcattggccagcgcattgagaatatcaagaacgagcacaagagcacctggcattacgatgaggacaacccatataagacctgggcctaccacggctcctacgaagtcaagcccagcgggagcgcctcgtccatggtgaacggcgtggtcaggctcttaacgaagccctgggatgtgattcccatggtcacccaaatcgccatgaccgacaccacgccgttcgggcagcagcgcgtgttcaaagagaaggtggacacccggacgccccgggcgaagcggggcaccgcccaaatcatggaggtcacggccaagtggctgtggggcttcctcagccgaaataagaagccccggatctgcacgagagaagagttcaccagaaaggtccgctccaacgccgccattggggcggttttcgttgatgagaaccagtggaactccgccaaagaggccgtggaggacgagcggttttgggacctggtgcaccgcgagcgggagctgcacaagcagggcaaatgcgcgacctgcgtctacaacatgatgggaaagcgagaaaagaagctcggcgagttcggaaaggcgaagggaagccgggcaatctggtacatgtggctgggagcccgattcttggagttcgaagccttagggttcatgaatgaggaccactggttctcccgtgaaaattcgttctccggcgtggagggggagggactgcacaagctgggttatatcctcagggacatctctaaaataccgggtggcaacatgtatgctgacgacactgcggggtgggacacacgcatcaccgaagacgacttacagaacgaggccaagatcaccgacatcatggagcccgagcatgccctcttagccacgtccatcttcaagctgacctatcaaaataaggtggtgcgggtgcagcgccccgccaagaacggcaccgtaatggacgtcatcagcaggcgcgaccaacgggggtcaggccaagtgggtacctacgggttgaacacgttcaccaacatggaggttcagctcatccgccagatggagagtgaaggcatctttctgccatccgagcttgagaccccaaacctcgctgaacgggtactggactggttagaaaagcacggtaccgaacgcctcaagagaatggccatcagcggagacgactgtgttgtgaagccagtcgacgaccgcttcgccacggccctgatagcactaaacgacatggggaaagtgcggaaggatatccctcagtgggagccctccaaaggttggaacgactggcagcaggtcccgttctgcagccatcacttccaccaactcatcatgaaggacggccgcgagatcgtagtgccctgccgaaaccaagacgagctggtaggtcgcgcgcgggtctcccagggcgccgggtggagcctgcgcgagaccgcctgcttaggcaaatcctatgcccaaatgtggcagctgatgtactttcaccggcgcgacctgcggttagccgccaacgccatctgcagcgccgtgcccgtagactgggtcccgacttcccgcaccacctggtccatccatgcccaccaccagtggatgacgaccgaggacatgctgagcgtgtggaaccgcgtgtggatcgaagaaaacccctggatggaggataaaacgcacgtcagcagttgggaggaggtgccctacctgggtaagcgcgaggatcagtggtgcggctccctcatcggcctgacggcgagagccacgtgggcaaccaacatccaggtggccatcaaccaggtcaggcgcctgatagggaacgagaactacctcgattacatgactagcatgaagcggttcaagaacgaatccgaccccgaaggagccctgtggtga

SEQ ID NO: 24023 - RNA, 9879 nt, synthetic construct
  misc_feature 1..9879: note = derived and/or modified CDS sequence (opt11) from DENV-1__FJ410184__SS-prME
  source 1..9879: mol_type = other RNA
tcagtcaccatgctactcatgctattgcccaccgccctcgccttccacttgaccacccggggcggggagccccacatgatagtgtcaaagcaagaacggggcaaaagcctcctgttcaagaccagcgccgggatcaacatgtgcaccttaattgcaatggaccttggcgagctgtgtgaggatacgatgacatataagtgccctcgcatcaccgaagccgagcccgacgacgtagactgctggtgtaacgccactgacacatgggtgacctacggtacgtgcagccagaccggggagcaccggagggataagcggtcagtcgcgttggcacctcacgtgggcttaggcctcgagacacgcacggaaacctggatgagctccgagggcgcctggaaacagatccagaaggtggagacttgggccctgcgccatcccgggttcacggtaattgccctgttcttagcgcatgctattggcactagcatcacccagaaggggatcatctttatactgctgatgctcgtcaccccatcaatggccatgcgctgtgttggtataggcaatcgggactttgtcgaaggtctcagcggcgcgacatgggtggacgtcgtcctggagcacggatcctgcgtgactaccatggcgaaggacaagcccactctagacatcgagttactgaaaaccgaagtaaccaaccccgcggtcctccgcaagctctgtatagaggcgaagatttctaacaccaccacggattcccggtgccccacccaaggcgaggccaccctggtggaggagcaggacgccaatttcgtgtgtagaaggaccttcgtggaccgcggctgggggaatggctgtggcctgttcgggaaggggtctctgctgacgtgcgccaagttcaaatgcgtgaccaagctcgagggcaagatcgtgcagtacgagaatctgaaatacagtgtcattgtaaccgtgcatacgggcgaccagcaccaggtcggtaacgagaccaccgagcacggtactatcgccaccatcacgcctcaggcccccacgagcgaaatacagctgacggactacggggccctcaccttagattgcagtccccggaccggcttagacttcaatgagatggtgcttctaaccatgaaggagaagtcctggttggttcacaagcagtggttcttagaccttcccctgccgtggactagtggggcatctaccagccaagagacctggaaccgccaggatctcttggttactttcaagactgcacacgcgaagaaacaggaggtagtagtgctgggcagccaagagggcgccatgcacaccgccctcaccggggccacggaaatccaaacctcgggcaccactacgatcttcgctgggcacctgaagtgccggctgaaaatggataagttgacgctgaaaggcatgagttacgtaatgtgcaccggtagcttcaaactggagaaggaggtggcggagactcagcacggcacggtgcttgtgcaagtcaagtacgaggggaccgatgccccctgcaagatccccttctccgcacaagacgagaagggggtaacacagaacggtcgcctcatcacggctaatccgatcgtgacagacaaggagaagcccgtcaacatcgagaccgagccgcccttcggggaaagctatatagtcgtgggcgcgggagagaaggcccttaagctatcctggtttaagaaggggtcatccatcggcaaaatgtttgaggccaccgcccgcggggctcgccggatggcgatactcggcgacaccgcgtgggacttcggaagcatcgggggggtcttcacgtccgttggaaagctggtgcaccaagttttcggcaccgcctacggggtgctgttcagcggtgtgagttggaccatgaagatcgggatcggcatcctcctgacctggctgggcctcaacagccgctcaacgagcctctctatgacctgcatcgccgtcgggatggtgaccctgtacctcggtgtaatggtccaggcggacagcgggtgcgttatcaactggaagggccgcgagctaaagtgcggatcgggcatcttcgtgaccaacgaggtccacacgtggactgagcagtacaaattccaggcggatagcccaaaacggctgagcgccgccatcgggaaggcctgggaagagggggtgtgtggcatacgctcggcaacccggcttgagaacatcatgtggaagcagatcagcaacgaactgaaccacattctgctcgaaaacgacatgaaattcacggtggtcgtgggtgacgcgaacggtatcctggctcagggcaagaagatgattcgcccccagccgatggagcaccgttactcctggaaatcctggggcaaagccaagatcatcggcgctgacatccaaaacaccacgttcattatcgacgggcccgacaccccggagtgccccgacgaccaacgtgcgtggaatatctgggaagtggaggactacggattcgggatattcaccaccaatatctggttgaagctacgggactcctacacacagatgtgcgatcaccggctgatgagcgccgccatcaaggattccaaggccgtccacgcagatatgggatactggatcgagagcgagaagaacgagacgtggaagttggcgcgggcttcctttatcgaggtgaagacctgcatctggcccaagagccacacgctgtggtccaacggagttctggagagcgagatgatcatccccaagatctatggaggcccgatttcccagcacaactaccgtcccgggtacttcacgcagactgccggcccctggcatctggggaaactagaactggactttgacctgtgcgagggcaccacggtcgtagtggacgagcactgcggtaaccgggggccgagcctccgcacaaccaccgtcaccggcaagatcattcacgaatggtgctgccgttcctgcaccctgccacctctgcgcttcagaggggaggacggatgctggtatggtatggagatcaggcccgtgaaggagcgggaagaaaatctcgtgaagagcatggtctccgccggcctgggtgaagtggacagcttcagcctgggtatcctttgcgtgtccatcatgatcgaggaggtcatgcgctcacgttggtcccgaaagatgctgatgaccgggaccctggccgtcttcctcctgctgatcatggggcagctcacgtggaacgacctgatccgactgtgcatcatggtcggcgcgaacgcaagcgacaggatggggatgggcacaacctacctcgccctgatggccacttttaagatgcgaccaatgttcgccgtcggccttctcttccggcgcctaacttcccgggaggtgctgctcctgacgatcgggctgagcctcgtggcgtccgttgagctacccaattcactggaggaacttggcgacggactggccatgggcatcatgatgctgaaacttctgaccgagtttcagccccaccagctctggaccaccctcctgtccctgactttcatcaagaccaccctctctctggactacgcctggaagacaatggctatggtgttatcgatcgtcagcctttttcccttatgcctgtcgacgactagccaaaagacaacctggctcccggtgctgctgggcagcctcggttgcaaacccctgacgatgttcctcataaccgagaacaagatttggggccgcaagagctggcccttgaacgagggtatcatggcgataggaatagtgagcatcctactgagctccctcttaaagaacgatgtccccctggccgggccgctcatagccggcggcatgctgattgcctgctacgtaatctcggggtcctcggcggacctgagtctcgagaaagccgccgaagtctcctgggaagaggaggccgagcactcgggcacctcacataacatcctggtggaggtgcaagatgatggcaccatgaaaatcaaagacgaggagagggacgatacccttactatcttgcttaaagcgaccttattagccgtgagcggcgtatacccaatgtcgatacctgccaccctgttcgtgtggtacttctggcagaagaaaaaacaacgcagcggggtcttgtgggataccccctcaccgcctgaggtcgagcgcgccgtgctggacgacggcatctaccgcatcctgcaaagaggcctgctgggtcgcagccaggtgggcgtcggcgtgtttcaagatggcgtctttcacacgatgtggcatgtcacccgcggggccgtgctcatgtaccaaggcaagcgcctggagcccagctgggcgtccgtcaagaaggacctgatctcctatggcggggggtggcggttccagggggcctggaataccggcgaggaagtccaggtaatcgcggtggagcccggcaaaaacccgaagaacgtccagaccacgcccggcacattcaaaacccccgagggcgaggtgggggccatcgcacttgatttcaagccgggaaccagcggttcccccatcgttaaccgcgaaggcaagattgttggcctttatgggaatggcgtggtgacgactagcggaacctacgtgagcgccatcgcgcaagcaaagaccagtcaggaggggtcccttcccgagattgaagatgaggtcttcaagaagaggaacctaacgataatggacctccaccccgggagcggtaagacccgccggtacctgcccgccatcgtgcgagaggccatcaagcggaagttacgcaccctgatccttgccccaacccgcgtcgtggcatctgagatggccgaagccctcaaggggatgcccattcggtaccagacgaccgctgtgaaatctgagcacaccgggcgcgagatcgttgaccttatgtgtcacgccaccttcacgatgcggttgcttagccccgtgcgagtgccgaactacaacatgattataatggacgaggcgcactttaccgaccccgcctccatcgccgctcgtggttacatcagcaccagggtcgggatgggtgaggccgcagccatcttcatgaccgccacgccgcccggctctgtggaggcctttccccagtcaaatgccgtgatccaggacgaggaacgggacatccctgagcgctcctggaatagcggttacgactggatcaccgactttccggggaagaccgtctggttcgtacctagtatcaagagcgggaatgacatcgcaaactgtttgcgcaagaacgggaagcgcgtgatccagctgtcccggaagacttttgacactgagtaccagaagaccaagaacaatgactgggactatgtcgtgaccaccgacattagcgagatgggggccaactttagagccgaccgggtgatcgacccgcgccggtgcctaaagcccgtcatcctgaaagatggcccagagcgcgttatcctggccggccccatgcctgtgacagtcgcatccgccgcccaacggagaggccgcatcggccgcaatcaaaacaaggaaggggaccagtacgtatacatgggccagcccctcaacaacgacgaagaccacgcacactggaccgaggccaagatgttactggacaacatcaatacacccgagggcatcatccccgccctcttcgagcccgagcgcgagaagtccgctgccatcgacggcgaataccggctgcgcggggaagccagaaagaccttcgtcgaactgatgagacgcggggatctgccggtctggctgtcctacaaggtagctagcgagggattccaatactccgacaggcggtggtgcttcgacggagagcgtaacaatcaggttctggaggaaaacatggacgtagagatctggacaaaggagggtgagcggaagaagcttaggccgaggtggctggatgcgcgcacctacagcgaccccctggccctccgtgagtttaaggagttcgccgctgggaggcggtcggttagcggcgacttgatcctcgagataggaaagctcccgcagcatctgaccctgcgcgcccaaaacgcgctcgacaacctcgtcatgcttcacaactctgagcaaggcgggaaggcctatcggcacgctatggaggaactccccgacacaatcgagactctgatgctgctcgcactgatcgccgtgctaaccggtggggtgacgctcttcttcctgtccgggaaggggctgggcaaaacatctatcgggctcctgtgcgtcatggcctcctctgccctgctctggatggcctccgtggaaccccactggattgccgccagcatcatcctggagttcttcctcatggtgttgctcattcccgagccggatcgccagcggacgccacaggacaatcagctggcatacgtcgtgatcggtctcctgttcatgatcctaacagtggccgccaacgaaatggggttactggagaccacgaagaaggatctgggtatcgggtatgtagcggcggagaaccaccaccacgccaccatgttggatgtagacttacgccccgcctctgcgtggaccctgtatgccgtggcgaccactgtcatcaccccaatgatgagacacaccatcgaaaacacgaccgcaaatatctcactgaccgccatagcgaaccaggccgcgatactgatgggactggacaagggttggcccatctccaaaatggatatcggggtgcccctcctggcactgggatgctactcgcaggtgaatccattaaccctgaccgcagccgtactaatgttggttgctcactatgcaattatcgggccgggtcttcaggccaaagccaccagagaagcccaaaaacgcacagcggcaggcatcatgaaaaaccccacggtggacggcatcgtggctatcgaccttgaccccgttgtgtacgatgccaagttcgagaagcagctcgggcaaatcatgctgctgatcctatgcacctcgcaaatcctgctgatgcggaccacctgggccctctgcgagagcatcaccctggcgaccgggcctctaaccaccctctgggagggatccccggggaagttttggaatacgaccatcgccgtgagcatggccaacatattccgcggctcgtatctggcaggagccgggctggcgttcagcctcatgaaatcccttggcggcggacggcgcgggaccggcgcccagggcgagaccctgggtgagaagtggaagagacagctcaaccagctcagcaagtctgagttcaacacgtacaagcgcagcggtatcatggaggttgaccggagcgaggctaaggaggggctgaagaggggcgagaccacgaagcacgcagtttcccgggggaccgcgaaactgcgctggttcgtcgagcggaatctcgtaaagccagagggcaaggtcatcgacctaggatgcggccgcggcggatggagctactactgtgccggactgaaaaaagtcacggaggtgaaggggtacaccaaaggcgggcccgggcacgaggagccgatccctatggccacctacggttggaacctcgtgaagctgcactcggggaaagacgtattcttcacaccccccgagaagtgtgatacactcctctgcgacatcggcgaatcttccccaaaccctactatcgaagaggggcggaccttacgcgtgctgaagatggtggagccctggctacggggcaaccagttctgcatcaagatcttaaacccctacatgcccagcgtcgtcgagaccctggagcagatgcaacgcaaacacggcggcatgctcgtccggaaccctctgtccagaaatagcacccacgagatgtattgggtctcctgcggcacggggaatatcgtgagcgcagttaacatgacctctcggatgttactaaaccgcttcacgatggcccataggaaacccacctatgaacgggatgtcgatctgggcgccggaacgcgacatgtcgccgtagagcccgaggtcgcaaatctggacatcattgggcagcggatcgagaacatcaagaacgagcacaagtcaacctggcactacgacgaagataacccttataagacctgggcgtaccacggctcctatgaggttaagccgagtggcagcgcctcatccatggtcaacggcgtggttcgcctcctaaccaagccttgggatgtgatccccatggtgacgcaaatcgcgatgactgacacaacacccttcggtcaacaacgggtgttcaaggagaaagtcgacacgcgcactccgcgggccaaacgcggcaccgcccaaatcatggaagtgaccgccaaatggctttggggctttctcagtaggaacaaaaagccccgtatctgcacgcgggaggagttcactcgcaaagtgcggtccaatgctgcaataggggcggtcttcgtggacgaaaatcagtggaactcggcaaaggaggctgttgaagacgagcggttctgggatctggtccaccgagaacgcgagctgcacaaacagggcaaatgcgcgacctgtgtgtataacatgatggggaagcgggagaagaagctcggcgagttcgggaaagccaagggtagccgcgccatctggtacatgtggcttggagcccggttcctggagttcgaagccttggggtttatgaatgaagaccactggttttcccgcgagaactcgttttccggcgtggagggcgagggcctgcataagctggggtacatcctccgggacatcagcaagatcccagggggcaatatgtacgcggatgacacggccgggtgggacacgaggatcaccgaggacgatctgcagaacgaggctaagatcaccgacatcatggagcccgagcacgcccttctggccaccagtatcttcaaactgacctatcagaataaggtcgtgcgagtgcagcggcccgctaagaacggcacagtcatggacgttatcagcaggagagaccaacgcgggtccggccaggtgggcacctacggtctgaacacctttacgaatatggaggtacagctcatccggcagatggagtcagagggcatcttccttccatccgagctggaaacccccaacttagctgagagggtattggattggctggagaagcacgggacggagaggctcaaacgtatggccatcagcggcgacgattgtgtggtcaagccggtggatgaccggttcgccaccgccttaattgccctgaacgacatggggaaggtgcgcaaggatatcccccagtgggagccctccaagggctggaatgattggcagcaggtccccttctgtagtcaccactttcaccagctcattatgaaggacgggcgggagatcgtggtaccgtgccgcaaccaggatgagctggtcgggcgggcgcgggtgtctcagggcgccggttggtcgctgcgggagacggcgtgcctcggtaagtcctacgcgcaaatgtggcagttgatgtacttccaccgccgggacctgagactcgcggccaacgccatctgcagcgcagtacccgtcgactgggtcccaacctcccgcaccacctggagcatacacgcgcaccaccaatggatgaccaccgaagacatgctgagcgtgtggaaccgagtctggattgaggagaacccctggatggaggacaagacccacgtatccagctgggaggaggtgccgtacttggggaagcgcgaagaccagtggtgcggctcactcataggcctgaccgcccgggccacctgggccacaaacattcaggtcgccattaaccaggtgcgccgactgatcggaaacgagaattaccttgactatatgactagcatgaagcgcttcaagaacgagtccgaccccgagggcgcactgtggtga

SEQ ID NO: 24024 - RNA, 9879 nt, synthetic construct
  misc_feature 1..9879: note = derived and/or modified CDS sequence (opt11) from DENV-1__FJ410185__SS-prME
  source 1..9879: mol_type = other RNA
agcgtgaccatgcttctaatgctcttacccacggcactcgctttccacctgactacccggggcggtgaacctcacatgattgtgagtaagcaggaacggggaaagagcctgctgttcaagactagcgtgggtatcaacatgtgtaccctgatagcgatggatctgggcgagttatgtgaggacaccatgacgtacaagtgtccccggatcactgaggccgagcccgatgatgtcgactgctggtgcaacgctacggatacctgggtcacctacgggacctgctcccagactggcgagcaccgacgggataagcggtccgtggctctcgcgccccacgtgggacttgggctagagactcggaccgaaacctggatgagttccgagggcgcttggaaacagatccagaaggtcgagacctgggcgctacggcacccgggtttcactgtaatcgccctgttcctcgcccacgcgatcggcaccagcataacccagaaggggatcatattcatactgctgatgctcgtcacccccagcatggcgatgagatgcgtcgggatcggcaaccgcgacttcgtggaggggctgagcggcgccacgtgggtggacgtggttctggagcatgggagttgtgtgaccaccatggctaaggacaagcccactttggatatcgagcttctgaagacggaagtcaccaaccccgccgtgctacgcaagttgtgcatagaagctaagatctccaacaccaccacggattcccgctgcccgacccaaggtgaggccaccctggtcgaggagcaggacagcaacttcgtttgccgccggaccttcgtggaccgtggctgggggaacggctgcggcctctttggcaaagggtccctgctgacgtgtgccaagtttaaatgcgtgaccaaactcgagggaaaaatcgtccaatacgagaacctgaagtacagcgtcatcgttaccgttcacaccggcgaccagcaccaggtggggaatgagacgaccgagcatggaaccatcgcgacgatcactcctcaggcccccacgtccgagatccaattgactgactacggggcgctcactctggactgcagccccagaaccggcctggacttcaacgagatggtcctcctgacaatgaaggagaaaagctggctagtgcacaagcagtggttcttagatctgccgctgccttggactagcggggccagcacctcccaggaaacctggaatcgacaggacctactggtgaccttcaaaaccgcccacgccaagaagcaagaagtcgtggtgctaggcagccaggagggcgcgatgcacaccgcactaacgggggccacagagatccagacctccggcaccaccacgatcttcgccgggcacctgaaatgccggctgaaaatggacaagttgactctgaagggcatgagctacgtcatgtgcaccgggtcgttcaaactggagaaggaggtggccgagactcagcacggcacggtgctagtccaggtgaagtacgagggtaccgacgccccctgcaagatcccgttctcagcgcaagacgaaaagggggtgacccaaaacggccgcctcatcaccgcgaatccgatcgtcactgacaaagagaagcccgtgaacatcgaaaccgagccgccattcggcgagtcatacatcgtgataggagccggcgagaaagccctgaagctgagctggttcaagaaggggtccagcattgggaagatgttcgaggctaccgcccgcggcgcgcgccgaatggcaatcctcggcgatactgcgtgggactttgggtccatcggcggcgtcttcacgtccgtcgggaaactggtgcaccaggtgttcggcgccgcttatggggtcctgttctccggcgtcagctggaccatgaaaatagggatcggcatcctcctgacctggctgggattgaactcccgcagcacctctttgagtatgacgtgcatcgccgtcgggatggtgaccctgtacctcggcgtgatggtacaggccgactccggatgcgtgattaactggaagggccgcgagcttaagtgcggctctgggatcttcgtgacgaacgaggtccacacctggacggagcagtacaagttccaggccgattctcccaaacgcctgagtgcggccatcggcaaggcgtgggaggagggggtgtgcgggatccgcagcgccaccaggctcgagaacatcatgtggaaacagatctcgaacgaactgaaccatattctgctcgagaacgacatgaagttcaccgttgtcgtaggggacgccaacggcatcctggcgcagggcaagaagatgatccgcccccagcccatggagcaccggtacagctggaaaagttggggcaaggcgaagataataggcgccgatatccagaatacaaccttcatcatcgacggtcccgacacgcccgagtgccccgacgatcagcgagcctggaacatctgggaagtggaggactacggcttcgggatcttcactaccaacatatggcttaagttgcgggacagctatactcagatgtgcgaccaccgccttatgtccgctgccatcaaagactccaaggcagttcacgccgatatgggctactggatcgaatcagagaaaaacgagacgtggaagctggcccgggcgtcttttatcgaagtgaagacctgcatctggccaaagtcccacaccctctggagtaatggagtgctggagtccgagatgataatcccgaagatctacgggggcccgatctcccagcacaactaccgccccgggtacttcacacagacggccggcccttggcacttggggaagctcgagctggactttgacctgtgcgagggcaccaccgttgtcgtggacgagcattgcggtaatcgtgggccgagtctccgcacaaccaccgtcaccggaaagattatccatgagtggtgctgtcggagctgcaccctgccgcctctgcgcttccgaggggaggatggctgctggtacgggatggaaatccgccccgtgaaggagaaagaggagaatctcgtgcggtccatggtgagcgccggtagcggcgaggtggactccttcagcctggggatcctgtgtgtgtccatcatgatcgaagaagtcatgaggtcacggtggtccaggaaaatgctcatgacgggcaccttagccgtcttcctgcttcttatcatgggacagctgacctggaacgatttaatcaggttatgtatcatggtcggcgccaatgcgagcgacaggatggggatgggcactacgtaccttgccttgatggccacgtttaagatgcggccgatgttcgctgtcggcctgctgttcagacgcctgacgtcccgcgaggtgctgctgctcactatcgggctgtctctggtcgcctctgtcgagctccccaacagtctggaggagctgggcgacgggctcgcaatgggcatcatgatgctgaagctcctcacggagttccagccccatcagctgtggaccacgttactctccctaaccttcatcaagactactctaagcctcgactacgcctggcgtactatggccatggtgctgagcatcgtcagcctgttccccctctgtttatcaaccacttcgcagaagacgacctggctgcctgtgttgctgggaagttttggctgtaagcccctgactatgttcctcatcacggagaataagatctggggccgcaagagctggccgctgaacgaagggataatggccataggcattgtgtctattctgctcagctcactcctgaagaacgacgtccccctggcgggtcccctgatcgccggcggcatgctgatagcctgctacgtgatctccgggagttccgccgacctcagcctagagaaggccgccgaagtgtcctgggaggaggaggccgagcactcgggaacctcccacaacatcttagtcgaggtgcaggacgacgggaccatgaaaatcaaggacgaggaaagagacgacacgctcacaatcctgcttaaggcaacgttgctggccgtgagcggtgtataccccatgtccattcccgccaccctcttcgtctggtacttctggcagaagaagaagcagcgttctggggtcctttgggataccccctcaccacccgaagtcgaacgagcggtattagacgatggcatctacaggatcctgcagcgcggcctgctcggtcggagtcaggtaggcgtcggggtgttccaggacggtgtcttccataccatgtggcacgtgactcggggagccgtactgatgtaccagggcaagcgactggaaccctcctgggcaagcgtgaagaaggacctgatctcctatggcgggggctggcgctttcaagggagctggaataccggcgaggaggtacaggtgatcgcagtggagccagggaagaacccgaagaacgtccaaaccactcccgggacattcaagacccccgagggtgaagtgggggctatcgctctcgatttcaagcccggaacaagtggcagccctattgtaaatcgggaggagaagatcgtcgggctgtacggcaacggggtggtcaccacatccggaacctacgtctctgcaatcgcccaagccaaaactagccaggaggggcctctccccgagattgaagatgaggtgttcaaaaagcgcaacctgactatcatggacctgcacccggggtccgggaaaactcggcgctacctccccgccatcgtgcgagaggctatcaagcgcaagctgaggactctgattctcgccccaacccgagtcgtggccagcgagatggccgaagcgctgaagggcatgccaatcagataccagactaccgcggtgaagtccgagcatactggacgcgagatcgtcgacttgatgtgccatgccaccttcaccatgcgcttactgagtccggtccgcgttcccaactacaacatgatcattatggacgaggcccacttcacggaccccgcgtccatcgcagccagggggtacatcagcacccgagtcggcatgggggaagcagccgccatctttatgaccgcgacgccaccaggctccgtagaggccttcccgcagagcaacgccgtgatccaggacgaggaacgcgatataccagaacggtcctggaacagcgggtacgactggatcacagacttccccggcaagaccgtatggtttgtgccctccattaagtcgggcaacgacatcgccaactgcctgcgcaagaacgggaaacgggtgatccaactctcccgcaagacctttgacaccgagtaccagaagacgaagaacaatgactgggactacgtcgtaaccaccgacatctcggaaatgggcgccaattttcgtgcggatcgcgtgatcgacccccgacgctgcctgaaacccgtcatcctgaaggacgggccggaacgggtgatccttgccggcccgatgcccgtgacagttgcctccgccgcgcagcgacgggggcgcatcggaagaaaccagaacaaagaaggggaccagtacgtgtatatggggcagccactgaacaatgacgaagaccacgcccattggacggaggccaagatgctgctcgacaacatcaacacacccgagggtatcatcccggccctgtttgagcccgagcgggagaagtccgccgcgatagacggtgaatacagactgcggggtgaggcacggaagaccttcgtcgagctcatgcggcgcggggatctccccgtgtggttgtcctacaaggtggccagcgaaggcttccagtactccgatagacgctggtgcttcgacggggaaagaaacaaccaggtcctcgaggagaacatggacgtggagatctggaccaaggagggggagcgcaagaaactgcgtccgcgctggttagacgctaggacgtacagcgacccgctcgcgctcagagagttcaaggagtttgcggcgggccggcgctcggtcagcggggacctgatccttgaaatcggcaagttaccccagcaccttactctccgggcccaaaacgccctggacaatctggtcatgcttcacaacagcgagcagggcgggaaagcctaccgccacgcgatggaggagctgcccgacacgatcgagactctgatgctcctggccctgatagccgtgctcacaggcggggtgacgctgtttttcctgagcggaaaggggctcgggaagacgagcatcggcctgctgtgcgttatggcgtcgagcgcgttgctgtggatggccaacgtggagccccactggattgccgcctccatcatcttggagttctttctaatggtgcttctgatcccggagcctgacagacagagaacccctcaggacaatcagctcgcctacgtagtgatcgggctcctgttcatgatcttaaccgtagcggccaacgagatgggcctgctcgagactactaagaaggacctcgggatcggccacgtcgccgccgagaaccagcaccacgcaaccatgctggacgtagatctgcggccggcaagcgcatggaccctctacgcagtggccacaaccgtgataacacccatgatgcgccacaccattgagaacacgaccgctaatatatcattgaccgcaattgcaaaccaggccgccattctgatggggctcgacaagggatggcccatcagcaagatggacataggcgtgccgttgctggccctgggctgctactcacaagtgaacccactgaccctgactgcggccgttctaatgcttgtggctcactacgccataataggccccggcttgcaggcgaaggctactagggaagcccagaagcggaccgccgccggcataatgaagaaccccactgtggatgggatcgtagctatcgacctcgaccctgtggtatacgacgccaagtttgagaagcaactgggacagataatgttactgatcctgtgcacgagtcagatccttctcatgcgcaccacctgggcactctgcgagtcaatcacactggccacgggaccactcaccaccctgtgggaggggagccccgggaagttctggaacaccacgatcgccgtaagcatggcaaacatcttccgggggagctacctggccggggccggcctcgcgttcagtctgatgaaatcactcgggggcggtcgccgggggactggggcccagggggagacccttggcgaaaagtggaagcgccagctgaaccaactgtccaaatcggagttcaacacttacaaacgctcgggtatcatggaggtggatcgcagcgaggcaaaggagggacttaagagaggggaaacgaccaagcacgccgtgagtcgaggcaccgccaagctgcggtggttcgtcgagcgaaaccttgtgaagcccgaggggaaggtcatcgacttaggctgcggccgcggcggttggtcctactactgtgccggcctcaagaaagtcaccgaggtgaaggggtatacgaaaggtgggcctgggcacgaagaaccgatccccatggcgacctacgggtggaacctggtgaagctgtattcgggcaaggacgtcttcttcaccccgcccgaaaagtgcgataccctcctgtgtgacatcggggagtccagccccaacccgaccatcgaagagggccgcacgctgcgtgtgctaaagatggtggagccctggctgaggggaaatcagttttgcatcaagatcctgaacccctacatgccatcggtcgtggagacactcgagcagatgcagcggaaacacggcggcatgctggtgcgcaacccccttagccggaactctacccatgagatgtattgggtcagctgcgggaccggcaacatcgtgtcagcagttaacatgacgagcagaatgctcctgaatcgcttcaccatggcccaccggaagccaacatacgagagagacgttgatctgggggccggcactcggcacgtggctgtggaaccagaggtagcgaacttagacatcatcggccagaggatagaaaacatcaagaatgagcacaagtccacgtggcactacgacgaggacaacccctacaagacgtgggcgtaccacggctcctatgaggttaagccatcaggtagcgccagtagcatggtgaacggggtagtgcggctgctgactaagccgtgggacgttataccaatggtgacccagatcgccatgacggacaccactccattcggccaacagcgcgtcttcaaggagaaggtcgacacccggacaccccgggccaagagggggaccgcccagatcatggaggtcactgctaagtggctctggggctttctgagccgcaacaaaaagccccggatctgcacccgggaggagttcacgcggaaggttcgctctaacgcggctattggcgccgttttcgtggacgagaaccagtggaacagcgcgaaggaggctgtggaggacgagcgtttctgggacttggtccatcgcgagcgggagctccacaaacaggggaagtgtgcgacatgcgtgtacaacatgatgggaaagcgcgagaagaagctgggggagttcggcaaggccaaagggtccagggcaatttggtacatgtggctgggcgcgcgctttctcgagttcgaggccctcggtttcatgaacgaagaccactggttctctcgggagaactccttcagcggggtggagggggagggtctccacaaacttggttacatcttgcgtgacatctcgaagatcccagggggtaacatgtacgccgacgacaccgctggctgggacacccgcatcactgaggatgacctgcagaacgaagcgaagatcaccgacataatggaacccgagcacgccctgctcgcgaccagcattttcaagctgacataccagaacaaagtagtgcgtgtacagagaccggcaaagaacggcacggtgatggacgtaatctccagacgtgatcagcgggggagcggccaggtcggaacctacggcctcaatacctttacgaacatggaggtccagctgatccgccagatggagtccgaggggatcttcctgccaagcgaactcgagactccgaacctcgcggagcgggtgctggattggctcgagaaacatggcactgagcgcctgaagcggatggcgatctccggtgacgactgcgtggtcaagcccgtggatgaccgcttcgccacggccctgattgcactcaacgacatgggcaaggtacggaaggatatcccccagtgggagcccagcaaagggtggaacgactggcagcaggtcccgttctgttcccaccactttcaccagctgatcatgaaggatgggcgcgagatagtggtgccctgtcggaatcaggacgagctggtcggccgagcccgagtaagccagggggcgggctggtccctccgcgaaaccgcctgcctgggcaagagctacgcccagatgtggcaactgatgtacttccaccggcgcgacctccggctggccgccaacgcgatctgctccgccgtacccgtggattgggtacccacaagccgcaccacatggagcatccacgcccaccaccagtggatgactaccgaggacatgctgtccgtgtggaaccgcgtatggatcgaagagaatccgtggatggaggacaagacgcacgtgagctcctgggaggaggtgccgtaccttggcaagcgtgaagaccaatggtgcggaagcctaatcggcctgaccgcccgagcgacctgggccactaacatccaagtagccataaaccaagtgcgccgacttataggcaacgagaactacctggactacatgacgtccatgaagcggttcaagaacgagagcgatcctgagggtgccctgtggtaa

SEQ ID NO: 24025 - RNA, 9879 nt, synthetic construct
  misc_feature 1..9879: note = derived and/or modified CDS sequence (opt11) from DENV-1__FJ547087__SS-prME
  source 1..9879: mol_type = other RNA
tcggtgaccatgctgctcatgctgttgcccacggccctcgctttccacctaaccaccaggggcggggagccccacatgatcgttagcaagcaagagcgggggaagagcctcctgttcaagacttcggctggggtcaacatgtgcaccttaattgccatggacctgggcgagctctgcgaggatactatgacctacaagtgcccccggattaccgaggccgaacccgacgacgtggactgttggtgtaacgccactgacacgtgggtgacctacggaacttgcagccaaaccggcgaacaccgacgcgacaaaaggtccgtggctctggcaccccacgtgggcctagggttggagaccagaacagagacctggatgagctccgagggcgcctggaagcagatccagaaggtcgagacctgggctctgcggcaccccgggtttacggtgatcgctctatttctggcgcacgccatcggcacctctatcactcagaaaggcataatcttcatactcctaatgctagtgacccccagcatggccatgcgctgcgtcggcatcggcaaccgggacttcgtggagggtctgagcggagccacgtgggtggacgtcgtgctggagcacggaagctgtgttaccaccatggccaagaacaagcccaccctcgacatcgagctgctcaagacggaggtgaccaaccccgctgtgctccgtaagctgtgcatcgaggccaagatcagcaacaccacaactgacagtagatgcccgacccagggagaggccaccttagtggaagagcaggacgccaactttgtatgccgccgaacctttgttgaccgcggctgggggaacggctgcggtctattcggcaagggatccctcctgacctgcgccaagttcaagtgtgtgaccaaacttgagggcaagatcgttcagtatgagaacctgaagtactccgtgattgtcaccgtccacacaggggaccaacaccaagtaggtaacgagacgaccgagcatggcaccatcgcgaccatcacgccgcaggcccccacgtcagagatccagctgaccgactacggcgctctcaccctggattgtagcccccggaccggcttagatttcaacgaaatggtcttactcacgatgaaggagaagtcctggctggtgcacaagcagtggttcctcgacctgccgctgccttggacttccggtgcctcaaccagccaggagacatggaaccgccaggatctcctggtgacatttaagactgcccacgcgaagaagcaggaggtcgttgtgctgggctcccaggagggagccatgcataccgccctcactggggccacggaaattcagaccagcggcaccactacgatcttcgctggacatctgaagtgccggttaaagatggacaagctgacattaaagggcatgtcctacgtcatgtgcaccgggagcttcaaactggagaaggaggtggcggaaacccagcatggcaccgtgctcgtccaggtgaagtacgagggcaccgatgccccctgtaagatccccttcagcacccaggacgagaagggagtgactcagaacggccgccttatcacggcaaacccgatagtcaccgacaaagagaagcccgtgaacatcgagacggaaccacccttcggggaatcgtacattatggtgggtgcaggagagaaagcgctgaaactatcctggttcaagaaggggagctcaataggcaagatgttcgaggccaccgcccggggggcacgtcggatggcaatcctcggcgacaccgcgtgggactttgggtcaattggaggcgttttcacctcggtggggaaactcgttcaccaggtcttcggcaccgcctacggggtgttgttcagcggcgtttcctggaccatgaaaatcgggatcggcatcctcctgacgtggctgggcctcaacagcaggagtgcgagcttgtccatgacctgtatcgcagtcgggatggttacgctgtacttaggagtgatggtccaggccgatagcggatgcgtgatcaactggaaggggcgcgagctgaagtgtgggtccggcatctttgtgacaaacgaagtccacacgtggaccgagcagtacaagtttcaggccgactccccgaagcggctgagcgccgccatcggcaaggcctgggaggagggggtgtgcggtatcaggtccgccactcggctcgaaaacataatgtggaagcagatcagcaatgagctgaaccacatcttgctcgagaacgacatgaagttcaccgtggtcgttggggatgcgaacggtattctggcccaggggaagaagatgatccggccccaacccatggagcacaagtactcctggaagtcctggggcaaggccaaaatcatcggcgccgacatccagaacaccaccttcatcatagacgggcctgacaccccggagtgccctgacgaccagcgggcgtggaacatctgggaggtggaggactatggcttcggcatcttcacgaccaacatctggctgaagctccgagattcctacacgcagatgtgcgatcatcggctaatgagcgccgccataaaagactccaaggccgtccatgccgatatgggctactggatcgaaagtgagaagaacgagacatggaagttggctcgcgcctccttcatcgaagtgaagacctgcatctggcccaaatctcacaccctctggtccaacggcgtgctagagtcagagatgatcatcccgaaaatctacgggggcccgatttcccagcacaactacaggcccggttatttcacgcagaccgcgggtccctggcaccttgggaagctcgagctggacttcgacttatgcgagggcacgaccgtcgtggtggacgagcactgcgggaaccgcgggcccagcctccggactacgaccgtcaccggcaagatcatccacgaatggtgctgccggagttgcacgctgccacccctccggttccgaggggaggatggctgttggtacgggatggagattcggcccgtgaaggagaaggaggagaacctcgtgcggtccatggtttccgccggcagcggcgaggtggattctttttccctggggatcctgtgcgtcagcatcatgatcgaagaggtcatgcggtcccgctggagccggaagatgctcatgacgggtacgctggccgtcttcctgctcctgatcatggggcagctgacctggaacgacctaatccgcctgtgcataatggtaggggctaatgcatccgatcgcatgggtatggggaccacctacctggccctcatggcaaccttcaagatgagaccgatgttcgcagtcgggctgctgttcagacgactcacaagccgcgaggtgttgctgcttacgattgggctgtccttggtggcttcagttgagctccccaactccttggaagagctgggcgatggcctcgctatgggcatcatgatgttgaagctcctcaccgaattccagccccaccagctttggaccaccctgctcagcctgaccttcatcaagaccacactgtccctcgactatgcctggaagacgatggctatggttttgagcattgtttcactcttccccctctgcctgagcacgacctcccagaagaccacttggctgccggtgctcctgggctcattcgggtgcaagcccttaacgatgttccttattaccgagaacaaaatctggggccggaagtcctggcctctgaatgaggggatcatggcgatcggcatcgtaagcatcctgctgtccagcttgctgaaaaatgacgtccccctcgccgggccgcttatcgccggcggcatgctgatcgcttgctatgtaatcagtgggtccagcgcggacctctccctcgagaaagctgccgaggtgtcgtgggaggaagaggccgagcactcaggtacctcgcataacatcctggtcgaggtgcaggacgatggaaccatgaagattaaagatgaggagcgggacgataccctcacgatcttactgaaggctaccctcctggccgtgtccggcgtctacccgatgagcatacccgcgaccctgtttgtgtggtacttctggcagaaaaaaaaacagcggtccggggtcctctgggatactcccagcccgcccgaggtcgagcgcgctgtactggacgatggcatttatagaatcctgcagagaggcctgctcggcaggagtcaggtgggcgtcggggtgttccaggacggcgttttccacacgatgtggcacgtaacccgcggggccgtgttgatgtaccagggtaagcgattagagccctcctgggccagtgtgaagaaggatctcatcagctacggcggggggtggcgcttccagggctcctggaataccggcgaggaggtgcaggtcatcgccgtcgagcccgggaagaacccgaaaaacgttcagaccacacccggtaccttcaagacgcccgagggggaggtgggcgcgattgccctggacttcaagcccggcacaagcgggtctccgatcgtgaaccgggagggcaagattgttggcctgtacgggaacggcgtggtaactaccagtgggacatacgtctccgccatagcccaagccaaggcgagccaggatggacccctccccgagattgaggacgaagttttcaagaagcgtaacctgaccatcatggacctacaccctggaagcggcaagacgcggagatatctccccgctatcgtgcgggaggcaatcaaaaggaagctacggacgctaatcctggccccaacccgcgtcgtggcgagcgagatggctgaagcgctcaagggcatgccgatccgctaccagaccacggccgtcaagagcgagcacaccgggcgggagatcgttgacctgatgtgccacgccaccttcaccatgcgcctcctgtccccggtgcgggtgccaaactataacatgatcatcatggacgaggcccacttcactgaccccgccagcatcgccgcccgcggctacatctccacccgggtcgggatgggcgaggccgcggcgatcttcatgaccgccacgccacccggaagcgtggaagcgtttccacagtctaacgccgtgatccaggacgaagagcgcgacatcccggagcggtcttggaactccggctacgactggataaccgacttccccggcaagacggtctggttcgtgccgagcataaagtcagggaacgatatagccaactgcttgcgcaagaacggcaagcgggttatccagttaagccgcaagactttcgacaccgagtaccagaagaccaaaaacaacgactgggactacgtcgtgaccaccgatatatccgagatgggggcaaacttccgggcagaccgcgtgatcgacccccggcgatgcctgaagccagtcattttgaaggacggccccgaacgggtgatcctcgccgggccgatgccagtgactgtcgctagcgctgcacagcgtcggggtcgcatcggccggaaccaaaacaaagagggggatcaatacgtgtacatgggtcagcccctgaacaacgatgaggatcacgcacactggacggaagcaaagatgctgctcgacaatatcaacacccccgaggggataatccctgcactattcgagcccgagagagaaaagagtgctgccatcgacggcgagtaccgactgcgcggggaggcccgcaagaccttcgtcgagctcatgcgacgcggcgacttgcccgtgtggctgtcgtacaaagttgcttccgaaggcttccagtatagcgaccgccgatggtgctttgacggcgagcgaaataaccaggtacttgaagagaacatggatgtagagatctggacaaaggagggggagcgcaagaagctgcggccccgctggctagacgcacgcacttactccgacccgcttgccttgcgcgagttcaaggagttcgccgccggccggcgcagcgtttccggcgacctgatcctcgagatcgggaagctgccccagcacctgaccattcgggcccagaacgcgctcgacaacctcgtcatgttgcacaactccgagcagggcggaaaagcctatcgccacgccatggaagaactccccgacaccatcgaaaccctgatgctactagctctgatcgcggtgctgaccggcggcgtgaccctgttctttctgagtgggaagggcttgggcaagacgtctatcgggctcctgtgcgtcatggccagctcagccctactctggatggcctccgtggagccacactggatagccgcgtccataattctggagttcttccttatggtgctcctgatcccggagcccgaccggcaacgcacgccacaggataaccagctggcctacgttgtgatcggcctccttttcatgatcttaaccgtggccgccaacgagatggggcttctcgagacgacgaaaaaggacttgggtatcgggcatgttgccgcggaaaatcaccaccatgccaccatgctcgacgtggaccttcggccagccagcgcctggaccctgtacgccgtggcaacgactgtcatcacccccatgatgcgccacaccatagagaacacaaccgccaacatctccctcaccgcgatcgccaaccaagccgcgatcttgatgggtttagacaaaggctggcccatttcgaagatggacatcggggtacccctcctggctctgggctgctacagtcaggtgaaccccctcactctgactgccgccgtcctgatgctcgtggcgcattatgccataattgggcccggcctgcaggccaaggccacccgggaggcgcagaaacgcacagcggctgggattatgaagaacccaaccgtcgatggcatcgttgccatagacctggaccctgtggtgtacgacgcgaagttcgagaagcagttaggccagatcatgttgctgatactatgcacgagccaaatcctgctgatgcgcaccacctgggctctctgcgagtccatcaccctggcgacggggccgctgaccaccctttgggagggcagccccggaaaattctggaacacaacgatcgctgtaagcatggccaacattttccggggcagctacctcgccggtgccgggctggcgttttccctcatgaagtccttgggaggggggcgccgggggaccggcgcgcagggcgagacgctgggggaaaagtggaagaggcagctcaatcagctgtccaagagcgagttcaacacctacaagcgaagcgggatcatggaggtagataggtcagaggccaaggaaggcctgaagcggggcgagacgacaaagcacgccgtgtcacgcgggaccgcgaagctccgctggttcgtcgagcgcaacctcgtgaagccggagggcaaagtgatagacctgggatgcggccgtggcgggtggtcctactactgcgccggcctgaagaaggtgaccgaggtcaaggggtacacaaagggcggccccggtcacgaagagccgatccctatggccacctacggctggaacctggtgaagctgcacagcgggaaagacgtctttttcacaccgcccgagaagtgtgacacccttctctgcgacatcggggagtccagcccgaatcccaccatcgaggagggccgcaccttgcgcgttctgaagatggtggaaccctggctgcgcggcaaccaattctgcatcaagattttaaatccctacatgccgtcggttgtggaaaccctggaacaaatgcagcggaagcacggcggcatgctcgtgcgcaaccccctgagcaggaactcaacgcacgagatgtactgggttagctgcggcaccgggaacatcgtgtcagccgttaatatgacgagccgcatgttgctcaaccggttcaccatggcccacaggaagcctacttatgagcgcgacgtggatctgggcgctggcaccaggcatgttgccgtagagcccgaggtggccaacctggacattataggtcagcgcattgagaacataaaaaatgagcataagtccacgtggcactacgacgaggacaacccgtacaagacttgggcttaccacggctcctacgaggtgaaaccctccgggagcgcatccagcatggtgaacggagtcgtgcgtttgctgaccaagccgtgggatgtcatccccatggtcacacagatcgccatgacggatacaaccccgtttgggcaacagcgcgtatttaaagagaaggtcgatacaagaactccccgcgcaaagcggggtacggcccagatcatggaggtgaccgccaaatggctatggggcttcctctccaggaacaaaaagccccggatctgcacccgcgaagaattcacgaggaaggtgcgcagcaacgccgcgataggcgccgtcttcgtggatgagaaccagtggaacagcgccaaggaggccgtggaggacgagcggttctgggatctggtccacagagaacgggaactgcacaagcagggcaagtgtgcgacgtgcgtgtacaacatgatggggaagcgcgagaagaagctcggcgagttcgggaaggcaaagggatcccgggccatctggtacatgtggttgggcgcccgctttctggagttcgaagcattgggtttcatgaacgaggaccattggttcagccgagagaactcgctgagcggcgtcgagggcgaaggcctgcacaagctcgggtacatcctgcgcgacatctccaagatcccgggcggcaacatgtacgcggacgataccgcggggtgggacacccgtataacggaggatgacctgcagaacgaggccaagatcaccgacataatggagcccgaacatgccttgctggccaccagcattttcaagctgacctaccagaacaaggtcgtccgcgtgcagaggcccgcgaagaacggaacggtcatggacgtgatttcccgcagggaccagcgcgggagcggacaggtcggaacatacgggctcaacaccttcaccaacatggaggttcaactgatccgccagatggagtctgagggcatctttctgccctgcgaattggagacgccgaaccttgccgagagggtgttagattggctcgagaaacacggggcggagcgcctaaagcgtatggccatcagcggcgacgactgtgtggtgaagcccatcgacgaccggttcgccaccgctctgatcgccctcaacgatatgggaaaggttcggaaggacatcccccagtgggagccgtccaaaggctggaacgactggcagcaggtccctttctgttctcaccacttccaccaactgatcatgaaggacggccgcgagatcgtcgtgccctgccggaaccaggacgagctggtggggcgggcccgggtctcccagggcgccgggtggagcctacgcgagaccgcgtgcctcggcaagtcctacgcgcagatgtggcagctgatgtactttcaccgccgtgacctccggctggccgctaacgcgatctgcagcgcggttcccgtggactgggtcccaacctcccgcacgacatggagcatacacgcccaccaccagtggatgaccaccgaggatatgctttccgtgtggaaccgggtgtggattgaagagaacccgtggatggaagataagacacacgtctccagctgggaggaggtgccctacctagggaagcgcgaggaccagtggtgcggctccctgatcgggttaaccgcccgcgccacctgggccaccaacatccaggtggcgattaaccaggtccggcgcctcattggaaacgagaactacctggactacatgaccagcatgaagcggttcaagaacgagtccgaccccgaaggcgccctctggtga

SEQ ID NO: 24026 - RNA, 9879 nt, synthetic construct
  misc_feature 1..9879: note = derived and/or modified CDS sequence (opt11) from DENV-1__FJ410186__SS-prME
  source 1..9879: mol_type = other RNA
agcgttaccatgctgttgatgctgctaccgaccgctctcgccttccacctgacaaccagaggaggggagcctcatatgatagtgagcaagcaggagcgaggcaagagtcttctcttcaaaaccagcgcaggggtgaacatgtgtacgcttatcgccatggatttgggtgagctatgcgaagatactatgacatacaagtgcccccggatcacagaggttgagcccgacgacgtcgactgttggtgcaacgccaccgatacgtgggtgacgtacgggacctgcagccaaaccggcgagcaccggcgcgacaaacgctccgtggccctggcgccccacgtcggcctggggctcgagacgcgcaccgagacctggatgagctccgagggcgcctggaaacagatccagaaggtggaaacctgggccttacgacacccggggtttactgtaatcgcctttttcctggctcatgcgatcgggaccagcatcacccagaaggggatcatctttatccttctgatgctggtaacccccagtatggccatgcgctgtgtgggcatcggcaatcgcgactttgtggaggggctcagcggtgccacgtgggtcgatgtggtgttggaacacgggtcctgcgttaccaccatggccaagaataagccgacactggacatcgagctcctaaagacggaggtcacaaaccccgctgtcctgcgcaagctctgcatagaggcgaagatctctaataccaccacggacagcaggtgccccactcagggggaggccaccctggtcgaggagcaggacgctaatttcgtgtgtcgccggacctttgttgacagggggtgggggaacggctgcgggctgtttgggaaggggagccttctgacttgtgccaaattcaaatgtgtcaccaaactggagggcaagatcgttcagtatgagaacttaaagtactcagtgatcgtaaccgtgcacacaggagaccaacatcaggttgggaacgagacgacagagcatggaaccatcgccaccatcacaccccaggcgccgaccagcgagatccagttgaccgattacggggccctgactttagactgtagcccccggaccggtctggacttcaacgagatggtgttgctgacgatgaaggagaaatcctggctggtgcataagcagtggttcctagacctccctctgccctggacatccggagcctcgactagccaggagacctggaatcgacaagacttactcgtcacgttcaagaccgcgcacgctaagaagcaggaggtggttgtccttggtagtcaagagggcgcgatgcacaccgccctaaccggggccacagaaatccaaaccagcggcaccaccactatattcgcaggtcacctcaagtgcaggctgaagatggacaagctaacccttaagggcatgtcctacgttatgtgcaccggttcgtttaagcttgagaaggaggttgctgagacgcagcacggcactgtcctggtccaggtgaagtacgaaggcacggacgccccatgtaagatacctttttccactcaggacgagaaaggggtcacccagaacggacgccttataacggccaacccgatcgtgaccgacaaagaaaagccggtaaatattgagaccgagccgcccttcggcgagagctacattatcgtaggcgcaggcgagaaggccctaaagctgtcctggttcaaaaaggggagctccataggcaagatgtttgaagcgaccgcccgcggggcccgccgcatggccatactaggtgacacggcctgggactttgggagcatcggcggcgtattcacttctgtggggaagttagtacaccaagtgttcggcacagcatacggggtgttgttcagcggtgtctcctggaccatgaagatcgggataggaatcctactcacgtggctcggcctgaacagccgctcggcttcactcagtatgacctgcatagccgtgggtatggtgactctgtatctgggcgtcatggttcaggccgacagcgggtgcgttatcaattggaagggtcgcgagctgaagtgcggaagcggcatcttcgtcacaaacgaggtgcacacttggactgagcagtataaatttcaggcggacagcccgaaacggctgagcgcggccatcggcaaggcgtgggaggaaggtgtctgcggtatccgtagcgccacccgtctggagaacatcatgtggaagcagatcagcaacgagttgaatcatatcctgctcgagaacgacatgaaattcaccgtcgtggtgggggacgccaacgggatcctcgcgcaggggaaaaagatgatcagaccccagccaatggagcataagtactcctggaagtcctggggcaaggcgaagataatcggcgctgacattcaaaacacgacttttatcatcgacgggccagacacgccggagtgcccggacgaccagcgagcttggaatatctgggaggtcgaggactacggctttgggatcttcacaacgaacatctggttaaagctaagagactcctacacgcagatgtgcgaccaccgccttatgtcagcggccatcaaagactccaaggcggtgcacgccgacatggggtactggatcgagagcgagaagaacgagacctggaaactcgcccgggcgtctttcatagaagtaaaaacctgtatctggcccaagtcccacactctttggtcaaacggcgtgctcgaaagcgaaatgatcatcccgaagatctatgggggaccgacgtcacagcataattacagacccgggtacttcacccagaccgccggaccatggcacctgggcaagctggagctcgactttgacctatgcgagggcaccacggtggtggtggacgaacactgcggcaacagagggccgtcgctgcggacaaccaccgtgacgggcaaaatcatccatgagtggtgttgtcgctcgtgcaccttaccgccgttgcggttccgcggggaggacggttgctggtacgggatggagatacggcccgtgaaggagaaagaggagaacctggttcggtccatggtgtccgctggttcaggtgaggtggacagcttctccctcgggatcctgtgcgtctcgatcatgatcgaggaggtcatgcggtcacgctggtcgcgtaaaatgttgatgactgggacgttagcggtgttcctactcctcataatgggacagttgacttggaacgacctgatcaggctctgcatcatggtcggcgcgaacgcgtccgacaggatgggtatgggcaccacctacctggcccttatggccactttcaaaatgagaccgatgtttgccgtgggcctcctgttccgccggctcacctcacgcgaggtcctcctgttaaccatagggctcagtctggttgcctccgtggaactgcccaactccctcgaagagctaggcgatggtctggcaatgggcatcatgatgttaaaactgctaaccgagttccagccacaccagctctggactaccctgctgtcgctcaccttcatcaagacgaccctgtccttggactatgcctggaagactatggccatggtcctaagcatcgtcagtctgttcccactgtgtctcagcaccacctctcagaaaacaacatggctgccggtgctgttaggcagcttcggttgcaagcccttaaccatgttcctgattaccgagaataaaatctggggccgtaagtcctggcccctgaacgaaggcatcatggcaatcggcatcgttagcatcctgctctcctcgctcctgaagaacgacgttcctttagcagggcccctcattgcaggcggcatgctgatcgcctgctacgtgatctcgggttctagcgcagacttgtccttggagaaggccgcggaagttagctgggaggaggaggccgagcactccggcaccagccacaacatcttagtggaggtgcaagacgatgggactatgaagattaaggacgaggagcgcgacgacactctgaccatcctcctaaaggccacgctgctcgctgtcagcggcgtttacccaatgagcattcccgccaccctgttcgtgtggtacttctggcagaagaagaagcagcggtccggcgtcctgtgggatacgccctcgccccctgaggtggagcgggcggtgctagatgacggaatatatcggattcttcagcgtggattactgggacggtcccaggttggcgtgggggtgttccaggatggcgtcttccacaccatgtggcacgttaccaggggcgctgttctcatgtaccagggtaagagactggagcccagctgggccagcgtgaagaaggacctgataagctacggtgggggatggcgtttccaggggctttggaacaccggtgaggaggtacaggtcatagccgtcgagccgggcaagaaccctaagaacgtgcagacgaccccgggcacctttaaaacgcccgagggagaggtaggtgcgatcgcgctggacttcaagccgggcacgtccgggtctcctatcgtcaatcgtgagggtaaaattgtgggcctttacgggaacggcgtggtcaccacctccgggacgtacgtgtctgccatcgcccaggccaaggcctcccaggaaggaccacttccggaaatagaggacgaagtgttcaaaaagcgaaatctgacgatcatggacttgcacccagggagcggcaaaacccggagatacctccccgctatcgtccgcgaagccatcaaacgcaagctgcggaccttgatcttggcgcccactcgcgtggtcgccagcgagatggcggaggccctgaagggcatgcccatccgctaccagacaaccgccgtgaagtccgagcacacggggcgggagatcgtggacttgatgtgtcacgccaccttcacgatgcgtctactaagcccggtgcgggtcccaaactacaacatgatcatcatggacgaagcccacttcaccgacccagcgtccatcgccgctcgcggctacatatctacccgtgtggggatgggcgaggccgctgctattttcatgaccgccacccccccggggtccgtagaggcctttccccagtcaaacgctgtcatccaggacgaggagcgagacatccccgagaggtcctggaacagtggctatgattggattaccgacttccctggcaagaccgtgtggttcgttccgtccatcaagtctgggaacgacatagccaactgcctgcgcaagaacggcaaacgggtcatccagctcagcagaaagacctttgacacggaataccaaaagaccaagaacaacgactgggactatgtggtaacgaccgacatttcagagatgggggcgaacttccgggcagaccgcgttatcgatccccggaggtgcctgaagccagtgattctgaaggacgggcccgaaagagtgatcctagccggtccgatgcccgtcacggtggcctccgcggctcagcgccggggtcgcataggccgcaatcagaacaaggaaggggatcagtacgtgtacatgggacagcccctgaacaacgacgaggaccatgcgcactggacagaggcgaagatgttgctcgacaatataaacacccccgaggggatcataccagccctatttgaaccagagcgagagaaatccgcagccattgacggcgagtaccgcctgcgcggggaggcacgaaaaaccttcgttgagctcatgcgacgcggagacctacccgtatggctgtcctacaaggtcgcctctgaaggctttcagtactcagaccgccgctggtgcttcgacggggaacgcaacaaccaagtcctcgaggagaacatggatgtggagatatggacaaaggagggtgagcgcaagaagctgcgtccccgctggctcgatgcgcggacatactcggatccgctcgcgcttcgcgagttcaaggaatttgccgccggtcggcgctccgtcagcggcgacctgattctcgaaattgggaagcttcctcagcacctaaccctccgggcacagaacgccctggataaccttgtgatgttacacaatagcgagcagggcgggaaggcatatcgccacgcaatggaggagctgccagacacaatcgaaacgttaatgctcctcgcactgatagccgtcctcacggggggcgtcaccctattcttcctttcggggaagggcctgggaaagaccagcatcgggctgctgtgcgtgatggcttcaagcgcgttgctttggatggcctccgtggaaccccactggatagccgcctccatcatcctagaattcttcctaatggtcttactgatcccggagcccgaccggcaacgcacgccgcaggataaccagttagcgtatgtagtgatcggcctgttgttcatgatacttactgtcgcagcaaacgagatggggctgcttgagaccaccaagaaggacctcggcatcgggcacgtggccgcagagaaccatcatcacgcgactatgctggacgtggacttgcggccggccagtgcgtggacgttatacgctgtcgccaccaccgtgattacgcccatgatgcgacacacgatcgagaatactaccgcgaacatatcgctgaccgcaatcgcaaaccaggctgcaatcctgatgggtctagataagggctggcccatctccaagatggacatcggtgtgcccctgctggcgctcggctgctactcgcaagtgaacccactgactcttaccgccgccgtactcatgctagtcgcacactacgcgataatcggacccgggctgcaggcccgggccacacgcgaggcccagaagcgcacagccgcagggatcatgaaaaaccccaccgtcgacggcatcgtagctatagatcttgaccccgtggtttatgacgccaagttcgagaaacagctggggcagattatgctgctgatcttgtgcaccagccaaatcctgctcatgaggactacctgggccctgtgcgaaagcatcactctagccacagggccgctaaccaccctgtgggaaggttcgcccgggaagttctggaatactaccatcgctgtgtctatggccaatatcttccgtggctcataccttgccggcgccgggcttgccttcagtctgatgaagtctctgggcgggggccgacgcgggaccggcgcgcaaggcgaaacgctcggggagaagtggaagcggcagcttaaccagctgtccaagtccgagttcaacacgtacaaacgcagcggtatcatggaggttgacaggagcgaagccaaggagggacttaagcgcggtgagaccaccaagcacgcggtcagccgggggaccgcaaagctgcgttggttcgtggagcgcaacctggtgaagcctgaaggcaaggttatcgatctgggctgtggcaggggagggtggagttattattgcgcgggactcaagaaggtgaccgaggtgaagggttataccaaggggggcccagggcatgaggagcctattccgatggccacttacggctggaacctagtcaaactgcattctgggaaggacgtcttcttcacgccacccgaaaagtgcgacaccctcctctgtgacatcggagagagctccccaaaccccacgatcgaggaggggcggaccctgagagtgctcaaaatggtcgaaccgtggctgcggggcaaccagttctgcatcaagatactgaacccatacatgcctagcgttgtcgagaccctcgagcagatgcagcgtaagcatggcgggatgctggttcggaacccgttatcccgcaacagcacccacgaaatgtactgggtgtcctgcggaacgggcaacatcgtgagcgccgtcaacatgacctcccggatgctcctgaaccgttttacaatggcgcacagaaagccaacctacgagagagacgtggacctgggcgccggcacgcggcacgtcgcggtagagcccgaggtggccaacttggatatcatcgggcagcggattgagaacattaaaaacgaacataaaagcacctggcactacgatgaggacaacccttacaagacctgggcctaccacggctcctacgaagtcaagcctagcgggtcggcgagctccatggtcaacggcgtagtccgcctgctgaccaagccttgggacgtgatccctatggtgactcagatcgccatgaccgacaccacgccgttcggccagcagagggtattcaaggagaaggtggacacgcgcacgccccgggcgaagcgcgggaccgcacagattatggaagtgacagccaagtggttatggggattcctgagcaggaacaagaaaccccgcatatgtacgcgcgaggagttcacccgaaaagtccgctcgaacgcagccatcggcgcggtgtttgtagacgagaaccagtggaatagcgccaaggaggccgtggaagacgagcgcttttgggacctggtacggagggaaagggagttgcacaaacagggcaagtgcgcaacctgcgtttacaacatgatgggaaagagggaaaagaagttaggggagttcgggaaagctaagggcagtagggctatctggtacatgtggctaggcgccaggtttctcgagttcgaggccctgggcttcatgaacgaagaccactggttctcccgggagaactccttatccggagtagaaggtgagggcctccataagctagggtacatcctgagggatatctcgaagatcccgggcgggaacatgtacgccgacgataccgcgggttgggatacgcgcatcaccgaggatgacctccagaacgaggccaagataacagatatcatggagcccgagcacgcactattggctacctcgatattcaagctaacctaccagaacaaggtggtccgggtgcaacgccccgccaagaatggcaccgtgatggatgtgatcagtcggcgagatcagcggggatctggccaggtcggtacttacggtctgaacaccttcacaaatatggaagtgcagttgattcgccagatggagagcgaagggatctttcttccctctgagctagagacccccaacctcgccgagagagtgctcgattggctggaaaaacatggggccgagcggttgaaacggatggctattagcggggatgactgcgtggtgaagccggtcgacgaccgattcgccaccgcactcattgcgttgaacgatatggggaaggtccggaaggacattccccagtgggagcccagtaagggctggaatgactggcaacaggtcccgttttgcagccatcacttccaccagctgatcatgaaggacggacgcgagatcgtggtcccttgccgtaaccaggatgagttggtgggcagagcccgggtgtcacagggcgccgggtggagcctaagagaaactgcctgtctcggtaagagttacgctcaaatgtggcagctcatgtacttccacaggcgagacctgcggctggcggccaacgccatatgcagcgccgatccggtcgactgggtgccaacgtcccgcaccacctggtcaatccacgcgcaccaccaatggatgaccactgaagatatgctcagcgtgtggaatcgcgtctggattgaagaaaacccgtggatggaggacaagacgcacgtctccagctgggaggaggtgccctacctggggaaacgggaggaccagtggtgcggaagtctgatcggactcaccgcccgcgccacgtgggctaccaacattcaggtcgccattaatcaggttcggaggctgattgggaatgagaactacctcgactacatgatcagcatgaagcggttcaagaacgaatccgatcccgagggcgcgttgtggtga

SEQ ID NO: 24027 - RNA, 9879 nt, synthetic construct
  misc_feature 1..9879: note = derived and/or modified CDS sequence (opt11) from DENV-1__FJ410187__SS-prME
  source 1..9879: mol_type = other RNA
tcagtgaccatgctgctcatgctgttgcccaccgctttagcctttcacctgaccacccgggggggggagccccacatgattgtttccaagcaggagcggggtaagagcctcctgttcaagacctccgccgggatcaacatgtgcaccctgatcgccatggacctcggagagctctgcgaggacaccatgacatacaaatgcccccggatcaccgaggccgagccggacgacgtggactgctggtgcaacgccacagacacctgggtaacctacggtacctgtagccagaccggtgagcaccggcgcgacaagcggtccgtcgccctagcgccccacgtgggcctggggctcgaaacccgcaccgagacctggatgagctccgaaggcgcctggaagcagatccagaaggtggagacttgggcattgaggcaccccgggttcacggtcacggccctgttcctcgcgcacgccatcggcaccagtataacccagaaggggatcattttcatactgctgatgttagtgacgccctccatggccatgcgctgcgttggcatcggcaaccgggacttcgtggaggggcttagcggtgccacctgggtggatgtggtcttagagcacgggtcctgcgtaaccaccatggcaaaggacaagcccacgctcgacatcgagttacttaagaccgaggtgaccaaccccgcggtcctccgcaagctgtgcatcgaggccaaaatcagcaacaccacaaccgacagtcggtgccctacccagggcgaggccaccctggtggaggagcaggacagcaacttcgtgtgccgccggacgttcgtcgaccgcggctgggggaatggttgcggcctcttcggcaaggggtccctgctgacctgcgccaagtttaaatgcgttaccaagctcgagggcaagatcgtacagtacgagaaccttaagtacagcgtcatcgtcacagtgcacacgggcgatcagcaccaggtcggcaatgaaaccaccgagcacggcaccatcgcaaccatcacgccccaagcgcccacctccgagatccagctgaccgattacggggccttaaccctggactgtagcccgcggacgggactggatttcaacgaaatggtgctcctgacgatgaaggagaagtcctggctggtccacaagcaatggttcttagacctgccgctgccatggaccagtggggccagcacctcccaggagacgtggaatcgccaggacctcctagtcaccttcaagaccgcccacgcgaagaaacaggaggtagtcgtactgggctcgcaagagggcgctatgcacaccgccctcacgggagcaacagagatccagacctcaggtacaaccaccatattcgccgggcacctgaagtgtcggctgaagatggacaagctcaccctgaagggcatgagctacgtgatgtgcacgggatccttcaagctggagaaggaggtagcagagacgcagcacggcaccgtgctggtgcaggtcaagtacgagggcaccgacgcgccctgcaagatcccattcagcgcccaggatgagaagggggtgacccagaacggccgcctcataaccgcaaacccgatcgtgaccgacaaggaaaagccggtcaacattgagactgagccgcccttcggggagagctacatcgtggtcggcgccggtgagaaggccctgaagttaagctggttcaagaaggggtccagcataggcaagatgttcgaggccacggccagaggggcccgtcggatggccatcctcggcgacacggcgtgggacttcggctctatcggcggcgtgttcaccagcgtggggaagttagtgcaccaggtcttcggcgccgcctacggagtgctgttcagcggcgtgagctggactatgaaaattgggattggcatcctcctgacctggctgggcctcaactccaggagcacgtccctgagcatgacctgcatagccgtcgggatggtgaccctgtacctcggcgtgatggtccaagctgactccgggtgcgtgatcaactggaagggccgagagctgaagtgcgggagcggcatttttgtgaccaacgaggttcacacatggaccgagcaatacaaattccaggcagacagccctaaacggctttccgccgccatcggcaaggcttgggaggagggtgtgtgcggcatccgcagcgccaccagactcgagaacatcatgtggaagcagatctccaacgagctgaatcacatcctgctcgagaacgacatgaagttcaccgtagtcgtgggcgacgcgaacggcatcctggcccagggcaagaagatgatccgcccccaacccatggagcaccggtacagttggaagtcctggggcaaggccaagatcatcggcgccgacatacagaacagcaccttcatcatcgacgggcccgacacgccggagtgccccgacgaccagagagcgtggaacatctgggaagtggaagactacggcttcgggatcttcaccaccaacatctggctgaagctccgggactcctatactcagatgtgtgaccaccgcctcatgagtgccgccatcaaggactccaaagccgtgcacgccgacatgggctactggatcgagagcgagaagaacgagacgtggaagctggcgcgggcctccttcatcgaggttaagacctgcatctggcctaagagccacaccctctggtccaatggcgtgctggagagtgagatgatcatcccgaagatctacgggggcccgatctctcagcacaattacaggcccgggtacttcacccagacggccggaccctggcacctggggaagttagaactggacttcgacctgtgcgagggcaccaccgtcgtggtggatgagcactgcggcaacagagggccgagcctccgcaccacgaccgtcaccgggaagatcatccacgagtggtgctgccggtcctgcaccctgccgcccctgcgcttccgcggggaagatgggtgttggtacgggatggagatccgtcccgtgaaagagaaggaagagaatctcgtgcggagcatggtcagcgcgggttccggcgaagttgactccttctccttagggatcctgtgtgtgagcatcatgatcgaggaggtcatgcgcagtcggtggtcccgcaagatgctcatgacgggcaccctggccgtttttctgctcttaatcatggggcagctgacttggaacgacttgatccgcctgtgcatcatggttggcgcgaacgcctccgatcggatggggatgggcaccacgtatctcgcactcatggccaccttcaagatgcgacctatgttcgccgtcgggctcctgttccggcgtctcactagccgggaggtactgctgctcaccatcgggctgtccctggtggcgagcgtcgagctccccaacagtctggaggagctgggcgacggcctcgctatgggcatcatgatgctgaaattgctcacagaattccaaccccaccagctgtggaccaccctgctctccctgaccttcatcaagacaaccctatccctcgactacgcctggcgaaccatggccatggtgttaagcatcgtctccctgttcccgctctgcctgtccaccacgtcccagaaaaccacctggctgccggtgctactgggatctttcgggtgcaaacccctgaccatgttcctcatcacggagaacaagatatgggggcggaagtcgtggcccctgaacgaggggataatggcaatcggcatcgtgagcattttgttaagctccctgctcaagaatgacgtccctctcgccggcccgctcatcgcaggcgggatgctgatcgcttgctacgtgattagcggttcctctgccgacctctccctggagaaggcggcagaggtgagctgggaagaggaggccgagcactctggtacaagccacaatatcctggtcgaagtgcaggacgatgggacaatgaagataaaggacgaggagcgagacgatacgctcaccatcctgctgaaggccacgttactggccgtgagtggcgtctaccccatgagcatccccgcgaccctgttcgtgtggtacttctggcagaagaagaagcagcggtccggggtcctatgggacacccccagcccgcccgaggtcgaacgcgccgtgctggacgacgggatctaccggatcctgcagcgcggcctgctcgggcgttcccaggtgggcgtcggggtgttccaagacggcgtgtttcacaccatgtggcacgtcacgcgcggggccgttttgatgtaccagggaaaacggctcgagcccagctgggcctctgtgaagaaagacctcatatcatacggaggaggctggcgcttccaagggagctggaataccggcgaggaggtccaggtgatcgccgtggagcccgggaaaaacccgaagaacgtccagaccacccccggcacgttcaagacccccgagggcgaggtgggggcgatcgcgctggacttcaagcccggtaccagcgggtccccgatcgtaaatcgggagggcaagatcgtcggcctgtacgggaacggcgtggtgaccaccagtgggacctacgtcagcgccatcgcccaggcgaagacctcccaggaaggccctctcccagagatcgaggaggaggtgttcaagaagcgcaacctcaccatcatggacctgcacccgggcagcggcaagactcggcgctacttgccagcgatcgtgcgggaagccatcaagcgcaagcttcgcactttgatcctcgcccccacgcgggtcgtggcctccgagatggcggaggccctgaaggggatgccaatccgctaccagaccacggccgtcaagagcgagcacactgggagagagatcgtcgacctgatgtgccacgccactttcactatgcgtctcctgtccccggtgcgggtgcccaactacaacatgatcatcatggatgaggcccacttcacggacccagctagcatcgcggcgcgcggctacatctccactagggtcggtatgggcgaggccgccgcgatctttatgaccgctacgccgcccgggagcgttgaggcgttcccccagtccaacgccgtgatccaggatgaggagcgtgacatacccgagcggagctggaactccggctacgattggattacggacttccccggcaagaccgtatggttcgtacccagcatcaagtccgggaacgacatcgccaactgtcttcgtaagaacggtaagcgggtgatccagctcagccgcaagaccttcgacaccgagtaccagaagacgcggaataacgactgggattacgtggtgaccaccgacatctcagagatgggggcgaacttccgcgccgaccgggtgatcgacccccgtcggtgcctgaaacccgtcatcctgaaggacggccccgagcgcgtaatcctcgccgggccgatgcccgtgacagtggccagcgcggcacagcggcgcggacgcatcggccggaaccagaacaaggagggtgaccagtacgtgtacatggggcagccactgaacaatgacgaggaccacgcccactggacggaggccaaaatgcttctggacaacattaacacccccgaggggatcatcccagccctattcgagcccgagcgcgagaagtccgctgccatcgacggcgagtaccggctgcgcggggaggcccggaagacttttgtcgaactcatgcgccggggagacctacccgtgtggctgagctacaaggtggccagtgaaggcttccagtactcggaccgcagatggtgtttcgacggcgaacggaacaatcaggtactcgaggaaaacatggacgtagagatatggaccaaggagggcgagcggaagaagctgcgcccccggtggctggacgcacgcacctacagcgacccgcttgcactgcgggagttcaaggagttcgccgccgggcgccggtccgtgagcggcgacctgatcttagagatcggtaagctgccacagcaccttaccttgcgcgcccagaacgctttagacaacctggtcatgctccacaattccgagcagggagggaaggcgtaccggcacgccatggaagaactccccgacaccatcgaaaccctgatgctcctggccctgatcgctgtgctcaccgggggagtcactctgttctttctgagcggaaagggcctcggcaagacctccatcgggctgctgtgtgtcatggcgtcttccgccctcctctggatggctaacgtggagccccactggatcgccgccagcatcatactggagttctttctcatggtgctactgatcccggagcccgacaggcaacggacgccccaggacaaccagttggcttacgtcgtgatcggcctgttgttcatgatcctcaccgtggccgccaatgagatggggctgctggagacgaccaagaaggacctcggaatcggtcacgtcgccgccgagaatcagcaccacgcgaccatgctggacgtggatctgcgcccggcctcagcctggaccctctacgccgtcgcaacgaccgtaatcacccccatgatgcgccacacaatcgagaacacaaccgcgaatatcagcctgacggccatcgccaaccaggccgccattctgatgggcctcgacaagggctggcccatctccaagatggatattggggtgcccctgctggcgctcggctgctacagccaggtgaatcctttgaccctgacggccgcagttctcatgctggtggcacactacgcgataatcggacccggtctgcaggccaaagccacccgcgaggcccagaagcgcacagccgccgggatcatgaagaaccccactgtggacggcatcgtcgccatcgacctcgaccccgtggtctatgacgccaagtttgagaagcagctgggccagatcatgctgcttatcctgtgcacgtcccagattctgctcatgcggaccacgtgggccctgtgcgagagcattacgctggccacggggccgctcactaccctgtgggagggatcccccgggaagttctggaacaccacgatcgcggtcagtatggccaatatattccgcggatcctacttagccggcgcagggctcgctttcagcctgatgaagtctctgggtggaggccggcgggggaccggcgcgcagggcgagaccctcggcgagaagtggaagcggcagctgaatcagctatctaagagcgagttcaatacctacaagcgctctggcatcatggaggtggacagaagtgaggccaaagaagggcttaagcgtggcgagacgacgaagcacgccgtgtcccgggggactgccaagctgcgctggttcgtagagcggaacctggtgaagcccgagggcaaggtgatcgacctgggctgcgggagaggcgggtggagctactactgcgcgggcctcaagaaggttactgaggtgaaggggtacacgaagggcggccccgggcacgaggagccgataccaatggccacctacggctggaacttagtgaagttgtactccggaaaggacgtcttttttacgccgcccgagaagtgcgacacactcctgtgcgacattggcgagtcatcgccgaaccccaccatcgaggaggggcggacactgcgcgtattaaagatggtggagccctggttacggggtaaccaattctgcataaagatactaaacccttacatgccgagcgtcgtagagaccctggaacaaatgcagcgcaagcacggcgggatgttagtgcggaaccccctttcccggaacagcacccacgagatgtactgggtgtcctgcggcactggtaatatcgtgtcggcggtgaacatgacgagccgcatgctcctgaaccggttcacaatgacccaccgcaagcccacgtacgaacgggacgtcgacctgggcgccggcacgcgccacgtcgccgtggagcccgaggtagcgaacctcgacatcatcgggcagcgaatcgagaacatcaagaacgagcacaagagcacctggcattatgatgaggacaacccatataagacctgggcctaccacggctcctacgaggtcaagcccagcgggtccgctagctccatggtgaacggcgttgttcgactgctgaccaagccttgggacgtcatacccatggtgacccagatagccatgactgacaccactcccttcggccagcagcgggtgttcaaggagaaggtcgacacacgcacgccccgtgccaagagaggcaccgcccagataatggaagttaccgcgaaatggctctggggcttcctgagccggaataagaagccccggatctgcacgcgggaagagtttaccaggaaggtgaggtcgaacgccgctatcggggccgtcttcgtggacgaaaaccagtggaacagcgcaaaggaggctgtggaagacgagagattctgggacctggtccatcgggagcgcgagctccacaagcagggtaagtgtgcgacctgcgtgtataacatgatgggtaagcgggagaaaaagctgggagagttcggcaaggccaagggcagcagggcgatctggtacatgtggctgggcgccagatttctcgagttcgaggccttggggttcatgaatgaagatcactggttctcccgcgagaatagcttctccggcgtcgaaggggagggcctgcacaagctcggctatatcttgcgcgacatatcgaagatcccgggcggcaacatgtacgcagacgacactgctgggtgggacacgcggatcaccgaggacgacctccagaacgaggcgaaaataacggacatcatggagcccgagcacgccctcctggccacctccatctttaaactcacgtaccagaacaaggtagtacgcgtgcagaggcctgccaagaacggcaccgtaatggatgtgatcagccgccgggatcagcgcggatccggccaggtaggcacctacgggttgaacaccttcacgaatatggaggtccaactgatccggcagatggagagcgagggcatcttcctgccttccgagctcgagaccccgaatctggccgagcgcgtgctggactggctagaaaagcacgggaccgagcgactgaagcgcatggcgatctctggcgacgactgcgtggtcaagccggtggatgatcggttcgccaccgccctgatcgctctcaacgacatggggaaagtgcgcaaggacatccctcagtgggaacccagcaaaggctggaacgactggcagcaggtcccgttctgcagccaccacttccatcagctgatcatgaaggacggccgggagatagtggtgccctgccgcaaccaggacgagctggtcggtcgagcccgcgtgtcccaaggcgcagggtggagcctacgggaaacggcctgcctgggcaagtcctacgcccaaatgtggcaactgatgtactttcaccgtcgcgaccttagactagccgcaaacgcaatctgcagcgccgtgcccgtcgactgggtgcccaccagccgcacgacctggtcaatccacgcccaccaccagtggatgaccacggaggacatgctgagcgtttggaaccgggtctggatcgaggaaaacccgtggatggaggacaaaactcacgtgtccagctgggaagaggtgccctacctcgggaagcgcgaggaccaatggtgcggctccctgatcgggctcaccgcccgggcgacctgggccacgaatatccaggtcgccatcaaccaggtgcgccgcttgatcgggaacgagaactacctggattacatgaccagcatgaagcgcttcaaaaacgagtccgaccccgagggcgccctgtggtga

SEQ ID NO: 24028 - RNA, 9879 nt, synthetic construct
  misc_feature 1..9879: note = derived and/or modified CDS sequence (opt11) from DENV-1__FJ478457__SS-prME
  source 1..9879: mol_type = other RNA
tcagttaccatgctcctaatgctgctgcccaccgcgctcgccttccatctgaccaccagaggtggcgagcctcatatgatagtgagcaaacaggaacggggcaaaagcctcctgttcaagacctcagcgggggtaaacatgtgtacgctcatcgctatggaccttggagagttgtgcgaggacacaatgacatacaagtgcccccgcatcaccgaggccgagccagatgatgtggattgttggtgcaatgccaccgacacatgggtcacctatgggacctgcagccaaacgggcgagcaccggagagacaaacggtccgtggctctggccccccacgtgggcctggggctcgagacgcgcaccgagacctggatgtcctccgaaggcgcatggaagcaaatccagaaggtagaaacatgggccctacggcaccccgggttcacggttatcgccctgttcctcgcgcacgccatcggcaccagcatcacccagaaggggatcatcttcatcctgttaatgctcgtcaccccctccatggccatgcgctgcgtaggcatcggcaaccgggacttcgtggaggggctcagcggcgccacctgggtggacgtagtgctggagcacgggtcctgcgtgacaaccatggccaagaataagcccaccctggacatcgagctcctgaagacggaggtcaccaaccccgcggtgctccgaaagctctgcatcgaggcgaagataagtaacaccactacggacagtcggtgcccgacccaaggagaagccacgctcgtagaggagcaggacgccaatttcgtctgtcgccggacatttgtggacagggggtgggggaacgggtgcggcctgttcggcaagggctctctgctgacttgcgccaaattcaaatgtgttaccaagctcgagggcaagattgtccaacatgaaaacctaaagtattccgtgatagtgaccgtgcacacaggcgaccaacaccaggtgggcaatgagacgaccgagcacggcacaatcgccaccatcacgccccaggccccgacaagcgaaatacagctgaccgactacggagccctcaccctggactgcagcccccggaccggcctggatttcaacgagatggtcctcctgactatgaaggagaaatcctggctggtgcataagcagtggttcctggacttgccactgccctggacgtccggtgccagtaccagccaggaaacgtggaaccgccaggacctcttggtgacgtttaaaacagctcacgcgaagaagcaggaggtcgtggtgctgggctcccaggagggcgcgatgcatacggccttaactggggccacggagatccagacgagcggcaccactacgatattcgcggggcacctgaagtgccggctgaagatggacaagctcaccctgaaaggcatgtcctacgtcatgtgcaccgggagcttcaagctggaaaaggaggtggcggaaactcagcacggcaccgtcttagtccaagtaaagtacgagggtaccgatgccccttgcaagatccccttttccacccaggacgagaaaggggtgacgcaaaacgggcgcctcatcacggcaaaccccatagtgaccgataaagagaagccggtgaacatcgaaaccgagccgccctttggtgagtcgtacattgtggtcggtgccggcgagaaggccctgaagctaagttggttcaagaaaggatcatccattggcaagatgttcgaggcgaccgcccgaggggcccgacggatggcaatcctcggcgacacggcgtgggatttcgggagcattggcggcatgttcacatccgttgggaagctggttcaccaggtattcggcacagcctatggggtgctgttcagcggcgtgtcctggacaatgaagatcgggattggcatcctcctgacgtggctgggcctcaactcccgctcgacgagcctgtccatgacctgtatcgccgtcgggatggtgaccctctacttaggggtaatggtccaggccgactccgggtgcgtgattaactggaaaggccgcgagcttaagtgcgggtccggcattttcgtgacgaacgaggtccatacgtggactgagcagtacaagtttcaggccgactcaccgaagcgcctgtcggcggccatcggcaaggcctgggaggaaggggtgtgcggcatccgctctgcaacacggctcgagaacatcatgtggaagcagatctcaaacgaactaaaccacatcctgctcgaaaacgatatgaagttcacagtagtcgtgggcgacgcctccggaatcctggcccaagggaagaagatgatccgaccgcaaccaatggagcacaaatacagctggaaatcatggggcaaggccaagatcatcggtgccgatatccagaacaccacgttcatcatcgacgggcccgataccccggagtgctcggatgatcaacgggcttggaacatttgggaggtggaggactacggcttcggcatattcaccacgaacatctggctcaaactacgagattcctacacccagatgtgtgaccaccgactgatgagcgcggccatcaaagattccaaggcagtccacgcagacatgggctactggatagagagtgagaagaacgagacctggaagctggcgcgtgcgtcatttatcgaggttaagacctgcatctggccaaagagccacacgctctggagtaatggcgtgctggagagcgagatgatcatacccaagatctacgggggacccatttcccaacataactatcgaccggggtacttcacgcagactgccggtccctggcacctggggaagctagagctagattttgacctgtgcgagggcaccacggtcatcgtggatgaacactgcggcaatcgcggcccctctctccggaccacaaccgtgacgggaaaaattatccacgagtggtgctgtcgctcttgcaccctgccgcccttgcggtttcgcggggaggacggctgctggtacgggatggagatacggcccgtcaaggaaaaagaagaaaacttggttcgcagcatggtcagcgccggcagcggcgaggtcgatagcttctccctgggaatcctgtgcgtgtccatcatgatcgaggaagtgatgcggtccaggtggagccggaagatgctcatgaccggcaccctggccgtattcttactcctgatcatggggcagctaacgtggaacgacctcatcaggctgtgcatcatggtgggtgcgaacgcatcagaccggatggggatgggcacgacatacttggccttgatggccactttcaaaatgcggccaatgttcgccgtcgggctgctgttcaggagactcacgagccgggaggtccttttactcacgataggactgtccctggtcgccagcgtggagctcccgaactccctggaggagttgggggacgggctcgcaatgggcatcatgatgctgaaactactaaccgagttccagccccaccagctgtggacgaccttactctccctgacctttatcaaaaccactctgtccctcgattacgcctggaaaacgatggccatggctctgagcatcgtctccctgtttcccctctgcctgtccactacttcccagaaaaccacgtggttgcccgtgctccttggctcgttcgggtgcaagcctttgaccatgttcctcatcaccgagaacaagatctggggtcggaagtcctggcccctgaacgaagggataatggcgatcggaatcgtcagcatcctactcagctccctactgaagaacgacgtgcccctggccggccccctgatcgccggcggtatgctgattgcctgttacgtgatctccgggtcctcagccgacttaagtctggaaaaggcggccgaagtaagctgggaggaagaagccgagcactccggcaccagccataacatgttggtggaggttcaggacgacggtaccatgaaaatcaaggacgaggagcgcgacgacactttaaccatcttactgaaagccactctcttagccgtctccggcgtgtatccgatgagcatccccgcgacgctgttcgtgtggtacttctggcagaaaaagaaacagcggtccggggtcctctgggacacgccctccccgcccgaggtggagcgcgccgtgctggacgacggcatctaccgcatcctgcaacgtggccttctcgggcggtcccaagtcggggtgggggtgttccaggacggcgtcttccacaccatgtggcacgtgacacgcggggccgtgttaatgtaccagggcaagcggctcgaacccagctgggcctccgttaagaaggatctcatcagctacggcggtgggtggcgtttccaggggtcctggaacaccggtgaggaagtccaggtgatagccgttgagccgggtaagaaccccaagaacgtgcagacaaccccaggtacctttaaaaccccagaaggcgaggtgggggccattgccctggacttcaagcccggaacgagcgggtcccccattgttaaccgagagggaaagatcgtgggcctatacgggaacggcgtcgttaccacatctgggacctacgtgagtgccatcgcacaggcgaaggcgtcccaagagggcccgctcccagagatcgaagatgaggtcttccgtaagagaaacctgacgatcatggacttacaccccggtagcggcaagacccgcaggtatctacccgccattgtgcgcgaagccatcaagcggaagctgcgcaccctgatcctcgcccccacccgcgtagtggcatccgagatggcagaggccctgaaaggtatgccgattcggtaccagacgaccgccgtaaagagcgagcacaccgggcgagagatcgtggacctcatgtgtcatgcgaccttcacgatgcgtctcttatcccccgtcagagtcccgaactataacatgatcataatggatgaggctcactttaccgaccccgccagcatcgccgcccgagggtacatctccaccagagtaggcatgggcgaggccgcggcaatattcatgaccgccactccgcccgggagcgtcgaagccttcccgcaatcaaacgccgtcatccaggacgaggagcgggacatcccagagcgcagctggaattctggttacgactggatcaccgacttcccgggcaagactgtgtggttcgtgcctagcatcaagtcggggaacgacatcgccaactgcctgcggaagaacggcaaacgcgtcattcagcttagccggaaaaccttcgacacggagtaccaaaagacaaagaacaacgactgggattatgtggttaccaccgatataagcgaaatgggggccaactttcgcgcagaccgggtcatcgacccgcgacgttgtctgaagcccgttatcctaaaggacggccccgagcgagtgatactcgccggtcccatgccggtcacagtagccagcgcagcccaacggcgcggccgtatcgggcggaatcagaacaaggagggggaccagtacgtctacatgggccagcccctgaacaacgacgaggaccatgctcactggactgaggccaagatgctgctcgacaacataaacacccccgaggggatcatccccgccctgtttgagccggagagggagaagtccgccgccatcgacggcgaataccggcttcgtggggaggcacggaagacattcgtagagttgatgcgcagaggcgatctgcccgtgtggctgagctacaaggtcgcaagtgagggtttccagtactctgatcgtcggtggtgcttcgatggtgagcgcaacaatcaggtgctggaagagaacatggacgtggagatctggacaaaggagggcgaaagaaaaaaactgaggccgcgatggctggacgcgcgtacctactcagaccccctcgccctgcgggagttcaaggagttcgccgccgggcggcggtcggtcagcggcgatctgattctcgaaatcggcaagctcccgcagcatcttactcttcgcgcacagaacgcgctggacaatctagtaatgctccataactccgaacagggaggtaaggcctaccggcacgccatggaggagctgcccgataccatcgagacgctgatgctcctagccctgatcgcggtgttaaccgggggggtcactctgttcttcttgtcgggtaaggggctcggtaaaacatccattgggctgctatgcgtgatggccagttccgccttgctgtggatggcgagcgtggagccccactggatcgccgcgtccatcatcctggaattcttcctcatggtcctactcatcccggagccggaccgccagcggacgccccaggataaccagctcgcgtacgtggtgatcggcctgctattcatgatcctcacggtcgccgccaacgagatggggctgctggaaaccaccaagaaggaccttggcatcgggcacgtggccgcggagaatcaccaccacgccaccatgctggacgttgacctgcgcccagcatcggcatggacgctctacgcagtcgcgacgacagtgatcaccccgatgatgcggcacacgatcgagaacacaaccgctaacatctctttgaccgccatagccaatcaggccgcgatcctcatgggcctcgacaaaggttggcccatctctaagatggacataggggtgcccctgttagccctcggctgctactcccaggtcaaccccctgacgctgaccgccgccgtgctcatgttggtggcccactacgccatcatcgggccgggcctgcaggccaaggcgacccgcgaggcccagaagcgcaccgctgcggggatcatgaagaacccaacggtcgacggcatcgtggccatcgacctcgaccccgtggtctacgatgcaaagttcgagaagcaattaggccagatcatgctattgatcctctgcaccagccagatactgctcatgcggaccacgtgggccttgtgcgaatccatcacgctagcgaccggtcccctcaccaccctatgggagggcagcccgggcaagttctggaacacgacgatcgcggtatcgatggccaacatcttcagaggcagctacctggcaggggccgggctagcgttctccctgatgaaatccctgggcgggggccgtcgcgggacaggggcccagggggagaccttgggagagaaatggaagcgccagctgaaccaactgagcaagtccgagttcaatacttacaaacgctctggcatcatggaggtggaccggtctgaggccaaggagggtttaaagcgcggcgagaccaccaaacacgccgtcagcaggggaaccgcgaaactacgctggttcgtcgagcggaacctggtgaagcccgaaggcaaagtgatcgacctgggatgcggacgcggaggctggtcctattactgcgccggcttaaagaaggttacggaggtgaaagggtacaccaagggcgggccagggcacgaggagcccattcctatggctacttacggctggaacctggtaaagctgcacagcggcaaagacgtattcttcactccgcctgagaagtgtgacacccttctgtgcgatatcggcgagagttcccccaacccgacgattgaagaggggcggacactgcgcgtgttgaaaatggtcgagccttggttacgggggaaccagttctgtatcaagatcctgaacccctatatgccctccgtggtagagaccctcgagcagatgcagcgaaagcacggggggatgcttgtccggaacccgcttagccgcaattccacacatgagatgtactgggtgagttgcggcacggggaatatcgtttccgccgtcaatatgactagccggatgttactcaaccgattcaccatggcccaccgcaaacccacctatgagcgggacgttgacctgggcgcgggcacgcgccacgtagccgtcgagccggaggtcgcgaacttagacataatcgggcagaggatagagaacatcaagaatgagcataagtcgacctggcactacgacgaggacaacccttacaagacctgggcctaccacgggagctacgaggtaaaaccgtccggaagcgccagttcgatggtcaacggagtggtccgcctgctgaccaagccttgggacgtcatacccatggtgacgcagatcgcgatgacggatacgaccccctttgggcagcaacgggtcttcaaggagaaggttgatacaaggactccccgggccaaacggggcacggcgcaggtaatggaagtcaccgcgaagtggctctggggctttctcagtcggaataagaagccccgcatctgcacacgagaggagttcacccgcaaagtgcgatccaatgccgcgataggtgcagtgttcgtcgacgagaatcagtggaattctgccaaggaagctgttgaagacgagaaattctgggatctagtgcacagagagcgggagctccacaagcagggcaagtgcgcgacctgcgtttacaacatgatgggaaagcgcgaaaagaagttaggggagttcggcaaggccaagggctcccgggctatctggtacatgtggctgggagcccgcttcttagagtttgaggccctggggttcatgaacgaagaccactggttctcgcgtgagaactcgctgtcgggcgtggaaggggaaggactccacaaactgggctatatcctgagggacatctccaagattcccggaggaaacatgtacgcggacgataccgcgggctgggacacccgaataaccgaggacgatctccaaaacgaggcaaagataaccgacataatggagccggaacacgccctgctcgccaccagcatcttcaaactcacgtaccaaaacaaggtagtacgagtgcagcgaccagcgaagaacggcaccgtgatggacgtcatcagtcggcgcgaccagcggggctcgggccaagtgggcacctacgggctgaacacgttcacaaatatggaggtgcagctcattcggcagatggaatcggaaggcatcttcttgcccagcgagctggagactcccaaccttgccgaacgggtcctcgactggcttgagaagcacgggaccgagcgcctgaagcggatggccatctccggcgacgactgcgttgtcaagccgattgacgaccgcttcgccacggccctcatcgcgctgaacgatatggggaaggtccgaaaggacattccacaatgggagcccagcaagggctggaacgagtggcagcaagtcccattctgcagtcaccacttccaccagctgataatgaaggacggccgcgagatcgtggtcccgtgtagaaatcaggacgagctcgtgggtagggccagagtgtctcagggggccgggtggtccctgcgcgagaccgcctgcctgggaaaaagctacgcccagatgtggcagctcatgtatttccaccggcgcgacctgcggctagcagccaatgccatctgcagcgccgtccccgtggattgggttcccacctcccgaacgacctggagcatccacgcccaccaccaatggatgactacggaggacatgctctccgtctggaaccgggtgtggatcgaggagaacccttggatggaggacaagacccacgtgagttcctgggaggaggtcccgtacctggggaagcgcgaagaccagtggtgcggaagcctgatcgggctcaccgcacgcgccacctgggccaccaacatccaagttgcaatcaaccaggtgcggcgactgatcggaaacgagaactaccttgactatatgacctccatgaaacggttcaaaaacgagtcggaccccgagggcgcgctttggtga

SEQ ID NO: 24029 - RNA, 9879 nt, synthetic construct
  misc_feature 1..9879: note = derived and/or modified CDS sequence (opt11) from DENV-1__FJ410188__SS-prME
  source 1..9879: mol_type = other RNA
tcggtgaccatgctgctcatgctgctgcccaccgtgctcgctttccacctgaccactagagggggtgagccgcacatgatagtcagcaagcaggagcggggcaagagcctcttattcaagacctccgccggggtgaacatgtgcaccctgatcgccatggacctgggcgaactctgcgaggacaccatgacgtacaagtgcccccgtatcaccgaggccgaacccgatgacgtggactgctggtgtaacgccaccgacacatgggtcacctacgggacctgcagccagactggcgagcaccggagggacaagcggtccgtggccctggcgccccacgtcggcctggggctcgagacgaggaccgagacctggatgagctccgagggggcctggaaacagatccagaaggtggagacctgggccctgcggcatcccgggttcacggtgatcgcgctgttcttggcccacgcaatcggcaccagcattacccagaaggggatcatcttcatcctgctgatgctggtgaccccctccatggccatgcgctgcgtgggcatcggcaaccgggacttcgtcgaggggctgagcggcgcgacatgggttgacgtggtcctggagcacggctcctgcgtcaccaccatggctaagaacaagcccaccctcgacatcgagctgctgaagacggaggtgaccaaccccgccgtgctccgcaagctgtgcatagaggctaagatcagcaacacgaccacggactcccggtgtcccacccagggcgaggccaccctggtcgaggaacaggacgccaacttcgtgtgtcgccggacctttgtggaccgggggtgggggaacggatgcggcctcttcggcaaggggagcctgctgacgtgcgccaagttcaagtgcgtcaccaagctcgagggcaagatcgtccagcacgaaaacctgaagtactccgtgatcgtcaccgtccacaccggcgaccagcaccaggtcgggaatgagacgaccgagcacggcaccatcgccaccataacgccccaggcgccaacgtcagaaatacagctgaccgactacggggcgctcacactggactgcagcccccggaccggccttgatttcaacgagatggtgcttctgacgatgaaggagaagtcctggctggtgcacaagcagtggttcctcgacctgccgctgccttggacctccggggctagcacgtcacaggagacctggaaccgccaggacctcctggtcacgttcaagaccgcccacgccaagaagcaggaggtggtggtcctgggctcccaggagggcgccatgcacaccgctctcaccggggccacggaaattcagactagcggcaccaccacgattttcgccgggcacctgaaatgccggctgaagatggacaaactcaccctgaaaggcatgtcctacgtgatgtgtaccgggtccttcaagctggagaaggaggtggcggagacccagcacggcaccgtcctggtacaggtgaagtacgagggcaccgacgcgccatgcaagatacccttctccacccaggacgagaagggggtcacccagaacggccggctaatcacggccaacccgatcgtgaccgacaaggagaagcccgtgaacatcgagaccgaaccgcccttcggggagtcctacattgtcgtgggcgcaggcgagaaggcactgaagctgtcctggttcaagaagggaagctccatcggcaagatgttcgaagctaccgcccgcggggcccgccgaatggccatcctcggcgacactgcctgggacttcgggagcattggcggcatgttcacctccgtggggaagctggttcaccaggtgttcggaaccgcgtacggggtgctgttcagcggcgtctcctggaccatgaaaatcggaatcggcatcctcctgacgtggctgggcctaaacagccgctccactagcctgtccatgacctgcatcgcagtggggatggtgaccttgtacctcggtgtcatggtgcaggccgacagcgggtgcgtgatcaactggaagggccgcgaactgaagtgcggctccggcattttcgtgactaacgaggtgcatacctggaccgagcagtacaagttccaggcggacagcccgaagcggctaagcgccgcgatcggcaaggcctgggaggagggggtttgcggcatccgttccgccacccggctcgagaacatcatgtggaagcaaattagcaacgagctgaaccacatcctgctcgagaacgatatgaagttcaccgtcgttgtgggggatgcctcgggcatcctcgctcaagggaagaagatgatccgcccccagcccatggagcacaagtactcgtggaagtcctggggcaaggcgaagatcatcggcgccgacatccagaacaccacgttcataatcgacgggcccgacaccccggagtgcagcgacgaccagcgggcctggaacatttgggaggtcgaggactacggcttcgggatcttcactacgaatatctggctgaaattacgcgactcctacacccagatgtgcgaccaccggctgatgagcgccgcgataaaggactctaaggccgtgcatgccgacatgggatactggatcgagagcgagaagaacgagacctggaagctggcgcgcgcttcgtttatcgaggtgaagacctgtatctggcccaagagccacacgctctggtccaacggcgtattagagagcgagatgatcatccccaagatctacgggggtcccatctcccagcacaattaccggccggggtactttacccagactgcgggcccatggcacctggggaagctcgagctcgacttcgatctgtgcgagggcaccacggtgatcgtggacgagcactgcggcaaccgcgggccctccctccggaccaccactgtcacgggcaagatcatccacgagtggtgctgccgctcctgtaccttaccgcccctgcggttccgcggggaggacggttgctggtacggtatggagatccggcccgtgaaggagaaggaggagaacctcgttcggagcatggtcagcgccggctccggcgaggtagatagcttctccttagggatcctgtgcgtgagcatcatgatcgaggaggtcatgcggtcgcgttggagccggaaaatgctcatgaccggcaccctggccgttttcctactcctgatcatggggcagctgacgtggaacgacctcatccgcctttgcatcatggtgggcgccaacgcctccgacagaatgggaatgggcaccacgtacctggctctcatggctaccttcaagatgcggcccatgttcgccgtaggactgctgttccgccggctcacgagccgcgaggtgctgctgctcaccatcgggctgtccctggtggccagcgtagagctgccaaattccttggaggagctaggcgacgggctcgcaatgggcatcatgatgctgaagctgctcaccgagttccagccccatcagctgtggacgacgctgctcagcctgaccttcatcaagaccaccctgtccctcgactacgcgtggaagacgatggctatggccctgagcatcgtctccctgtttcccctttgccttagcaccacctcccagaagaccacgtggctgcccgtcctcctgggctcattcgggtgtaagccgctgaccatgttcttgatcaccgagaataagatctgggggcggaagtcctggcccctgaacgagggaataatggccatcggcattgtgagcatcctgctcagctccctgctgaagaacgacgtgccgctcgcggggcctctgatcgccggcggtatgctgatcgcctgctacgtcatcagcgggtccagcgccgacctctcccttgagaaggccgcggaggtgagctgggaggaggaggccgagcactccggcactagccacaacatgctggtggaggtccaggacgacgggacgatgaagatcaaggacgaggagcgtgacgacacgctcaccatcctgctgaaggccaccctcctagctgtgtccggcgtgtacccaatgagcatccctgccaccttattcgtctggtacttctggcagaagaagaagcagcgttccggggtgttatgggacacgccctccccgcccgaggtggaacgcgcggtgctggacgacggcatctaccggatcctgcagcgcggcctgttagggcggtcccaggtgggcgtgggagtcttccaggatggcgtattccacaccatgtggcacgtgacccgcggggcagttctaatgtaccagggcaagcggctggaacccagctgggcctccgtgaagaaagacctgatctcatatggagggggctggaggttccagggaagctggaacaccggcgaggaggtgcaggtcatcgccgtggagcccgggaagaaccccaagaacgtccagacgaccccggggaccttcaagacccccgagggcgaggttggggccatcgccctggatttcaagcctggcacgagcgggtcccctatcgtgaatcgggagggcaagatcgtgggcctgtacgggaatggcgtcgtgaccaccagcgggacatacgtgagcgccatcgcccaagccaaggcctcccaggagggcccgctccctgagatagaggacgaggtcttccgcaagcggaacctaacgatcatggacctgcatcccgggagcggcaaaacccgccggtatctcccggcgatcgtgagagaggctatcaagcggaagttgcgcacgctgatcctcgcccccacacgcgtggtcgcctccgaaatggcggaggccctcaagggcatgcccatccggtaccagacgaccgccgtaaagagcgagcacaccgggcgcgagatcgtggacctgatgtgtcacgccaccttcacgatgaggcttctgtcccccgtccgcgtgccgaactacaatatgatcatcatggacgaggcccacttcaccgacccggcgagcatcgccgcccggggctacatcagcacccgcgttgggatgggggaggccgccgcgatcttcatgaccgcaacgccgcccgggagcgtcgaggccttcccacagagtaacgccgtgatccaggatgaggagcgagacatccccgagcgcagctggaactccgggtacgactggatcaccgacttccccggcaagaccgtgtggttcgtccccagcatcaagtcagggaacgacatcgccaactgcctgcggaagaacggcaagcgcgtgatccagctcagccggaagaccttcgataccgagtaccagaagaccaagaacaacgattgggactatgtggttaccactgacatctccgagatgggcgcaaacttccgcgccgaccgggtaatcgacccgcgccggtgcctgaagccagtgatactgaaggacgggcccgagagggtcatcctagccgggcccatgccggtgacggtggccagcgcagcccagcggcgcggccggatcggcaggaaccagaacaaggagggggaccagtacgtatacatgggccaacccctgaacaatgacgaggatcacgcccactggaccgaggccaagatgctgctcgacaacatcaacacccccgaggggatcatccccgcactgttcgagccggagcgcgagaagtccgcggcgatcgacggggagtaccggctgagaggggaagccagaaagaccttcgtggagttgatgcgccggggcgatctgcccgtctggctgagctataaggtggcctccgaggggttccagtacagcgacagacgatggtgctttgacggggagcgcaacaaccaggtgttagaggagaacatggacgtggagatctggacgaaggagggcgagcggaagaaactccgcccccggtggctggacgcccgcacgtacagcgaccccctcgctctgcgggagttcaaagagttcgcagccgggagacggtccgtgagcggcgaccttatcttagagatcggcaagttgccgcagcacctaaccctccgtgcccagaacgccctggacaacctggtgatgctccataactccgaacagggagggaaggcgtaccggcacgccatggaggagttacccgacaccatcgagaccctgatgctcctggcactgatcgccgtccttaccggcggggtgaccctgttcttcctgagcgggaaagggctcggcaagacctccatcgggctgctgtgcgtgatggcgagctccgcgctcctgtggatggccagtgtcgagccccactggatcgccgcctccatcatcctggagttcttcctcatggtgctgctgatccccgagccggaccgacagcggacgccccaggacaaccagctcgcgtacgtggttattgggctgctatttatgatcctcacggtggccgccaacgagatggggctgctggagaccacgaagaaggacctcggcatcgggcacgtggcagccgagaatcaccaccacgcgaccatgctggacgtggacctgcgtcccgcgagcgcttggacgctctacgccgtggccaccacggtgatcacccctatgatgcggcacacgatcgagaacaccaccgctaacatatccctgaccgccatcgccaatcaggcggcgatcctgatgggcctcgacaagggctggcccatcagcaagatggacatcggggtccccctgctggcgctcggctgctacagccaggtgaaccccctgacgctgaccgccgccgtgctcatgctggtcgcccattacgccatcatcgggccgggactgcaggccaaggccacccgcgaagcccaaaaacgcaccgccgcggggatcatgaagaacccaacggtggacggcatagtggccatcgacttagacccagtcgtttacgacgccaagtttgagaagcagttaggtcagatcatgcttttgatactgtgcaccagccaaatcctgctcatgcgaaccacctgggccctgtgcgagtccatcacgctggcgaccgggcccctcactaccttatgggaggggagcccggggaagttctggaacacgaccatcgcggtgtccatggccaacatcttccgtggctcttacttggccggcgccgggctcgccttttcactgatgaagtccctgggcggtggccggagagggaccggagctcaaggcgagaccctcggggagaagtggaagcggcagctgaatcagttatctaagtccgagttcaacacgtacaagcgcagcggcatcatggaggtcgacaggtccgaggctaaggaggggctaaagcgcggcgagacaaccaagcacgccgtgagccgcgggaccgccaagctgcgctggttcgtggaaaggaacttggtcaagcccgagggcaaggttatcgatctgggctgcgggcgcggcggatggtcctactactgtgcgggcctcaagaaagtgacggaggtcaagggttacaccaagggcggccccgggcatgaggaacccatcccgatggccacctacggctggaacctggttaaactgcacagcggaaaggacgtgttcttcacgccgcccgagaagtgtgacaccctactgtgcgacataggcgagtccagccccaacccgacgattgaggaggggcgcaccctgcgcgtactcaagatggtcgagccctggttacgaggcaatcaattctgtatcaagatcctgaacccctacatgccatccgtggtcgaaaccctcgagcagatgcagcgcaagcatggagggatgctggtgcggaacccgctgagccgcaatagtacacacgagatgtactgggtcagctgcggcacggggaacatcgtcagtgccgtgaacatgacctcccggatgctgctgaaccgcttcaccatggcccaccgcaagcccacgtacgagcgagatgtggacctgggcgccggcactcgccacgtcgcggtggagcccgaagtggccaatctcgacatcatcgggcagcggatcgagaacatcaagaacgagcacaagtctacatggcactacgacgaggacaacccctacaagacgtgggcctaccatggcagctatgaggtcaaaccgtccgggagcgcctcctccatggtgaacggagtcgttcgcctgttgaccaagccctgggacgtgatcccaatggtcacgcagatcgccatgaccgacaccacccccttcgggcagcagcgggtgtttaaggaaaaggtggacacacgcacccccagagcgaagcgcggcaccgcccaggtaatggaggtgaccgccaagtggctctggggcttcctgagccggaacaagaagccccgcatctgcacgcgggaagagttcacccgcaaggtgcggtcaaacgccgctataggggcggtcttcgtggacgaaaaccagtggaacagcgccaaagaggccgtggaggacgaaaagttctgggacctggtccaccgggagcgggagttacacaagcagggcaagtgcgcgacctgcgtgtacaatatgatggggaagcgtgagaagaagctgggcgagttcgggaaggcgaagggctcccgggccatctggtacatgtggctgggagctcgcttcctcgagttcgaggccctggggttcatgaacgaggaccactggttcagccgggaaaattccctgtctggcgtggagggggagggcctccacaagctggggtacatcctgcgcgacatctccaagatccccggcggcaacatgtacgccgacgacactgcaggatgggacacccggatcaccgaggacgacctccagaacgaagccaagatcaccgacatcatggagccggagcacgcccttctggccaccagcatcttcaagctcacgtatcaaaacaaggtggtgcgcgtgcagcgcccggccaagaacggcaccgtaatggacgtgatctctcggcgcgaccagcgggggagcggccaggtcggcacctacgggctgaacaccttcacgaacatggaggtccagttgatccgccaaatggagtccgagggcatcttcctcccctctgagctggagacccccaacctggcggagcgggtgttagactggctggagaagcacgggaccgagcgcctgaagcggatggccatctccggcgacgactgcgtggtcaagccgatcgacgatcgcttcgccaccgcccttatcgccctgaacgacatggggaaggtgcgaaaggacataccccagtgggaacccagcaagggatggaacgagtggcagcaggtccccttctgctcccaccatttccaccagctgatcatgaaggatggccgggagatagtcgtgccgtgccggaaccaggatgagctcgtggggcgcgcgcgggtcagccagggagccgggtggtccctccgcgagacggcctgcctgggcaagagctacgcccagatgtggcagttaatgtacttccaccgccgcgacctgcggctggccgcgaacgccatctgcagcgccgtgcccgtggactgggtcccaacctcgaggaccacctggagtatccacgcccaccaccagtggatgactacggaggacatgctatccgtgtggaaccgggtgtggatcgaagaaaacccctggatggaagacaagacccacgtcagctcctgggaggaggtgccgtatctcgggaagcgcgaggaccagtggtgcggaagcctgatcggcctcaccgcgcgcgccacctgggccacgaacatccaggtggcaatcaaccaggtccggcgcctgatagggaacgagaactacctggactacatgacctctatgaagcggttcaagaacgagagcgacccagagggcgccctctggtaa

SEQ ID NO: 24030 - RNA, 9879 nt, synthetic construct
  misc_feature 1..9879: note = derived and/or modified CDS sequence (opt11) from DENV-1__FJ478458__SS-prME
  source 1..9879: mol_type = other RNA
agcgtaaccatgctgctcatgctgctgccaaccgccctcgcatttcacctcacaacccggggcggtgagccacacatgatcgtgagcaagcaggagcggggcaagagcttgctgtttaagaccagcgcggggatcaatatgtgcactctgatcgccatggacttaggcgagctatgcgaggacacgatgacctataaatgtccccggatcaccgaagccgagcccgacgacgtggactgctggtgcaacgccaccgacacgtgggtaacatatgggacctgcagccagaccggcgagcatcggcgggacaagcggtccgtcgcccttgcgcctcacgttggcctggggctagagacgcgaaccgagacctggatgagctctgaaggagcctggaagcagatccagaaggtggagacctgggcactgcggcaccccgggttcacggtgaccgctttattcctcgcgcacgccatcggcaccagcatcacccagaagggaatcatttttattctgctgatgttggttacgccctccatggccatgcgctgcgtgggcatcggcaaccgggactttgttgagggtctgagcggcgcaacctgggtggacgtggtcctggagcacgggtcctgtgtgaccactatggccaaggacaagccgacactcgacatagagctgcttaagaccgaggtcaccaaccccgcgatactgcggaagctgtgcatcgaggccaagatcagcaacacaacgaccgattcccggtgtcccacgcagggcgaagcgaccctggtcgaggagcaggacagcaacttcgtgtgccgccgcacgttcgtggatcgcggctgggggaacggctgcggcttgttcggcaaggggtccctgctgacctgtgccaagtttaagtgtgtcaccaagctagagggcaagatagtccagtacgagaacttaaagtacagcgtgatcgtcaccgtacacacgggcgatcagcaccaagtggggaacgaaaccacagagcacggaaccatcgccaccataacgccccaggcgcccacctccgagattcagctgaccgactacggggcactcaccctggactgcagccccagaacgggccttgactttaacgaaatggtcctcctgaccatgaaggagaagtcctggctggttcacaagcagtggttcttggacctgccgttgccctggacgtccggggccagcaccagtcaggaaacgtggaaccgccaggatctcctggtcaccttcaagaccgcccacgccaagaagcaggaggtggtggttctgggcagccaagagggcgcgatgcacaccgcgctcacaggggccaccgagatccagaccagcggcactacgaccatcttcgccgggcatctgaagtgcagactgaagatggacaaactcaccctgaaggggatgagctacgtgatgtgcaccgggtccttcaaactggagaaggaggtggcggagacgcagcacggcaccgtcctggtgcaggtgaagtacgagggcaccgacgcgccctgcaagattcccttcagcgcccaggacgagaagggggtcacccagaacggcagactgatcacggccaacccgattgtgaccgacaaggagaagcctgtgaacatcgagaccgagccgccgttcggggaatcctatatcgttgtgggcgctggagagaaagcactgaagctatcgtggttcaaaaaagggtctagcatcggcaaaatgttcgaggctaccgcccggggggcccgccggatggccatcctaggcgacaccgcgtgggattttggatccatcggcggcgtgttcacgtctgtcgggaagctggtgcaccaagtcttcggcgctgcctacggggttctattctccggcgtaagctggaccatgaagatcgggatcgggattctcctgacatggctgggcctcaactcccgcagcacgtccctgagcatgacctgtattgccgtggggatggtcaccttgtacctgggcgtgatggtccaggccgattccgggtgcgtcataaactggaagggcagggagctgaaatgcggtagcggcatcttcgtgaccaacgaggtgcacacgtggactgagcagtacaagttccaggctgacagccccaagcgtctgagcgccgctataggcaaagcctgggaggagggggtctgcggcatccgctcggccacccggctcgagaacataatgtggaagcaaatcagcaatgagcttaatcacatcctgcttgagaatgacatgaagttcacggtggtggtcggggacgcgaacggaatcctagcccagggcaagaagatgataagaccgcagcccatggagcaccgttactcatggaagtcttggggcaaagccaagatcattggcgccgacattcagaacaccacgtttatcatcgacgggcccgacaccccggagtgccccgacgatcagcgagcgtggaacatctgggaagtggaggactacggcttcggtattttcacgaccaacatctggctgaagctccgggacagctacacgcaaatgtgtgaccaccgcctcatgtccgccgccataaaagatagcaaggccgtgcacgccgacatgggctattggatcgaatcagagaagaacgagacctggaagctcgcgagggccagcttcatagaggtgaagacatgcatctggcctaagtcacataccctctggagtaacggagttctcgagtccgagatgatcatccccaagatctacgggggcccgatcagccagcataactaccgcccagggtacttcacacagactgcgggtccgtggcacctcgggaagctcgaactggactttgacctctgcgaaggcactaccgtagtagtggacgaacactgcgggaaccgggggccgtcgctccgcactaccaccgttacgggcaagatcatccacgagtggtgttgccggagctgcacgctgccgcccctgcgattccgtggggaggacggctgctggtatggcatggagatccgccccgtcaaggagaaggaggaaaacctcgtgcggtccatggtaagcgccggcagcggcgaggtcgattcctttagcctagggattctgtgtgtgtcgatcatgattgaggaggtgatgcgcagtcggtggtcccgcaagatgctcatgaccgggacgctggcggtctttctgctcctgataatggggcagctgacttggaacgacctcatccgcttgtgtatcatggtgggcgctaatgccagtgaccggatggggatgggaaccacctacctggccctgatggccacattcaaaatgcgcccgatgttcgcagtgggcctgctgttccggaggctcacatcccgggaggtactactactcacgatcgggctgagcctcgtggcgtccgtggagctccccaacagcctggaggagctgggcgacgggctcgccatgggtatcatgatgctcaagctgttgaccgagttccagccccaccagctgtggaccacactgctctccctgacgttcatcaagaccacgctgagtctcgactacgcttggcgcaccatggctatggttctctccatcgccagcctcttccctctctgcctatccacgaccagccagaagactacatggctccccgtgctcctgggttcatttgggtgcaagcccctgacgatgttcctcatcacagagaacaagatctggggaagaaagtcgtggcctcttaatgaggggatcatggcaataggcatagtatccatcctgctatcgagcctgctgaagaacgacgtgcccctagcggggccgttaatcgccggcggcatgctgatcgcatgctacgtgatctccgggagctccgcggacctcagcctggagaaggccgccgaagtctcctgggaggaggaggccgagcacagcggtacttcccacaacattctcgtggaggtgcaggacgatgggaccatgaagatcaaagacgaggaacgcgacgacaccctgacgatcctgctgaaggccaccctgttagcggtcagcggcgtttatccgatgtccatccccgccacccttttcgtttggtacttctggcagaagaaaaagcagcgatcgggggtcctatgggacaccccatccccgcctgaggtggagcgcgccgtgctggatgacgggatctaccggatccttcagcgcgggcttctcgggcggagccaggtcggtgtgggtgtgttccaagacggcgtcttccacacgatgtggcacgtgacccgcggggccgtgctgatgtaccagggtaagcggctcgagccatcctgggcaagcgtcaagaaggacctcatcagctacggcggcggttggcgcttccaaggttcatggaacaccggcgaggaggtccaggtgatcgcggtcgagcccgggaagaatccgaagaatgtgcagacgacgcccggcaccttcaagacccccgagggcgaggtgggggctatcgccctggacttcaagcccggcacctcggggagcccgattgtcaaccgggagggcaagatcgtcggcctgtatgggaatggcgtcgtcactacaagcgggacctacgttagcgctatagcccaggccaagaccagccaagaaggacccctccccgagatcgaggaggaggttttcaagaagcgcaacctgacgatcatggatttacaccccgggtcaggcaagacccggcgctacctccccgccatcgttagagaggcgatcaagcgcaaactgcgtaccctgatcttagcccccactcgggtggtagcgtccgaaatggccgaggccctgaagggcatgcccatacgctatcagacgacggcggtgaagtccgagcacaccgggagggagattgtggacctgatgtgccacgccaccttcacgatgcgcctcctgagcccggtgcgagtcccgaactacaacatgatcatcatggacgaggcgcacttcaccgaccccgccagcatcgcagcccggggctacattagcacacgggtggggatgggcgaggccgcggccatctttatgaccgccacgcctccgggatccgtcgaggccttcccccagagcaatgccgtcatccaagacgaggagagagacatccctgaacggagctggaacagcggctacgactggatcaccgacttccccggcaagaccgtgtggttcgtgccgtccatcaagagcgggaatgacatcgcgaactgtcttagaaagaatggcaagcgggtcatccagctctcccgaaagaccttcgacacggagtaccagaagaccaagaacaacgactgggactacgtggtgactacagacatcagcgagatgggggccaacttccgggcagaccgagtcatagacccccgcagatgccttaagcccgtgattttgaaggacggaccagagcgggtgatcctcgccgggccgatgcccgtcacggtggcttccgccgcccagcgccggggccgcatcggccgcaaccaaaacaaggagggggaccaatacgtgtacatgggccagccgctgaacaacgacgaagaccatgcccattggactgaagccaagatgcttctagataacatcaacacccccgaggggattatccctgcgttgttcgaacccgagcgcgagaagagtgcggccatcgacggcgagtaccgcctgagaggggaggcccggaagacctttgttgagctcatgcgaagaggcgaccttcctgtgtggttgtcctacaaggtcgcgagcgagggcttccagtactccgacaggcgctggtgcttcgacggggagcggaacaaccaagtgctcgaggagaatatggacgttgagatctggacgaaggagggcgagcgcaagaaactgcgaccgcgctggctggatgcgcggacctacagcgacccgctcgcccttcgcgaattcaaggagttcgccgcggggcgtcgctcagtcagtggcgatctgatacttgaaatcggcaagctgccccagcacctgactctccgcgcccagaacgcgctggacaacttggtgatgctccacaacagcgaacagggcgggaaggcctaccgccacgccatggaggagctgcccgacaccatcgagaccctgatgctcctcgctctgatcgcggtgttgacaggcggagtcaccctgttcttcttgtctgggaaggggctcggcaagactagcatcggcctcctgtgtgtcatggccagtagcgccctcctttggatggccaacgtagagccccactggatagctgcgtccatcatcctggagttcttcctcatggttctgctgatcccggagcccgatcgacaacgtacgcctcaggacaaccagttggcctacgttgtgatcggcctgctattcatgatactcacggtagccgccaacgagatggggctgctggagaccacgaagaaggacctgggtatcgggcatgttgccgcggaaaaccagcaccatgccactatgctggacgtggacctgcggccggccagcgcttggacgttatacgccgttgcgaccaccgtgatcactcccatgatgcgacacactatcgagaacaccaccgccaacatcagcctgaccgccatcgctaaccaggccgcgatcctaatgggcctcgacaagggctggcccataagcaagatggacatcggggtaccccttctggccttaggttgctacagtcaggtcaacccgctgacgctgaccgccgccgtgctaatgctggtggcccactatgccatcatcggtcctggcctgcaggccaaggccacccgcgaggcccagaagcggacagcggccggaatcatgaagaaccccaccgtcgacggcatcgtggccatcgacctcgaccccgtcgtatacgacgcgaaattcgaaaagcagctgggccagatcatgctgctcattctctgtacgtcccaaatccttctcatgaggaccacctgggccttgtgcgagtccataacgctggcgacggggccgctcacgaccctgtgggagggtagccccgggaagttctggaacacgacaattgccgtttcaatggccaacatctttcggggaagctatctggccggcgccggactcgcgttcagcctgatgaagtccctgggtggtggcaggcggggtaccggggcacagggcgagaccttaggggagaagtggaagcgccagctgaaccagctgtccaagagcgagttcaacacatacaaacggtccggtatcatggaggtagaccgctctgaggccaaggaggggctcaaaagaggcgagacaaccaagcatgcagtatcgcgtggcactgctaagctgaggtggttcgtcgagcgcaatctggtgaaacccgagggtaaggtcatcgatttaggctgcgggcgtggagggtggtcctattactgcgcaggcctcaagaaggtaacggaagtgaaggggtacaccaagggcggccccggccacgaggaaccaatacccatggccacctacggctggaatctggttaagctgtacagcggtaaggacgtgtttttcacaccgccagaaaagtgtgacaccctcttatgcgacataggcgagtcaagccccaatccaaccatcgaggaagggcgcaccctgcgggtcttaaagatggtcgagccctggttacgaggcaatcagttctgcatcaagatcctgaacccctacatgccgtccgtggtcgagaccttggagcaaatgcagcggaagcatggggggatgctggtgcgcaaccccctgtctagaaacagtacccatgagatgtactgggtgtcttgtggaacgggtaacatcgtttccgccgtgaacatgacgagccgaatgttactgaaccgatttacaatgacccatcggaagccgacgtacgaacgcgacgtggacctgggggccggcacccggcatgtggcggttgagcccgaagtggccaacctcgacattatcggacagcgtatagaaaacatcaagaacgagcacaagtccacttggcactacgacgaggataacccgtacaagacctgggcctaccacggcagctacgaggtgaagccctccggtagcgcctccagcatggtcaatggcgtggtgcggctcctgacaaagccttgggacgtaatccccatggtgacccagatcgccatgaccgataccacgccgttcggccagcaacgcgtcttcaaagaaaaggttgacacgcggacgccgagggcgaagcggggcaccgcccagatcatggaggtcacagccaagtggctctggggcttcctctcccgcaacaagaagccaaggatctgcacccgggaagagttcacccggaaggtccgcagtaacgccgcgatcggggcggtgttcgtggacgaaaatcagtggaactccgccaaggaggccgtcgaggacgagcggttttgggacctggtccaccgggagcgggagttgcacaaacagggcaagtgtgcgacctgtgtctacaacatgatggggaagcgggagaagaagctgggcgagtttggcaaggcgaagggtagtcgcgccatttggtatatgtggctgggtgcacgcttcctggaatttgaggccttaggattcatgaacgaggatcactggttcagccgggagaactccttcagcggcgtcgagggggagggcctgcacaagctggggtacattctgcgcgatatctccaagatcccgggaggcaacatgtatgccgacgacacggcgggttgggacacccgcatcaccgaggacgatctccagaacgaagccaagatcaccgacatcatggagcccgaacacgccttactggccacgagcatcttcaagttaacctaccagaataaggtggtgcgggtccaacgccccgcgaagaacggcacggtgatggatgtgatctcccggcgcgatcagcgtggttccggccaggttggcacctacggactaaacacgttcactaacatggaggttcaactgattaggcaaatggagtccgaagggatcttcctgccgagcgagctcgagaccccaaacctggcggagcgggtgctggactggctcgagaaacacgggaccgagcgcttgaagcggatggccatcagcggggatgattgcgtcgtaaagcccgtggacgaccgcttcgccacggccctaatcgccttaaacgacatggggaaagtcagaaaggacataccccagtgggaaccctccaagggctggaacgactggcagcaggtcccgttctgctcccaccacttccaccaactgataatgaaggatggccgtgagatagtggtgccctgcaggaatcaggacgagctggtagggcgcgcgcgggtgagccagggcgccgggtggtccctccgcgagaccgcctgtctaggcaagagctacgcccagatgtggcagcttatgtattttcaccgacgcgatctccggctggccgcgaacgcaatttgctccgccgttcccgttgattgggttcccacgagccgcacaacctggtctatccacgcccaccaccagtggatgacgaccgaggacatgttatccgtctggaaccgcgtatggatcgaggagaacccgtggatggaggacaagacccacgtgagtagctgggaagaggtaccctacctcgggaagcgggaggaccagtggtgcggcagtctcataggactgaccgctcgcgccacttgggccactaatatccaggtcgccatcaaccaagtccggaggctaatcggtaacgagaactaccttgactacatgacctccatgaagcggtttaagaacgagagcgacccggagggtgccctgtggtag

SEQ ID NO: 24031 - RNA, 9879 nt, synthetic construct
  misc_feature 1..9879: note = derived and/or modified CDS sequence (opt11) from DENV-1__FJ410190__SS-prME
  source 1..9879: mol_type = other RNA
agtgttaccatgctgctcatgctgctgcccaccgccctcgcgtttcacttaaccactcgcggtggggaaccccacatgatagtatccaaacaggagcgcgggaaaagtctgttgttcaaaacgtcggtggggatcaacatgtgtacgcttatcgccatggacctgggtgagctctgcgaagacaccatgacctacaagtgcccccgaataactgaggccgagcccgatgacgtagactgctggtgcaatgcgaccgatacctgggtaacgtacgggacatgcagccagacaggcgagcaccggagggacaagcggtccgtagccttagcgccccacgtcggccttggcctcgaaacgaggaccgagacctggatgagctccgaaggcgcctggaagcagatccaaaaagtcgagacgtgggcactccgtcacccgggcttcacagttatagcactttttctcgcacacgcgattggcacctccatcacccaaaaggggatcatcttcatcttgctgatgttagtgaccccttccatggccatgcggtgtgtaggcatcgggaacagggacttcgttgaggggctgagcggcgcgacctgggtggatgtggtgctggagcatgggtcctgcgtcaccaccatggccaaagacaagcccactctcgacatcgagctgctgaagacagaggtcaccaatccggcagtgctacgcaagctctgcatcgaggctaaaatctcaaacacaactacggactcccggtgcccgacccagggagaggcaaccctggtggaggaacaggattccaacttcgtgtgcaggcggaccttcgtggatcgcggctggggtaacggctgtggccttttcggcaaggggagtttacttacgtgcgcgaagttcaagtgcgtcaccaagctcgagggcaagatcgtgcagtatgagaacctgaagtacagcgttatcgtgacggtccacactggggatcaacatcaagtggggaacgagacgaccgagcacggcaccatagccaccatcacaccccaggctcccacgtccgagattcagctgaccgactacggagcgcttaccctggactgcagcccccggaccggcctggactttaacgagatggtcctcctgacaatgaaggagaagtcgtggttggttcacaagcagtggtttctcgacctgcccctgccctggacctcaggtgcatcgacctcccaggagacgtggaaccgccaggacctcctggttacgtttaagaccgcccacgctaagaagcaggaggtcgttgttctaggcagccaggagggagcaatgcacactgcgctcacgggagccaccgagatccagacttcaggcactaccacgattttcgctgggcatctgaagtgccggctgaagatggataaactcactctgaaaggtatgagctacgtaatgtgtaccgggtctttcaagctggaaaaggaagtggccgagacccagcacggtacggtgctggtccaggtaaagtacgagggaaccgacgccccctgcaagataccgttcagtgcgcaggacgaaaaaggtgtgacacaaaacggccgcctcatcacggccaacccgatagtcaccgacaaagagaagccagttaatatcgagaccgagccgcctttcggagagtcctacattgtcatcggggccggcgagaaggctttaaaacttagctggttcaagaaaggttccagcatcggcaagatgtttgaggcaaccgcccgaggcgcccgccggatggccatactcggggataccgcgtgggacttcggcagtatcggcggcgtctttacgagcgtaggaaaactggtccatcaggtctttggcgccgcctacggggtgttattctccggcgtgagctggaccatgaagatcggtataggtatcctcctaacatggctgggcctcaattcacgcagcacctccctgagcatgacgtgcattgcagtcgggatggtgacattgtacctcggcgtgatggtacaagccgactccgggtgcgtgataaactggaaaggccgggagttaaagtgtgggagcggcatctttgttacgaatgaggtgcacacctggacggagcagtataaatttcaagccgacagcccgaagcgtctttccgcggccatcggcaaggcatgggaggagggcgtatgcggcatccgctctgcaacccgacttgaaaacataatgtggaaacagatctccaacgaactgaatcacatccttctagagaacgacatgaagttcactgtggtcgtaggggatgcgaacgggatcctagcgcagggtaaaaagatgatacggccgcagcccatggagcacaggtatagctggaagtcctggggcaaggccaagattataggggccgacatccaaaacaccaccttcattatagacggacccgacacgccggagtgccccgatgaccagagagcctggaatatatgggaagtggaggattacggcttcggaatttttacgacaaatatctggctgaaactccgggacagctacacccaaatgtgcgaccaccgcctgatgagcgcggccattaaggatagcaaggccgttcacgccgacatgggctactggatagagtccgagaagaacgagacgtggaagttagcccgggcgagcttcatcgaggtaaaaacctgcatttggcccaagtcccacaccctttggagcaacggggtgctggagtccgaaatgatcatccccaaaatttacggcggacctatcagccaacacaattatcgccccgggtacttcactcagactgcaggcccctggcacctggggaagctggagctggattttgacttgtgcgaggggaccaccgtcgtagtcgacgagcactgcgggaaccggggtccgagtctccgcaccaccactgtaaccggcaagatcatccacgagtggtgttgccggtcatgcaccctgccaccgctgcgcttccgtggggaggacggatgctggtacggaatggagatccgccctgtgaaggagaaggaggaaaacttagtgcgctccatggttagcgccggcagtggggaggtagactccttttctttggggattctttgcgtgtcaatcatgatagaggaagtcatgcgcagccggtggtccagaaagatgctcatgaccggcaccctggctgtgttcctgctgctaatcatggggcagctgacctggaacgacctcatccgcctgtgcatcatggtgggcgcaaacgcgtctgaccggatggggatgggtacgacgtacctggcattgatggccaccttcaagatgcgaccgatgtttgccgtcggattgctgttcagacggctcactagcagagaggtccttctgcttaccatcgggttaagccttgtggcgagtgttgagcttcccaattcgctggaagaactgggtgacggactagccatggggatcatgatgctgaagctgctcaccgagttccagccccaccaactttggaccaccctgctctcgctgacattcataaagacgaccctgtccctcgactacgcctggagaacaatggctatggtgctgtccatcgtgagcctcttcccactatgcctgagcacgacaagccagaaaacgacgtggctccccgtgctcctgggctccttcgggtgcaagccactgacgatgtttctaatcacggagaacaaaatctggggtcgcaagtcatggcccctgaacgaggggatcatggcaataggtatcgtgtcaattctgctcagcagccttcttaagaatgacgtacccctcgccgggccgctaattgcagggggcatgctgatcgcgtgttacgtaatctctggcagcagcgcagacctgagcctggagaaggccgcggaggtgagttgggaggaagaagccgagcattccggcacctcccacaacatcctggtggaggtacaggacgatggcactatgaagatcaaggacgaggagcgtgacgacactctcacgatactgctgaaggccaccctcctcgcagtgagcggcgtttacccaatgtcaatccccgctaccctgttcgtctggtacttctggcaaaagaagaagcagcgatcgggggtcctctgggacaccccaagtccgcccgaagtggaacgcgcggtcctagacgatggcatctatcgcatccttcaaagaggcctgctcgggcgtagccaagtcggcgtcggtgtgttccaagacggcgtattccacactatgtggcacgtgacccgcggggccgtgctgatgtatcagggcaagcgtctagagccctcctgggcctcggtcaagaaggacctcatctcctacggtgggggctggcgcttccaggggagctggaacacaggcgaagaggtccaagttatagccgtggagccaggaaagaatcccaaaaatgtccagacaacccccgggacgttcaaaacccccgagggggaggtgggggccattgcgctcgacttcaagcccggaacgagtggaagccccatcgtcaacagagaagagaaaattgtgggcctgtacggaaacggggtggtcactacgtccggcacctacgtctctgcgatcgctcaggctaagacaagccaagaggggcccctgccggaaatcgaagacgaggtgttcaagaaacgcaacctgactatcatggacctgcacccgggcagcggcaaaacgagacgctacctccctgcaatcgtgagagaggcaattaagcgcaagctgcgcacactgatcctcgcccctacccgcgtcgtggcgagcgagatggccgaggcgctcaagggcatgccaatccggtaccaaacgacggcggttaagagcgagcatactgggcgcgagatcgtcgacttaatgtgtcatgccacctttaccatgcgtctcctgtcaccggtgagagtgcccaactacaatatgatcataatggacgaggcccactttacggatcccgcgtccatcgcggcacgtgggtacatttcgacacgggttgggatgggggaggccgcggccatcttcatgaccgctacaccacccggcagcgttgaggccttcccccaatcaaatgcagtcatacaggacgaggaacgcgacatccccgagcggtcctggaacagcggatacgattggatcactgatttccccggcaagaccgtatggttcgtaccctcaatcaagagcggcaacgacatcgcaaattgcctgcgcaaaaacggcaagcgcgtgattcagctttcccgcaaaacctttgatacggaataccagaagacgaagaacaacgattgggactatgtcgtcaccacagacatcagcgagatgggcgccaactttcgggcggaccgcgtcattgacccccggcgatgcctgaagcccgtaatactcaaggacgggccggagcgggtgatcctcgccggccctatgcccgtgactgtcgctagcgccgcgcagcgccgcgggagaatcggccgaaatcagaacaaggagggggatcagtacgtttacatggggcagccactgaacaacgacgaagaccatgcacactggacggaggccaagatgcttctagacaatatcaataccccggaaggtatcatccccgctctatttgagcccgagagggagaagtccgcagctattgatggggagtaccggctgagaggcgaggccaggaagaccttcgtggaacttatgcggcggggagacctgcccgtatggctgagctacaaagtggcatctgagggattccagtattccgatcgacgctggtgtttcgacggggagagaaacaatcaggtccttgaagagaacatggacgtggagatttggaccaaggagggggaaagaaagaagctgcggccccgctggttggacgcccggacatacagcgacccgctagccctacgcgaatttaaagagttcgccgcgggtcggcgctcggtgtccggggaccttattttggagatcgggaagttgccccaacacctgacgctccgggcccagaacgcactggataatctggtcatgctccataattctgagcaaggagggaaagcctacagacatgccatggaggagctgccggatacaattgagaccctgatgttactagccttaatagccgtcctcaccggcggggttacgctgtttttcctgtccggcaaggggctcggcaagacttccatcggcctcctgtgtgtaatggcgtcctccgcgctgctgtggatggccaacgtagagccccactggatcgccgcttccattatactggagttcttcctcatggttctgcttataccagagcccgataggcagcgcacgccacaagacaaccagctcgcgtacgtagtaatcgggctcctgttcatgatcctcaccgtggcggcgaacgagatgggcctgctggaaacgaccaaaaaggaccttgggatcggccatgtagccgccgaaaaccagcagcacgccaccatgctagatgtggacctgcgccccgcgagcgcctggaccctatatgcggttgccacgaccgtgatcacgcccatgatgcggcacaccatcgaaaacacgaccgcaaatatttccctaaccgcgattgctaaccaggccgccatcctgatggggctcgacaaaggatggcccatctcgaagatggacatcggcgtgccgctgctggccctagggtgttacagccaggtaaatccgctgacgctaacagccgccgttctaatgctagtggcccattatgccatcatcggacctggtctccaggcgaaagccacacgcgaggcacagaaaaggaccgctgccggcatcatgaagaatcccaccgtagacgggattgtcgccatcgacctcgacccagtggtgtatgatgccaagtttgagaagcagttaggccagattatgttacttatcctgtgtacgtcccaaatcttgctgatgcgcaccacatgggctctatgtgagtcaataaccttagctactggcccgctcaccaccctgtgggaggggagtccaggcaagttttggaataccacgatcgccgtctccatggcaaacatctttcggggaagctacctggcaggcgccggcctcgcattctcactcatgaagtctctcggaggcgggcgccggggaaccggtgcgcagggagagactttgggcgagaaatggaaacgacagcttaaccagctgtccaagagcgagttcaacacgtacaagcggagcggcatcatggaagttgatcgctccgaagccaaggagggcctcaagcgcggagagactaccaagcacgcagttagtcggggcaccgccaaacttaggtggttcgtagaacgaaacctggtcaaacccgagggtaaggtcattgatctggggtgtggacgcggcgggtggtcttactactgcgctgggctaaagaaagtcacagaggttaaggggtatacgaagggtgggccgggccacgaggagccgatccctatggcaacatacgggtggaacttagtaaagctgtattcgggcaaggacgtgtttttcacgccgcccgaaaagtgcgacacgctcctgtgcgacatcggggaaagcagcccgaaccctactatcgaggaaggccgcacgctgcgggtgctcaagatggtggagccctggctaagagggaaccagttctgcataaagatattaaacccctacatgccgtccgtcgtggaaacgctcgaacaaatgcaacggaagcacggcggaatgctagtgcgcaatcccctgagcagaaactccacacacgagatgtactgggtgagctgcgggaccgggaacatcgtatccgctgtgaacatgacgagccgaatgcttctcaatcgcttcacaatggcccaccggaagcccacctatgagcgcgacgtcgacctgggcgccggaactaggcatgtggccgtggagccagaggtagcgaatctcgacatcatcggccagcgcatcgaaaacatcaaaaacgagcacaagtcaacgtggcactatgacgaggataatccatacaagacgtgggcctaccacgggtcgtacgaggtgaagccctccggcagtgcctcttcgatggtgaacggggtcgtgcggttgcttaccaagccctgggatgtcattcccatggtgacacagatcgccatgacggacaccaccccgttcggccagcagcgcgtgttcaaggagaaggtcgacactcggacgccgcgcgcgaagcgtggtacagcgcaaatcatggaggtcaccgctaagtggctttggggctttctgtcccggaacaagaaaccacggatatgcactcgcgaggagttcacgagaaaggttcgctcgaacgcagccataggcgctgtcttcgtggacgagaaccaatggaactctgctaaggaggccgtggaagacgagcgtttctgggaccttgtccaccgggagagggaattacacaagcaaggaaagtgcgcgacgtgcgtgtataacatgatggggaagcgcgagaagaagctgggtgagttcggcaaagcaaagggatctagagctatctggtacatgtggcttggcgcgcgcttcctcgagttcgaggccctgggcttcatgaatgaggaccattggttctctcgggagaactcgttcagcggcgtggagggagaggggctgcataagctcgggtacatcctccgcgatatttccaagataccgggaggaaacatgtatgcggacgacactgccggctgggacacccgcatcacggaagacgacctacaaaacgaggccaaaatcaccgatatcatggagcccgagcacgcactgctagcgactagcatcttcaaattgacctaccagaacaaggtcgtgcgggtgcaacgccccgcgaaaaacgggacggtgatggatgtgatcagtcggcgtgaccaacggggcagcggacaggtggggacttatggcttaaacaccttcacaaacatggaggttcagctaatccgccagatggagtccgaggggatctttctgcccagtgaactcgaaacccctaatcttgccgagcgcgtactggactggctggaaaaacatggcacggaacgcctgaaaagaatggcaatatccggggacgactgcgtagtcaagccggtggacgaccgctttgccaccgccctgatagcccttaacgacatgggaaaggtgcggaaagacataccccaatgggaaccctcgaaggggtggaacgactggcagcaggtcccattctgttcgcatcacttccaccaactcatcatgaaagacggccgcgagatagtggtgccgtgccgaaaccaggatgagcttgtaggccgcgcgcgggtgtcgcagggcgcgggctggtccctccgcgaaacagcctgcctgggcaaaagctatgcccaaatgtggcagctgatgtacttccaccggcgagacctccggctggcagccaatgcaatatgctccgcggtgccggtggactgggtgcccacgagccgaaccacctggagcatccacgcccaccatcaatggatgaccaccgaggatatgctatccgtgtggaaccgcgtctggattgaggagaacccctggatggaggacaagactcacgtgtcgtcctgggaggaagtaccctatctcggaaagcgcgaggaccagtggtgcggtagcctgatcggactcaccgcacgcgcgacctgggccactaatattcaggtcgccatcaaccaggtgcggaggctcattgggaacgaaaactaccttgactatatgacgtccatgaagcggtttaagaacgagagcgaccccgagggagccttgtggtga

SEQ ID NO: 24032 - RNA, 9879 nt, synthetic construct
  misc_feature 1..9879: note = derived and/or modified CDS sequence (opt11) from DENV-1__EU482591__SS-prME
  source 1..9879: mol_type = other RNA
agcgttaccatgctgctcatgctgctgccgacggccttagcgtttcacctgacaactagagggggggagcctcatatgattgtcagcaaacaggagaggggcaagagcctcctgttcaagacatctgcgggggtcaacatgtgcaccctcatcgccatggacttgggagagctctgcgaagacaccatgacgtacaagtgcccccgcataacggaggctgagccagacgacgtggactgctggtgcaacgccaccgacacatgggttacatacgggacgtgtagccaaactggagagcaccggcgcgagaagcggtccgttgccctggctccacacgtaggcctagggctcgaaacccgcacggagacctggatgagttccgagggcgcctggaaacagatacagcgggttgagacatgggcccttcggcaccctgggtttacggtgatcgcgttcttcctggcgcacgctatcggcaccagcataacccagaagggcatcattttcatcctgctaatgctggtgacaccgtccatggcgatgcggtgcgtcggcataggcaaccgcgattttgtggaagggctcagcggcgccacgtgggtggacgtcgtactggagcatgggtcttgcgtgaccacaatggccaagaacaagcccaccctggacatagagctgctgaagaccgaggtcacaaaccccgcggtgttacggaagctgtgtatcgaagccaagatcagcaacacaacgaccgactcccgatgcccaacgcagggtgaggccaccctggtagaagagcaagacgcaaacttcgtctgccggcgcaccttcgtcgaccggggttggggaaacggctgcgggcttttcggcaaggggtccctactgacgtgcgccaagttcaaatgcgtgacaaagctggagggcaagatcgtccagtatgagaacctcaaatattccgtgatcgtgaccgtccacacgggtgaccagcaccaggtggggaatgaaactaccgagcacggcaccatagcgactattacccctcaagcccccacgtctgagatccaattaactgactacggagccttgaccctcgactgctcgccccggaccggtctggacttcaacgagatggtcctgctcacgatgaaagagaagtcctggctggtccacaagcagtggttcctggacctcccgctaccctggacctcaggtgcatctactagccaggagacttggaaccgtcaggacctgctcgtgactttcaaaacagcccacgcgaagaagcaggaggtagtggttctgggctctcaggaaggcgcaatgcacaccgccttgacgggcgccacagagatccagacgagtggcaccaccacgatctttgccgggcacctcaagtgccgacttaagatggataagttgaccttgaagggcatgtcctacgtcatgtgtacggggtccttcaagctagaaaaggaagtggccgagacccagcatggaacggttctggttcaggtaaagtacgagggtaccgacgcgccctgcaagatacctttcagtacccaggacgaaaagggagtaacccaaaacgggcggttaataaccgccaaccccatcgtcaccgataaagaaaaacctgtgaacatcgaaaccgagccgccattcggggagagctatatcgtagtcggcgccggagagaaggcactcaagctgtcctggttcaagcgcgggagctccattggcaaaatgttcgaagccacggcacgcggggcgcgccgaatggccatcctgggggacacggcgtgggactttggttccatcggcggcgtgttcacctctgtggggaagctagttcatcaggtgttcggtaccgcatacggtgtactcttcagcggcgtctcttggaccatgaagatcgggatcggaatactgctcacttggttaggcttaaactcgcggtccaccagcctctcgatgacctgcatcgccgtggggatggtaaccctgtatctgggcgtcatggtgcaggccgacagtgggtgcgtgataaactggaagggccgagagctgaaatgcgggtctggaatattcgtcacgaacgaagttcacacctggaccgagcagtacaagtttcaggctgattctcccaaacggcttagcgcggctatcggcaaggcctgggaggagggagtgtgcggcatccgttcggccacccggctagagaacataatgtggaagcagatcagcaacgagctcaaccacatccttctggagaacgacatgaagttcaccgtcgtagtcggggacgcaaacggtattctcgcccaggggaagaagatgattcgcccgcagcccatggagcacaagtactcgtggaagtcctggggcaaagcaaagatcatcggagccgacatccagaacacgaccttcatcatcgatgggcccgacaccccggagtgtcccgacggccagcgggcctggaacatatgggaggtcgaggactacgggttcggcgtgtttactacaaacatctggttaaaactgcgggactcctacactcagatgtgcgaccaccggcttatgagcgcggccatcaaggatagtaaggccgtgcacgccgatatgggttactggattgagagtgagaagaacgaaacctggaaacttgcccgcgcgtccttcattgaggtcaagacctgcacgtggcctaagagccacacgctgtggtccaatggggttcttgagagcgagatgatcatccccaagatatacggagggccgatttcccagcataactatcggcccggctacttcactcagaccgccgggccctggcacctgggcaagctggaactggatttcgacctatgcgagggcacgacagtggtggtggacgagcactgtgggaaccgcggcccgagcctccggaccaccactgtgaccggcaagataatccacgagtggtgttgcagatcgtgcaccctgccccctctgcggttccgcggcgaggatgggtgttggtacggaatggagatccggccagtaaaagaaaaggaggaaaacctggtgcgcagcatggtatccgcgggcagcggcgaggtcgatagtttctctctcggaatcctgtgcgtgagcatcatgatcgaagaggtcatgcggtcccgctggagccgcaaaatgctgatgacagggacactagccgtgttcctgctgttgatcatgggccagctgacctggaacgacctcataagactttgcatcatggtgggggcgaatgcgtccgacaggatgggcatgggcaccacatacctggccctcatggccacgttcaagatgcggccaatgttcgccgtcggcctcctgttccgtcggcttaccagtcgagaagtcctcctactgacgatcggcctctccctggtggcaagcgtcgagctacctaactccttggaggagctgggggacggcctagccatgggcatcatgatgctcaagctgctgaccgagttccagccacatcaactctggacaacattgctgagcctcaccttcgtgaaaaccaccctgtccttagactacgcatggaagaccaccgccatggccctatctatcgtgtccctgttccccctgtgtttgagcaccacatcccagaaaacgacttggctgccggtcctgctcgggagcttcggatgcaagcccttaaccatgttcctgatcaccgagaacaagatctggggccggaaaagctggcccctcaacgaaggcatcatggcgatcgggatagtgtctatcctgctcagtagcctcctgaaaaacgatgtgcccctggctggacctctaatcgcggggggcatgctgatcgcctgttacgtcatcagcggctcctctgccgacttgtcgctcgagaaggcggccgaggtatcatgggaacaggaggccgaacacagcggcgcaagccactcgatcctcgtggaggtccaggacgacggtacaatgaaaatcaaagacgaggagcgggatgacacccttaccatacttttgaaggccaccttattagcagtcagcggggtgtacccgatgtctatccctgcaacgctgttcgtatggtacttctggcagaagaagaagcaacggagcggggtgctgtgggacaccccttcaccgcccgaggtcgagcgcgcagtcctggacaatggcatttaccggatcctgcagcgcggcctactgggccggagccaagtgggcgtgggggtcttccaagacggtgtgtttcacacgatgtggcacgtgacccgaggagccgttctcatgtaccagggcaagcggcttgagccaagttgggctagcgtgaaaaaggacttgatctcctatgggggcgggtggcgctttcagggcagctggaacacaggggaggaagtgcaggtcatcgcggtggaacccgggaagaacccgaaaaacgtccagacaacccccggcacattcaagacgcctgaaggggaggtcggcgctatcgcactcgattttaagcccggcacctccggtagcccgatcgtcaacagagagggcaagatcgtggggctgtatggcaatggggtcgtgaccactagtggcacttacgtgtcagccatcgcacaggccaaggctagccaggagggtcccctccccgaaatcgaagacgaagtcttcaagaagcgtaacttaacgatcatggacctgcaccccggatctggtaagacccggcgatacctgcccgcaatcgtgcgggaggccatcaagcggaagctccgcacccttatactggcacccacgcgggtggtcgctagtgaaatggcggaagccctcaaggggatgcctattcgctaccagaccacggcggtgaagtccgagcataccgggcgagagatcgtggacctgatgtgccacgcgacgttcaccatgcgcctgctcagcccggtcagagtgcctaactacaacatgataataatggacgaggcacacttcaccgaccccgcctcgatcgccgcgcgaggatacatctcaactcgagtgggcatgggtgaggcggcggccatcttcatgacggctacgccccccgggtcagtcgaggccttcccccagagcaatgccgtgatccaggacgaggagcgcgacatccccgagagatcgtggaactcgggatacgattggatcaccgacttccccgggaagaccgtctggtttgtcccctcgatcaagtctggcaacgatatcgccaactgcctgcgcaagaatgggaagcgggtgatacagttatcaagaaagacgttcgacactgagtatcagaagacaaagaacaacgattgggattatgttgtaaccacggacatcagcgagatgggcgccaacttcagggccgaccgcgtgatagacccccggagatgcttgaaacccgtgatattaaaagacgggcccgagcgggtcatcttagcgggccccatgcccgtgactgtcgcctcagccgcccaacgtcgtggtcgtatagggaggaatcagaacaaggaaggcgaccagtacgtgtacatggggcagccgttaaacaacgacgaggatcatgcacactggaccgaagcgaagatgctgcttgacaacatcaatacccctgaaggcattattccggcattattcgagcccgagagggagaagagcgcagccatcgacggagagtaccgcctgcggggtgaagcaagaaagacgtttgtggaattgatgcgtcgcggggaccttccagtctggctatcctacaaagtagcgagtgagggttttcaatactcagaccgtcgctggtgctttgacggcgagcgaaataaccaagtcttagaggaaaacatggacgttgagatctggactaaggagggtgaacgtaagaagctcagaccccgctggcttgatgcccgcacctactcagacccgctggccctccgcgagttcaaggaattcgccgccggcagacgctctgtgtccggagacctgatcctggagatcgggaaactcccgcagcacttaactctaagagcgcaaaacgcgttagacaaccttgtcatgctgcataatagcgagcaaggcgggaaggcgtaccgacatgccatggaggagctccccgacacaatcgagacgctaatgctgctcgccctaatcgccgtccttaccggcggggtgaccctcttctttttatcggggaaaggactggggaagacctcaatcggcctcctatgcgtgacggcatccagcgcgttgctctggatggcttccgtggagccacactggatcgcggccagcataatcttagaattcttcctcatggttctcctgatcccggagccggatcgacagcgtacgccccaggacaatcagctggcgtacgtggttatcgggctcctgttcatgatcttgaccgtggccgccaacgagatgggcctgctggaaaccaccaagaaggatctggggatagggtacgtggcagcggaaaaccaccagcacgccaccatgctcgacgtggatctacatccggctagtgcgtggacgttgtatgccgtcgccaccacggtgataacccccatgatgcggcacaccatcgaaaacaccacggccaacatcagcctcaccgccatcgcaaaccaagcggccatcctcatggggctggataaagggtggcccatttctaagatggatatcggggtccctctcttagccctgggctgctactcacaggttaacccgctcactctgaccgctgcggtgcttatgttggtcgcccattacgcgataatcggccccgggttacaggccaaggcgacgcgcgaggcgcagaagaggaccgcggctggcatcatgaaaaaccccaccgttgatggcatcgtggcgatcgaccttgatcccgtcgtttacgacgccaagttcgagaagcaactggggcagataatgctgctgatcctctgtacgtcccaaatactgctgatgcggaccacgtgggcgttatgtgagagcataaccctggccaccgggccgctgacgacactctgggagggttcaccaggcaagttctggaataccaccattgcggttagtatggcgaacatctttcgcggctcctacttggccggggcgggcctggctttcagcctgatgaagtcgctcggcggaggtcggagagggacgggcgcgcaaggcgagacattgggcgagaagtggaagcggcagctcaaccaactgtccaagagcgagttcaatacctataagaggtccggtattatggaggtggaccggtccgaggccaaggaaggcctgaagcgcggggagaccacgaaacacgccgtgtcccgaggcacagctaagctccgctggttcgtagaacggaacttggtcaagccagagggcaaagtcatcgacctggggtgcggccgcggtggctggtcttattactgtgccgggctgaaaaaggtgaccgaggtaaaaggctataccaagggcggccccggccacgaggaacccattcctatggccacatacgggtggaacctcgtgaagttacattccggcaaggatgtgttcttcatgccgcccgagaagtgcgacacattactctgcgacataggggagagctccccgaaccccaccatcgaggagggccggacgttacgggtactgaagatggtagaaccctggctcaggggcaaccaattctgcataaagatcttgaacccgtacatgcctagcgtggtagagaccctcgaacgaatgcagcggaagcatgggggcatgctggtccgcaaccccctatccagaaacagcacgcatgagatgtactgggtctcttgcgggaccggcaacatcgtcagtgccgtgaatatgacctcccgtatgcttctcaaccgattcaccatggcacaccgaaaacccacgtacgaaagggacgtcgatttgggagccggtacgcggcacgtcgccgtggagcccgaagtggccaatcttgatatcatcggccagcgaatcgagaacatcaaaaatgagcataagagcacctggcactacgacgaagacaacccgtacaagacgtgggcctaccacggttcgtacgaggtcaaaccctctggctctgcgagctctatggtgaacggagtagtacgtctcctgaccaaaccctgggacgtgatccccatggtcacccaaatcgcgatgaccgacaccacgcctttcggacagcagcgcgtattcaaggaaaaggtggacacccggacgcctcgtgccaagcggggcaccacacaaatcatggaggtcaccgccaagtggttgtggggtttcctctcgaggaacaagaagccccggatctgcacgcgtgaggagttcacccggaaagtgcgctccaatgccgcgattggtgccgtgtttgtcgacgagaaccagtggaacagcgccaaagaagcggtggaggacgagaggttctgggacttagtgcaccgcgagcgagaactgcacaaacaggggaaatgtgctacctgcgtctataacatgatggggaaacgagagaaaaagctcggcgagttcggcaaagccaagggaagccgtgctatctggtacatgtggctgggagcacgcttcctggagttcgaagccctcggattcatgaacgaagaccactggttcagccgagagaacagcctttccggggtggagggcgaggggcttcacaagcttggatatatcttgcgggacatcagcaagataccgggaggtaacatgtacgcggatgacaccgcaggctgggacacacgtatcaccgaggacgacttgcagaacgaggccaagatcactgacatcatggagcctgagcacgcattgctggccacaagcatcttcaaactaacataccagaacaaggtggtccgcgtccagcgtcccgcgaaaaacgggaccgtgatggatgttataagccggcgcgaccagcggggctccggccaggtggggacgtacggcctgaacacgttcaccaacatggaggtgcagctgatccggcaaatggaaagcgagggtatcttccttcccagtgaactcgagacccccaatctggccgaaagagcactggactggctcgagaaacacggcgccgaacggctgaagcggatggccatatctggggacgactgtgtcgtgaagcccatcgacgaccgctttgcgacggctctgaccgcattaaacgacatgggcaaagtgcggaaagacatccctcagtgggagccctctaagggctggaatgactggcaacaggtgccgttctgcagccatcactttcatcagctgataatgaaggacgggcgcgagatagttgtgccatgtcggaatcaagacgaactagtcggccgcgctcgggtgtcccaaggggccggctggtccctcagggagacggcatgcttagggaagtcctacgcgcagatgtggcaacttatgtattttcaccgaagagacctacggctggccgccaatgcgatctgtagcgccgtccctgttgattgggtgcccaccagccgaactacgtggtctatccatgcccaccaccaatggatgaccactgaggacatgcttagcgtgtggaaccgcgtctggatcgaggaaaacccgtggatggaggacaagacccacgtgtccagctgggaagaagtgccctacctaggcaagagggaggaccagtggtgcggcagcctgatcgggctgacagccagggccacctgggcgacgaacatccaggtggccataaatcaggtgcggcgccttatcggcaatgagaactaccttgactatatgaccagcatgaagcgatttaagaacgagtccgacagcgaaggggccttatggtga

SEQ ID NO: 24033 - RNA, 9879 nt, synthetic construct
  misc_feature 1..9879: note = derived and/or modified CDS sequence (opt11) from DENV-1__EU482592__SS-prME
  source 1..9879: mol_type = other RNA
tcagtgaccatgctgttaatgctgctacctacagccctcgcctttcacctgaccacccgaggaggggaaccccacatgatagtttccaagcaggagcgggggaaatctttactattcaaaaccagcgccgggattaacatgtgtaccctgatcgccatggacctgggcgagctctgcgaggatactatgacgtacaagtgcccccgtatcactgaggccgaacctgacgacgttgactgttggtgcaacgccaccgatacttgggtaacatatgggacctgctcccagacaggcgaacaccggcgcgacaagcggtccgtcgctctggcgccccatgtaggcctggggctggagacccgcaccgaaacctggatgagcagcgagggcgcctggaaacagatccagaaggtagagacctgggccctgaggcaccccgggttcacggtcaccgccctgttcctcgctcacgcgatcggcacctccataacccagaaggggattatcttcatcctgctcatgctcgtgaccccctccatggcgatgcgctgcgtgggcatcggcaaccgggacttcgtcgaggggctaagcggcgccacctgggtggacgtggtcttggaacacgggtcctgtgtgaccaccatggccaaggacaagcccacgctcgacatcgagctgttgaaaaccgaggtgaccaaccccgccgtcctccgcaaactgtgtatcgaggctaagatcagcaacacgacgacagattcccggtgcccgacccagggcgaggccactctggtggaggagcaggactccaatttcgtgtgccggcgtacattcgtcgaccgagggtggggaaacggctgcggcctcttcggcaaggggagtctattgacatgtgccaagtttaaatgcgtgaccaaattggagggcaagatagtgcagtacgagaacctgaagtacagcgtcatcgtcaccgtgcacaccggcgaccagcaccaggtcgggaacgaaactaccgaacacgggaccatcgccaccattacgccccaggcacccaccagtgaaatccagctaaccgactacggggccctcacgctggactgcagcccccggacgggtcttgatttcaatgagatggttctcctgaccatgaaggagaagtcctggttagtccacaagcagtggttcctagatctaccgctgccctggacaagcggggctagcacgtcccaggaaacgtggaataggcaggatctcttagtcactttcaagactgcgcatgcaaagaagcaagaggtggttgtgctgggcagccaggagggtgccatgcacacggcactaactggggccactgagatccagacctccgggacgacgaccatcttcgcagggcacctgaagtgccgcctgaagatggacaagttgacactcaagggcatgagctacgtgatgtgcaccgggtcgtttaagctggagaaagaggtagccgagacgcagcacggaaccgtgctggtccaggtcaagtacgagggtaccgacgcgccttgcaagatcccgttcagcgcccaggacgagaaaggtgtgacacaaaacggccgcctcatcacggccaaccctattgtgaccgacaaggaaaagcccgtcaacatcgaaaccgagccgcccttcggagaatcctatatcgttgttggagcaggcgaaaaggcgctgaagctgagctggttcaagaaggggagttcgatcggcaagatgttcgaggccactgcccgcggggcccgccggatggccatcctcggcgacacggcctgggacttcggctccatcgggggcgttttcaccagcgtggggaagctggtgcaccaagtcttcggcgccgcctacggggttctattctccggagtgagctggaccatgaagatcgggatcggcatcctcctcacttggctgggccttaacagcaggagcacgtccctgagtatgacctgtatcgccgttgggatggtgactctctatctcggggtgatggtccaggccgactccgggtgcgtcatcaattggaaaggccgcgagctgaagtgcgggagcgggatcttcgtgacaaacgaggtccacacatggaccgaacagtacaagttccaggcagacagcccgaaaagactttctgccgccataggcaaggcctgggaggagggggtgtgcggcatccgctcggcgacgcgacttgagaacatcatgtggaagcagatctccaatgagctgaaccatatcctgctcgagaacgatatgaaattcacagtagtggtgggggatgcaaacggaatactcgcccagggcaagaagatgatccgcccccagcccatggagcatcggtatagctggaagtcctggggcaaagccaagatcatcggcgccgacattcagaatagtacctttatcatcgatgggcccgacaccccggagtgtccagacgaccagcgcgcgtggaacatctgggaggtggaggactacggcttcgggattttcactaccaacatctggctgaagctacgggactcctacactcaaatgtgcgatcaccgccttatgagcgccgcaatcaaagattcaaaggccgtgcacgccgacatgggttactggatcgaatccgagaagaacgagacgtggaagctggcgcgggcatcctttatagaggtgaagacatgcatatggcctaagagccacaccctctggtctaatggcgttctggaaagcgagatgattattcccaagatctacgggggcccgatctcccagcacaattaccgtccggggtatttcactcagacggcgggtccatggcacctagggaagctcgagctggatttcgatctgtgcgagggcacgacagtcgtggtggacgagcactgtggcaaccgggggccgagcctacgcaccacgacggtcaccggcaagatcatacacgaatggtgctgcagatcctgcactttgccgcccctgcgctttcgtggggaagatggctgctggtacgggatggagatccgtccggtgaaggagaaggaggaaaacctcgtgcgcagcatggtctcggctggcagtggggaggtcgacagcttctcgctggggatactctgcgtaagcatcatgatagaagaggtgatgcggtcccggtggagccgaaagatgctcatgactggcaccctggccgtgtttctactactaatcatggggcaactaacgtggaacgacctcatccgactgtgtatcatggtgggtgccaacgcgtccgaccggatggggatggggactacgtacctcgcgctcatggcaacctttaagatgcgaccgatgtttgccgtcggcctgctgttccgtcgcctcacgtcacgggaagtactgttacttaccatcgggctgtccctggtggcgtcagttgagctccctaacagcctggaagaactgggcgacggcctcgcaatgggaataatgatgctgaagctgctcactgagttccagccgcaccagctgtggaccaccctgttaagcctaaccttcatcaaaacgaccctgtccctcgactacgcctggcgcacgatggccatggtgctgagcatcgtatcgctattccccctttgtctgagtaccacgtctcagaagactacttggttaccggtgctattaggatcattcggatgcaagccactgactatgttcctgatcacggagaacaaaatctggggcagaaaatcctggcccttaaacgaggggatcatggcgatcggtatcgtctcaatcctcctcagctccctgttaaagaacgatgtccccctcgccggccctctgatcgcaggcggtatgctgatcgcctgttacgttataagcgggagttcagccgacttgtccctggagaaggcggcggaggtatcttgggaggaggaggccgagcactccggcacgagccataacatcttagtcgaggtccaggacgatgggaccatgaagatcaaagacgaggagcgtgacgacacactcaccatcctgctgaaggccacgctgctcgccgtgtccggagtgtacccaatgagcatcccggcgaccctgtttgtttggtatttctggcagaagaagaagcagcggtccggggtgctgtgggacactccctcgccgcccgaggtggaacgcgccgtgcttgacgatggcatttaccggatccttcagcgcggcctgctaggtcgcagccaggtgggcgtcggggtgttccaggacggcgtattccacacaatgtggcatgtcacccgcggggccgtgctgatgtaccaaggcaagcggctagagccgagctgggcctccgtgaagaaggacctaatctcatacggcggtggctggcgctttcaggggtcctggaacaccggcgaggaggtacaggtgatcgccgtcgagccagggaagaacccaaagaatgtccagaccaccccaggcacgttcaaaacccccgagggcgaggtgggggcgatcgcactggattttaagcccggcaccagtgggagcccgatcgtgaaccgtgagggcaagatcgtcggactatacgggaacggcgtagtgaccacgtcgggaacctacgtcagcgccattgcccaagccaagacctcccaggaggggcccctccctgagatcgaggaggaagtgtttaagaagagaaacctgaccatcatggacttgcacccggggagcggtaagacgaggaggtacctccctgcgatagtgcgggaggccatcaagcgcaagctgcgcacactgatccttgcccccacccgggttgtggcaagcgagatggcagaagccctgaagggcatgcctatccgataccagactacggccgtcaagagcgagcacaccgggcgggagatcgtcgaccttatgtgccatgcaaccttcaccatgagactcctgtccccggtgcgggtgcccaactacaatatgattatcatggacgaggcccacttcacggacccagcaagcattgccgcccgcggctacatatccacacgggtagggatgggcgaggcggccgcgatcttcatgaccgctacgccacccgggagcgtggaagccttcccccagtccaacgccgtgatccaggacgaggagcgggacatacccgagcggtcctggaactccggctacgattggatcacggacttcccgggtaagaccgtctggttcgttcccagcattaagagtgggaatgacatagccaactgcctgcgcaagaacgggaagcgggtcatccagctcagccgtaagaccttcgataccgagtaccagaagacgcgcaacaacgactgggattatgtcgtgacgacagacatttccgagatgggagctaacttccgcgccgaccgggtgatcgacccccgccggtgccttaagcccgtcatcctgaaggacggcccggagcgggtgatcttagccgggccgatgcccgtgacagtcgctagcgccgcgcagcggcgcgggcggattggacgtaaccagaacaaggagggagaccagtacgtttacatgggccagccgctgaacaacgatgaggaccacgcccactggaccgaggccaaaatgctcctggacaacatcaacactccagagggtatcatcccggccctcttcgagcccgaacgcgaaaaatctgcggctatcgacggggagtaccggctgagaggggaggcacggaagaccttcgtcgaactcatgcgccggggcgacctgccggtctggctgagctataaggttgcctccgagggcttccagtactcagaccgccggtggtgctttgacggggagcggaacaaccaagttttagaagagaacatggatgtggagatctggaccaaagagggcgagcggaagaagctgcgcccgcgctggctggacgccaggacgtacagcgacccgctcgctctgcgtgaatttaaggagttcgccgccgggcgccggtccgttagtggcgacctgatcttggagatcggcaagctgcctcagcatctgaccctacgcgcccagaacgccctcgacaatctggtcatgctccacaactccgagcaaggtgggaaggcataccgacacgcgatggaggagcttcccgacaccatcgagaccctgatgttactagctttaatagccgtcctcaccgggggcgtcacactgttcttcttatcaggtaagggcctcggcaagaccagcatcgggttactgtgcgttatggcgagctccgccctgctgtggatggccaacgtcgagccccactggatcgccgccagcatcatcctggagttcttcctcatggtgttattgataccagagccagaccgccagaggactccgcaggacaatcagctcgcgtacgtcgtgatcgggctgttattcatgatcctcaccgtagccgccaacgagatggggctgttagagacgaccaagaaggacttgggcattggttacgtcgccgccgagaaccagcaccacgcgaccatgctggatgtggatctgcgccccgccagtgcctggaccctctacgccgtggcaacgaccgtcatcaccccgatgatgagacataccatcgagaacacgaccgccaacattagcctgaccgccatcgccaatcaggccgcgattctgatgggactcgacaagggctggcccatttcgaagatggacatcggggtgcccctgctggccctcggctgctacagccaggtgaacccgctaaccctgacggccgccgtactcatgctcgtggcccactacgctatcatcgggcccggactgcaggccaaagcgacccgggaggcccaaaagcgtaccgccgcggggatcatgaagaatcccaccgtggacggcatcgtcgccatcgacctagaccccgtcgtgtacgacgccaagttcgaaaagcagctaggccaaattatgctgcttattctttgcacatcccagattctgctcatgcggaccacgtgggccctttgtgagagcatcaccctcgcgacggggccattgaccaccctatgggaaggttcccccggtaagttctggaacacgaccatcgctgtctccatggccaacatcttcaggggctcctatcttgcgggcgccgggctcgcgttctcactgatgaagtcactgggcgggggacgacgcgggaccggcgctcagggcgagaccctcggcgagaagtggaagcggcagctcaaccagctgagcaagagcgagttcaacacgtataaacgctcgggcatcatggaggtggaccggagtgaggccaaagaaggtttaaaacgcggtgagacgacaaagcacgcggtgtcccggggcaccgccaagctgcgctggttcgttgagcggaacctggtgaaacccgagggtaaggtgatcgacctgggttgcggacgcggaggatggagctactactgcgctggcctcaagaaggtcacggaggtgaaggggtatacgaagggcggccctgggcacgaggagcccatccccatggccacctacggctggaacctggtcaagctatactccgggaaagacgtctttttcactccacccgagaagtgtgacacgctcctgtgcgacatcggcgagagctcgccgaaccccaccatcgaggagggaagaactttgcgggtgctcaagatggtggagccttggctacgcggcaaccagttctgtatcaagatacttaacccctacatgccgagcgtcgtggaaacgctcgagcagatgcaacgcaagcacggtgggatgctggtgcgcaaccccctgtcccgcaacagcacccacgagatgtactgggtatcttgcggcacagggaacatcgtgagcgccgtcaacatgacgtcccgaatgctcctgaaccggtttaccatgacacacaggaagccaacctacgagcgggacgtcgacctgggagcaggcacacgccacgtggcagtggagcccgaggtagcgaacttggacattatcgggcagcggatcgagaacatcaagaacgagcacaagagcacatggtactacgacgaggacaacccttacaagacctgggcctatcacggctcgtacgaagtgaagcccagcgggtccgcctcgagtatggtgaacggtgtggttcgcctgctgaccaagccctgggatgtcattcccatggtgacgcagattgccatgaccgatacgacccccttcggtcagcagcgggtatttaaggagaaggtcgatacgaggacgccccgcgccaagcgcggcactgctcagatcatggaggtgaccgcaaagtggttatggggctttctctcacgtaacaagaagccgcgcatctgcacgcgggaggagttcacacgcaaggtgcggagcaacgccgccatcggggccgtgttcgtcgacgagaatcagtggaactccgcgaaggaggcggtggaggacgagcgcttttgggatctcgtacaccgggagcgtgagctccacaagcagggcaaatgcgcaacatgtgtgtataacatgatgggcaagcgcgaaaagaagctaggtgagttcggcaaggctaagggttcccgcgcgatctggtacatgtggctaggcgctcggtttttagagttcgaggcactagggttcatgaacgaggaccattggttctcacgcgagaacagtttctccggcgttgagggggaggggctgcacaagctcgggtacattctgcgcgacatctcgaagatcccaggcggaaacatgtacgccgacgacaccgctgggtgggacacgcgtatcaccgaggacgatctgcagaatgaagcgaagattaccgacataatggagcccgagcacgccctcctggccacgagcatattcaaattgacgtaccaaaataaagtagtgcgcgttcagagaccagccaaaaatggaaccgtcatggacgtgatctcgcgccgagaccagcgagggtcgggacaagtaggcacctacggcctaaacaccttcacgaacatggaggtccagctgattcgtcaaatggagagcgaaggaatcttcctgccgagcgagcttgagacccctaacttggccgaaagggtcctgaactggctcgagaagcacgggaccgaaagactgaagcgtatggcgatctcgggtgacgattgcgtcgttaaaccagtggacgaccggttcgctaccgcactgatcgccttgaacgacatggggaaggtgcgcaaggacatcccccagtgggaacccagtaagggatggaacgactggcaacaggttccattttgctcacaccactttcaccagctcataatgaaggacggccgagagattgtagtgccctgccgcaaccaagacgagctggtcggtcgggcccgcgtcagtcaaggcgctgggtggagcctccgggagactgcttgcctgggaaagtcctacgcccagatgtggcagctgatgtactttcaccgccgggacttgcgccttgcagcgaacgcgatatgtagcgctgtgcccgtcgactgggtgcctacctctagaaccacctggtctatccacgcccaccaccagtggatgaccacagaggacatgctgagcgtgtggaacagagtctggatcgaggagaacccgtggatggaggacaagacccacgtgtccagttgggaggaggtgccctacctcggtaaaagagaggatcaatggtgcggctccctcatcggtctcaccgccagagcgacctgggcgacgaacatccaggtcgccatcaaccaggtgaggcggctcatcggaaacgagaattatttggactacatgacctccatgaagcgcttcaagaatgagtctgaccccgagggtgctctgtggtga

SEQ ID NO: 24034 - RNA, 9879 nt, synthetic construct
  misc_feature 1..9879: note = derived and/or modified CDS sequence (opt11) from DENV-1__EU482609__SS-prME
  source 1..9879: mol_type = other RNA
agcgtgaccatgctgttgatgctcttacccaccgccctcgccttccacctgaccaccagaggcggggaaccccacatgatcgtgtctaagcaggagagggggaaaagcctgctgtttaagaccagtgcgggggtgaacatgtgcaccctgatcgccatggacctgggcgagctctgcgaggacaccatgacctacaagtgcccacggatcaccgaggccgagcccgatgatgtggactgctggtgcaacgcaaccgatacctgggtgacgtacgggacctgttcacagaccggcgagcatcggagggacaagcggtctgtggccctggcaccccacgtgggcctggggctcgaaacgcggacagagacgtggatgagcagtgagggcgcttggaagcaaatccagcgggtcgagacctgggccctgcggcatcccgggttcacggtaatcgctctgtttctcgcccacgccatcggaacgagcatcacccagaaggggataatcttcatactgctgatgctcgtgacccccagcatggccatgcggtgcgtcggcataggtaatcgcgacttcgtggaggggctgagcggcgccacttgggtggacgtcgtgctggagcacgggtcctgcgtgactacgatggccaagaacaagccaactctggacatcgagctgttaaagacagaggttaccaacccagcggtgctccggaagctctgcatcgaagccaagatcagcaacaccaccacggactccagatgcccgactcaaggcgaggccaccctggtggaagaacaggacgccaacttcgtctgtcggcgcaccttcgtggatcggggctggggaaatggctgcggcctcttcggcaaagggagcctcctgacgtgcgcaaagttcaagtgcgtgaccaagctcgagggaaagatcgtccagtacgagaacttgaagtactcagtaatcgtaaccgtacacaccggggaccagcaccaagttgggaacgagacgactgagcacggcaccatcgcaaccatcacgccccaggcccccacgagcgaaatccagctgaccgattacggggccctgaccctagactgctcaccccggaccggcctggacttcaacgagatggtcctcctgacgatgaaagagaagtcttggctcgtgcacaagcagtggttcctcgacctgcctctgccctggacttccggggccagcaccagccaggagacctggaaccggcaggacctcctggtgacgtttaagaccgcacacgcgaagaaacaggaggtcgtggtgctgggctcccaggagggcgccatgcataccgctctcaccggggccacggagatccagaccagcggcaccaccacgatcttcgccggtcacttgaaatgccgtttgaagatggacaagctcaccttaaagggcatgtcgtacgtcatgtgtaccggctccttcaagctggagaaggaggtggcggagacgcagcatggcaccgtgttagttcaggtgaaatacgagggcaccgacgcaccctgcaagatccccttctccacccaggatgagaagggggtaacccagaacggccgtctcataacggccaacccgatcgtcaccgacaaggagaaaccagtgaacatagagacagagccacccttcggggagagctacatcgtggtcggcgccggcgagaaggcgttgaagttgtcctggttcaaaaagggaagctccataggcaagatgttcgaggccaccgcccgaggggcacggcgtatggctatcttaggcgacacggcgtgggactttgggagcattggcggtgtcttcacctcggtggggaagctggtccaccaggtgttcggcaccgcctacggggtccttttcagtggcgtctcctggaccatgaaaatcggtataggcatcctcctgacgtggctaggtctaaattcacgctccacgagcctgtccatgacctgcatagcagtgggcatggtcaccctgtacctcggcgtcatggtgcaggcggacagcgggtgcgtgatcaactggaaaggtcgtgagctaaagtgcggatccggcatcttcgtcacgaacgaagtgcacacctggaccgaacagtacaagttccaggccgacagcccgaaacgcctgagcgcagcaatcggcaaagcctgggaggagggggtgtgcggaatccggagtgccacccgcctcgagaacatcatgtggaagcagatcagcaacgagctgaaccacatcctgctcgagaacgacatgaagtttaccgtagtggtaggagacgccaacggcatccttgctcaagggaagaagatgatccgcccccagccaatggagcacaagtactcctggaagagttggggcaaggccaagatcatcggcgccgacatccagaacacgaccttcatcatcgacggtcctgacactccggagtgtcctgacggccagcgcgcctggaacatatgggaggttgaagactacgggtttggtatcttcaccacgaacatctggctgaagctccgggactcctacacccagatgtgcgaccaccgcctgatgagcgcggcgatcaaagactccaaggccgtgcatgccgacatgggatactggatagagagcgaaaagaacgaaacctggaaacttgcccgggcgtccttcatcgaagtgaaaacctgtacatggcccaagtcgcataccctctggtccaacggtgtactggagagcgagatgattatccccaaaatctacggcgggccgatctcccagcacaactaccgccccggctacttcacccagaccgccgggccttggcacctgggcaagctcgagctggacttcgacctgtgcgagggtacgacggtcgtagtcgatgagcactgcgggaacaggggccctagcctacgaaccaccacggtgactgggaagatcatccacgagtggtgttgccggtcctgcaccctgccgcccttgcgcttccggggcgaagatggttgctggtacggcatggaaatccgtcctgtgaaggagaaggaagagaacctcgtccggagcatggtgtccgctggcagcggggaggtggactcattctccctgggcatcctgtgcgtctcaatcatgatcgaggaggttatgcggagccggtggtcgcgcaagatgttgatgaccgggacgttagccgtgttcctgctcctgatcatgggacagttaacctggaatgacctcatccgcctgtgcatcatggtcggcgccaacgcgtccgaccggatgggaatgggcaccacctacctcgctctgatggccacgtttaagatgcgcccaatgttcgctgttgggctgctgttccggcgcctaaccagccgggaggtgctgctgctcacaatcggcctatccttggtcgccagcgtggaactccccaactccctggaggagctaggggacggactcgcgatgggcatcatgatgctaaagctgcttaccgagttccagccgcaccagctgtggacgaccctgctcagcctgacctttgtgaagaccacgctgtccctggactacgcctggaagaccaccgccatggtgttaagcatcgtttcgctgttccccctctgcctgagcaccacgtcccagaagaccacctggctgccggtcctcctgggctcttttggctgcaagcccctgaccatgttcctgatcaccgagaacaagatttgggggcgcaaatcctggccactgaacgaggggatcatggccatagggatcgtgagcatcctgttgtccagcctgctgaagaatgacgtgcccctcgcgggcccgctgatcgcaggcggaatgctaatcgcatgctatgtcatcagcggctccagcgctgacctctccctggagaaagccgcggaggtgagctgggagcaggaggcggagcactctggggcatcacacaacatactggtggaagtccaggacgacggcacgatgaaaatcaaggacgaggagcgggacgacaccctcaccatcctactgaaagccaccctcctagccgtatccggggtgtaccccatgagcatccccgcgacgctgtttgtatggtacttctggcaaaagaagaagcagcgctccggtgtgctctgggacactcccagcccgcctgaggtggagcgggccgtcctggacgacggcatataccgcatcctgcagcggggtctgctcggccgctcccaggtgggggtgggcgtattccaggacggggttttccacaccatgtggcacgtgacccggggcgcagtcctgatgtaccagggcaagcgcctagagcccagctgggcttccgtgaagaaggaccttatcagctatggaggagggtggcggttccagggatcctggaacacgggggaggaggtgcaggtcatcgccgtggagcccggcaagaacccgaagaacgtgcagaccacccctggcaccttcaagacgcccgagggagaggtaggcgcgatcgctcttgacttcaagcccgggaccagcggctccccaatcgtgaaccgcgaaggcaagattgtggggctgtacggcaacggagtcgtgacaaccagcggcacgtacgtgtccgccatcgcccaggctcgcgcgagccaggaggggcccctccccgagatagaagacgaggttttcaagaagcgcaatctgaccatcatggacctgcaccccgggagcggcaagacccgccgctacttaccggccattgtgcgtgaagccatcaagcgcaagctgcgcactctgatcctcgcccccacgcgggtcgtcgcgtccgagatggccgaggccctgaaggggatgcccatacgctatcaaacgaccgccgttaagtccgagcacaccggccgtgagatcgttgacctgatgtgccacgccacgttcaccatgcgcctcctgtccccggtccgggtgcccaactacaacatgatcataatggacgaggcgcacttcactgatcccgcctctatagccgcccgcgggtacatctccacccgggtggggatgggggaggccgcggccatcttcatgacggccacgccaccggggtccgtcgaggccttcccccaatccaacgccgtgatccaggacgaggagagagacatccccgagagatcctggaactccggctatgactggatcaccgacttccccggaaagaccgtgtggttcgtcccaagcatcaagtctgggaacgacatcgcgaattgtctgcgcaagaacgggaagcgggtcattcagctcagccggaagacgttcgataccgagtaccagaagacaaagaacaacgactgggactacgtggtaaccacggacatttccgagatgggagcgaacttccgagctgaccgcgtgatagacccccggcggtgcctgaagccagtgattctgaaggacgggccagaacgggtcattctcgccggcccgatgcccgtgaccgtcgctagcgccgcccagcggcggggaagaatcgggcgcaaccagaataaggagggcgaccagtacgtgtacatggggcagccgctgaacaacgacgaggaccacgcccactggacggaggccaagatgctgctcgacaatattaacaccccggagggcataatcccggcgctgttcgagcccgagcgggagaagtccgccgccatcgacggcgaataccgcctgcggggcgaagcccgcaagacgttcgttgagctcatgcggcgcggcgacctgcctgtctggctaagctacaaggtggcctccgaggggttccagtattcggaccggcgctggtgcttcgacggcgagcgcaacaaccaggtgctcgaggagaacatggacgtcgaaatttggaccaaggaaggggagcgcaagaaacttcggcccagatggctggatgcgagaacctactccgatccgctagccctgcgcgagttcaaagagttcgccgccgggcggcgcagtgtgagcggcgacctgatcctcgagatcgggaagctgcctcagcacctgaccctccgagcccaaaacgcgctggacaacctggtgatgctccacaacagtgagcaaggagggaaggcctatcgacacgccatggaggagcttcccgacaccatcgagacgttaatgctcctggctctgatcgcagtcctaacaggaggggtgacactgttcttcttgagcggcaagggcctcgggaaaacctccattggcttactgtgcgtgacggccagctcagcactcctgtggatggcctcggtcgagccccactggatcgccgcttccattattctcgagttcttcctcatggtgttgctgattccagagcccgaccggcagcgcacgccacaagataaccagctcgcctacgtcgtcatagggctgctgttcatgattctcaccgttgccgccaacgagatggggctgctggagaccacgaagaaggacctcgggattggctacgtggccgcagagaaccatcagcacgccactatgctggacgtcgatctgcggccggccagcgcctggacgctctacgccgtggcgactactgtgatcacccccatgatgaggcacaccatcgagaacacgacggccaacatctccctgaccgccatcgccaaccaggccgcgatactgatgggcctagacaaggggtggcctatcagcaaaatggacatcggtgtccccctgctggccctcgggtgttactcccaggttaacccgctgacacttaccgctgccgtgctcatgctggtcgcgcactacgccatcatcggccccgggctgcaggccaaggcaacgcgcgaggcccagaagaggaccgcggcaggcatcatgaagaaccccaccgtggacggcatagtggccattgaccttgaccccgtcgtgtatgacgccaagttcgagaagcaactggggcagatcatgttactcatactgtgcaccagccaaatcctgctaatgaggacgacctgggccctgtgcgagtccatcacgctggcaaccggaccgctcacgactctgtgggagggcagccccggcaagttttggaacaccaccatcgcggtgtcgatggctaacatcttccggggctcatacctggccggcgccgggctagcgttctccctgatgaagtccctcgggggtggccgccgggggacgggcgcccagggggagacactcggcgagaaatggaagcgccagctgaaccagctgtccaagagcgagttcaacacgtacaagcggagcgggatcatggaggtcgaccgctccgaggccaaggagggactgaagagaggggagaccacgaagcacgccgtgagccgcggcaccgcgaagctgcggtggttcgtggagcgcaacttagttaaacccgagggtaaagtgatcgatctggggtgcggcagagggggctggtcttactactgcgccgggctgaagaaggtgacggaggtcaagggctacacaaagggcgggcccggccacgaggagccgatccccatggctacctacgggtggaacctggttaagctgcacagcggaaaagacgtgttcttcatgccgcccgagaagtgcgacacgctcctgtgtgacatcggggagtccagcccgaaccccaccatcgaagaaggccgcaccttaagagtcctcaagatggtggagccctggctgaagggcaaccagttctgcatcaagatcctgaacccttacatgccgtccgtggtcgagacgctcgagcagatgcagcggaagcacgggggcatgctggtgagaaaccctctgagcaggaactccacgcacgagatgtattgggtaagctgcgggaccggcaacatcgtctcagccgtgaacatgacctcaagaatgctcctaaaccgcttcaccatggcgcaccggaaacccacctacgagcgggacgttgacctgggcgcggggacccgccacgtcgcggttgagccggaggtggccaacctcgacatcatcggccagaggatagaaaacatcaagaacgagcataagtccacatggcactacgacgaggacaacccgtacaagacctgggcatatcatgggagctatgaggtcaagccctccggcagcgcctccagtatggtgaatggggtcgtgcgcctgctaacaaagccctgggacgtgatacccatggtcacccagattgcaatgaccgataccacgcccttcggccagcagcgagtgttcaaggagaaggtagacacccggacgcccagggccaagaggggtaccacgcagatcatggaagtcaccgcccgctggctctggggctttctgtcccgaaacaagaaaccgcggatatgcacccgcgaagagttcacccggaaggtgcgcagcaacgccgctatcggcgcggtgtttgtcgacgagaaccagtggaatagcgccaaggaggccgtggaggacgagagattctgggacctggtccaccgcgagcgcgaactccacaagcaggggaagtgcgcgacgtgcgtctacaacatgatgggcaaacgcgagaagaagctgggagagttcggcaaggcaaagggatcccgggccatatggtacatgtggctgggggcccgcttcctagagttcgaggctttaggatttatgaacgaggatcactggttcagccgggagaactccctgagtggggtggagggggagggcctccataagctgggctacatcctgcgcgacatctcaaagataccgggcgggaacatgtacgccgacgacaccgcgggctgggatacccgcatcaccgaagacgacctccagaacgaggccaagatcacggacatcatggagcccgagcacgcactgctggctaccagcatcttcaaactcacctaccagaacaaggtcgtccgggttcagcgacccgctaaaaacgggacggtgatggacgtcatctcccggcgcgaccaacgcggcagcgggcaggtcgggacgtacggcctaaacaccttcactaacatggaggtgcagctgatacgacagatggaatcagaagggatcttcagcccctccgagttggagaccccgaacctggcggagagggtcctggactggttagagaagcatggcgccgaacgactgaagcggatggccattagcggagacgactgcgtggtgaagcccatcgacgaccgcttcgccacggccctgacagctctcaacgatatgggcaaggtccggaaagatataccccagtgggagccgtcaaagggctggaacgactggcaacaggtcccgttctgttcgcaccacttccaccagctgatcatgaaggacgggcgcgagatagtagtaccctgccggaaccaggacgagctggtcggccgagcaagggtgtcccagggggccggctggagtctccgcgagaccgcatgcctggggaagagttacgctcagatgtggcagcttatgtactttcaccggcgcgatctccggctagcggccaacgccatctgtagcgccgtacccgtagactgggtgccgactagccgcaccacgtggagtatccacgcgcaccaccagtggatgaccaccgaggacatgttaagcgtctggaaccgcgtgtggatagaggagaacccgtggatggaggacaagacccacgtatccagctgggaagaagtcccctacctcggcaagcgggaagatcagtggtgtggctccctgatcggtctgaccgcccgcgcgacctgggccaccaacatccaggtggccatcaaccaggtgcggcgcctcattggcaacgagaactacctggactacatgacaagcatgaagcgcttcaagaacgaatccgaccccgaaggggcgctgtggtga

SEQ ID NO: 24035 - RNA, 9879 nt, synthetic construct
  misc_feature 1..9879: note = derived and/or modified CDS sequence (opt11) from DENV-1__EU482610__SS-prME
  source 1..9879: mol_type = other RNA
agcgtcaccatgctgctcatgctgctgcccaccgcactcgctttccacctgaccacccgcggcggggagccccacatgatcgtgagcaaacaggagcggggcaagagcctgctgttcaagacctcagcaggtgtgaacatgtgcacgttaatcgcaatggacctgggggagctctgtgaggacaccatgacctacaagtgcccccgcatcaccgaggccgaaccggacgacgtggactgctggtgcaacgccacagacacctgggtgacctatgggacttgcagccagacgggcgagcaccggcgagagaagagatccgtcgccctagccccgcacgtgggcctcggtctcgagacccgcacggagacctggatgagctccgagggcgcttggaagcagatccagcgggtagagacctgggtcctgcgccaccccgggttcactgtgatagccttcttcctagcccacgcgatcggcaccagcatcacccagaaagggatcatattcatcctcctaatgttggtcactccctccatggccatgcgatgtgtgggcataggcaaccgagactttgtggaggggctcagcggcgccacgtgggtcgacgtagtcctggagcatgggtcctgtgtcaccaccatggccaagaacaaaccaactctggatatcgagctactaaagactgaggtgaccaaccccgccgttctgcggaagctctgcatcgaggcgaagataagcaacaccaccacggattcacgttgcccaacccaaggagaggccaccctggtcgaggagcaggacgcaaatttcgtttgccggcgcaccttcgtagaccggggctgggggaacggctgcgggttattcggcaaagggtccctcctgacgtgcgccaagttcaaatgcgtcaccaagctggaaggcaagatcgtgcagtatgagaacctcaagtactccgtgatcgtcaccgtgcacactggagatcagcaccaggtcgggaatgagacgaccgagcacggcaccatcgctaccataacaccccaggcgcccactagcgagatccagctgaccgactacggggcactaaccctcgactgtagcccccgaaccggcttggacttcaacgagatggttctgctgaccatgaaggagaagtcctggctggtgcacaagcagtggttcctagacttgccgctgccctggacctccggagcatctaccagccaggagacctggaaccgtcaggacttgctagtcacgttcaagacagcccacgccaagaagcaggaggtggttgtcctgggatcccaggagggcgcgatgcacaccgccctcacaggggccacggaaatccagactagcggtaccaccaccatcttcgccgggcacctaaagtgccgcctaaagatggacaagttaaccctcaaggggatgtcctatgtgatgtgcaccggatcgttcaaactggagaaggaggttgctgagacccaacacggcacggtgttggtacaggtgaaatacgaaggcaccgacgcgccctgcaagatcccgttcagtactcaggatgaaaagggggtcacccagaacggccggctgatcacggcgaacccgatcgtgactgacaaggagaagcccgtcaacattgagaccgagccgcctttcggcgaaagctacatcgtagtgggcgccggcgagaaggctcttaaactctcctggttcaagcgtggaagctccatcggcaagatgtttgaggcaaccgctcgcggtgcccgccgaatggcgatcctgggagacacggcctgggacttcggatctatcggcggcgtgttcactagcgtggggaagttagtgcatcaggtgttcggcaccgcgtatggggtactgttcagcggcgtttcttggaccatgaagatcggaatcggtatcctgctcacgtggctgggcctgaacagccggtccaccagcctctcgatgacctgcatcgctgtcgggatggtgactctgtacctcggcgtgatggtgcaggccgacagcggctgcgtcatcaactggaagggtcgcgagctcaagtgcggttccggcatattcgtgacaaatgaggtacacacgtggaccgaacagtacaaattccaggctgacagcccgaagcggctgtcggcggcgatcggcaaggcctgggaggaaggcgtctgcggaatacgctcggcgacgaggttagaaaatatcatgtggaagcagatcagcaacgaactgaatcacatccttctggagaacgatatgaagctcaccgtagtggtcggggacgccaatggcatactcgcccaggggaaaaagatgattcgcccccaacccatggaacacaagtactcctggaagtcctggggcaaggcaaagatcatcggcgccgacatccagaatacgacgtttatcatcgacgggcccgacactcctgagtgtcctgacggccagagagcctggaacatctgggaagtggaggactatgggtttggcgtgtttaccaccaacatctggttgaagctccgcgactcctatacccagatgtgcgaccaccgtttaatgagcgccgcgatcaaagactccaaggccgtccacgccgacatgggctactggatcgagagcgagaaaaatgagacctggaagctggcccgcgcctcattcattgaggtaaagacctgcacgtggccaaagtcgcacacgttgtggtccaatggggtattggagagtgaaatgatcatacccaagatctacggggggccgatatcccagcacaattatcggcccggctacttcacccaaacggcgggaccttggcatctgggaaagctagagctggacttcgatctgtgcgagggtacgactgtggtggtggacgagcactgcgggaaccgaggcccatcgctccggacaaccacggtcaccggcaaaatcatccacgagtggtgctgccgctcctgtaccctgccccccctgcggttcaggggagaggacgggtgctggtacggcatggagatccggcccgtcaaagagaaagaagaaaacctcgtgcgctcaatggtctccgctggcagtggggaggtagactctttctccctgggcatactgtgtgtgagtatcatgatcgaggaggtcatgcggagtcgctggtctcgcaaaatgttaatgaccggcacgctggccgtgttcctgctcctgatcatgggccagctgacctggaacgatctcatccggttgtgcattatggtgggggccaacgcctccgatcggatgggcatgggcaccacctacctggcgctcatggctacgttcaagatgagaccgatgtttgcagtgggtctactgtttcgccggctcactagcagagaagtgctgctgttaacgatcggcctgtccctcgtggccagcgtggagctccccaactccttggaggagcttggtgatggtctcgccatgggcattatgatgttaaagctgcttactgaattccagccccaccagctatggactaccctgctgagcctgaccttcgtgaagaccacgctatccttagactacgcctggaagacgaccgccatggtcctgtctatcgtgtcactcttccccctctgcttgagcacaacgtcccaaaagacaacgtggctaccggtgctcctagggagctttggctgcaagcccctcacaatgttcttaatcaccgagaacaagatctgggggcggaagagctggcctctgaacgaggggatcatggcaattgggatcgtcagcattctgctcagtagtctgctgaagaatgacgtccccttggcaggtcctttgatagctggcgggatgctcatcgcctgttacgtgatcagcggcagttcagcggacctttccctggagaaagcggccgaggtcagttgggagcaggaagctgagcattctggggcgagccataacatcctagttgaggtgcaggacgacggcacgatgaagattaaggacgaggagcgcgacgacaccctcaccatactgctgaaggcgaccctcctggctgtttccggggtgtaccccatgtcgattcccgccacgctgttcgtgtggtatttctggcagaagaagaaacagcggagcggcgtcctctgggacactcccagcccgccggaggtggagagggctgtgctggacgacggtatctaccggatcctgcagcgcggattattgggccggtctcaagttggcgtaggcgtttttcaggacggagtctttcacaccatgtggcacgttacccgcggagccgtgttgatgtaccagggtaagcggctcgaacccagctgggcctccgtcaaaaaggacttaatcagctacgggggggggtggcgctttcagggctcctggaatacgggggaagaggtccaggtgatcgccgtcgagccaggcaagaaccctaagaatgtacagaccaccccaggcaccttcaagacgcccgaaggggaggtgggcgcaatagcgctggatttcaagcccgggacctctggttccccgattgtaaatcgtgagggcaagatcgtaggtctgtacggcaacggggtggttacgaccagcggaacttacgtttcggccattgcacaggccaaggctagccaggaggggccactccccgagatcgaagatgaggttttcaagaagaggaacctaaccatcatggaccttcacccgggcagcggcaagaccaggcgctatttacccgcgatcgtccgcgaagcgatcaagagaaaactgcgtaccctgatcctcgcacccacgcgagtggtggcctccgagatggcagaggccttgaaggggatgcccatccgctatcagacgaccgccgtcaagtcggaacacaccggccgggaaatcgtggaccttatgtgccatgccacttttaccatgcgcctcctgtccccggtaagagtccctaactataacatgattatcatggacgaggcccacttcactgaccccgcaagtatcgctgcgcgcgggtacatctctacccgagtgggcatgggagaggccgccgcaatcttcatgacagccacgccgcccggcagcgtggaggccttcccacagagtaacgccgtaattcaagacgaggagcgtgacataccagagcggagctggaattccggctacgactggatcacggacttcccaggcaagaccgtatggttcgtgcccagcattaagtccggcaacgacatcgccaactgcctgcgcaagaacgggaagcgggtcatccagctcagccgtaaaacgttcgacacagagtaccagaagacgaagaataatgattgggattacgtcgttaccacggatatcagcgagatgggcgccaacttccgggccgatcgcgtcatcgacccccggcgctgtctgaagccagtcatcctgaaagatgggcccgagcgcgtcatactcgccggaccgatgcccgtgaccgtggcttccgctgcccagaggcggggccgcataggtcgaaatcagaacaaggagggcgaccagtacgtctacatgggccaaccccttaacaacgatgaagaccacgcccattggaccgaggccaaaatgctgcttgacaacattaacacacccgagggcatcatcccggccctgtttgagcccgagcgggagaaatctgcagccatcgacggggaataccgtctgcggggcgaggctcgcaaaacgttcgtggagctcatgcggagaggggacctgcccgtttggctgagctacaaagtcgcctctgagggctttcaatatagtgaccggcgctggtgctttgacggcgagcgcaacaaccaggttctcgaggagaacatggacgtggagatctggaccaaagagggggagcggaagaagctgcggcctcgctggttggatgcccggacctactccgacccgctcgcgctgagagagttcaaggagttcgcggccggccgccggtccgtctcaggcgatctgatcttggagattgggaaactgccacagcacctgaccctccgcgcccagaacgctctggacaacctggttatgctccacaactccgagcagggcgggaaggcctaccgccatgccatggaggaattacccgataccatagagacgctgatgctcttggctctgattgcagtgctcacgggaggggttacgctcttcttcttgagcgggaaggggttagggaagacatccatcggcctactatgcgtgaccgcgagcagcgccctcctgtggatggcctctgtggagccccactggatcgccgcctcaatcatcttggagttcttcctcatggtcctgctcattccggagccagaccggcaaaggacgcctcaggacaaccaactagcgtatgtggtgatcgggctgctgttcatgatcctcaccgtcgccgccaatgagatgggcctgctggagaccactaagaaggatctgggcatcggctacgtagccgccgaaaaccaccagcacgctaccatgctcgacgtagacctgcaccccgccagcgcctggaccctctacgccgtcgccaccacagtcatcaccccaatgatgcgtcataccatcgagaacaccaccgctaacatatccctgacggccattgcaaaccaggccgccatcctgatgggcctcgacaaagggtggccgattagtaagatggatatcggcgtgcccctgctcgcgttaggttgttactcccaggtcaacccgctaaccttaactgccgcagtgctcatgctggtggcccattatgcgataattggccctgggctgcaggccaaggccacgcgcgaggcccagaaacgcacggctgcgggcatcatgaagaatcccaccgttgacggcatcgtggccatcgatctcgaccccgtcgtctacgacgccaaattcgagaagcagctggggcagatcatgctgctaatcctgtgcaccagccagatcttgctcatgcgaacgacatgggccctgtgcgaatctatcaccctggcaaccggcccgctaacgaccctgtgggagggctcgccaggcaagttttggaatacgaccatcgcggtgtccatggccaacatcttccgcggcagctacctggctggagcaggattagcgttctccctaatgaagtccctcggcggcgggcggcgtggtactggcgcacagggggagaccctcggcgagaaatggaagaggcagctgaaccaactgagtaagagtgaattcaatacctataagcgatcgggtatcatggaagtagaccgctccgaggccaaggagggattgaagcgcggggaaaccacgaagcacgccgtcagcaggggcaccgccaagttgcgatggttcgttgagagaaatctggtcaagccagagggcaaagttattgatctgggctgcggaagagggggttggagctactattgcgcggggcttaaaaaagtgaccgaggtgaagggctacaccaagggcgggcccggccacgaggagccgatccccatggccacctacgggtggaacctggtcaagttgcacagcggtaaggatgtgtttttcatgccgcccgaaaagtgcgacacgttactgtgtgacattggggagtcctcaccgaaccccaccatcgaggaaggacggaccctgcgggtcctcaagatggtcgagccatggctgcggggtaatcaattctgcatcaagattctgaacccctacatgccgtccgtggtggagaccctcgaacagatgcaaaggaagcacggcggtatgctggtcagaaatcccctgagcaggaactcaactcacgagatgtactgggtgagctgcggaaccggcaacatcgtctccgcggtcaacatgaccagccgcatgcttctgaatcgcttcaccatggcgcacaggaagcccacctacgagcgggacgtggatctgggcgctgggaccagacacgtggcggtagagcccgaggtggcgaacctggacataatcggacagcgaattgagaatataaagaacgagcacaagtccacttggcactacgacgaggacaacccctacaagacatgggcataccacggtagctacgaggtcaaaccctcggggagcgcgagtagcatggtgaacggggtggttcgcctgctcacgaagccctgggacgtcatccccatggtaacccagattgccatgaccgacacaactccttttggccagcagcgggtcttcaaggagaaagtggacaccaggacgccgcgggccaagcgcgggaccacgcaaataatggaagtgacggccaagtggctctggggattcctgagcaggaacaagaagcctcggatctgcacccgtgaagagttcacccgcaaggtccggagcaatgcggccattggggctgtgttcgttgacgagaaccagtggaactcggctaaagaagcggtggaagacgaacgcttttgggacctggtacaccgagagcgagagttgcacaagcagggaaagtgtgcgacgtgtgtgtacaatatgatggggaagagagagaagaagctgggagagttcggcaaagcgaagggctcccgcgcgatttggtacatgtggctaggggcccggttcctcgaattcgaggccctgggcttcatgaatgaggaccactggttctcacgtgaaaactccttatcgggggtcgaaggagaagggctccacaagctcggctatatcctgcgggacatctccaagatccccggcgggaacatgtacgctgacgacaccgctggatgggacacccgcatcaccgaagacgacctccagaacgaggcgaagataacggacatcatggagccagagcacgcactgctggccactagcattttcaagctcacctaccagaacaaagtggtccgtgtccagcggcccgccaaaaacggtaccgttatggacgtgatctcacgtcgcgatcagcgcggtagcggccaggtcgggacatacggtctgaataccttcaccaatatggaggtgcaactgatcaggcagatggagtccgaggggatcttcctcccctctgaactcgagacaccgaacctggccgagagagcgctcgattggctagagaaacacggcgcagagcgcctaaaacgcatggccatttccggtgacgactgcgtggtcaagcccatagatgaccggtttgccacggcactcaccgcgctgaacgacatgggcaaagtgaggaaggacatcccccaatgggagcccagtaaggggtggaacgactggcagcaggtcccgttctgctcccaccacttccaccaactgataatgaaggacgggcgggaaatcgtcgtaccttgtcgcaaccaggatgagctcgtcggacgtgcccgtgtcagccagggggcaggctggtcccttcgggagactgcttgcttgggaaaaagctacgcccagatgtggcaactgatgtactttcaccgccgggacctgcgcctggcggccaacgccatctgctccgccgttccagtggactgggtgcccacctcgcggaccacgtggagcatccacgcgcaccatcagtggatgaccaccgaagacatgctatcagtatggaaccgggtgtggattgaggagaatccgtggatggaagacaagacccacgtaagctcgtgggaggaggtgccctatctgggcaagagggaggaccagtggtgcggaagcttgatcgggctcaccgcccgggccacctgggccaccaacatccaagtggccatcaaccaggtacggcggctgatcggaaacgaaaactacctcgattacatgacgtctatgaagcgcttcaagaacgagagcgatcccgagggggcgctctggtga

SEQ ID NO: 24036 - RNA, 9879 nt, synthetic construct
  misc_feature 1..9879: note = derived and/or modified CDS sequence (opt11) from DENV-1__EU482611__SS-prME
  source 1..9879: mol_type = other RNA
agcgtgaccatgctattgatgctgctgcccaccgccctcgccttccatctaaccacccgcggcggggaaccccacatgatagtgtcaaagcaggagcggggcaagtcactgctctttaagaccagcgccggggtgaatatgtgcaccctgatcgctatggatctgggggagctatgcgaggacaccatgacctacaaatgcccccgtattaccgaggccgagcccgacgacgtagactgctggtgcaacgccactgacacctgggtgacctacgggacgtgctcacagaccggcgagcacagacgtgagaaacggtcagtcgccctggcaccgcacgtgggtttagggctcgagacccgtacagaaacctggatgagctccgaaggcgcgtggaagcagatccagcgggtagagacctgggccctcagacatccggggttcacagtgatcgccttcttcctggcgcacgccatcggcacgagcataacccagaaagggatcattttcatactgctgatgctggtgaccccctctatggccatgcggtgcgtcggcattggaaacagagacttcgtcgaagggctcagcggagcaacgtgggtggacgtggtgctcgagcatggttcgtgtgtgaccaccatggccaagaacaagcccacgctcgatattgagttgctgaaaactgaggtcaccaaccccgccgtgctgcggaagctgtgcatcgaggccaagatcagcaacactaccacggactcacgctgccccacgcagggcgaagccaccttagtggaggaacaggacgccaatttcgtgtgccgacgcaccttcgttgaccggggctggggtaatggctgtgggttattcggcaagggctctctcctgacgtgcgcaaagttcaagtgcgtgaccaagctggaggggaagatagtccagtacgagaacctcaagtactccgtgatcgtgaccgtacacactggcgaccagcaccaggtggggaacgagacgaccgagcacggcacaatcgcgaccatcacgccacaggcaccaacgagcgagatacagcttaccgactacggggccctgaccctcgactgctctccaagaaccggtctggacttcaacgagatggtcctgctcacgatgaaggaaaagtcctggctggtccataagcagtggttcctggacctaccgctgccttggacctccggggcgtccacctcgcaggagacctggaatcggcaggacctgctcgtaacattcaagaccgcccacgcaaagaagcaggaggtcgtggtcttaggctcccaagaaggcgccatgcacaccgccctgaccggggcgacggagatccagacgagcggaacgaccacaatcttcgccgggcacctcaaatgccgcctgaaaatggacaagctcactctcaagggtatgtcatacgtcatgtgcaccgggtccttcaagctggaaaaagaggtggcggagactcagcacggcacggtgctcgttcaagtcaagtacgagggtaccgatgccccgtgcaagatacccttttccacccaagacgagaagggtgttacccaaaacgggcgactgatcacggccaatccgatcgtcactgacaaagagaagcccgtgaacatcgagaccgagccgcccttcggagagtcgtacatagtggtcggcgctggtgaaaaggcactcaagttatcctggttcaagcgagggagttccatcggaaagatgttcgaggccaccgcgcgtggggccagaaggatggctatcctgggcgacacggcgtgggacttcggtagcataggcggcgtcttcacctccgtgggaaaactcgtccaccaggtgtttggcaccgcatacggggtgctgttcagtggcgtctcctggaccatgaagatcgggatcggcatcctactcacgtggctgggcttgaacagtcggtccacttctctctccatgacctgcatcgccgtgggaatggtgaccctgtacctgggagttatggtacaggccgactctgggtgcgtgatcaattggaaaggccgcgaactcaagtgtgggtcaggcatcttcgtgacgaatgaggtgcacacgtggactgagcagtacaagtttcaggccgactcccccaagcggctttcggcggcaatcggcaaggcctgggaggagggagtgtgcggtattcgctccgccacccggctggagaacataatgtggaagcagatcagcaacgaactcaaccacattctgctggagaacgacatgaagttgaccgtcgttgtaggggacgcaaacggcatccttgcgcagggcaagaaaatgatcagaccgcagcccatggagcacaagtattcctggaagtcctggggcaaagccaagatcatcggcgccgacatccagaacactaccttcatcattgacgggcccgataccccggaatgtcccgatggccagcgggcttggaacatctgggaggtcgaggactacgggttcggagtgtttaccacgaacatttggctgaagctccgcgactcctacacccaaatgtgcgaccaccgcctgatgagtgcggccatcaaggactccaaagccgtgcacgccgacatgggctactggatcgagagcgaaaagaatgagacatggaagctagccagagcgagcttcatcgaggtgaaaacctgcacgtggcccaaaagccataccctctggtccaatggggtgctggagagcgaaatgatcattcccaaaatctatgggggtccgatctcccaacataactatcggcccggttacttcacccaaaccgccgggccttggcacctcggcaagctcgaactggacttcgatctgtgcgaggggactacggtggtcgtcgacgagcactgtggcaaccgcggccctagcctcagaaccacaacggtaacggggaagatcatccacgagtggtgctgccgttcctgtactctacctcccctgcggttccgcggcgaagacgggtgttggtatggcatggaaatccggccagtcaaagagaaggaggaaaacctcgtgcgctccatggtgtcggccggctcgggggaggtagacagcttcagcctgggtatcctgtgcgtctctataatgatcgaggaggtaatgcggagtcgctggagccgcaagatgctgatgaccgggacgttagccgtcttcctgctcctgatcatgggccagctgacctggaacgacttaatccggctgtgcatcatggttggggcaaacgcgtccgaccgcatggggatgggcaccacctacctggccctcatggccacgttcaagatgcggccaatgttcgccgtggggcttctgttccggcggctaactagccgcgaggtcctgctgctcacaatcggcctgagcctggtggccagcgtggagctccccaatagcctggaggagctgggggacggccttgcgatgggcatcatgatgttaaagctcctcaccgagttccagccccaccagctgtggactaccctactcagcctgacctttgtgaagaccacgctgtctctggactacgcgtggaagaccaccgccatggtgttgagcatcgtctccctgttcccgctttgcctaagcaccacatcccagaagaccacgtggctcccggtgctcctggggagctttggatgcaagcccctgacaatgttcttgatcactgagaacaaaatctgggggcggaagtcctggcccttaaacgagggaatcatggccatcgggatcgtgtcaatcctgttatcaagcctgctgaagaacgacgtccccctggcaggaccgctgatcgcaggcggtatgctgatcgcctgctatgtgataagcggttcatcggcagacctcagtctggagaaggccgcggaggtgagctgggagcaggaggcagagcactccggggcaagccacaacatcctggtagaggtacaggacgacggcacgatgaagatcaaggacgaggaacgagatgatacacttacaatcctgctgaaggccaccctattagccgtgtcaggggtctacccgatgtcaatccccgcgacgttgttcgtgtggtacttctggcaaaagaaaaagcagcgatccggcgtgttatgggacaccccctccccacccgaagtcgagagagcagttctggacgacggaatctacagaatactacagcgcgggctcctaggccggtcccaggtgggggtaggcgtatttcaggacggagtctttcacacgatgtggcacgtcacgaggggagccgtcctgatgtaccagggcaagcgtctggaacccagctgggcctccgttaagaaggacctcatcagctacgggggcggttggcgcttccagggctcatggaacacgggggaggaggtccaggttatcgccgtggagcccggcaagaacccgaagaacgtccagaccacccccggcacgttcaaaacgcccgagggggaggtgggcgccatagccttagactttaaacccgggaccagcgggtccccaattgttaatcgtgagggcaagatcgttgggctttacggtaacggggtcgttactaccagcggcacgtacgtaagtgcgatcgcccaggccaaggcttcccaagaaggacccctcccggagatcgaggatgaggtattcaagaagcgcaacctgaccattatggatctgcacccgggctctggaaaaacccgtcgttacttaccggccattgtccgtgaggcgatcaagcggaagttacgcaccctgatcctagcacctactagagtcgtggcgtccgagatggccgaggccctcaaagggatgcccatacgctaccagacgaccgcggtcaaaagcgaacacaccggccgggagatcgtcgatctgatgtgtcacgccacattcaccatgcgcctcctgagcccggtgcgggtgcctaactataacatgatcatcatggacgaggcacactttaccgatccagccagcatagcagcaagagggtatatcagtacccgggtcggaatgggggaggccgcggccatatttatgacggccaccccgcctggcagcgtcgaggctttcccccaatccaacgccgtgatccaagacgaggagcgcgacatccccgagcgaagctggaactctggatacgactggataaccgacttccccggaaagaccgtctggttcgtgcccagcatcaagagtgggaacgacatcgcgaactgtctgcgaaagaacggtaagcgggtaatccagctcagccgcaagacgtttgataccgagtaccagaaaaccaagaataacgattgggactacgttgtgactaccgacatcagtgagatgggcgcaaactttcgagccgaccgcgtgatcgacccccgtcgttgcctcaagcccgtcatactgaaggacggtcccgaacgggtgatactcgccggcccgatgcccgtgaccgtggcgagcgcggctcagcgccggggcaggatcgggcgcaaccaaaacaaggaaggggaccagtacgtgtacatgggacagcctcttaataatgacgaggaccatgcccactggaccgaggcgaagatgctgctcgacaatatcaacacccccgagggcatcatcccggcgctgttcgaacccgagagggagaagagtgccgctatcgacggggaataccgcttacggggagaagctcgaaagacgttcgtcgagttgatgcggcggggcgacctgcccgtgtggctgtcatacaaagtggcctccgagggattccagtactcagaccggcgatggtgcttcgacggcgagcggaataaccaggtcctcgaggaaaacatggacgtggagatctggaccaaggagggggaacgcaagaaacttcgtccccgctggttggacgcacggacatactcggacccgctcgccctgcgcgagttcaaggagttcgccgccggccggcgcagcgttagcggcgatctgatcctcgagatcgggaaattgccccagcatctgacgctgcgggcccaaaatgctctggacaacttggtcatgctccacaacagcgagcaaggcgggaaagcataccgccacgccatggaggagttgcccgacacgattgaaacgttaatgttgcttgccctgattgcggtcttgaccggaggcgtgaccttgttcttcctgtcaggtaaaggactagggaaaaccagcatcggcttgctgtgcgtcactgcctcgtccgccctgctgtggatggcctcggtggaaccccactggatcgccgcatctatcatcctggagttcttcctcatggtgctgctgatcccagagcccgaccggcagagaacgccccaggacaaccagctagcatatgttgttatcggcttactgttcatgatactcaccgtggcagccaacgagatgggcctgctggagaccacgaagaaagacctcggcatcggctacgtcgctgccgagaaccaccagcacgcgaccatgctagacgtagaccttcatccggcctctgcctggaccctctatgcggtggcgaccacggtaattacccccatgatgaggcacacgatcgagaacactaccgccaacatcagtctgaccgccatagccaaccaggccgctatcctgatgggccttgacaagggctggcccatctcaaagatggacatcggcgtgcccttactagcgctcggatgctactcgcaggttaacccattgaccctgaccgcggcagtcctcatgcttgttgcgcattatgcaatcatcggacccgggttacaggcgaaagccacgcgggaggcccagaagcgcaccgcagccggcatcatgaaaaacccaacggtcgacgggatagtcgccattgatctcgaccccgtggtgtacgacgccaaattcgagaaacaactggggcagatcatgctgctcatcctgtgcacctcacaaattttgctcatgcgtacaacgtgggctctctgcgagtccatcaccttggcgaccggcccgctcactaccctgtgggaggggagccccggcaagttttggaacaccaccattgccgtctcaatggctaacatatttcggggtagctacttggccggagccggactcgcgttcagtctgatgaagagtctgggaggcgggcgacgagggactggcgcccagggcgagacattgggagaaaagtggaagcggcagctgaaccagttatcgaaaagtgagttcaacacatacaaacgcagcgggattatggaggtggaccggtccgaggccaaggagggcctcaaacgcggggagaccacgaagcatgccgttagccgaggtactgcgaagttacgctggttcgtcgagcggaacctagtgaagcccgagggcaaggtaattgacctgggttgcggccgcgggggttggtcctattactgtgcagggttaaagaaggtcacagaagtgaaaggctacactaaaggcgggcccggccacgaggagcctatccccatggccacctacggttggaacttggtgaaacttcacagcggcaaagatgtcttcttcatgccgcccgagaaatgcgacacgctcctgtgcgatatcggggagtccagccctaatcctaccatagaggagggtagaaccctgcgggttctcaagatggtagaaccctggctacgcggaaaccagttctgcataaagatactgaacccatacatgccctctgtcgtggagaccctcgagcagatgcagcgcaagcacggtggcatgctggtgaggaaccccctaagcaggaacagcacgcacgaaatgtattgggtcagttgcggaaccggaaacatcgtgtccgcagttaacatgacatccaggatgctcctcaataggttcaccatggctcatcgcaaacccacctacgagcgggacgttgatctgggcgcgggaacccgccacgtcgcggtggaacctgaagtcgccaacctcgacatcatcggccaacggatcgagaatatcaagaatgagcacaaatcaacctggcactatgatgaggataatccgtataagacatgggcctatcacgggagctacgaggtgaagccctccggcagcgcctccagcatggtaaacggtgtcgtgcgcttactgacgaagccctgggacgtcatccccatggtgacccagatagcgatgacggacacgacgccgttcggacagcagcgagtgttcaaggagaaagtcgacacccgcacgccccgggcaaagcgcggtaccacccaaatcatggaagtgaccgcgaagtggctctgggggtttctatcccggaacaagaagccccgcatctgcacccgggaggagtttaccagaaaagtgcggtcaaacgccgccattggggcggtcttcgttgacgaaaaccagtggaatagcgccaaggaggctgttgaggatgagcgcttctgggacttagtgcaccgggaacgagagctacacaaacaggggaagtgcgcgacatgcgtgtacaacatgatgggtaagagagagaagaaacttggggagttcggcaaagcgaagggctcccgcgccatttggtatatgtggctaggtgcacggttcctcgagttcgaggcacttggcttcatgaacgaggaccactggttcagccgagagaactccctgagcggggtcgagggagagggtctgcacaagctcggctatatattacgggacatctccaagatccctggcgggaacatgtacgccgacgacaccgcaggttgggacactcgcatcaccgaggacgacctccaaaacgaggccaagatcacggacatcatggaacccgagcacgcactgcttgccaccagcatctttaagctcacctaccagaacaaggtagtgcgagtgcagcggccagcaaagaatgggaccgtgatggatgtgatttcccgacgggaccaaagaggcagcggccaggtggggacgtacggcctgaacaccttcaccaatatggaggtccagctgatccggcagatggagagtgaggggatcttcctccctagcgaactggagaccccgaacctggctgagcgtgccctagactggttggagaaacacggcgcggaacggctgaagcgcatggcgatctccggggacgactgcgtagtgaagcccatcgacgaccggtttgccactgcgctcacggctctgaacgacatgggcaaggtgcgcaaggacatcccacagtgggagcccagcaagggctggaatgactggcagcaggtcccgttttgctcccaccatttccaccagctgatcatgaaagatgggcgggagattgttgtcccctgccgcaaccaggacgaactcgtggggcgagcccgcgtgagccagggtgccggctggtccctgcgcgagactgcctgcctcggaaagagctacgcgcaaatgtggcagctcatgtactttcaccgcagggacctccggctcgccgcgaacgccatctgctccgcggtccccgtagactgggtccccaccagccggaccacgtggtctatccacgcgcaccaccagtggatgacaactgaagatatgctctccgtctggaaccgcgtttggatcgaggagaacccgtggatggaggacaagacacatgtgtcctcctgggaagaggttccttacctgggtaagagggaggaccagtggtgcggttcactgatcggattaactgcccgcgcaacctgggccaccaatatccaggtggcaatcaaccaagtgcgtcggcttatcggcaacgagaactatctggattatatgacctccatgaaacgcttcaaaaacgagagcgacccggagggggccttatggtga

SEQ ID NO: 24037 - RNA, 9879 nt, synthetic construct
  misc_feature 1..9879: note = derived and/or modified CDS sequence (opt11) from DENV-1__FJ639735__SS-prME
  source 1..9879: mol_type = other RNA
agcgttaccatgctgctcatgctactgcccaccgctctcgccttccacttgacgactcggggtggggagccacacatgattgtgagcaagcaagagcgaggcaagagcctcctgttcaagactagtgcaggcgtgaacatgtgcacgttgatcgcaatggacttaggcgagctctgcgaggatacgatgacctacaaatgtccccgaatcaccgaagctgagccagatgacgtggactgctggtgcaacgccaccgacacgtgggtaacctacggaacctgctcacagactggagaacataggcgcgataagcggtccgtggccctggcgccccacgtgggcttaggtctagaaacgcgaaccgagacgtggatgagctccgagggcgcctggaagcagatccaacgggtcgagacctgggccctgcgacaccccggtttcaccgtcaccgccctgttcctcgctcacgccatcgggaccagcataacgcagaagggcatcatattcattcttctgatgctcgtgacgccctccatggccatgcggtgcgtcgggataggcaaccgcgacttcgtggaggggctaagtggtgccacgtgggtggacgtggtgctggagcacggctcctgcgtgaccaccatggccaagaacaagcccacgctcgatatcgagctcctgaagactgaagtaactaaccccgctgtcctccggaagctgtgcatcgaggccaagatcagcaacaccacgaccgattccaggtgtcccacccagggggaggccaccctagtggaggaacaggacgccaacttcgtctgcagacgcacgtttgtggaccgagggtgggggaacggatgtggcttattcggcaaggggagcctgttgacctgtgccaagttcaaatgtgtgaccaagctcgaaggaaagatcgtccagtatgagaacttaaagtacagtgtgatcgtaaccgtccacacgggagaccagcaccaggttgggaacgagaccactgagcacggcaccatcgcgacgattacaccccaggcccccaccagcgagatccagctgaccgactacggggccctaactttagattgctcgccccgaacaggtctggatttcaacgagatggtgctcctgaccatgaaggaaaagagttggctggtccacaaacagtggttcctcgacctgccgctgccctggacctccggggcgagcacctctcaggagacctggaaccggcaggacctactggtgaccttcaagaccgcccacgccaagaagcaggaggtagtggtgctgggctcacaggagggcgcgatgcacaccgctctcactggtgccacagagatccagactagcggtaccacgaccatcttcgccggccatctgaaatgcagactgaagatggacaagctgacgttgaaaggcacatcatacgtcatgtgcacgggtagtttcaagttagagaaggaagtagctgaaacgcagcacggtaccgttctggttcaggtgaagtatgagggtaccgacgccccctgtaaaatccccttttcgacgcaggacgaaaagggggtgacccaaaatggacggcttatcaccgccaacccgatagtgacggacaaggagaagcccgtgaacatcgaaacagagccgcccttcggggaaagctatatcgtggtcggtgcgggtgaaaaggctttgaaactctcctggtttaagaaggggagttccatcggcaagatgttcgaagccaccgcccgcggggctcggcgcatggctatactcggagataccgcgtgggacttcggatcaatcggcggcgtgttcactagtgtgggcaagctggtccaccaggttttcggcacggcctatggggtactgttttctggcgtatcctggactatgaagatcgggatcggaatcctcctgacgtggttgggccttaacagccgctccaccagcctatcaatgacgtgcatcgccgtcgggatggtcacactgtacttgggtgtaatggtgcaggctgacagcgggtgcgtgataaactggaagggccgggagctgaaatgtgggtccggcatcttcgtcaccaatgaggtgcacacttggactgaacaatataagttccaagccgacagccctaaacgccttagcgctgccattgggaaggcctgggaagagggcgtgtgcggcattcggtccgccacgcgcctcgagaacattatgtggaaacagattagcaacgaattaaatcacatcctgctcgagaatgacatgaaattcaccgtcgtggtgggggacgccaacggcatactggcgcaaggcaagaagatgatccgacctcagcccatggaacacaagtactcctggaagagctggggcaaggccaagataataggcgcagatatccaaaacacgacgtttattatcgacggccccgacacgccggagtgccccgatgaccaacgtgcttggaacatctgggaggtggaagactacgggttcggtatattcacaacaaacatctggctcaaactgcgggactcctacacccagatgtgcgaccaccgcctgatgtccgcggccatcaaggacagcaaagccgtccatgcagacatgggctactggatcgagagcgagaagaacgagacgtggaagctggccagggcgtccttcatagaggtgaagacctgcacctggccgaagtctcataccctatggtctaacggagtccttgaaagcgagatgataatccccaagatctacggcgggcctatctcgcagcacaactatcgacccgggtacttcacgcagacagcaggcccctggcacctggggaagctcgagctggatttcaacctctgtgagggcaccaccgttgtggtagatgagcactgcggcaacagaggaccgagcctccgtactaccaccgtaacaggcaaaatcatccacgagtggtgctgccggtcctgcacactgcctcctctgcgctttagaggtgaggacggatgctggtacggaatggagatacgccctgtaaaggagaaggaggagaacctcgtcagaagcatggtttctgccggaagcggcgaggtcgactcgttctccctgggcattctatgcgtcagcatcatgatagaagaagtgatgcgttcccggtggagccgcaagatgctaatgactggcacgctcgccgtattcctgctcttgatcatggggcaattgacgtggaatgacctcatccgactgtgcatcatggtcggtgcgaatgcgagcgaccggatggggatgggcacgacttacctggccctgatggccacctttaagatgcgcccgatgtttgccgttggcctgctgttccggcgcctcaccagcagggaagtgctactgctcacgatcgggctatccttagtcgcctccgtggagttgcccaactcactagaggagttgggcgacgggctcgcgatgggaataatgatgctgaagctgctcacggagtttcagccccaccagctgtggaccacactgctcagcctgactttcatcaagacaaccttgtcactcgactacgcctggaagacaacggcgatggcgctgagcatcgtctccctgttccccctctgcctgtctaccacctctcaaaagaccacctggctgccggtgctcctgggcagcttcggttgcaagcccctgaccatgttcctcatcaccgagaataagatctggggtcgtaagtcctggcccctgaacgaagggatcatggccattgggatcgtctctatcctgctttctagcctgttaaaaaatgacgtgcccctggccgggccactgatcgccgggggcatgcttatagcctgctacgttatcagcgggagttctgccgacctttccctcgagaaggcggccgaagttagctgggagcaggaggccgagcactccggcaccagtcacaatatactggtagaggttcaagatgacgggactatgaagatcaaggacgaggagaaggatgacacactcaccatactgctgaaggcgaccctgttggcagtgtcgggtgtctacccgatgagcattcccgcgaccctgttcgtgtggtacttctggcagaagaagaagcagaggtccggcgtgctctgggacacgcctagcccacccgaggtcgaacgcgccgtgctggacgacggcatctacagaatcttacagcgcggtctcttagggcggtctcaagtaggtgtcggagtgttccaggacggcgtatttcacaccatgtggcacgtaacccggggggccgttctgatgtatcagggcaagcggctcgagccatcgtgggcatccgttaagaaagatctcatcagctacggcggggggtggcgcttccaggggagttggaacaccggcgaagaagttcaggtgatcgccgttgagcccgggaagaacccaaaaaacgtccagacgacccctggcacattcaaaacccccgagggcgaggtgggggccatcgccctcgacttcaagccgggcacaagtgggtctcccatcgtgaaccgggagggaaagatcgtcggcctgtatgggaatggcgttgtgaccaccagcgggacctacgtcagcgccatcgcccaggcgaaggcgagccaggagggtcccctccctgagatcgaagacgaggtgtttaagaaacgcaatctgaccatcatggacctgcatccggggtcgggcaagacccgacggtacctccccgccatcgtaagggaggcgataaaacgcaagttaagaactctgatcttggctcccacacgcgtcgtcgcgtccgagatggccgaggccctgaaaggcatgccaatccgataccaaactacagccgtcaagagcgagcacactgggagagagatcgtagacctaatgtgccacgccacttttaccatgcgcctcctatcccctgtgcgggtgcccaactacaacatgatcgttatggacgaggcgcactttacggaccccgcctctatcgcagcccgcggctacatctcgacacgagtagggatgggcgaggccgcggcaatcttcatgaccgccaccccccccgggtccgtagaggcgtttccccagtccaacgccgtcatccaggatgaggagcgcgacatacccgaacggagctggaactccggctatgactggatcaccgatttcccagggaaaaccgtttggttcgtgccgagcataaagtccgggaacgacatcgcgaattgcctgcgtaagaacggcaagcgggtcatccagctctcgcgcaagacctttgacactgagtaccagaagacaaaaaacaacgactgggattacgtcgtgaccactgacatttctgagatgggggccaattttcgggcagaccgcgttatcgacccccgccgttgccttaagcctgtcattctgaaagacgggcctgagagggtgatcctcgcggggccgatgccagtaacggtggcgagcgctgcccaacgccggggccgcattggccgaaatcaaaataaagagggtgaccagtacgtatacatgggccagccactaaacaacgatgaagaccatgctcattggacagaggccaagatgctgctcgacaatatcaatacccccgaggggatcattcccgctctgttcgaacccgagcgcgagaagtcagctgccatcgacggcgagtatcgcctcaggggtgaggcccgcaaaacgttcgtagagctaatgcggaggggggatctgcccgtctggcttagctacaaggtcgcctccgagggcttccagtatagcgaccgccgctggtgttttgatggcgaacggaacaatcaagtgctcgaggagaacatggacgtagagatctggacgaaggagggcgagcgcaagaagctccggccccgttggctagacgccagaacgtactccgacccgctcgccctgcgcgagttcaaggagttcgccgccgggcggcgcagcgtcagcggggatctgatcctggagatcgggaagctgccccagcacctgaccctccgggcacagaacgcgttagacaacctggtgatgctccacaactctgaacagggtggaaaagcataccgccacgccatggaggagctgccagacaccatcgagacactcatgctattggccctgatcgcggtgctcactgggggtgtcacgctgttcttcttaagtgggaagggtctcgggaagacctccatcgggctcctttgtgtgaccgcaagctccgccctcctatggatggcaagcgtagagccccattggattgctgcgtcgatcatactggagttcttcctgatggtcctgctgattcccgagcctgatcggcaacgcacgccacaggacaaccagctcgcgtacgtggtgatcggcctgctcttcatgatactcaccgttgccgccaacgagatggggctactggagacgaccaagcgggacctcgggatagggcacgtggctgcggagaaccaccagcacgccactatgctagacgtggacctacgccctgccagcgcctggacactctacgcggtagctacaaccgtgatcacccccatgatgagacacaccattgaaaacaccaccgccaacatctccctaacggccattgccaaccaggcggctatactgatgggcctggacaagggctggcctatcagcaagatggacataggggtaccactgctagctctcggctgttactcccaggtcaacccgcttactctgactgctgcggtgctaatgctggtagcgcactatgccatcattgggcctggactgcaggcaaaagccacccgcgaagcccagaaacgcacggctgccgggatcatgaagaaccctaccgtagacgggatcgtggcaattgacctcgatcccgtggtctatgatgctaaattcgagaagcagttaggacagatcatgctgctcatcctatgcacttcgcagatcttactaatgcggaccacgtgggccctgtgcgagtccataaccctagcgacgggcccgctcaccacgctgtgggaggggagcccaggtaagttctggaacaccaccatagcggtgtccatggccaacatcttccgcggcagctacctggcgggcgccgggctggctttctccttgatgaagagtctgggggggggccggcgcggaacgggcgcacagggagagactctcggagagaagtggaagcggcagctgaaccagctctccaagagcgagttcaacacctacaaaagatctggaatcatggaagttgaccgatccgaagccaaggaggggctcaagcgcggtgagacaactaagcatgcagtcagccggggcacagccaaactgagatggttcgtagaacggaacctcgtgaagcccgaaggcaaggtcatcgaccttggctgcgggcgcggcggttggtcctattactgcgccggcctcaagaaggtgactgaagtcaaggggtataccaagggcggaccgggacacgaggagccgatcccgatggccacctacggttggaacctggtcaagctgcacagcggtaaggatgtgttcttcatgccgcctgagaagtgtgacacccttctgtgcgacatcggcgagtcaagcccgaacccgacaatcgaagaggggcggacactacgcgttctcaaaatggtggagccctggctacggggtaaccagttctgcataaagatcctgaacccctacatgccgtccgtagtggaaaccctcgagcagatgcagcgcaagcatgggggaatgctcgtgcggaaccccttgagccgcaactccacccacgaaatgtattgggttagctgcggcacgggaaatattgtgagcgcagtcaatatgactagccgcatgctgttgaacagatttacgatggcgcaccgcaagcccacttacgagcgggacgtagacctgggcgcgggtacgcgacacgtggccgttgagccggaggtggccaacctagatattatcgggcagcggattgagaacatcaagaatgagcacaagagtacttggcactatgacgaggacaatccgtacaagacgtgggcttaccacggctcatatgaggtgaagccctcagggtcagcatccagcatggtgaacggcgtggtccgcctgctgacaaagccctgggacgttattccgatggtaacgcagattgcgatgaccgatacaacccccttcggacagcaacgtgttttcaaagaaaaggttgacacccgcacgcctcgcgccaagcggggaacaactcagatcatggaggtgactgcaaaatggctatggggattcctgtcccgaaacaaaaagcctagaatctgcaccagggaggagttcactcgcaaggttcggtcgaatgccgcgatcggggccgtgttcgtcgacgagaaccagtggaacagcgcaaaggaggccgtcgaggacgagcgcttctgggatcttgtccaccgggaacgcgagctccacaagcagggcaagtgtgcgacctgcgtgtataacatgatgggcaagcgggagaagaagttaggcgagttcggtaaggcgaagggctctcgcgcaatctggtacatgtggctcggcgcccggttcctcgagttcgaagccctggggttcatgaacgaggatcactggttcagccgcgaaaactccctgagcggcgtcgagggggagggcctacacaagcttgggtacatcctgcgcgacatatcgaagatcccgggaggcaatatgtatgccgacgacacggcgggatgggacacacgcatcactgaggacgatttgcagaacgaagcgaagatcaccgacatcatggagcccgagcacgcgttgctggccacctctatctttaaactcacttatcaaaataaagtggtacgcgtccagcggccagcgaagaacggcaccgtgatggacgtgatctcccgcagagaccaacgcggctcgggccaagttggtacgtatggactgaatacatttaccaacatggaagtgcagctaatccggcagatggaaagtgaaggcattttcctaccctcagaactggagaccccgaacctggcggaacgcgtgctcgactggctggagaaacacggggccgagcggctgaagcgcatggccatcagcggcgacgattgcgtcgttaaacccatcgacgaccgttttgccacggccttgaccgccctgaacgacatggggaaggtgcgaaaggacataccccaatgggaaccgtcgaagggatggaacgactggcagcaagtgcccttctgctcccaccacttccaccagcttatcatgaaggacgggcgagagatcgtggtgccgtgtcgcaaccaggatgagttggtcgggcgggcccgcgtgagccagggcgcggggtggtcactgcgggagacggcctgcttaggcaaatcgtacgcccaaatgtggcaactcatgtatttccaccgacgggaccttcgccttgctgctaacgccatttgctcagccgtccccgtcgactgggtacccacctcgcggaccacctggagcatccacgcgcaccaccagtggatgacgaccgaggacatgctctctgtatggaatcgcgtctggattgaggagaacccatggatggaagacaagacacatgtgtcatcctgggaggaagtgccgtatctgggtaagcgcgaggaccagtggtgcggaagtctcatcggtctcactgcccgggccacctgggccaccaacatccaggtagccatcaatcaggtaaggagactgatcgggaacgaaaactacctggattacatgacctcgatgaagcgcttcaagaacgagagcgaccccgaaggagctctctggtga

SEQ ID NO: 24038 - RNA, 9879 nt, synthetic construct
  misc_feature 1..9879: note = derived and/or modified CDS sequence (opt11) from DENV-1__FJ639740__SS-prME
  source 1..9879: mol_type = other RNA
tccgtgaccatgttgttgatgctgctgccaaccgcgcttgccttccacctaaccacccgaggcggggaaccgcacatgatcgtgtccaagcaggagcgggggaagagcctcctgttcaagacctccgcgggggtcaacatgtgcaccctgatcgcaatggacttgggcgagctttgcgaggacaccatgacctacaagtgcccccgcatcaccgaggctgagcccgacgacgttgactgctggtgcaacgccaccgacacttgggttacatacgggacctgcagccaaacaggagagcaccggcgtgacaagcgctccgtggccctggcgcctcacgtgggccttgggctagaaacgcgaaccgagacctggatgagctccgagggtgcctggaaacagattcagcgggttgagacctgggcgctgcgccaccccgggttcaccgtgatcgccctgttcttggcgcacgccatcggcaccagcatcacccagaaaggtatcatctttattctgctgatgctcgtgaccccctcgatggctatgcggtgcgtcggaatcggcaaccgagatttcgtagaagggttgagcggcgcaacgtgggtcgacgttgtcctggagcacggatcctgcgtgacgaccatggccaagaacaagccaactctcgacatagaactgctgaagactgaggttacaaaccccgcagtgctacggaagctgtgtatcgaggccaagatctcaaacactaccaccgactcgagatgcccgacgcaaggcgaggccacgctagtggaggagcaggacgccaacttcgtctgcagacgcaccctcgtggaccggggctggggcaacggctgcgggctattcggaaaggggtcactgctaacgtgcgccaaattcaagtgcgtcaccaagctcgagggcaagatcgttcagtacgagaacttgaagtactccgtgatcgtgacggtccacaccggcgatcagcaccaggtggggaatgaaacaaccgagcacggaaccatcgcgaccatcacgccccaagcgcctacgagcgagattcaactcactgactacggcgctctgactctggactgcagcccccgcaccggcctcgacttcaacgagatggtcttactgacaatgaaggagaaatcctggctcgtccacaagcagtggttcctggacctgccgctcccctggacctccggggccagcacgagccaggagacgtggaaccggcaggatcttttagtaacgtttaaaaccgcacacgccaagaagcaggaggtcgtggtgctcggttctcaggagggcgcgatgcacaccgccctaactggagccacggagatccagacctccggcactaccacgatctttgccgggcacttaaagtgccgcttaaagatggacaagctgaccctgaaggggatgtcatatgtcatgtgcacagggagcttcaagctggagaaggaggttgcggagacccagcatggtacggtcttagtccaagtgaaatacgagggcaccgacgccccgtgcaaaatccccttcgccacccaggatgaaaagggggtgactcaaaatggcaggctgataacagctaatccgatcgtgaccgacaaggagaagcccgtgaacatcgaaaccgaaccgcccttcggggagtcctatatcgtggtaggcgcgggcgagaaggccctgaagttaagctggttcaaaaaggggtccagtatcggcaagatgtttgaagccaccgcccgaggggccaggagaatggcgatcctgggggatacggcgtgggacttcgggtccatcggcggggtgttcaccagtgtggggaaactcgtccaccaggtgtttggaaccgcttatggggtcttgttcagcggcgtctcatggaccatgaagatcggtatcggcatcttgctgacgtggctgggcctgaactcgcgatcaacctcgctgagcatgacttgcatagccgtggggatggtgaccctctacctgggggtcatggtccaagccgacagcggctgcgtgatcaactggaagggacgggagctgaagtgcgggagcggcatcttcgtcacgaacgaggtacacacctggaccgagcagtacaaattccaggcggactccccaaaacgcttgagcgccgcgattggtaaggcctgggaagagggggtctgcggaatccgaagtgccacccgcctggagaacatcatgtggaagcagatcagtaacgagctgaaccacatcctcctggaaaacgacatgaagttcaccgtcgtggtgggggacgcgaacggcattctggcccagggtaaaaagatgattcggccccagcctatggagcataagtacagctggaagtcatggggaaaggctaagatcatcggcgccgacatccagaatacgaccttcatcatagacggtccggacaccccggagtgtccagacgggcagcgggcgtggaacatatgggaagtagaagactatgggttcggcatattcacaacaaacatatggttaaagctgcgggacagttacacccagatgtgcgaccaccgcttaatgagtgccgctatcaaggattctaaggccgtccacgccgacatgggatactggatcgagagtgaaaagaacgagacctggaaactcgcgcgcgctagctttattgaggtgaagacttgcacgtggcccaaatctcacaccctgtggagcaatggagtcctggagtccgagatgatcatccccaagatctacggcggtccgattagccagcacaactaccggcccggctacttcacacaaaccgccgggccctggcacctcggcaagctcgagctggactttgatctctgcgagggcacgacagtggtggtcgacgagcactgcgggaatcgtggtccgagtctccgcactaccacggtgacagggaagatcatccatgagtggtgctgccggagctgcactctgcctccgctgcgattccgtggcgaagacgggtgctggtacggaatggagatacgcccagtaaaggagaaggaggaaaacctggtccgatcgatggtaagcgcagggtccggggaggtggacagcttcagcctgggcatcctctgcgtctccatcatgatcgaggaggtaatgcgctcgcggtggtcccgcaagatgctgatgaccgggactctggcggtgttcctactgttaatcatgggccagcttacatggaatgacctgatacgcctgtgcatcatggtcggggcgaacgccagcgaccgcatgggcatgggcaccacctacctcgccctgatggccacgttcaagatgcgcccaatgttcgctgtgggactcctgttccggcgactgacctcccgggaggttctgctcttaaccatcggcctgagcttagtcgcgtccgtggaactgccgaacagcctggaagagcttggggacggcttagctatggggataatgatgctgaagctcttgaccgagtttcaaccccaccaactgtggacgaccctcctgtccctgaccttcgtcaagaccacgctctccctggactacgcctggaaaaccaccgccatggtgttgtccatcgtcagcctctttcccctgtgcttgtcaaccacgagccagaagaccacctggctcccggtcttgctggggtccttcggctgtaagccgctcaccatgttcctgatcacggaaaacaagatttggggacgcaagagctggcctctaaacgagggcatcatggcgatcggaattgtttccatcctcttgtcatccctgctcaagaacgatgtgcctctggccggcccgctgatcgccggcggaatgctcatcgcctgctatgtaatcagcggcagctccgccgatctgagcctggagaaagcggccgaggtgtcgtgggagcaagaagccgagcactccggagcctcccacaacattctcgtggaggtccaggacgacgggacgatgaagattaaggatgaagagcgggacgacacactgaccatcctgctcaaggcgaccctgttagcggtgagtggggtgtaccccatgtccatcccagccaccttgttcgtctggtacttctggcaaaagaagaagcagcgcagcggcgtgctgtgggacacaccctccccgcccgaggtagagcgggccgtcttggacgacggtatctaccggatcctgcagcgcggactcttagggagaagccaagtaggggtgggcgtcttccaagacggtgtcttccacactatgtggcacgttacccgaggagccgtgctgatgtaccagggcaagcgtctcgaacccagctgggcaagcgtgaagaaggacctgatctcctacgggggggggtggcgcttccaaggcagctggaatacgggggaagaggtgcaggtcatcgctgtggaacccggcaagaacccgaaaaacgtgcagacaacccccggcactttcaaaacgcccgagggcgaagtcggggccatcgccctggacttcaagcccgggacgtccggcagcccaatcgtgaacagggagggaaagatcgtcggtctctacggcaacggggttgttacaacctctggcacctacgtgagcgccatcgcccaggcgaaggcgagccaggagggccccctgcccgagatagaggatgaggtcttcaagaagagaaacctgaccataatggacctccatccaggaagcggaaagacgcgcagatacctaccggctatcgtgcgcgaggccatcaagagaaaactgcgcaccctcatcctcgcgccgacgcgtgttgttgccagcgagatggccgaggcactgaaggggatgcccatccggtaccaaaccacggccgtgaagtcagagcacacaggccgcgagatcgtggacttaatgtgccacgcaaccttcacaatgcgcttactgagcccggtccgcgtgccaaattacaacatgatcatcatggacgaggcccacttcacggatccggcctccatcgcagctcggggctacatcagcacgcgcgtgggcatgggggaggctgctgccatattcatgacggccactccgccgggcagcgtcgaggcgttcccccagagcaacgcggtgatacaggacgaggagagagacatccccgagcgctcttggaacagcggctacgactggatcaccgatttccccgggaagacagtgtggtttgtccccagtatcaagtccgggaacgacatcgccaactgcctccggaagaacgggaagagagtgatccagctttccaggaagacgttcgataccgagtaccaaaagaccaagaacaacgactgggactacgtggtaaccaccgacatcagcgagatgggcgccaacttccgcgcagatcgggtaatcgacccccgccggtgcctgaaacccgtgattctcaaggatgggccggagcgcgtgatcctagctggccccatgcccgtcactgtagcgtccgccgcccagcggcgcggacgaattggccgcaaccaaaacaaggagggcgaccagtacgtgtacatgggccaacccctgaacaatgacgaagaccatgcgcattggaccgaggcgaaaatgctcctggacaacataaacactcccgagggcatcatcccggcactattcgagcccgagcgagaaaagtccgccgccatcgacggcgagtaccgactccgcggcgaggcccggaaaacattcgtggaactgatgcgccggggcgacctgcccgtctggctctcctacaaagtggcgagcgaggggttccagtactcagatcgccggtggtgtttcgacggcgagcgcaataatcaggtgctcgaggagaacatggatgtcgaaatatggacaaaggagggcgagcgcaagaagctgcgcccccggtggctcgacgcgaggacctactctgacccactggcacttcgtgagttcaaggaattcgccgccggccgccgttcagtgagcggggacctgatcctggagattggcaagttgccccagcaccttaccctgcgcgcgcagaatgccctggataacctcgtgatgttacataacagcgagcagggcgggaaagcgtaccggcacgccatggaagagctgccggacaccattgagacactcatgttgctcgcgctcatcgctgtcctgaccggaggggtcaccctattttttctctccggcaagggactgggcaagaccagcatcggtctactatgcgtgactgcatccagcgctctcctgtggatggcctcggtagagccccactggatcgccgcctctatcatattggaattcttcctgatggtgctgttaataccggaacccgaccgccagcggacaccccaggacaaccagctggcctacgtggtcatagggttactgtttatgattttgaccgtcgccgccaacgagatgggactgctcgagacgacgaaaaaggacctcggaatcggctacgtggcggccgaaaaccatcagcacgctaccatgctggatgttgatctccgccctgcctccgcctggaccctatacgcggtggccactacggtcatcacccccatgatgcgacacacgattgagaacacaactgccaacattagcctgaccgcgattgccaaccaggcggcgatcctcatgggcttagacaaggggtggcccatatcaaaaatggacattggcgtacccttgttagccctgggttgctactcccaggtgaacccgctgaccctcaccgcagcggtactgatgctggtcgctcactacgccatcattggtccgggtcttcaagcgaaggccacacgcgaggcgcagaaacgcacagccgcgggcatcatgaaaaaccccacggttgacgggatagtggccatagatttagaccccgtcgtgtacgacgccaagttcgagaagcagctggggcagataatgctcctgatcctgtgcacctcccagattctcctgatgagaacgacctgggcgttgtgtgagtcaataacccttgccaccgggccgctgacgacactgtgggagggcagccccggcaagttctggaacacgaccatcgcggtaagcatggccaacatctttcgcggcagttacctcgccggggcgggactcgccttcagcctgatgaagtccctcggggggggtcgtcgcggtacgggcgcccaaggcgagaccctgggagaaaagtggaaacggcagctgaatcaactctctaagtccgagttcaacacctacaaacggtcggggataatggaggtggaccggagcgaggccaaagaggggctgaagcgcggagagacgacgaagcatgcggtatcccgggggaccgctaagcttcgctggttcgtggagagaaacttggtcaagcctgaaggcaaggtgatcgacctcggctgtggccgcggggggtggtcatactactgtgccgggctaaagaaggtgaccgaagttaagggctacaccaaaggtgggccaggccacgaggagcccattcccatggccacctatggatggaacctggtaaagctccacagtggtaaagacgtgttcttcatgccgcccgagaaatgcgatacgctgttatgcgatatcggggagtcctccccgaaccccaccatcgaggaggggcggaccctcagggtcttgaaaatggtggagccgtggctccggggcaatcagttttgcattaagatcctcaatccatacatgccgagcgttgtagagactctggaacagatgcagcggaagcacggcggcatgctggtgagaaatcccctctcccgcaatagcacgcacgagatgtattgggtgtcatgtgggaccggcaatatcgtcagcgctgtgaacatgacctcccggatgcttctgaacaggttcacaatggcgcaccgcaaacccacgtacgagcgggatgtggacttaggcgccgggacgcgccatgtggctgtggagcccgaggaggccaacctggacattatcggccaacgaatcgagaatatcaagaacgagcacaagtccacctggcattacgacgaagacaacccctacaagacatgggcctaccacggatcctacgaggtgaagccctcaggctcagcatcttccatggtcaacggggtcgtccgcctgctcacaaagccctgggacgtaattcccatggtgacacagatcgccatgaccgacaccacgccgtttggccagcagcgggtcttcaaggagaaggtggacacccgtacgccccgggcgaaacggggcactacacagatcatggaggtaaccgccaagtggctgtggggtttcctgagccggaacaaaaagccccgcatctgcacccgggaggagttcacccgcaaggtccggtccaacgcagcaattggcgccgtgttcgttgacgagaaccaatggaattcagctaaggaagccgtcgaggacgagagattctgggaccttgtgcaccgggagcgcgagttacacaagcagggaaagtgcgcgacgtgtgtctataacatgatgggcaaacgggagaaaaagctgggggagttcggaaaggccaaaggatcacgcgcgatctggtacatgtggctcggagcccggttcctggagtttgaggcactcgggtttatgaacgaggaccactggttttcccgcgagaacagcttatcgggggtcgaaggcgagggcctccacaaactgggctatatccttcgggacatctcaaagatcccaggcgggaacatgtacgccgacgacaccgccggatgggatacacgcattactgaggacgatctgcagaatgaggctaagatcacggacatcatggaacccgagcacgccctgctcgcgacctccatcttcaagctcacctaccaaaacaaggtggtgcgggtccaaagacccgcgaagaatggcaccgtcatggacgtgatctcgcgcagggaccagcgcggcagcggccaagtgggcacgtacggcctgaacactttcacgaacatggaggtacagttgatccgccagatggagagcgaggggatcttcctgccatcggagctggagacccctaacttggctgagcgcgtactggactggctggagaaacacggcgcggagcggctcaagcgcatggccatatcaggggacgactgcgttgtgaagcccatcgacgaccggttcgccaccgcgctgactgccctgaacgacatgggcaaggtgcgcaaggacatcccccagtgggagccgagcaagggctggaacgactggcagcaggtcccgttctgcagccaccatttccaccagctcatcatgaaggacgggcgggagatcgtggtgccatgccgcaaccaggacgagttagtcgggcgggcccgagtgtcccagggggccggatggagcctgcgggagaccgcatgcctagggaagtcttatgcgcagatgtggcagctaatgtatttccaccgccgggatctgcggctcgccgccaacgccatctgtagcgcggtgcccgtcgactgggtcccaacgtcccggaccacgtggtccatccacgcgcaccaccagtggatgacaaccgaagatatgctgagtgtgtggaatcgcgtctggatcgaggaaaacccgtggatggaagataaaacacacgtctccagctgggaggaggtgccataccttggtaagcgcgaggaccaatggtgcggctccctcatcgggctgacagccagagccacgtgggccaccaacatccaagtcgcgatcaaccaggtgcgccggctaatcgggaacgagaactacctcgattacatgaccagcatgaaacgcttcaagaatgaatccgatcccgagggggcactgtggtga

SEQ ID NO: 24039 - RNA, 9879 nt, synthetic construct
  misc_feature 1..9879: note = derived and/or modified CDS sequence (opt11) from DENV-1__FJ639741__SS-prME
  source 1..9879: mol_type = other RNA
agcgtgaccatccttctcatgctgctgccaaccgcccttgcctttcacctgaccacacgcgggggagaaccccacatgatcgttagcaaacaggagaggggaaagagcctactgtttaagaccagcgccggggtgaacatgtgtaccctgatagccatggacctaggcgaactttgcgaggacactatgacctacaagtgcccccgcatcaccgaggccgagcccgatgacgtcgactgctggtgcaacgccaccgacacatgggtcacctacgggacctgcagccagaccggggagcaccggagggacaagcggagtgtggccttggcgccccacgtgggattaggcctcgagacgcgcaccgagacttggatgtcctcggagggcgcctggaagcaaatccagcgtgttgagacgtgggctctgcgccaccccgggttcacagtgatcgccctctttctcgcacacgccatcggcaccagcatcacacagaaggggatcatcttcattctgctgatgctcgtgaccccgtctatggccatgcggtgcgtcggcatcggcaaccgcgacttcgtggaggggttaagcggcgccacgtgggtggacgtcgtcctggagcacgggtcctgcgtcaccaccatggccaagaataagcccaccttggacatcgagctgctgaagacggaggtcactaaccccgcggtcctccgcaagctgtgcatagaggccaagatcagcaacaccaccacggacagccgctgccctacgcagggcgaggccaccctggtggaggaacaggacgcaaactttgtctgccggcggacgttcgttgatcggggctgggggaacggctgcggcctcttcggcaaggggtctttgttgacgtgcgccaagttcaagtgcgtgaccaagctcgaaggaaaaattgtccagtacgagaatctgaagtactcagtgatcgtgacggtccataccggagaccagcaccaagtggggaacgagacgaccgagcacggcaccatcgcgaccatcactccccaggcccccaccagcgaaatacaactgaccgactatggggccttaaccctggactgtagcccaaggaccggcctagattttaacgagatggtcctcctgacgatgaaggagaagtcctggctagtgcacaagcagtggttcctcgacctacctctcccctggacgtccgggaccagcacctcccaggagacgtggaaccggcaggatctcctggtgacattcaagacggcgcacgccaagaagcaggaagtggtggtgttaggctcccaggagggcgcgatgcataccgcgcttactggggcaaccgagatacagactagcggcaccacgaccatctttgccgggcacctgaagtgccgcctgaagatggataaactgactctgaagggcacctcctatgtaatgtgcacggggagcttcaagctggagaaagaggtggccgagacccagcacggcacggtgttagtgcaggtcaagtacgagggcaccgacgcgccctgcaagatccccttctccacacaggacgagaagggggtgacccagaacgggagattgatcaccgctaacccgatcgtaaccgacaaggagaagcctgtgaacatcgagacggagcctcccttcggggaaagttacatcgtggtcggcgccggtgagaaggcactgaaactgtcctggttcaagaagggtagctcaatcggcaagatgtttgaggcaaccgcccgcggtgctcggcgcatggccatcttaggggacactgcttgggacttcgggtccatcggcggcgtgttcaccagtgtggggaagttggtccaccaggtgttcggtacggcgtacggcgtgcttttcagcggcgtctcatggacaatgaagataggcatcggcatccttctgacctggctgggcctaaacagtcgctccacgagcctgtccatgacctgtatcgccgtggggatggttaccctttacctcggcgtaatggtgcaggcagatagtggttgcgttattaactggaagggccgggagctgaagtgcgggtccggcatctttgtcacgaacgaggtgcacacctggacagagcaatacaagttccaagccgacagccctaaacgactgtccgccgcaatcggcaaagcctgggaggagggggtgtgcgggatccggtccgcgacgcgcctcgaaaacatcatgtggaaacagatcagcaacgagctgaaccacatactgctagaaaacgacatgaagttcaccgtcgtggttggtgacgctaacggcatcttggcccagggaaagaagatgatccgtccacagcccatggagcacaaatactcttggaagtcctggggtaaggcgaagatcattggcgccgacattcaaaacacgaccttcatcattgatggacccgacacaccggagtgccccgatgaccagcgggcctggaacatctgggaagtcgaggactacggcttcgggattttcaccaccaacatatggctgaagctccgggactcctacacccagatgtgcgaccaccgcctgatgtctgctgcaatcaaggactcgaaagccgtgcacgccgacatgggatactggatcgaatctgaaaagaacgagacgtggaaactggccaaggcctccttcatcgaggtgaagacatgcatctggcccaagtctcacaccttgtggtctaatggcgtcctggagagcgagatgattatcccaaagatctacgggggccccatctcccagcacaactatcggccagggtattttacccagacggccggcccctggcacctggggaagctagagctcgatttcgacttatgcgaaggcactaccgtggtggttgatgagcactgcggcaaccgagggccgagcctcagaaccacgaccgttaccggcaagatcatacacgagtggtgctgccgctcctgcaccttgccgcccctgaggtttcgcggggaggacggatgctggtatgggatggagatccggcccgtcaaggaaaaggaggaaaatctcgtccgcagcatggtctccgctggcagcggagaggtcgactcgttctcattagggatcctttgcgtcagcatcatgatcgaggaggtgatgcggtcccgctggagccggaagatgctcatgacggggaccctagcagtgtttctgctcctgataatggggcagctgacgtggaacgacctcatccgcctctgcattatggtcggcgcgaacgcctccgacaggatgggaatgggcaccacgtatctggcgctcatggccaccttcaagatgcggccgatgttcgccgtgggcttgctgttccgccggctcaccagccgtgaggtgctattattgacaataggactgagcttggtcgccagcgtggagctcccgaactccctggaggaactgggcgacggactcgccatgggcatcatgatgctgaagctgctcaccgagttccagccccaccaactatggaccaccctgctaagcctgaccttcatcaagacaaccctgtccctcgactatgcgtggaaaactaccgccatggtcctgagcattgtgtccctgttcccgttgtgcctgagcacgacctcccagaaaaccacctggctgccggtgctcctgggcagcttcgggtgcaagcctctgactatgttcctgatcacggagaataagatctggggccggaagtcctggcccctgaacgaagggatcatggccatcggaatcgtcagcatcctgctcagcagcctgttaaagaatgacgtgcccctcgccgggccgctgatcgcgggcggaatgctcattgcctgttacgtgattagcggatctagcgccgatctgtccctcgaaaaggcggccgaggttagctgggagcaagaggcggagcactccggcacctcacacaacatcttggttgaagtccaagacgacgggaccatgaagataaaggacgaagaacgagacgacacattaaccatcctgcttaaggccaccctcctggccgtgtccggtgtgtacccaatgagcattcccgcaactcttttcgtgtggtacttctggcagaagaagaagcagcgttctggcgtcctgtgggataccccctctccgcccgaggtggaacgcgccgtgctggatgatggcatctaccgcatcctgcagcgcggactactagggcggagtcaggtcggcgtgggagtgttccaggacggcgtgttccacacgatgtggcacgtgacccgtggggcggtgctgatgtaccagggcaagcggttggagcccagctgggcttcagtcaagaaggacctcatcagctacggcgggggctggcgtttccaggggtcctggaacaccggggaggaggtccaggtgatcgccgttgagcccggcaagaacccgaagaacgtgcagactacacccggcactttcaagacccccgaaggcgaggtaggcgcaatcgccctggacttcaagcccggcaccagcgggtccccgatcgtcaaccgggagggcaagatcgttggcctgtacgggaatggtgtggtcacgacatcgggaacctacgtgagtgcaatcgcccaggccaaggccagccaggaaggacccctcccagagatcgaagacgaagtatttaagaagagaaacctgactatcatggacctgcacccggggagtggcaagacgcgacgctacctcccagccatcgtccgcgaagcgattaagaggaagctgcggaccctgattctcgccccaactcgcgtggttgcaagtgaaatggcagaggcgctaaagggcatgcccatacgctaccagaccacggccgtaaagagcgagcacaccgggcgagagatcgtggacctcatgtgccacgccaccttcaccatgcgattactgtccccggtgcgagtccccaactacaacatgattatcatggatgaagcccactttaccgatcccgccagcatagcggcccgcgggtacatttccacgagggtggggatgggtgaagccgctgccatcttcatgaccgcgacgcctcccgggagcgtggaggccttcccccagtccaacgccgtgatccaagacgaggaaagagacatcccagagcggagctggaactccggctacgactggatcacagacttccccggcaaaaccgtgtggttcgtacctagcatcaaatccggtaacgacatcgcgaactgcctgagaaagaacggcaagcgggttattcagctcagccggaaaacgttcgacaccgagtaccagaagacgaagaataatgattgggactacgtcgtgaccaccgacatctccgagatgggggctaacttccgagcggaccgcgttatcgacccccggcgctgcttaaagcccgtgatactgaaggacggtcccgagagggtgatcctcgctgggccgatgcccgtcaccgtggccagcgcagcgcagcgacggggccgcatcggccggaatcagaataaggaaggggatcagtacgtctacatgggccagcctctgaacaacgatgaggaccatgcacattggacggaggccaaaatgctactcgacaatattaacacccccgaagggatcatcccggccctgttcgagcccgagcgtgagaagtccgcagcgatcgacggcgagtaccgcctgcgcggggaggctcgcaagaccttcgtcgagctgatgcggcgcggcgacctgcccgtgtggctgagttacaaggtcgcctccgagggcttccagtacagcgatcgccgctggtgcttcgacggcgaacgaaataaccaggtgctcgaggagaacatggatgtggagatctggaccaaggagggcgagcgcaagaaactgcggccccgctggctggatgcccggacgtactccgatcccctcgcccttcgtgagttcaaggagttcgcggccgggcggcgcagcgtcagcggcgatttaatcctcgagataggcaaactgccccagcatctgacgctccgggcccagaacgccctggacaacttggtgatgctgcacaactccgagcagggtggcaaggcataccgccatgcgatggaagaactaccggataccatcgagaccctgatgctcctggccctgatcgctgtgctcaccggaggcgtcacgttgttcttcttatctgggaagggcctcgggaagacctccatcgggttactgtgcgtaaccgccagctccgcactgctgtggatggcctcggtggagccccactggatagcggcctccatcatcctggagttctttctcatggtacttctgatcccggagcccgaccggcagcggacaccgcaagacaatcagctcgcgtacgtggtgatcgggctgctgttcatgatcttaacggtcgcggccaacgagatggggctgctcgagacgaccaagaaggacctcggcatcgggcacgtggccgccgagaaccaccaacatgccaccatgcttgacgtcgacttgcggccggccagcgcctggactctctacgccgtcgccaccaccgtgatcacaccgatgatgcgccacacgattgagaacacgaccgccaacatctccctgaccgcgatcgcgaatcaggccgccatcctaatggggttagacaaaggatggcccattagcaagatggacatcggggttcccctgctggccctcggctgttattcccaagtcaacccgctgacgctgaccgccgctgttctaatgctagtggcccactacgccatcatcgggcccggcctgcaggcgaaggctacccgggaggcccagaagcgcaccgccgcgggaatcatgaagaatcccacagtcgacggcatcgttgcgatcgacctcgaccccgtggtctacgacgccaaatttgagaagcagctaggccagatcatgctcctcatattgtgcaccagccaaatcctgctcatgcgcacaacctgggccctttgtgagtcaatcacgttagccaccgggcccctcaccacactgtgggaaggttcacccgggaagttctggaacacgaccatagccgtgtccatggcgaacatcttccgaggcagctaccttgccggcgccggactcgccttcagcctgatgaagtccctgggcggaggccgccgggggaccggtgcccaaggcgagaccctcggggagaagtggaagcgccagctgaaccagttgtctaagagtgagttcaacacgtataaacgatctggcatcatggaagtggaccgctcagaggcgaaggagggattaaagcggggcgaaactacgaagcatgccgtcagccgcggcaccgccaagctgcggtggtttgtggagcgcaacctggtaaagcccgaggggaaggtcatcgacctaggatgcggtcgcgggggttggtcgtactactgcgccggcctcaagaaggtgaccgaggttaaagggtacacgaagggcgggcttgggcacgaggagcctataccgatggcgacgtacggctggaacctggtcaagttacatagcgggaaagacgtcttcttcatgcctcccgagaagtgcgacaccctactgtgcgacatcggcgagtccagccctaacccgaccatcgaggaggggcgcacgctgcgggtgctgaagatggtcgagccatggctgaggggcaaccaattctgcatcaagatactcaacccctacatgccctctgtcgtggagacactggagcagatgcaacggaagcacggcggaatgctcgtccgcaacccgctatctagaaattcgacgcacgagatgtactgggtgagctgcggaaccggcaacatcgtgtccgccgtcaacatgacgtcaaggatgcttttaaatagattcacgatggcccaccgcaaacccacctacgagcgcgacgtggacctcggcgccggcacccggcatgtggccgtcgagcccgaggtcgctaacttggacataatcgggcagcggattgagaatatcaagaacgagcacaagtccacttggcactacgacgaggacaacccctacaagacttgggcttaccacggcagctacgaggtgaagccgtccgggagcgcctcctccatggtcaatggagtcgtcaaactgctcaccaagccctgggacgttatccccatggtgactcagatcgccatgacggataccacacctttcggtcagcagcgggtcttcaaagagaaggtcgacacccgaactccccgggccaagcgcggtaccacccaaataatggaggtgaccgcgaagtggctgtgggggttcctatcccggaataaaaagccccgcatctgcacgagggaggagttcacccgcaaagtccggagcaacgccgcgattggggccgtgttcgtggatgaaaaccagtggaacagcgcgaaggaggcggtcgaggatgagcgtttctggaacctcgtccaccgggaacgcgagttacacaagcagggcaagtgcgcgacctgcgtgtataacatgatggggaaacgggagaagaagctgggcgagtttggtaaggccaagggctcacgcgcgatctggtacatgtggctcggtgcgcggttcctggagttcgaagctctgggctttatgaacgaggaccactggtttagccgggagaatagcctcagcggcgttgagggggagggcctgcacaagctggggtacatactccgggacatttccaagatacccggcggcaacatgtacgcggacgacaccgcagggtgggacacgcgcatcactgaagatgatctgcagaacgaggcgaagatcaccgacataatggagcctgagcatgcccttctcgccacaagcatcttcaagctgacctatcagaacaaggtggtccgggtacagcgccccgcgaaaaacggcaccgtgatggacgtgatctccagacgggaccagagggggagcggccaggtcggcacctacgggttaaacaccttcacgaacatggaagtgcagctcatccgccagatggagtccgagggcatctttctgccctctgagctggagacacccaacttagccgagcgcgtactggactggcttgagaagcacggggccgagcggttgaagcgcatggcgatctcgggcgacgactgcgtcgtaaagccgatcgatgaccggttcgctaccgccctgactgcactgaacgacatggggaaagtgcgtaaggacatcccccagtgggagccttctaagggctggaacgactggcagcaggtccccttctgctcccatcactttcatcaattaattatgaaagacggccgcgagatcgtggtgccgtgcagaaaccaggatgagctggtcgggagggcaagggttagccaaggagcggggtggtccctgcgcgagaccgcctgcctgggcaagtcctacgcccagatgtggcagctgatgtatttccaccggagggacctgcgcttagccgccaacgcgatctgctccgccgtgcccgtcgactgggtgcccacgagccgaaccacctggagcatccacgcccaccaccagtggatgaccactgaagacatgttgtccgtctggaaccgcgtctggatagaggagaacccctggatggaagataagacccacgtgagctcttgggaagaagtgccgtacttagggaagcgtgaggaccagtggtgcggcagcttgatcgggctgaccgcccgcgctacctgggcgacaaacatccaggttgctattaatcaggtccgacggctgattgggaacgagaactacctggattacatgacctccatgaagcggttcaagaacgagtcggatcccgaaggagccctgtggtga

SEQ ID NO: 24040 - RNA, 9879 nt, synthetic construct
  misc_feature 1..9879: note = derived and/or modified CDS sequence (opt11) from DENV-1__FJ639743__SS-prME
  source 1..9879: mol_type = other RNA
agcgtgactatgctgctgatgctgctgcctaccgccctcgcgttccacctgactacgaggggcggggagccccacatgatcgtgagcaaacaggagcggggcaagagcctgctgttcaagaccagcgcgggggtgaacatgtgtaccctaattgccatggacctgggcgagctctgcgaggacactatgacctacaagtgccccaggatcaccgaagccgagccagacgacgtcgactgctggtgcaacgccaccgatacctgggttacttatggcacttgcagccagaccggcgaacaccggcgcgacaaacggtccgtggctctggccccccacgtcggcctggggctcgaaactcgcaccgagacatggatgtcgtccgagggagcttggaagcaaatacaaagagtagaaacctgggccctgcggcaccccgggttcacggtgatggccctgttcctggctcacgctatagggaccagcatcacgcagaaggggatcatcttcatcctgctgatgctcgtgaccccctccatggcgatgcgctgcgtgggcatcggcaacagagatttcgttgagggcctgtcgggcgccacgtgggtggacgttgtgctggagcacgggtcatgcgtgactaccatggccaagaataaaccaacactcgacatcgagctgctgaagactgaggtcaccaatcccgcggtgttgcggaaattgtgcatcgaggcgaagatctcaaacaccaccacggactcccgctgccccacccagggtgaagccaccctcgtggaggagcaggacgccaacttcgtctgtcggcgcaccttcgtggatcgcggctgggggaacggctgcggtctgttcggcaaggggtccctgctgacgtgcgccaagttcaaatgcgtgaccaagctcgagggcaagatcgtacaatacgaaaatctcaaatattccgtgatagtcacggtacacacaggtgatcagcaccaggtgggcaacgagacgaccgagcacggcaccattgcgaccatcacgccccaagcccccactagcgaaatccagctgaccgactacggggcactcactcttgactgttccccgcggaccggcctggacttcaacgagatggtcctcctgacgatgaaggagaagtcctggctggtgcacaagcaatggttcctcgacctgccgttgccctggacctccggtgccagcaccagccaggagacctggaaccggcaggacctcctcgtaactttcaagaccgcacatgcgaagaagcaggaggtcgtggtgctgggttcccaagagggagcgatgcacaccgccctcaccggggccacggagatacagacctcaggcaccaccacgatcttcgccgggcatctgaaatgccgcctgaaaatggacaagctcaccctgaagggcatgtcctacgtcatgtgtaccgggagcttcaagctggagaaagaagtggcggagacccagcacggcacggtgctggtccaggttcgatacgagggcaccgacgccccctgcaagatccccttctcaacccaggacgagaaaggagtaacgcagaacggccgcctcatcacggccaacccgatagtcacagacaaggagaaacccgtgaatattgagaccgagccgccgtttggagagagctacattgtggtcggcgccggagagaaggcgctgaagctgtcctggttcaagaaagggagctccatcggtaagatgttcgaggccaccgcccgcggggcccgccgcatggcaatcctcggagatacggcctgggatttcggtagcatcggcggcgtgtttacctccgtggggaagctggtccaccaggtgttcggcaccgcttacggggtgctattttctggcgtatcatggacgatgaagattgggatcggaatcctccttacttggctgggcctcaacagccggtccaccagcctttcaatgacttgcatcgccgtggggatggtaactctgtacctgggcgtcatggtccaggctgactccgggtgcgtaatcaactggaagggccgcgaactgaagtgcgggtccggcatcttcgtcacgaatgaagtgcatacctggaccgaacagtacaagttccaggcggatagtccgaagcgtcttagcgccgccatcggcaaggcctgggaagagggggtatgcggcatccgcagcgccactcggctcgaaaacataatgtggaaacagattagcaacgagctcaaccacatcctcctcgagaacgacatgaaattcaccgtcgtggtcggggatgccaacggcatcctggcgcaagggaagaagatgatccgtccccagcccatggagcacaagtacagctggaaatcttggggcaaagcgaaggtcatcggcgcagacatccaaaacaccacctttatcatcgacgggcctgacactccagagtgtcccgacggccagcgggcctggaacatctgggaagtggaggattacgggttcggcattttcaccactaacatctggctgaaactccgcgattcctacactcagatgtgcgaccaccggcttatgagcgcggctataaaggactccaaggccgttcatgcggacatgggctactggatcgagagcgagaagaacgagacctggaagttagccagagcgtcttttatcgaggtcaagacttgtacttggcccaagtcccacaccctctggtccaacggggtactggagtctgagatgatcatccccaagatctacggcgggcctatcagccagcacaactatcgaccaggctacttcacccagaccgctgggccttggcacctgggcaagctcgagctcgacttcgacttatgtgaagggacgacagtagttgtggacgagcactgcgggaatcgcggacctagccttcggaccacgacggtgaccgggaagataatccacgagtggtgctgccgctcctgcactctgccgcccctgcggttccgcggcgaagacgggtgctggtatggcatggagatccggcccgtcaaggagaaggaggagaacctagtgcggagcatggtttctgctgggagcggggaggtcgacagcttctccttaggtatcctttgcgtgagcatcatgatcgaggaggtgatgcggtcccgctggagccgtaagatgctcatgactggcacgctggccgtcttcctgctcctggtcatgggccaactgacctggaatgatttgatcagattatgcatcatggtgggggcaaacgcatccgaccgcatgggtatgggaacgacgtacctggccctaatggccacattcaaaatgcggccgatgttcgcagtcggtctgctattccgccggttaaccagccgcgaggttttactgctcactatcggcctgagcctggtcgcaagcgtggagctccccaacagtcttgaggagctgggggatggcctggcgatgggcattatgatgctcaagctactcaccgagttccagccccaccagctgtggacgacgctgctcagcctcaccttcgtgaagaccacgctttccctcgactacgcttggaagactactgccatggtcctgagcatcgtgtccctgttccccctttgcctctcaaccacgtcccagaagaccacctggctgccagtgctcctggggagcttcgggtgcaagccccttaccatgttcctcattaccgagaataagatctgggggcggaaatcctggcccctcaacgagggcatcatggcgattggtatcgtctcgatcctgttatccagcctcctcaagaacgacgtgcccctggccggaccgctgatcgctggcggcatgcttattgcctgctacgtgatcagcggctcgtcggccgacctctccctggaaaaggccgcggaggtctcgtgggagcaggaggccgagcactccggggcaagccataacatactggtggaggtgcaggacgatggtacaatgaagatcaaggacgaggagcgcgacgacaccctcacaatactgttgaaagcgaccttgctagccgttagcggggtgtaccccatgagcattcccgcaactctgttcgtgtggtacttttggcagaagaagaaacaacggtccggcgtgctctgggataccccctccccgcctgaggtggaacgcgccgtgctggacgacggcatctatcggatcctgcagcgcgggctgttaggtcggtcccaggtcggggtcggtgtgttccaagacggtgtattccacacaatgtggcacgtgacccgaggcgcggtgctgatgtaccagggcaagcgactggaaccctcatgggcaagtgtgaagaaggatctcatcagctacgggggcgggtggcgcttccagggctcatggaacacgggggaagaggtccaggttattgccgttgaacccggcaaaaacccgaagaatgtacaaacgacccccggcacgttcaagacgagcgagggggaggtgggcgcaatcgccctggatttcaagcccgggacgtccggcagccccatcgtcaatagagagggcaagattgtgggtctgtacggcaacggggtggtcacaacatccggcacttacgtaagcgcaatcgcgcaggccaaggcatctcaagaagggcctttaccagagatcgaggatgaagtattcaagaagcgcaacctgaccatcatggacctccaccccggctcgggaaaaactcggcgctatctcccagccattgtccgggaggcaatcaagcgcaagctccgaaccctcatcctcgcccccacgcgggtggtcgcgagcgagatggccgaggcactgaaggggatgcccattcgctaccaaaccaccgcggtcaagtccgaacacaccggccgggagatcgttgatctcatgtgtcacgccacgtttactatgcgtctcttgagccccgtgcgggtcccgaactacaacatgatcatcatggatgaggcgcacttcactgaccctgcctccatcgccgcccgggggtacatctctactagggtgggaatgggggaagccgcagcaattttcatgacggcgacgcctccggggtccgtggaagcctttccgcagtctaacgccgtcatccaagacgaggaacgcgatatccccgagaggagttggaacagcggctacgactggatcactgactttcccggtcgtaccgtttggttcgtgccctccatcaagtctggtaatgacatcgctaactgtctgaggaagaacgggaaacgcgtgatacagctctctcgcaagactttcgatacagagtatcaaaaaaccaaaaacaacgattgggactacgttgtgaccacggacatcagcgagatgggggccaacttccgcgccgatcgagtcatcgacccgcgtcggtgcctgaagcccgtgattctaaaggacggaccggagcgcgtcatcttagccggccccatgccggtgactgtggcatctgcagcccagcgccgcggccgcatagggcggaaccagaacaaggaaggcgaccagtacgtctacatgggtcagcccctaaacaacgacgaggaccacgcccactggaccgaagccaagatgttactcgacaacatcaacacccccgagggtatcatccccgcgctgttcgagcccgagagggagaagtccgccgccatcgacggggagtatcggctgcgcggcgaggcccggaagacgttcgtggagctcatgcgcagaggcgacctgcccgtgtggctgtcctacaaggtcgccagcgaggggttccaatactccgacaggcgctggtgtttcgacggcgagaggaacaaccaggtgttagaggagaacatggacgtagagatctggaccaaggagggggagcggaagaagctaagaccccggtggctggatgcgcgcacatacagcgatcccctcgccttacgggagttcaaggagttcgccgcgggccgcaggagcgtctccggggaccttatcctcgaaatagggaaactgccgcaacacctgaccctccgcgctcagaatgctctggataacctggtgatgctccacaacagtgaacaaggcggaaaggcctaccgacacgccatggaggagctgcccgacaccattgagacgctgatgctcttggccctgatcgctgtacttaccggcggggtaaccctgttcttcctgtccgggaagggcctcggaaagaccagcatcggcttgctgtgcgttacggcctccagcgccctcctgtggatggcttctgtggaaccccactggatcgccgcgtctatcatcctggagtttttcctcatggtcctgcttatccccgagccggaccgccagaggacgccgcaggacaaccagctagcctacgtagtgatcgggctgctattcatgatactcaccgtcgctgccaacgagatgggcctgttagagaccacgaagaaggacctcgggatcggctacgtggcggcggagaaccatcagcacgccaccatgctggacgtggacttgcgccccgccagcgcttggacactttacgccgtcgcgaccaccgtcatcaccccgatgatgaggcacaccatcgagaacaccacggccaacatcagcctgaccgcgatagccaaccaagccgcaatcctgatgggtctcgacaaagggtggccgatctccaaaatggatatcggagtgccgttactagccctcgggtgctacagccaggtcaaccctctgactttaaccgccgcagtcctcatgctcgtggcacactatgccatcatcggccctgggctgcaggccaaggccaccagggaagcccagaagcgcacggccgccggcatcatgaagaaccccaccgtcgacggcatcgtggccatcgacttagatcccgtggtctacgacgccaaatttgagaagcaactggggcaaataatgctactcatcctgtgcacgtcccagatcctgctcatgcggacgacctgggccttgtgcgaatctatcaccctggcgactggccccctcactaccttgtgggaggggagtccgggcaagttttggaatactaccatagctgtgagcatggctaacatctttcgcggatcctacttagccggggctggcctagcgttcagcctgatgaaatcacttggcggcgggcggcgcgggacgggcgcgcagggggagaccctcggcgagaagtggaagcggcagctgaaccagctgagcaagagcgagttcaacacctacaaacgctctggtataatggaggtggaccggagcgaggcgaaggagggcctcaagcgcggtgagacgaccaagcacgccgtcagtcggggcaccgcgaagctgcgctggtttgtggagcgaaacctggtgaagcccgagggcaaggtaatcgacctcgggtgcggacgcgggggctggagctactactgcgccgggctgaagaaggtgaccgaggtgaagggctacaccaagggcgggcctggccacgaggagcctatcccgatggcaacctacgggtggaacctggtcaaactgcactccggcaaggacgtgttctttatgagccccgagaagtgcgacacactcctctgcgacatcggggagtcgagcccgaaccccaccatcgaggaggggcgaaccctgcgagtgcttaaaatggtcgagccgtggctgcgcggcaaccagttctgtatcaaaatactgaacccctatatgccttccgtggtggaaaccctggagcagatgcagcgcaagcacgggggcatgctggtccgtaaccccctgtcacgtaattccacgcacgagatgtactgggtgagctgcggcaccggaaatatagtctccgccgtgaacatgaccagccgcatgctcctgaaccgattcaccatggcccaccggaaaccgacctacgagcgggacgtagatctgggtgcggggacccgccacgttgccgtcgagcccgaggaggccaatctcgatatcatcggccagcggatcgagaacattcgtaacgaacacaagtctacctggcactacgacgaggacaacccttacaagacctgggcttaccacgggagctacgaggtgaagccttccggctccgcctctagcatggtcaacggggtggtgcggctgctgacgaagccgtgggacgtcatccccatggtgacccagatagctatgaccgacaccacaccgttcggccagcagcgcgtcttcaaagagaaagtggacacacggacgccccgcgctaagcgggggaccacgcagatcatggaggttaccgccaagtggctctgggggtttctgagccgaaataagaagccccggatctgcacccgcgaggagttcacccggaaagtgcgctccaacgccgccatcggcgccgtcttcgtggacgaaaaccagtggaacagcgctaaggaagccgtggaggacgagcggttctgggatctggtccaccgcgaacgagagctccacaagcagggcaaatgtgccacatgcgtgtacaacatgatgggcaaacgcgagaagaagctcggtgaattcgggaaggcgaaaggctcccgagccatctggtacatgtggctgggagcccgtttccttgagtttgaggccctcggcttcatgaacgaggaccactggttcagcagggaaaattccctgagcggggtggagggcgaagggttacacaagctgggctacatcctgcgggacatctccaaaatcccgggcggcaacatgtacgccgacgacacggcgggatgggacactcgcattaccgaggacgacttgcagaacgaggccaagatcacggacataatggagcctgagcatgccctgctggccacaagcatcttcaagttaacatatcagaacaaggtagtgagggttcagcggccggccaagaacgggactgttatggacgtgatcagtcgtcgggaccagcggggcagcggccaggtggggacgtacggcctgaacaccttcaccaacatggaagtccagctgattcgacagatggagtccgaggggattttcctccccagtgagctggagacccccaatctggcggagcgagtgctcgattggctggagaaacatggcgctgaacgcctgaagagaatggccatctcgggggacgactgcgtagtcaaaccgatcgatgaccggttcgccacggccctcaccgctctgaacgatatgggcaaggttcggaaggacatcccgcagtgggagccttcaaaaggatggaacgactggcagcaagtgcccttctgctcccaccatttccaccaattgatcatgaaggacggtcgcgagatcgtcgtaccatgccggaatcaagacgagctcgtcggtcgcgcccgggtctcccagggggccggctggtccctccgagagacggcttgcctgggtaaaagctacgcgcagatgtggcagttgatgtacttccaccggcgcgacctgcgcctggcagccaacgccatctgcagcgccgtgccagttgattgggtaccgacctcccggacaacatggagcatccatgcgcaccaccagtggatgaccaccgaggacatgctgtccgtgtggaatcgcgtgtggatcgaggagaatccgtggatggaggacaaaacacacgtctcgtcctgggaggaggtgccctatctgggcaagcgggaggaccagtggtgcggcagcctgatcggcctcactgcccgcgctacctgggctaccaacatccaggtagccatcaaccaggtccggagattaatcggaaacgagaactacctagactacatgacctccatgaaacggttcaagaatgagagcgatccggagggggcgctctggtga

SEQ ID NO: 24041 - RNA, 9879 nt, synthetic construct
  misc_feature 1..9879: note = derived and/or modified CDS sequence (opt11) from DENV-1__FJ639794__SS-prME
  source 1..9879: mol_type = other RNA
tcagtgaccatgctactcatgctgctgcctaccgccctcgcctttcacctgactacccgcgggggggagccacacatgatcgtgagcaagcaagagcggggcaagtcactcctgtttaagaccagcgcgggggtgaacatgtgtaccctaatcgctatggacctaggcgaactctgcgaggacaccatgacctataaatgccctaggataaccgaggccgagcccgacgacgtggactgctggtgcaacgctaccgacacctgggtcacctacggcacctgctctcagaccggcgagcaccggcgcgacaagcggtcagtggccttagcgccccacgtgggactgggactcgagacccgtaccgagacttggatgagcagtgagggtgcctggaaacagatccagcgggtcgagacctgggccctccgacaccccgggttcacggtgatagccctgttcttggcgcacgccatcggcaccagcatcacacagaaggggatcatcttcatccttcttatgctcgtgaccccctccatggccatgcggtgcgtcggcatcggcaaccgagacttcgtggaggggctgtcaggcgccacgtgggtggacgtcgtgctggagcatggatcttgcgtgaccaccatggccaagaataagcccacactcgatatcgagctgctgaaaacggaggtcaccaacccagcggtgctccggaagctgtgcatcgaagccaagatcagcaacacgaccacggactcccgctgcccgacccagggcgaggccacccttgtcgaggagcaggacgccaacttcgtctgccggcgcactttcgtggaccggggatgggggaacggctgcggccttttcggcaaagggagcctgctgacgtgcgccaaattcaagtgcgtgacgaagctcgaaggtaagatcgtccagtacgagaatctgaagtactccgtgatcgtgacggtccacaccggcgaccagcaccaggtggggaacgagacgaccgagcatggcaccatcgctaccatcacgccccaggccccaacgagcgagatccagttaaccgattacggggccctcacccttgattgcagcccccgcaccggcctggacttcaacgagatggtccttctgactatgaaggagaagtcctggctggtccacaagcagtggtttctcgacctgccgctgccctggacctctggggccagcacgagccaggaaacctggaaccgtcaggacttactggtgacattcaagaccgcccacgcaaagaaacaggaggtcgtggtgctgggctctcaggagggtgccatgcacaccgccttgaccggggccacggagatacagaccagcggcaccaccacgatctttgccgggcacctgaagtgccgcctgaaaatggataagctcaccctgaaaggcatgtcctacgtcatgtgcaccgggagctttaagctggaaaaggaggtggcggagacgcagcacggtacagtccttgtccaagtaaagtacgaggggacagacgccccttgtaaaatccccttcagtactcaggacgagaagggggtgacccagaacggcaggctcataacggccaacccgatcgtcactgacaaggagaagcccgttaacatcgagaccgagccgccctttggcgagagctacatcgtggtcggcgccggcgagaaggcgctaaagctgtcctggttcaaaaagggctcctccatcggcaagatgttcgaagccaccgcacgcggtgcccgaagaatggccatcctcggcgacacggcgtgggactttgggagcatcggcggtgtgttcacctccgtagggaagctggtccaccaggtattcggtaccgcctacggggtgctattcagcggcgtctcctggacgatgaagattggtatcggaatactcttaacgtggttgggcctcaacagcaggtccacgagcctgtccatgacctgcatcgtggtggggatggtcaccctgtatctcggcgtgatggtgcaggcagacagcgggtgcgtcatcaactggaagggccgggagctgaaatgcgggtccggcatcttcgtaacgaacgaagtgcacacctggaccgagcagtataagtttcaggccgacagtccgaagcgcctgagcgccgcgatcggaaaggcttgggaggagggggtctgcggcatccggtcggccacacgcctcgagaacatcatgtggaaacagataagcaacgagctgaaccacatcctgctcgagaacgacatgaagttcaccgtggtggtcggggacgcaaacggtattctggcccagggaaaaaagatgatccgcccccaacccatggagcacaagtactcctggaagtcctggggcaaggccaagataataggcgcagacatccagaacaccaccttcatcatcgacggccctgacaccccggagtgccccgatggccagagggcctggaacatctgggaagtggaggactacgggttcgggatcttcaccacgaatatctggctgaagctccgggactcatatacccagatgtgcgaccaccgccttatgagcgccgccattaaagactccaaggccgtgcacgccgacatgggctactggattgagagcgagaagaacgagacgtggaaactggctcgggcatcctttatcgaggtcaagacctgcacatggcccaagtcgcacaccctctggagtaacggggtgctggagagcgagatgatcatcccaaagatctacggtgggccgatctcccagcacaactaccgccccggctactttacccagaccgcggggccctggcacctgggcaagctggagctggacttcgacctgtgcgagggcacgactgtggtggtagacgagcactgcgggaatcggggccccagcctccgcaccaccacggtgaccggcaagatcatccacgagtggtgctgccggtcctgcacgctgccaccactgaggttccggggcgaggacgggtgctggtacggcatggagatccgccccgtcaaggagaaggaggagaacctcgtgcggagcatggtgtccgccggcagcggggaagtcgacagcttctccctggggatcctgtgcgtgtctataatgatcgaggaggtgatgcgctcccggtggagccgcaagatgctgatgaccgggaccctggccgtcttcctgctcctgatcatgggtcaactgacctggaacgatctcatcaggctttgcatcatggtgggagccaacgcctccgaccggatgggcatgggcacaacctatctcgcgctcatggcgacattcaagatgcgcccgatgttcgcagtgggcctgctgttcaggcgcttaacaagccgggaggtactactcctcaccattgggctgtccttagtcgccagcgtggagctccccaactccctggaggagctgggagacggcctcgctatgggcatcatgatgctgaagctgttgactgagttccaaccccaccagctgtggaccacccttttgagcctcaccttcgtgaaaaccactctgagcctcgactacgcgtggaagactaccgccatggtgcttagcatcgtttcgctgttcccactctgcctgagcacgacgtcacagaaaaccacctggctacccgttctcctggggagctttggctgcaagccacttaccatgtttctcataaccgagaacaagatctgggggcgcaagtcctggcccctgaacgagggtatcatggccatcgggattgtgagtatccttctttccagcctgttgaagaatgacgtcccccttgcgggcccgctgatcgcgggcgggatgctgatcgcctgctacgttattagcggctccagcgcggacctctccctggagaaggccgccgaggtgagctgggagcaggaggcggagcactccggggccagccacaacatactggtcgaggtgcaggacgacggcacaatgaagatcaaggacgaggagcgcgacgacaccctcaccatcctcctgaaggcgaccctcctagccgtatccggtgtttaccccatgagcatccccgccacgctgtttgtgtggtacttctggcaaaagaagaagcagcgctccggcgtgctatgggacacccccagcccgcccgaggtcgagcgggcggtgctggatgacggcatctaccgcatcttgcaacgggggttgctcggccgctcgcaggtgggggtcggtgtattccaggatggggtgttccacacgatgtggcacgtcacccgaggcgccgtgctcatgtaccaggggaagagactggagcccagctgggcctccgtcaagaaggacctcattagctatgggggcggctggcggttccaaggctcctggaacacaggggaggaggtgcaggtgatcgccgtggagcccggcaagaatccgaagaatgtccagactacccccgggaccttcaagacaccggagggtgaagtgggcgccatcgcgctggacttcaagcccgggaccagcggttctccgatagtgaaccgcgagggcaagatcgtagggctgtacggcaatggggtggtgactacgagcggaacgtacgtctccgctatcgcccaggccaaggcctctcaggaggggcccctccctgaaatagaggacgaggtcttcaagaagcggaacctgaccatcatggacctgcacccggggagcggaaagacccgccgatatctccccgcgatcgtccgcgaggccatcaagcggaagcttcggacattgatcctcgcccccacgcgcgtcgtagcctcggagatggcagaggcgctgaaagggatgcccatacgttaccaaaccaccgccgtcaagagcgagcacaccggccgcgagatcgtcgatctaatgtgccatgccacttttaccatgcggttgctatccccggtgagagtaccgaactacaacatgatcatcatggacgaggctcacttcaccgaccctgcgagcatcgccgcccggggctacatctccaccagagtcggaatgggggaggccgccgcgatcttcatgacggctacgccacccggatcggtggaggccttcccccaatccaacgccgtgatccaggacgaggagcgggacatccccgagcgcagctggaacctgggctacgactggatcaccgacttccccggcaaaaccgtctggtttgtgccctcaatcaagagcgggaacgacattgccaactgcttgcggaagaacgggaaacgcgtcatccaactgtcccggaagacgttcgacaccgagtaccagaagaccaagaacaacgactgggactatgtcgtgacgacggacatctccgagatgggcgcaaatttccgagccgaccgggtgatcgatccccgccggtgcctgaagccggtcatcttaaaggacggacccgagcgtgtgatccttgcgggcccgatgccagttaccgtggcctcggcagcccagagacgcgggagaataggccgcaaccagaacaaggaaggcgaccagtacgtgtacatggggcagcccttgaataacgacgaggaccacgcacactggaccgaagccaagatgctcctagacaacatcaacacccccgagggtatcattccggccttgtttgagcccgaacgcgagaagtccgcggccattgacggggagtaccggctccgcggcgaggcccggaagacgttcgtcgagctgatgcgccggggcgacctgccggtgtggctctcgtacaaggtcgccagcgagggattccagtactccgaccgacggtggtgcttcgatggcgagcgcaataaccaggtcctggaggagaacatggacgtggagatctggaccaaggagggcgagcggaaaaagctgcgcccacgctggctagacgccaggacatacagcgaccccctggctctgcgggagtttaaggagttcgcagcaggccgccggtccgtgtccggcgacctcatcctggagatcgggaagctgccacaacacttgaccctgcgcgcccagaatgcgttggacaacctcgtaatgctgcacaactctgagcagggcgggaaagcgtaccggcacgccatggaagagctgcccgacaccatagagacactcatgctgctagccctcatcgccgtgctcaccgggggggttaccctgttcttcctctcaggcaaaggcctggggaagacgagcatcggcctgctctgcgtaaccgcctccagcgccctgctgtggatggcctccgtggagccccactggatcgccgccagcatcattctagagttcttcctgatggtgctactcatcccggaacccgacaggcagcggacgccccaggacaatcagctggcgtacgttgtgattggactcctctttatgatactgaccgtagccgcgaacgagatgggcctgctagagaccactaagaaggacctgggtatcgggtacgtcgccgccgaaaaccaccagcacgcgacgatgctagacgtggacctccgcccggcctccgcttggactttatacgccgtggccaccacggttatcacccccatgatgcggcacaccatcgagaacacaacggcgaacatcagcttgaccgccatcgccaaccaggccgcaatactcatgggcctggacaaggggtggcccatcagtaagatggacatcggtgttcctctcctcgcgctggggtgctacagccaggttaacccgctgacgctcaccgctgccgttctgatgctggtggcccactacgctattatcggcccaggcctccaagctaaggctacgcgggaggcccagaagcggaccgccgcgggaatcatgaagaaccccactgtggatggcattgtagccatcgacctggaccccgtggtctacgacgcaaagttcgagaagcagctggggcagatcatgctgctgatcctgtgcacctcccaaatcttactgatgcggacgacctgggccctctgcgaatcaatcaccctcgccaccggcccgctgacgacactgtgggaggggtcccccggcaagttctggaatacaaccatagcggtcagcatggccaacatctttcgcggctcttacctcgcaggagccggtctggcattcagcctgatgaagtctctcgggggaggtcggcgcggcacgggcgcgcagggggagacactgggtgagaagtggaagcggcagctgaaccagttgagtaagtccgaattcaacacttacaagcgcagcgggatcatggaggtggaccggagcgaggccaaggagggcctgaagcgcggggagaccaccaaacacgccgtgtcgcggggcaccgcgaaactgcgctggttcgtcgagcggaacctggtgaagcccgagggcaaggtgatcgacctcgggtgcggccgcggaggctggagttactactgcgcggggctgaagaaggtaaccgaggtgaagggctacaccaagggcgggcccggtcacgaggaaccgatccccatggccacctacggttggaacctagtcaagctccactccggcaaggacgtcttcttcatgccgcccgaaaagtgcgacacgctgctctgcgatatcggggagagctctcccaaccccaccatcgaagaaggtcggaccctcagggttctgaagatggtggagccctggctgaagggcaatcagttctgtatcaagatcttaaacccctacatgccaagcgtggtggagaccttggagcagatgcagcgtaagcacgggggcatgctagtgcgcaaccccctctcccggaactcaacgcacgagatgtactgggtctcctgcgggaccggcaacattgtgagcgccgtgaacatgacctcccggatgctgctgaaccggttcacgatggtccaccgcaagcccacgtacgagcgagatgtcgacctcggcgccgggactcgacacgttgccgtcgagcccgaagtggccaatctggacattatcggccaacgcattgagaacatcaagaacgaacacaaaagcacctggcactatgacgaggacaacccgtacaaaacgtgggcctaccacggttcctacgaagtgaagccaagcggctccgccagctctatggtgaatggagttgtgcggctactcacgaagccctgggacgtgatccctatggtgacccagatcgccatgactgacaccacgccgttcggccagcagcgcgtcttcaaggagaaggtggacacacggacgccccgcgccaagcggggcaccacacagatcatggaggttacggcgaagtggctatgggggttcctgtctcgcaacaagaagccgcggatctgcacccgggaggagttcacgcgaaaggtccgctccaacgccgccatcggcgccgtgttcgtggacgagaaccagtggaacagtgccaaggaggcggttgaggatgagcggttctgggacctcgtgcatcgcgagcgggagctacacaagcaggggaagtgcgcgacgtgcgtttataatatgatgggtaagagagagaagaaactgggggagttcggcaaggccaagggcagccgggccatctggtacatgtggctgggggcccggttcctggagtttgaagcccttgggttcatgaacgaggaccactggttctcccgagaaaatagcctcagcggggtcgagggcgagggactgcacaagctgggctacatcctccgcgacatttcgaagatcccgggcggtaacatgtacgccgacgacaccgcaggctgggataccagaatcaccgaggacgacctccagaacgaggctaagatcacggacataatggagccggaacacgctttactcgccacctccatcttcaagttgacttaccaaaacaaggtggtccgcgttcagcgccccgccaaaaacgggaccgtgatggacgtcatttcacggcgtgaccagcggggctcgggccaggtcgggacgtacggcctgaacaccttcaccaacatggaggtgcaactcatccgccagatggagagcgaggggatcttcctgccgtcagagctggagaccccgaatctcgccgagcgggtgctggactggctggaaaagcacggcgccgagcgcctcaaacgcatggcgatctcaggggacgactgcgtcgtgaaacccatcgacgaccgtttcgcaacggccctgacagccctgaacgacatggggaaggtgagaaaggacatcccccaatgggagccctccaagggctggaacgactggcagcaagtcccgttctgcagccatcacttccaccaattagtgatgaaagacgggagagagattgtggtcccctgccggaaccaggacgagctggtgggccgcgcccgggtgtcccagggggcgggctggagcctgcgcgagaccgcctgcctcggaaagtcctacgcccagatgtggcagctgatgtactttcacaggagggacctgcggctagccgccaacgcgatctgcagcgccgtccccgtagactgggttccgacatcgcgcaccacctggagcatccacgcccaccaccagtggatgaccaccgaggacatgctgtccgtctggaaccgggtctggatcgaggaaaacccgtggatggaggacaagacccacgtgagtagctgggaggaggtcccctatctgggcaagcgcgaggaccagtggtgcggctccctcatcgggctgacggcccgcgcgacttgggccaccaacatccaagtggccattaaccaggtacggcgcctgattgggaacgagaattacctcgattacatgaccagcatgaagcggttcaaaaacgagtccgaccccgagggggccctgtggtga

SEQ ID NO: 24042 - RNA, 9879 nt, synthetic construct
  misc_feature 1..9879: note = derived and/or modified CDS sequence (opt11) from DENV-1__FJ639796__SS-prME
  source 1..9879: mol_type = other RNA
agcgtaacgatgcttctgatgctcctaccaacagccctcgcattccaccttacgacccggggaggagaaccacacatgatcgtaagcaaacaagaaaggggaaaatccctactctttaaaacctccgcgggagtaaatatgtgcacactaatagcgatggacttaggagaactgtgcgaagacacaatgacctacaagtgtccaaggataacagaagcggaacctgacgacgtcgactgctggtgcaatgccaccgacacttgggtaacctacggaacatgctcccaaacgggcgaacataggagagacaaacgaagcgtagccctagccccgcacgtaggactaggcctcgaaacgaggaccgaaacctggatgagtagcgaaggagcttggaagcaaatccaacgtgtcgaaacatgggccctcagacatcccggattcaccgtcattgcactattcctagcacacgcaataggcacgagcatcactcaaaaagggattattttcatactactcatgttagtgaccccgtcgatggcaatgcggtgcgttggaatcggcaatagagacttcgtggaaggattgtcaggtgccacttgggtggacgtggttttagaacacgggtcctgcgtcaccacgatggccaaaaacaaaccgacactggacatcgagctactcaaaacggaagtcacgaacccagcagtcctgcggaagctgtgtatagaggccaaaatctcaaacactacaacagatagcagatgtccaacgcaaggcgaggcgactctagtagaagaacaggatgcaaatttcgtatgccgacgcaccttcgtagaccgtggctggggcaatggatgcgggctattcggaaaagggagcctgttgacatgcgccaaattcaaatgcgttacaaaattggaggggaagatagtacaatatgagaacctaaaatattcggtgatagttacggtccacacaggagaccaacaccaggtcggaaacgaaacgaccgagcacggcacgatagccacgataacaccccaagctcccacgagtgaaatccagctcaccgactacggcgcactgactttggactgctctccccgtacagggctagattttaacgagatggtattgctcacgatgaaggagaaatcatggttagtacataagcaatggttcctagacctgccactcccgtggacgagcggggcgagcacgtcccaggaaacgtggaaccggcaagaccttttagtaactttcaagacagcacacgccaaaaagcaggaagtagtggtgcttggtagtcaggagggggcaatgcacacggcactgaccggcgctacagaaatacaaacctccggcacaacgacaatcttcgcaggacacctgaagtgtcgcctaaagatggacaaactcaccttgaaagggatgtcatatgtgatgtgcaccggcagcttcaagctggagaaagaggtagcggagacgcaacatggaacggtcctagtacaggtgaagtacgaaggaaccgacgccccctgcaaaatacccttttccacccaggacgaaaaaggcgtcacacagaatggcaggttgataacagctaacccgatagtgacagacaaagaaaagcccgtaaatatcgagacagaacccccattcggagaaagttacatagtagtcggggccggcgaaaaggcactaaagctcagctggttcaagaaaggctctagcattggaaagatgttcgaggcgacggcgcgcggagcacgccggatggccatactcggtgacaccgcttgggatttcgggtcaatcggaggagtgtttacatccgtaggaaagttagtccaccaggtctttgggaccgcgtacggagtcctcttctcaggggtgagctggaccatgaaaataggcatcggaatcctactgacatggctaggtttaaactcacggagtaccagcctatcaatgacgtgcatagcggtgggcatggttactctgtacctcggtgtaatggttcaagccgatagcggttgcgtcatcaactggaaagggagagagctaaaatgcggaagtggaatattcgtaactaacgaggtgcacacctggactgagcaatacaaatttcaggccgactcccccaaacgactctccgctgccataggtaaagcatgggaggaaggcgtatgcggcatcagaagtgcaacccgccttgagaacataatgtggaaacaaattagtaacgaactgaaccatattctcctcgaaaacgacatgaagttcaccgtcgtggtaggggacgccaacgggattctcgcacaagggaagaaaatgatccgaccccaacccatggagcacaaatactcatggaaatcatggggcaaagccaaaataatcggagcggacattcagaacacgacattcatcatcgacggaccagacacgccagaatgcccggacgggcagagggcgtggaatatttgggaggtcgaagactatggattcggcattttcactaccaacatatggctgaaactacgcgacagctatacgcaaatgtgcgaccacagactcatgtcagctgctataaaagattcgaaggcggtacatgcggatatgggctactggattgaaagcgagaaaaatgaaacatggaagctggcgcgcgcatcttttatcgaagtaaaaacgtgcacgtggcccaaatcacacactctgtggtcaaatggcgttcttgaatcggaaatgatcattccgaagatatacggcggcccgatatcgcaacataactaccgcccagggtacttcacccagactgccggcccctggcacctaggaaaacttgaactcgatttcgacctgtgcgagggcacaacagtcgtggtagacgaacactgtggaaaccgcggaccctctctaaggaccactacagtgaccggaaagatcatccatgagtggtgttgccgtagttgcaccctgccgcccctaagattcaggggtgaagacggctgctggtatggcatggaaataaggccagttaaagaaaaagaagaaaatctagtgcgatcgatggtaagcgccggcagtggcgaagtcgactcattctcattgggcattctctgcgtatcaatcatgattgaggaagtaatgaggtcgcggtggagccgaaagatgctaatgaccggtaccctggctgtttttctgctcctaataatgggtcaattgacctggaacgacctaataagactctgtatcatggtaggagcaaacgcatccgacagaatggggatgggcaccacctacctcgcattgatggcgacgtttaagatgaggccaatgttcgcagtcggactactattccgcagactcacctctcgcgaagtactcctgctaacaataggtttaagcctagtggcctcagtggagcttccgaacagcctagaagaactaggcgacggactggcgatgggcataatgatgcttaaactcctaaccgagttccaaccacaccaactctggaccactctcttatcgctcaccttcgtgaaaaccacactctcactagactacgcatggaaaactaccgcgatggtcctatcgatcgtctccctgtttcctctatgcctatcaacgaccagccaaaagacaacatggttacccgtactgctgggttcattcgggtgcaagccgctcacaatgttcctcataaccgagaataagatatggggccggaaaagctggcccctcaatgagggaatcatggcaatcggtatagtgtccatcctcctttcaagcctacttaagaacgacgtaccgctggccggccccctcatcgccggcggaatgctaatcgcctgctacgtaatatccggatccagtgccgacctcagcctggaaaaagcggccgaggtaagctgggagcaggaggccgagcatagcggcgcgagccacaacatattagtggaagtccaagatgatgggacaatgaagataaaggatgaagaaagggacgacacactgactattcttctgaaggcaacgttgctagcggtcagtggcgtctacccgatgtctataccagcaacattgttcgtgtggtatttctggcagaagaagaaacaacgatcgggagtactgtgggacaccccatcgcctcccgaagtagaacgtgcagtattagacgatgggatatatcgaatactgcagcgaggactgctcggccgctcacaagtgggagtgggagttttccaagacggggtgttccatactatgtggcacgttacccgaggggccgtactcatgtaccaaggaaaaagactcgaaccctcctgggcctcagtcaaaaaggatctcatctcctacggcggaggttggcggttccaaggaagttggaacacaggggaagaagtacaggtaatagcagtggaaccggggaagaaccccaaaaacgtacaaacaaccccaggaactttcaaaacaccagaaggggaagtaggagcgatcgccctagactttaagccaggtacaagcggttcgccgatagtgaatagagaaggaaagatcgttggtctatacggaaacggagtcgttaccacgtctggtacgtacgtcagtgccatcgctcaagcgaaagctagccaagaaggacctcttcctgagatcgaagacgaagtgttcaagaagcgcaacttaacgataatggatctccacccaggcagtgggaagacccgtaggtacttaccagccatcgtgcgagaagccatcaaaaggaaactgagaacgctaatccttgcaccgacgcgagtcgtcgccagcgagatggccgaagcactaaagggcatgcctatccgctaccagacaacggcagtcaaatctgaacacacagggcgagagattgtggacctcatgtgccacgccacgttcaccatgagactccttagcccggtacgcgtccccaattacaacatgatcataatggacgaagcccacttcaccgaccctgcgtctatcgcggcaagagggtatatatccacacgcgtcggaatgggagaagcagccgcaatctttatgaccgcaacaccgcctggcagcgtcgaggcattcccacaatctaacgccgtgatccaggacgaggaacgcgacattcccgagaggagctggaactccggctacgactggataacagactttccgggaaaaaccgtctggttcgtcccatcaatcaaatcagggaatgacattgcaaattgtttacgtaaaaatggcaaaagggtcatacaactctctcgaaaaacgttcgacacagagtaccagaagacgaaaaacaacgattgggactatgtagtcacaacggacataagcgaaatgggagccaacttcagagcggacagagtcatagacccacggcgctgcctgaaaccggttatccttaaggacgggccggagagggtcatactagcagggcccatgcccgttaccgtagcgagcgccgcacaacgccgaggcaggatcgggagaaaccaaaacaaagaaggagaccaatatgtatacatgggccaaccactaaataacgatgaggaccacgcccactggacagaagcaaagatgctcttggacaacataaacactcccgaagggattatacccgctttgttcgagcctgaacgagagaaatcagcagccattgacggagagtaccgcctgcgtggcgaagcccgaaaaacattcgtcgagctgatgcgacgaggagacttgcccgtatggctcagttacaaggtcgcatccgaagggttccaatattccgacaggagatggtgctttgacggagaacgaaacaaccaagtactcgaggagaacatggacgtagaaatctggacaaaggagggagaaagaaagaaactgcgcccgagatggctggacgcccggacatactcagatccacttgccctacgcgagttcaaggaatttgccgctggacggcgaagcgtctcaggagaccttatactcgaaatcggcaaactcccacaacacctcacactacgagcccaaaacgcgctcgacaacctagtgatgctccataactctgaacagggcggcaaggcgtacaggcacgcaatggaggaacttcccgacacaatagaaacgttgatgttattggcactcatagcggtcctcacaggcggagtaacgttattcttcctcagtgggaaaggtctaggcaaaacgtcaatcggactactgtgtgtaacagccagctcagcactcctatggatggcatcagtagagccacactggattgcggcaagcataatactcgagttcttcttgatggtgctacttatacccgagccagacaggcagaggaccccgcaagacaaccagctagcctacgtggtgataggcctactgttcatgatcctgacggtggcagcaaacgaaatgggcctcctagagacgactaagaaagacctagggatcggctacgtagccgccgaaaatcaccaacacgcaacaatgctagacgtagacctccgccctgcatcagcgtggactctctacgcggtggctactacagttataaccccaatgatgcggcacaccatcgaaaacactacagcgaacatttccttgaccgcaatagcgaatcaagccgcaatactcatgggactggataaaggatggcccatctcgaaaatggacattggggtccctttgctggccctaggatgctattcacaagtgaatccgctaaccctgacggcggcagtgctgatgctcgtagcgcactacgccattatcgggccaggcctccaagctaaagcgaccagggaagcacaaaaacggacagcggcaggcatcatgaaaaaccctacagtggacggaatcgtagccatcgaccttgacccggtagtatacgacgccaaatttgagaaacagctgggacagatcatgctactcatcctgtgcacttcacaaatcctcctcatgcgaaccacgtgggctctctgtgagagcataacgctggcaacaggccctctaacaacactatgggaaggctcacccgggaagttctggaacaccaccatagcagtatcaatggcaaatatcttccgaggcagctatctcgctggcgctggactcgcatttagccttatgaaaagcctagggggcggacgcagaggaaccggcgctcaaggggaaacacttggtgagaaatggaaacgtcaattaaaccaactcagtaaaagtgagttcaacacctacaagcgctcaggaataatggaagtagaccgcagtgaagccaaagaaggactaaaaagaggagagactacaaaacacgcggtgagtcggggcactgcgaaacttcgatggttcgtcgaacgcaatctagtcaagccggaaggaaaagtgatagacctcggatgcggcagaggcggatggtcctactattgcgctggtctcaaaaaggtaacagaagtcaagggatacactaagggaggcccggggcatgaagaaccgatacccatggcaacatacgggtggaatctggtaaagttgcactccggcaaagacgtgttcttcatgcctcccgagaaatgcgacaccctactatgcgacattggcgagagtagtccaaacccaacgatagaagagggccgtacactccgcgtcttgaagatggtagagccatggctcaagggaaaccaattctgcataaagatcctaaacccgtatatgccgagcgtagtagaaacactcgaacagatgcaaagaaaacacggcggcatgcttgtaagaaacccgctgtcccgcaactcgacccacgagatgtattgggtctcttgcggcacaggcaacatagtgagcgccgtaaacatgacctccagaatgctgctcaaccgctttacaatggcccacagaaaacccacatacgagagagatgtcgatttaggtgcaggtacacggcatgtggccgtagaacccgaagttgcaaacctcgatataataggacagcgcattgagaacatcaagaatgaacacaagagcacatggcattatgacgaggacaacccctacaagacctgggcttatcacggatcatacgaagttaagccaagtggaagtgcatcctcgatggtcaatggggtcgtgcgcctgctgacaaaaccttgggacgtgatccccatggtgacccaaatcgcgatgactgatacaaccccatttggacaacaacgagtatttaaagaaaaagtagacacaagaacgccgagagcgaaacggggcaccacgcagataatggaagtaacagccaaatggttatggggattcttaagtcggaataaaaagccccgcatatgcacacgagaagagttcacgagaaaagtacggtcaaatgcagctatcggcgctgtatttgtggacgaaaatcaatggaatagcgctaaagaggcggtagaagacgaacggttctgggatctcgtgcatagagagcgcgagctgcataagcaaggtaaatgcgcaacctgtgtctacaacatgatgggaaaaagggaaaagaaacttggagagttcgggaaagccaaaggcagcagagccatttggtatatgtggctaggcgctcgcttcctcgagttcgaagcgctcggattcatgaacgaggaccattggtttagccgagaaaattcgcttagtggcgtagagggcgaaggcctccacaaattgggctatatcctgcgcgatataagtaaaatccctgggggaaatatgtacgcggatgacacagcagggtgggacacccgaattacagaagacgacttgcagaatgaagcaaaaattactgacatcatggagccggaacacgcgctcctcgcgacgtccatattcaaactgacctaccaaaacaaggtagtgagggtccaacgacccgccaagaatggaacggtgatggacgtgatctccagaagagatcaacggggtagcggccaagtgggaacctacgggctaaataccttcaccaacatggaagtgcaactaataagacaaatggaatccgaaggcatcttcttgccaagtgagctagaaacgccgaacctcgcagagagggtactcgactggcttgaaaaacacggcgcagaaaggctgaaacgaatggcaatatcaggggacgactgtgtcgttaaacccatcgacgatcggttcgcgacggcgctgacggccctcaatgatatgggcaaggtccgtaaagacataccacaatgggagccaagcaaagggtggaacgactggcaacaagtcccgttctgcagtcaccacttccaccagcttataatgaaagatggccgcgaaattgtcgtcccatgtcgaaaccaagacgaactcgtggggagagcacgcgtatcacaaggcgccggatggtcgctacgagaaacagcatgcctagggaaaagctacgcgcaaatgtggcaactaatgtatttccacaggcgggacttaagacttgcagcaaacgctatctgctcagccgtgcccgtggactgggtcccgacaagtaggacaacctggtcgatacacgcgcatcaccagtggatgactacggaagacatgcttagcgtttggaacagggtctggatcgaagagaacccctggatggaggataagacacacgtgagcagctgggaagaagtgccgtatttggggaaacgggaagaccaatggtgcggatcattgatagggctgacagcccgggcgacctgggccactaacatacaggtggccataaaccaagtccgaagactcataggcaacgaaaattaccttgattatatgacctcgatgaaaagattcaaaaacgaaagtgacccagaaggggccctatggtga

SEQ ID NO: 24043 - RNA, 9879 nt, synthetic construct
  misc_feature 1..9879: note = derived and/or modified CDS sequence (opt11) from DENV-1__FJ639797__SS-prME
  source 1..9879: mol_type = other RNA
agcgttaccatgctgctcatgctgctgccgaccgcccttgccttccacctgaccactaggggcggggaaccacacatgatagtgagcaaacaggaaaggggcaagtcactactcttcaagaccagcgccggggtgaatatgtgcaccttaattgctatggacttaggtgagctttgcgaggataccatgacgtacaaatgtcctcggatcacagaagctgaacccgacgatgttgactgctggtgtaacgccacagacacgtgggtgacatacgggacctgcagccaaaccggcgaacaccggcgggacaagcggtccgtagctctggcgccacacgtaggccttgggctcgagacgcgcaccgagacctggatgtcgtccgagggcgcctggaagcagatacagcgggtagagacctgggccctgcgtcaccccgggttcactgtgattgccctgttcctcgcgcatgcaatcggtacgagcatcacccagaaggggatcatcttcatcctgcttatgctcgtgaccccctccatggccatgcgatgcgtcggcatcggcaaccgcgattttgtggaagggctcagcggcgccacgtgggtggacgtcgttcttgagcacggatcctgcgtgacgaccatggccaagaacaaacccacgctggatatcgagctgttgaagaccgaggttactaaccctgcggtgctccggaagctgtgcatagaggccaagatcagcaacacaaccacagactcccgctgccctactcagggcgaggcaaccctggtggaggagcaggacgccaacttcgtctgccggcgcacattcgtggaccggggctgggggaacggctgcggactcttcgggaaagggagcctgctgacgtgtgccaagttcaaatgcgtaaccaagctcgagggcaagatcgtacagtacgagaacctgaagtactcggtgattgtgacggtccataccggtgatcagcaccaagtagggaacgagacgaccgagcacggcaccatcgccaccattacgccccaggcccccacctcggaaatacagctgacggactacggggctctcaccctggactgcagccctcggaccggactggacttcaacgaaatggttcttctgacgatgaaagagaagtcctggctagtgcacaagcagtggttcctcgacttgccgctgccctggacatccggtgccagcaccagccaggagacctggaaccggcaggacctcctggtgactttcaagacagcccacgctaagaaacaggaagtcgtagtgctaggctcccaggagggtgccatgcacacagctctcacgggcgccaccgagatccagaccagcggcacgaccacaatcttcgccgggcacttgaagtgccgcctgaagatggacaagctcacactgaaaggcatgtcgtatgtcatgtgcactgggagcttcaagctggagaaagaggtagcggagacccagcacggaacagtcctggtgcaggtaaagtatgagggtacagacgctccatgcaaaatccccttcagtacccaggacgaaaagggggtgactcagaacggccggctcatcacagcgaaccctatcgtcactgacaaggagaaacctgtgaacatcgaaaccgagccgccatttggggagagctacatcgttgtaggcgccggtgaaaaagcgttaaagctgagctggttcaagaagggttcctcgattggcaagatgttcgaggcaaccgctagaggggcaagacgcatggcgatcctcggagacacggcgtgggatttcggaagtatcggaggcgtgttcacaagtgtgggaaagctggtccaccaggtgtttggcaccgcctacggggtgctgttctccggtgtgtcctggacaatgaagatagggatcggcatactactgacgtggctgggcctcaactcaaggtccaccagcctctccatgacctgtattgccgtcggaatggtaaccctctacctcggggtcatggtgcaggcagattcggggtgcgttatcaattggaaaggccgggagctgaagtgcggaagcggcatcttcgtcacgaacgaggtgcacacctggactgagcagtacaagttccaagcagacagtcctaagcgcctgtcagcggctatcggccgagcctgggaagaaggggtgtgcggcatcaggagtgccaccagactagaaaacatcatgtggaagcagatcagcaacgagctaaaccacatcctgctcgagaacgatatgaagttcaccgtcgttgtgggggacgccaatggcatcctggcgcagggcaagaagatgatccgcccacagcctatggaacacaagtactcctggaagtcctggggtaaagccaagatcatcggcgccgacatccagaacacgactttcattatcgacgggcccgataccccggagtgccccgacggccagcgggcctggaacatctgggaggtggaggactacggtttcggtatcttcacaacgaatatctggctaaagctcagagactcctacactcagatgtgcgaccaccggctgatgtctgcggccatcaaggactccaaggccgtgcacgccgacatgggctactggatagagagcgagaagaacgagacctggaagctggccagggcgtccttcatcgaggtgaaaacctgcatctggcccaaaagccataccctctggtccaatggggtcctggagagcgagatgatcatccccaagatctacggtgggcccatctcccagcataactatcggcccggatactttacccagaccgccggcccctggcacctgggcaaactcgagctcgacttcgacttatgcgagggcaccacggtggtggttgacgagcattgtgggaaccgagggccgtctcttcgcaccacaaccgtgactggtaagataatccacgagtggtgctgtcgctcctgcacccttccgccgctaagatttagaggcgaggatggctgctggtacggcatggagatccggcccgtaaaagagaaggaggagaacctcgtccgctcgatggtgagcgccggcagcggggaggtggactctttctctctgggcatcctgtgcgtcagcatcatgatcgaggaggtgatgcggtcccgctggagcaggaaaatgttgatgaccgggacgctggctgtgtttctgttgcttatcatgggccagctgacttggaacgacctcatccggctgtgcatcatggtgggggcgaatgccagcgaccgcatgggcatgggcacaacctatctggcccttatggccactttcaagatgcgtccgatgtttgcagtggggctgctgtttaggcgcctcaccagtcgcgaggtgcttctgctcaccatcggattgtcccttgtggccagcgtagagctccccaattccctggaagaactcggggacggcctcgcgatgggcatcatgatgttgaagctgctcaccgagttccagccccaccaattatggaccacgctgctgagcctgacattcgtcaagaccaccttgtccctcgattacgcctggaagacgaccgccatggtgcttagcatcgtgtctctcttccccctctgcctctccaccacctcacagaagacgacctggctgcctgtcctcctagggagcttcggctgcaagccccttacaatgtttctcatcacagagaataagatctgggggcgaaagtcctggccattaaatgagggcatcatggccatcgggattgtgagtatcctgctatcctccctcttaaagaacgacgtgccgctagcggggccgctgatagctggcgggatgctgatcgcctgctacgtaatcagtggctccagcgccgacctgagcctcgagaaggcagcggaagttagctgggaacaagaggccgaacacagcggggccagtcacaacattctggtggaagtccaagacgacggcaccatgaagataaaggacgaggaacgcgacgacaccctcaccatcctgctgaaggccacgctcctggccgtgtccggcgtgtaccccatgagcatccctgcaaccctcttcgtctggtacttttggcagaagaagaagcagagatccggcgtgctctgggatacgcccagcccgcccgaagttgagagggccgtcctggatgacggtatatacaggatccttcaacgcgggctgctcgggcgatcacaagtgggtgtaggcgtgttccaggatggggtgttccacaccatgtggcacgtgacacgcggtgccgtcctcatgtatcaaggtaagcggctagagcccagctgggcctccgttaagaaagacctcatcagctacggcggcggatggagattccagggttcctggaataccggggaggaagtgcaagtcattgctgtcgagcccggcaagaacccgaagaacgtccaaacgacccccggcaccttcaagacacccgagggggaagtcggggcaatcgccctggacttcaagcccgggacgtcggggtcccccattgtgaaccgggagggaaagatcgtggggctatacggtaacggtgtcgtcaccaccagcggtacctacgtgtccgccatcgcgcaggccaaggcgtcgcaggagggtccactcccggaaatcgaagatgaggtgttcaagaagaggaacttaaccatcatggacctgcaccccggctctggcaagacccggaggtatctgcccgcgatcgtgagagaggccataaagcgcaaacttcgcacccttatcctcgccccgactcgggtggtcgcgtccgagatggctgaggccctgaaagggatgcctatccgataccagactaccgccgtcaagagcgaacacaccggcagggaaatcgtggacttaatgtgccacgccaccttcacgatgcgccttctgagtccggtccgggtgcccaactacaatatgatcatcatggacgaagcgcacttcaccgaccccgccagtatcgccgcacgagggtatatctctacgcgggttggcatgggagaggctgcggccatcttcatgaccgccacgccgcctggctccgtagaggccttccctcaaagtaacgccgtcatacaggacgaggagagggacatccccgagcgtagctggaactccggctatgattggatcaccgacttccccggaaagaccgtttggttcgtcccgtcaatcaagtccggcaacgatatcgcgaactgcctgcgcaaaaacgggaagcgcgtgatccagctatcacgcaagacctttgacacggaataccagaagaccaagaacaacgactgggactacgtggtcaccaccgacatctccgaaatgggagccaattttcgggcagaccgcgtgatcgatccaagacggtgtctaaaacccgtgatactgaaggacggccctgagcgcgtcatactcgccgggcccatgcccgtgacagtcgcgagcgcggcccagcgacggggccgcattgggcgaaatcagaacaaggagggcgatcaatacgtgtacatggggcagcccttaaacaacgacgaggaccacgcccactggacggaggctaaaatgcttctagacaacattaacacccccgagggcatcatcccggcgctgtttgagcctgaacgggaaaagtccgccgccatcgacggcgagtatcgattacgtggcgaggcgcgcaaaaccttcgtagagctcatgcggagaggggacttgccggtctggctgagctataaagtggcctccgaggggttccagtatagcgacaggcgctggtgcttcgacggtgagcggaataaccaggtgctggaggagaacatggacgtcgagatctggaccaaggagggggagcgcaaaaagctgcggccacgatggctggacgcgcggacgtactccgacccgttggccctgcgtgagttcaaggagttcgccgccggccggaggtctgtgtctggcgacttaatcttggagataggtaaactgcctcagcacctgaccctgagagcccagaatgcgctggataaccttgtgatgctccataattctgagcagggcgggaaggcctaccgccacgctatggaagaactgcccgacacaatcgagaccctgatgctcctggccctgatcgcggtactcacaggcggggtgacccttttcttcctgagcggtaagggtttggggaagacctccatcgggctgctgtgcgtgaccgcttcatccgccctcctctggatggccagcgtcgagccacactggatcgccgcctccataatcctagaatttttcctcatggtgctgctcatcccagagcctgaccggcagcgcacgccacaagacaaccagctcgcctacgtagttatagggttactgttcatgatcctgaccgtagccgcgaatgagatgggcctgctagagactaccaagaaagacctcgggatcggctacgtggccgcggagaaccaccagcacgccacgatgctggacgtcgatctgcggccggccagcgcctggaccctctacgcagtcgccaccaccgttatcacgcccatgatgcgccacaccatcgaaaataccactgccaacatctccctgacggcgatcgctaaccaggccgcaatcctgatgggtctagacaaagggtggcccatcagcaagatggacataggcgtccccttgcttgccctcgggtgctacagtcaggtgaacccgctgactctgacagcggcggtattgatgctggtcgctcactatgcgatcatcgggcccgggctgcaggcgaaggccacccgcgaagcccagaagagaaccgcggcgggcatcatgaagaaccccaccgtggatggcatcgtggccattgacctcgaccccgttgtgtacgacgcaaagttcgaaaagcagctgggacagatcatgctgctcatcctgtgcaccagccagatacttctcatgcgtaccacatgggccctgtgcgagtccatcaccttagcgaccggaccgctcaccacgctgtgggaggggagccccggaaagttctggaacactaccatcgccgtctccatggccaatatcttcaggggtagctatctcgcgggggccggcctcgcgttctccttaatgaagtccctagggggcggtcgccgtggcaccggcgcccagggtgagactctcggagagaagtggaagcgccaactgaaccaactgtccaaaagcgagttcaacacctacaaacggagcggcatcatggaggtcgaccgctccgaggccaaggagggcctcaagcgcggcgagactaccaagcatgctgtaagccgtgggacggcgaaacttagatggttcgtcgaaaggaacctggtcaagcctgaaggaaaggtcatcgacctgggctgcggtcgcggcggctggagctactactgcgctgggttgaagaaggtaaccgaagtcaaggggtacacgaagggagggcccggccacgaggaacccatccccatggccacttacgggtggaacctggtgaagctgcacagcggcaaggacgtgttctttatgccgcccgagaagtgcgacaccctcctttgcgatatcggggagagtagcccgaaccccacgatagaagaggggcgtaccctgcgagtcctcaagatggtggaaccctggttaaaggggaaccagttttgcattaagattttgaacccttatatgccgtccgtggtcgagaccctcgagcagatgcagcgcaagcacgggggcatgctagtacggaaccccttaagccgcaactccacgcacgagatgtactgggtgagctgtggtacaggcaatattgtctccgccgtgaatatgaccagccggatgttactcaatcgcttcaccatggcccaccgtaagcccacgtacgagcgggatgtggacctcggcgcaggaacgcggcacgtcgccgtcgagcccgaggtagccaacttagacattatcggccagagaatcgagaacatcaagaacgagcacaagtccacctggcattacgatgaggataacccgtacaagacctgggcgtaccacggaagctacgaggtcaagccatcaggcagcgcctcgagcatggtaaatggtgtcgtccgcctgctgaccaaaccttgggacgtgattcccatggtcacgcagatcgcgatgaccgacactaccccgttcggccaacaacgagtgttcaaggagaaggtggatacgcgcacgcctcgggcgaagcgcggcaccacccagataatggaggttacggcaaagtggctctgggggttcctatcccggaacaagaaaccccgcatttgcacccgggaggagttcaccaggaaagtgcggagcaacgcagccatcggtgcggtgttcgtcgacgagaaccagtggaactcagccaaggaggccgttgaggatgagcgattctgggatctcgtgcaccgggagcgcgagctccataaacaggggaagtgcgcgacctgcgtctacaatatgatggggaagagggagaagaaactcggggagttcggcaaggcgaagggcagtcgcgccatctggtatatgtggctgggcgcgcggttcctcgagttcgaggccctgggtttcatgaatgaggaccactggttcagccgcgagaactccctgtctggggtggagggcgaggggctccacaaactgggctacatcctacgggacatctctaagatcccaggtgggaacatgtacgccgatgacacggctggttgggatacgcgtatcaccgaagacgacttacagaacgaagccaagataactgacatcatggagccggagcacgccctcctcgccacgtctatctttaaactgacgtatcagaataaggtggtgagagtgcagaggccggccaagaacgggaccgtgatggacgtgatctcccggagggatcagcgaggctcgggccaagtggggacctacggcctgaacacattcaccaacatggaggtacagctgatacggcagatggaatccgagggaattttcctccccagtgagctggaaaccccgaatcttgcagagcgtgtcctcgactggcttgagaagcacggggccgagcggctcaagaggatggcaatctccggggacgattgcgtggttaagcctatcgatgaccggtttgccaccgcactcacggctctgaacgacatgggcaaagtacgcaaggacattccacagtgggagccatcgaaaggctggaatgactggcaacaggtgccgttctgctcccaccattttcatcagctaatcatgaaagacgggcgtgagatcgtggtcccctgcagaaaccaagacgagcttgtgggccgcgcccgcgtgagccagggcgctgggtggtccctgcgggagactgcctgcctgggcaagtcgtacgcgcaaatgtggcagttgatgtacttccaccgccgggacctgcgcctggcagccaatgccatctgctcagccgtccccgttgactgggtgcccaccagtcggactacctggagcatccacgcgcaccaccagtggatgaccacagaggatatgctgtccgtttggaaccgcgtttggatcgaggagaatccgtggatggaggacaagacacacgttagctcctgggaggaggtgccctaccttggcaaacgcgaggaccagtggtgcggcagcttaattgggctcacagcccgtgccacgtgggctacaaacatccaggtggccatcaaccaggtcaggagactgatcgggaacgagaactacctggactacatgactagcatgaagcgcttcaaaaatgagagtgaccccgaaggggcgctctggtaa

SEQ ID NO: 24044 - RNA, 9879 nt, synthetic construct
  misc_feature 1..9879: note = derived and/or modified CDS sequence (opt11) from DENV-1__FJ639802__SS-prME
  source 1..9879: mol_type = other RNA
tctgtgaccatgctcttaatgctgctgcccaccgccttggcctttcacctcaccacccgcggcggggagccgcacatgatcgtgagcaagcaagagcggggcaagagccttctgttcaagactagcgccggtgtgaacatgtgcaccctgatcgcaatggacctgggcgagctctgcgaggacaccatgacctacaagtgcccccggatcactgaggccgagcccgacgacgtggactgctggtgcaacgccaccgatacttgggtgacctatggcacctgctcgcagaccggcgaacaccgtcgagacaagcgctcggtggccctggcgccacatgtgggcctggggctcgagacgcgtaccgagacctggatgagctctgagggcgcctggaaacagatccaacgcgtcgagacctgggccctgagacaccccgggttcacggtgatcgccttgttcctcgcgcacgctatcggaacatcaatcacccagaaagggatcatcttcattctgctgatgctcgtcacccccagcatggccatgcggtgcgtcggcatcggcaaccgcgacttcgtagaggggctgagcggtgccacctgggtggatgtcgtgctggaacacggctcctgcgtgaccacaatggccaaaaacaaacccaccctcgacatcgaactgctcaagacggaggtaaccaaccccgcggtgttaagaaagctgtgcatcgaggcaaagatctcgaacaccaccacagactcccgctgccccacccagggcgaggcgacgctagtggaggaacaggacgctaacttcgtctgccgtcgcacctttgtggaccggggctgggggaacggctgcggcctcttcggcaaggggtcgttgctcacgtgcgccaagttcaagtgcgtgaccaagctcgaaggcaagatagtccaatacgagaacctgaagtactctgtaatcgtgacagtgcacaccggcgaccagcaccaagtgggcaacgagacgaccgaacacggcaccattgcgacaatcacgccccaggccccgacgtcagagatccagctgaccgactacggggccttaaccctggattgcagcccccggactggcttggatttcaacgagatggtcctcctgacaatgaaggagaagtcctggttggtacacaagcagtggttcctcgatctgccgctgccgtggacatcaggggccagcaccagccaggagacctggaacaggcaggacctcctggtgaccttcaagaccgcacacgcgaaaaaacaggaagtcgtggtgctgggctcacaggagggcgccatgcacaccgccctcactggtgctacggagatccagaccagcggcaccaccaccatcttcgccggccacctgaagtgccgcctcaagatggacaagttaacactgaagggcatgtcctacgttatgtgcaccgggagcttcaagctggagaaggaggtcgcggagacccagcacggcactgtgttagtccaggtgaagtacgagggcaccgacgctccgtgcaagatccccttctccacgcaagacgagaagggggtgactcagaacggcaggttaatcacggcaaaccctatcgtcactgacaaggagaagcccgtgaatatcgagaccgagccgcccttcggggagtcatacatcgtggtcggcgcgggcgagaaggctttgaagctgtcctggttcaagaaaggcagctccatagggaagatgttcgaggccaccgcccgcggggcccggcgcatggcaatcctcggcgatactgcgtgggacttcgggtccatcggcggcgtgttcacatccgtggggaagctggtgcaccaagtgttcggcaccgcctacggtgtcctgttcagtggggtctcctggaccatgaagatcggcatcggcatcctcctgacgtggctgggtctcaacagccgctccaccagcctgtcaatgacctgcatcgccgtggggatggtgacactgtatctcggcgtcatggtccaggccgacagcgggtgcgtgataaactggaagggccgggagctcaagtgcgggtctggcatcttcgtcacgaacgaggtgcacacctggactgagcagtaccgcttccaggctgacagccccaagcggctcagcgcggccatcggaaaggcttgggaggaaggggtgtgcggcatccgctccgccaccagactcgagaacatcatgtggaagcaaatcagcaacgagctgaaccacatcctgcttgaaaacgacatgaagttcaccgtcgtcgtgggggacgccaacggcatacttgctcaggggaaaaagatgatccggcctcagcccatggagcacaagtactcctggaagtcctggggaaaagccaagatcatcggcgccgacatccagaacacaaccttcatcatcgacgggcccgataccccggagtgcccagacggccagcgggcttggaacatatgggaggtcgaggactacgggttcggcatctttaccacgaacatctggctgaagctccgcgactcttacacccagatgtgcgatcaccggctgatgagcgctgccatcaaagactccaaggccgtacatgccgacatgggatactggatagagagcgagaagaacgagacgtggaagctggctcgcgcgtccttcatcgaggtgaaaacgtgcatctggcccaaaagccacacgctctggtccaacggggtcctggagagcgagatgatcatccccaaaatttacggcgggccgatatcacagcacaactaccggcccggctacttcacccagacagccgggccctggcacctgggcaagctcgagctggatttcgacctgtgcgaaggaacgactgtggtggtggacgagcactgcgggaacaggggcccgagcctgcggacaaccacagtgacgggtaagatcatccacgaatggtgctgccgctcttgcaccctgccgcccttacggttccgcggcgaggacgggtgctggtacggcatggagatccggccagtcaaggagaaggaggagaacctcgtcagaagcatggtgtccgcgggcagcggtgaggtcgatagcttctccctgggcatcctgtgcgtcagcatcatgatcgaggaggtgatgcggtcccgatggagccggaagatgctcatgaccggtaccctggcggtgttcctgctcctgatcatgggccagctgacgtggaacgacctaattcggctgtgcatcatggttggagccaatgcgtcagaccgcatgggcatgggcaccacctacctggccctcatggcgacctttaaaatgcggccgatgttcgccgtggggctgctgttccgccggctcacgagcagagaggtgctgctgctgaccatcggcctgtccctggtcgcgagtgtggagctccccaactccctggaggagttgggggacggcctcgctatgggcataatgatgctgaagctgctcaccgaatttcagccccaccagctgtggaccacgctgctcagcctgacattcgtcaagaccaccctgtccctagactacgcctggaaaacgaccgcaatggtgctgagcatcgtgtccctgttccccctttgtctgtcaaccacgtcacagaagacgacctggctgccggtcctccttgggagcttcggctgcaagccgcttactatgttcctcatcacagagaacaagatatggggacggaagtcctggcccctgaacgagggcatcatggctatcggcatcgtaagtatcctcctctctagcctgctgaagaacgacgtgcctctcgcgggcccgctgatcgcaggagggatgttaatagcatgctacgtcatcagcggctcctcagccgacttgtccctggagaaggccgcggaggtgagctgggagcaggaggccgagcattccggggcaagccacaacatcttagtggaggtccaggacgacgggacaatgaagatcaaggacgaggagcgcgacgacacgctcacaatcctgctgaaggcaacactcttagctgtctccggggtgtaccccatgagcatccccgctaccctgttcgtctggtacttctggcagaagaagaagcagcgctccggcgtgctctgggacactcccagcccgcccgaagtggagcgcgccgtcctggacgacggcatctacaggatcttacagcgcgggctgctcggcagatcccaggtgggcgtgggcgtcttccaggacggggtgttccacaccatgtggcacgtgacccgcggcgccgtcctaatgtaccaaggcaagcggctggaacccagctgggcctccgtgaagaaggacctgatttcctacggtggcggctggcgcttccaaggctcctggaacaccggggaggaggtacaggtcatcgccgtagagccaggcaaaaacccgaagaacgtgcagaccacccccggcaccttcaagacccccgagggggaggtcggcgcgatcgcactagacttcaaacccggcacgagcggctccccgatcgtaaatcgggagggcaagatagtcgggttgtacggcaacggggtagtgaccacgagcggcacctacgtgtccgccatcgctcaggccaaggcgagccaggaggggcccttacccgagatcgaggacgaggtcttcaaaaagcgcaacttaacgataatggatcttcacccaggctcgggcaagacccgtcgctacctccccgccatcgtgcgggaggccatcaagcggaagctgcgcaccctaattctcgcccccacccgggtggtcgcgtccgagatggccgaggcgctgaaggggatgcccatcaggtaccaaacgaccgccgtcaagagcgagcacacgggcagagagatcgtggacctgatgtgccacgccaccttcacaatgagactcttgagcccggtccgggtgccgaattacaacatgattatcatggacgaggcgcatttcaccgaccccgccagcattgctgctcgcgggtacatatccacccgggtgggcatgggcgaggccgcggccatcttcatgaccgccacgccccccggcagcgtcgaggcctttcctcaatccaacgctgtgatacaggacgaggagcgcgacatccccgagcggagctggaattccggctacgactggatcaccgacttccccgggaagacggtgtggttcgtcccgtcaatcaagagtggcaatgacatcgccaactgcctccggaagaacgggaagcgggtgatccagttaagccgcaaaaccttcgacacggagtaccagaagaccaaaaacaacgactgggactacgtggttaccaccgacatctccgaaatgggcgccaatttccgggccgaccgagtaattgaccccaggcggtgcctgaagcccgtgatactgaaggacgggcccgaaagggtcatcctcgccggcccgatgcccgtgacggtcgcgagtgcagcccagagacgggggcgcattggccgcaaccagaacaaagagggcgaccagtacgtgtatatggggcagcccttgaacaacgacgaggaccacgctcactggaccgaggccaagatgctgctcgacaacataaacacccccgagggcataatacccgcgttgttcgaacctgagcgggagaagtctgccgccatcgacggggagtatcgccttcggggcgaggcccgaaaaacctttgtggaactaatgcgccgcggggacctgccggtctggctgtcttacaaggtggcctccgaggggttccagtacagcgaccggcgctggtgcttcgacggcgaacggaacaaccaagtgctcgaggagaacatggacgtcgaaatctggacgaaggagggggaacgcaagaagctgcggccccgctggctggacgcgcggacctactccgacccgctagccctgcgcgagttcaaggaattcgccgccggtcggcggagcgtgagcggcgacctgatcttagaaatagggaagctgcctcaacacctgaccctccgggcccagaacgcgctggacaaccttgtaatgctccacaattccgaacagggagggaaggcctaccgccacgccatggaagagcttcccgacacaatcgagaccctgatgctcctggctttaatcgcggtcctcactggcggtgtgacgttattcttcttaagcggcaagggactcgggaaaacttccatcggcctgctgtgcgtgaccgcctcttccgccttgctttggatggccagcgtggagccccattggatcgccgcgagtatcatcctggagttcttcctcatggtgctgcttatcccggagcctgaccggcagcgcacgccccaggacaaccaactcgcctacgtggtcatcgggctgctattcatgatcctcaccgtcgccgccaacgagatgggcctgctggagaccaccaagaaggacctcgggatcggctatgtggccgcagagaaccaccagcacgccacgatgctggacgtcgacctgcggccggcctcggcctggacgctctacgccgtggctaccacagtgatcacgcctatgatgcggcacaccatcgagaacaccaccgccaacatctccctgacggccattgccaaccaggcagcgatcctgatgggcctcgacaaggggtggcccataagcaaaatggacatcggcgtacccctgctggccctcgggtgctactcccaggtgaacccgttgaccctgaccgccgccgtgttaatgctggtcgctcactacgcaatcatcggaccggggttacaggccaaggccacgagagaggctcagaagcgaacggcggccggcatcatgaagaaccccaccgtggatggtatagtggcaatagacctcgaccccgtcgtgtacgacgccaagttcgaaaagcagctggggcagattatgttacttatcctgtgcaccagccaaatcctcctcatgcgcaccacgtgggctctgtgcgagtctattaccctggcgaccggcccactcactacgctctgggaagggtcgcccggcaagttttggaacaccaccatcgccgtgtccatggccaacattttccggggcagctacctggccggggccggcctcgcgttctctctgatgaaatccctcgggggtgggcgtcgggggaccggtgcgcagggggagacgctcggcgagaaatggaagcggcagctgaaccagctgtccaagagtgaattcaacacctacaaacggagcggaatcatggaggtcgaccgctccgaggccaaggagggcctcaagcgaggtgagaccaccaagcacgcagttagccgcggcaccgcgaagctgcgctggttcgtcgagcgcaatctcgtcaaacccgagggcaaggtcatcgacctggggtgcgggcgcggcgggtggtcctactattgtgccggcctcaagaaagtgaccgaggtcaaggggtacaccaaggggggccctggacatgaggagccgatcccaatggccacctacgggtggaacctggtgaagcttcactcaggcaaggatgtgttcttcatgccacctgagaagtgcgacaccctcctgtgtgacataggggagtccagtcccaaccccacgatagaggagggcagaacgctgcgggtcttgaagatggttgagccttggctgaagggcaaccagttctgcatcaagatcctgaacccctacatgccgtccgtggtagagacactcgagcaaatgcaacgcaagcatgggggaatgctggtccggaatcccttaagccgcaactccacccacgagatgtactgggtgagctgcgggacgggcaacatcgttagtgccgtgaacatgaccagccgaatgctcttaaaccgctttaccatggcccaccgtaagcctacttacgagcgggacgtggacctgggcgcgggtacgcgccacgtcgctgtggagcccgaggttgccaacctcgacatcatcggccagcggatcgagaacatcaaaaacgagcacaagagcacctggcactatgacgaggacaacccgtataagacctgggcctaccacgggagctacgaggtcaagccctccggcagcgcctcaagcatggtgaacggggtcgtgcgcctgctgactaagccctgggacgtgatccccatggtcacgcagatcgcgatgaccgacacaaccccgttcgggcagcagcgggtgtttaaggagaaggtggacacgcgcacgccccgggcaaagcgcggcaccacccagatcatggaagtcacggccaagtggctctgggggttcctgtcccggaacaagaagccccgcatctgtacccgggaggagttcactcgcaaggtgcggagcaacgccgctattggagcagtgttcgtcgatgagaaccagtggaatagcgccaaggaggccgtggaggacgagagattctgggacctggtgcaccgcgaacgcgagctccacaaacaaggtaagtgcgcgacctgcgtgtacaacatgatgggcaagcgagagaagaagctgggggagtttggcaaggcgaagggcagccgggccatctggtatatgtggctgggggcccggttcctcgagttcgaggcactgggcttcatgaacgaagaccactggttcagccgtgagaactccctgagtggggtagagggtgaggggctccataagctagggtacatcctgcgggacatttccaagataccgggcgggaacatgtacgccgacgacacggcgggctgggatactaggatcaccgaggacgacctccagaatgaagccaagatcaccgacatcatggagcccgagcacgccctgctggccacgagcatctttaagctcacctaccaaaacaaggtcgtccgcgtgcagcggcccgccaagaacgggacagtaatggacgtcatatcccgtcgtgaccagcgcggcagcggtcaggtggggacctatggcctcaacacgtttaccaacatggaggtgcagctgatccggcagatggagtccgaggggatcttcctccccagtgagctggagacgccgaacctggcggagcgcgtcctcgactggctggagaagcacggcgccgagaggttaaagcgaatggccatctccggagacgattgcgtggtgaaacccatcgacgaccggttcgccaccgccctcacggcgctgaacgacatgggcaaggtccgcaaggacataccccagtgggagcccagcaaaggctggaacgactggcagcaggtcccgttctgttcccaccacttccatcagctgatcatgaaggacgggcgggaaatcgtagtcccttgccgcaaccaggacgagctcgtgggccgggcccgcgtgagtcagggggcgggctggagcctgcgggaaaccgcctgcctgggtaagagttacgcccagatgtggcagctcatgtacttccaccgccgagacctgcgcttagcggccaacgccatctgctccgccgtccccgtggactgggtgcccaccagccggaccacatggagtatccacgcgcaccaccagtggatgacaacggaagacatgctctccgtctggaaccgcgtatggatcgaggaaaacccgtggatggaggacaaaacccacgtgagcagttgggaggaagtaccctacctgggcaagcgtgaggaccaatggtgcgggagcttgatcgggttgaccgcccgggccacttgggccacgaacatccaggtggcaatcaaccaggtgcgccgactgatcggcaacgagaactacctggactatatgacctccatgaagcgcttcaagaacgagtccgaccccgagggcgcgctctggtga

SEQ ID NO: 24045 - RNA, 9879 nt, synthetic construct
  misc_feature 1..9879: note = derived and/or modified CDS sequence (opt11) from DENV-1__JN819410__SS-prME
  source 1..9879: mol_type = other RNA
tccgtgaccatgctcttgatgctgctccctaccgccctcgcattccaccttacaacgcgcggcggggaaccacatatgatagtgtccaaacaagaacgggggaaatcattactattcaaaacctcagccggagtgaacatgtgtacgctgatcgctatggacttaggagaattatgcgaagatacaatgacatacaaatgtccaagaattactgaagcggaaccagatgacgtagactgttggtgtaacgcaaccgatacctgggtcacttacgggacgtgctcacaaaccggagaacacagaagagaaaaacgcagtgtcgcactggcgcctcatgtggggctcggattagaaaccaggactgaaacatggatgtcaagcgagggcgcatggaaacaaatacaaagagtggagacttgggcactgagacaccccggttttaccgtcatagcattctttctagcacacgccattggaacctcaatcacgcaaaaaggaatcatattcatactgttaatgttggtcacgccgtcaatggcaatgaggtgtgttggaataggaaatcgggacttcgtagagggtctgagcggagctacctgggtcgatgtcgtcctggagcacggctcatgtgttacaacaatggccaaaaacaaacccacgctcgacatagagctactaaaaacggaagtcactaacccagcagtattaagaaaactgtgtatagaggcgaaaataagtaacactaccaccgactcgcgatgtcccacacaaggagaggcgaccctcgtagaggagcaagacgcaaactttgtatgtcggagaactctagtagatcggggctggggcaatggatgcggactcttcgggaaaggtaacctcttaacgtgtgcaaaattcaaatgcgtgacaaaactggaagggaagatcgttcaatatgaaaacttaaagtacagcgtgatagtcacagtccacacaggcgaccaacaccaagtcgggaacgaaaccactgaacatggcacaatagcgaccataaccccgcaagctcccactagcgaaattcaacttacagactacggcgcgcttacactcgactgctcaccacgtacgggcctcgacttcaacgaaatggtgctgttgacaatgaaagaaaaatcctggctggtgcataaacagtggttcctagacctccccctaccgtggacatcaggagccagcacatctcaagaaacctggaacagacaggacctcttagtaacattcaaaacggcacatgccaagaaacaagaggtagtcgttctcggcagccaagaaggagccatgcatacagctctaaccggcgcaactgagatacagacctccggaacaacaacaatattcgcaggccacttaaaatgccggctaaaaatggacaaactaaccctgaaaggaatgtcctacgtgatgtgcacaggtagcttcaaactcgaaaaagaagtggccgagacccagcacggaacagttctggtccaagtcaaatacgagggcacagacgcgccttgcaaaatccccttctcgacccaagatgaaaaaggcgtcactcaaaacggaaggctaatcacggcgaaccccattgtaaccgacaaggaaaaacctgtgaatatcgagaccgagccacccttcggagagtcctacatagtggtcggcgcaggcgaaaaggcactcaaactatcgtggtttaaacgtggcagttccataggaaaaatgtttgaagcaacggccagaggcgcaagacgtatggccatacttggggacaccgcatgggatttcggatccataggaggggtctttacatccgtcgggaaattagtgcaccaggtgttcggcactgcatacggcgtactattctccggtgtgtcctggacaatgaaaattggaataggcatcttgctcacgtggctgggcctgaactcacgatcaacctccctctccatgacgtgcatagcggtcggcatggtaacgctgtatctcggtgtcatggtccaagcagactcgggctgcgtgatcaattggaagggcagggaacttaaatgtggctccggaattttcgtaaccaacgaggtccacacatggacggagcagtacaagttccaagcagacagcccaaaaaggcttagcgcagcaatcggaaaggcatgggaagaaggagtttgtgggattcggtcggccacacggctcgaaaacataatgtggaagcaaataagcaacgagcttaaccacatacttctagagaacgacatgaagttcaccgtcgtagtgggtgatgcgaatggaatactagcacaggggaagaaaatgataagaccccagcctatggaacacaagtactcgtggaaatcctgggggaaagcaaagataataggagcagacatccaaaatacgacattcattattgacggccccgatacgccggagtgccccgatggacaacgtgcatggaacatctgggaagttgaagactacggcttcggcgtcttcacgacgaacatctggctaaaactacgtgattcttacacacagatgtgcgaccacagactaatgagtgcagccatcaaggactccaaggccgtacatgcagatatgggatattggatcgaatcggagaaaaacgaaacctggaagctggcgcgcgccagcttcatcgaagtaaagacatgcacctggcccaagagccataccctgtggagcaacggggttctggagagcgagatgatcattccaaaaatctacggagggccgatctcccaacataattaccgaccgggatatttcacacagacggccggaccgtggcacctaggcaaactggagctggacttcgacctgtgcgagggaacgacggtcgttgtagacgaacattgcggcaatcgcggtccaagcctccggacaacaaccgtgacgggaaagataatccacgaatggtgctgccgatcctgcacgttacctcctctccgattcagaggggaagacggctgctggtacggaatggaaatccggccggtcaaagaaaaagaagagaacctggtaaggagtatggtctcagcagggagcggggaggtcgatagtttcagtctgggaatactctgcgtatcgataatgatagaagaagtaatgagaagtcggtggagtcgcaaaatgcttatgaccggaacgctagcagtcttcttactcctgatcatgggccagctaacatggaacgatttgatccgtctctgcatcatggtaggggcgaacgcatcggatcgaatgggaatggggacaacctacctagcgttaatggctaccttcaaaatgaggccaatgttcgcagtcggcctcttatttcgccgcctgacgtccagagaggtcttactactgaccataggtctatctctagttgcaagcgtcgaacttcccaactcgctagaggagttaggcgacgggttagcaatgggaatcatgatgttaaaactactgacggagttccaaccacaccagctctggaccaccctgttatcactaacatttatcaagacaacactgagccttgactatgcctggaaaaccacggcgatggttcttagcatagtctccctgttcccgttatgcctctccacaacaagccagaaaacaacttggctacccgtcctactgggctcgttcgggtgcaaaccactaacaatgtttctaataaccgagaacaaaatctggggccgaaaaagctggcccttaaatgaaggaataatggcaatcggcatagtgagcatacttctatcgtctcttctcaaaaacgacgtccctctcgccggtccattaatcgccgggggaatgctcatagcatgctacgtaatttcaggcagcagtgcggacctcagcctagagaaagccgcagaggtgagctgggaacaggaagccgaacactctggagccagccacaatatattggtagaggtacaagatgatgggaccatgaagatcaaagatgaagaacgagacgacactctaacaattctcctgaaagctaccttactggcggtatctggggtctatccaatgtcgattccagcaacactattcgtctggtatttctggcagaagaagaaacaacgaagcggcgtattgtgggacacaccttcaccacccgaagtggaaagagccgtactggatgacgggatatacagaatacttcagcggggtctactaggtcgctcccaggtaggggtgggtgtttttcaagatggagtctttcacacaatgtggcacgtaactagaggagcggtcctcatgtaccagggcaaacgcctggagccctcgtgggcatccgtaaagaaggacttgatatcctacggagggggatggcgattccaaggcagctggaacaccggcgaggaggtacaggtgatagcagtcgaaccgggcaagaacccgaaaaacgttcaaacaacacccggcacctttaaaaccccagaaggcgaggtcggagccatagcgctcgattttaaacctggtacgtctggcagtcccattgttaacagggagggaaagatagtaggactctacgggaacggtgtagtcacaacttcaggaacttacgtcagcgcaatcgcccaggctaaagccagccaagaagggccactaccggaaatcgaggatgaagtcttcaagaaaaggaacctaacgatcatggaccttcacccggggagcgggaaaacgcggcgatacctgcccgcaatagtaagagaggcaattaaacggaaactacgaaccctcatattagcccctacccgcgtcgtcgcatcggaaatggcagaagcgctcaaggggatgccgataaggtatcaaaccacagcagtaaaatcggaacacactggtagagaaatagtcgacctaatgtgccatgccactttcacgatgcgactactatcccccgtgagggttccaaattataacatgattataatggacgaagcccactttaccgacccagccagcatcgccgcacgaggctacattagcacacgggtaggcatgggggaggctgctgcgatattcatgacagcgacgccccctggcagcgtagaggcattcccccaaagtaatgctgtaatccaggacgaagaacgcgatataccagaacgtagttggaactccgggtacgactggataaccgacttccctggaaagacagtatggtttgtccccagcattaagtcaggcaacgacatagcaaactgcctaaggaagaatggcaagagagtaatacagctctcccgcaaaacattcgacacagaataccagaaaaccaaaaacaacgactgggactacgtggtaaccaccgacatatccgagatgggggcaaattttcgtgcagatagggtaatagaccccagaaggtgcctaaagcccgtaatactcaaagatggaccagagagggtaatactagcgggcccaatgccagtcacagtggcatctgccgcacaaagaagaggaaggatcggaagaaatcaaaacaaggaaggagaccaatacgtatacatgggtcagccgctaaataacgacgaagaccatgcccactggacagaggccaagatgcttctcgacaacattaacaccccagagggcatcatccctgctctcttcgaacctgaaagggagaaatccgcagcaatagacggggaataccgcctccgcggagaagcgaggaaaacgtttgtggaactgatgcgccgcggagaccttcccgtatggctcagctataaagtagcctcagaaggcttccaatactccgaccggagatggtgcttcgatggcgaacgcaacaaccaagtgctcgaagaaaacatggatgtcgaaatctggacgaaagagggcgaaaggaagaaactaaggccacgttggctagatgcgcgcacatacagtgaccccctggccctccgagagttcaaggagttcgcagcgggacggcgaagtgtcagcggcgatctcatattggaaatcggcaagctaccgcaacatctgacgcttcgtgcccagaacgcacttgacaatctcgtaatgttacacaactcagaacagggtggcaaggcctacaggcacgccatggaagaactcccggacaccatcgaaacactaatgttattagcccttatagcagtactaacgggcggagtcacactcttctttctgtcggggaagggattggggaaaacatcgattgggctgctatgcgtcaccgcaagcagcgcactactttggatggctagcgtcgagccacactggatagcagcgagcataatacttgagttcttcctgatggtgctccttattccagaaccggaccgccaacgcacaccacaggacaaccagctagcctatgtggtcatcggcctattattcatgatactcacggttgctgccaacgaaatggggttgctcgagacaaccaagaaggacctcggtatcggctacgttgcggcggaaaatcaccaacatgcaactatgctggatgtagatctgcacccagcctcagcctggacactgtacgccgtagcaacgacagtaatcaccccaatgatgcggcacacaatagaaaacactactgcgaacattagtctaacagcgatcgcgaaccaagccgcgatacttatgggcttagacaaaggctggcccatctcaaaaatggacataggcgtcccactactagccctcggctgctacagtcaagtgaatcccctgaccctaacggccgcggtactcatgctagtcgcacactatgcgataataggtcccgggttacaggcgaaagctacaagagaggcgcaaaaacgcacagccgcaggaataatgaaaaacccgactgtcgatggcattgtcgctattgatctagatccagtagtgtacgacgcaaagtttgagaagcaactgggccaaataatgctactaatactatgcacctcgcagatcctgctgatgcgaaccacgtgggccctatgcgaaagtatcactctagcgacgggccccttgaccaccctctgggaagggagccccgggaaattttggaacacgacaatcgcagtgagcatggccaacatatttcgcggaagctacctcgcaggagccgggcttgcgttcagcctcatgaaaagtctagggggtggccgtcgcggaacgggagcccaaggagagacactgggggaaaaatggaagcgccaactaaaccagctctcaaaatcagagtttaacacgtacaagcggtcgggcatcatggaagttgaccggtcagaagctaaggaaggactgaagcggggtgagactacaaaacacgccgtgtctcgaggcaccgccaaactccgctggttcgtcgaaagaaacttggttaaaccggaaggcaaagtgatagacttaggctgcggccgcggaggatggtcgtattactgcgctggtttgaaaaaggtaacggaggtgaaaggctacaccaagggcgggccaggccatgaggagcctattccgatggcaacctacggttggaacctggtgaaactacactccggaaaggacgtcttctttatgcccccagagaaatgtgatacactcctatgcgacattggggaaagctcgcctaatccaacgatcgaagaaggacggaccttacgggtattaaagatggtagaaccgtggctgcgggggaatcaattctgcatcaaaatcctgaacccttacatgccatcagtcgtcgagaccttagagcaaatgcaacgtaagcatggagggatgctagtgcggaaccccctcagcaggaacagcacgcatgaaatgtactgggtctcgtgtggaacgggaaacatagtctcagccgtgaacatgacctcacggatgctcctgaaccggttcaccatggcgcatagaaagccaacctacgaaagagatgtggacctcggcgccggcacgcgacacgttgcagtggaaccggaggtcgcaaacctagatattatcgggcagcgtatcgagaatataaagaatgaacacaagagcacctggcattacgacgaagacaacccgtacaaaacctgggcctatcacggatcatatgaagtcaaaccatcgggcagtgcaagcagtatggtgaacggcgtagtacgcctactaacaaagccatgggacgtcatacccatggtgacacaaatagcaatgacagacaccaccccgtttggacaacagcgagtcttcaaagaaaaggtcgacacccggacaccccgagctaaaaggggcaccacccaaattatggaagtgaccgccaagtggctctggggtttcctgtcgagaaacaagaaaccgcgtatttgcacaagggaagagttcacccgcaaggtacgctcaaacgccgcaatcggagctgtcttcgtggacgaaaaccagtggaactcagcaaaagaagcagtagaggacgagcggttctgggacctggtccaccgtgaacgagagctccacaaacaggggaagtgcgcaacctgcgtatacaatatgatgggcaaacgagagaagaaactgggcgagttcggcaaggcaaaaggcagccgagcgatatggtacatgtggctcggggcacgcttcctagaatttgaggcactgggttttatgaacgaagaccactggtttagccgggaaaattccctaagcggagtcgaaggagaagggctccataaactaggatatatcctccgcgatatttccaaaataccaggcgggaacatgtacgcggacgacacggcaggatgggatacgcgaatcacggaggacgatctacagaatgaagccaaaatcacagatattatggagcctgagcacgcactgctcgcaacgagtatattcaagctgacataccaaaacaaggtcgtccgcgtccagcggccagccaaaaacggcacagtaatggacgtgatcagtcgtcgcgaccaacggggctcgggccaagttggcacatatggattgaatacgttcaccaacatggaagtacaactcataagacaaatggagtctgaaggcatcttcttaccatccgagctagaaacaccaaacctggcagaacgagcgctggactggttggagaaacatggcgcagagcgtctcaaacggatggcaataagcggagacgattgcgtggtgaaaccgatcgacgatcgattcgccacggccctaacagcgttaaatgacatgggcaaggtacgtaaggacatcccccaatgggaacctagtaagggttggaatgactggcaacaggtcccgttttgctcgcaccacttccaccagctgataatgaaagacgggagagagatcgtggtaccgtgcaggaatcaagacgaactcgttggaagggcgcgcgtgtcccaaggagctggctggagtctaagagaaaccgcgtgcctgggtaaaagctacgcccaaatgtggcagctaatgtacttccatagaagagatttacgtctcgccgcaaacgctatatgcagcgccgtacccgtcgattgggtcccgacctcaagaactacttggagcatacacgcgcaccaccagtggatgaccaccgaagacatgctaagcgtttggaaccgggtgtggatcgaagaaaacccatggatggaagataagacccacgtcagcagctgggaggaagtaccgtatctaggcaagagagaagaccagtggtgcggctctctcatagggctaaccgcgagggcgacatgggcaaccaacatacaggtagctataaaccaggtccgacgtttgattggcaatgaaaactacctcgactacatgacatctatgaagaggtttaaaaatgagagcgatcccgaaggtgccctgtggtaa

SEQ ID NO: 24046 - RNA, 9879 nt, synthetic construct
  misc_feature 1..9879: note = derived and/or modified CDS sequence (opt11) from DENV-1__FJ639806__SS-prME
  source 1..9879: mol_type = other RNA
agcgttaccatgctgctcatgcttttgcctaccgccctcgcctttcatctgaccacacgcgggggggaaccccacatgattgtgtcgaagcaagaaaggggcaaaagcctgttgtttaagacctccgccggggtaaacatgtgcaccctgatcgccatggacctgggcgagttatgcgaagataccatgacctacaagtgcccccgaatcaccgaagcagagcccgacgatgtggactgctggtgcaacgccactgacacttgggtgacctacggtacgtgcagccagactggcgagcaccggcgcgacaagcgatccgtggccctcgcgccccacgttggcttaggcctggagacgcgcaccgagacctggatgagctccgagggagcgtggaagcaaatccagagagtagagacctgggctctgaggcacccgggcttcacggtaatcgctcttttcctagcgcacgccatcggcacgtcgattacccagaagggtatcattttcatcctgcttatgctcgtgactccgtcgatggccatgcggtgcgtcggcatagggaatcgcgatttcgtggagggactgtctggcgctacgtgggtggacgttgtactggaacacggatcgtgcgtaaccaccatggccaagaataagcccaccttggacatcgaattactgaagactgaggtcaccaaccccgcggtcttacggaagctgtgtatcgaggccaagatcagcaacacgaccacggattcccgctgtcccacccagggcgaagccaccctggtagaggagcaggacgctaatttcgtctgccgtcgcactttcgtggaccggggctgggggaacggctgcggcctttttggaaaggggtctctcctaacctgcgccaaattcaagtgcgtgaccaagctcgagggaaagattgtccagtacgagaacctgaagtactcagttattgtgactgtccatacaggagatcaacaccaggtagggaacgagacgaccgagcatggcaccatcgcgaccatcactccccaggcacccacgagcgagatccagttgaccgactacggagcccttacccttgactgctcgccccggactggcctggactttaacgagatggtactcctgacgatgaaggagaaatcctggctggtccataagcagtggttcctcgaccttcctctgccctggacctccggggccagcacctcgcaggagacttggaatcggcaggacctactggtgacgttcaaaaccgcgcatgctaagaagcaggaggtggtggttctgggctcccaggagggcgccatgcataccgcacttaccggcgctactgagatccaaacctcaggaaccacgacgatcttcgccgggcacctgaagtgtcgcttgaagatggacaaactgaccctcaaaggcatgtcctacgtcatgtgcacgggcagcttcaagctagaaaaggaggttgcggagacccagcacgggactgtgttggtccaggtaaagtacgagggaaccgatgccccatgcaaaatcccgttctctacccaggacgagaaaggcgtgacccaaaacggcaggctaatcacggcaaatccgatcgtaaccgacaaggaaaagcccgtgaacatcgaaaccgagccgcccttcggcgagagctatatcgtggtaggcgctggcgagaaagcgctgaagctatcctggttcaagaaggggagctccatcggcaaaatgttcgaagccactgcacgcggcgcccgccgcatggcaatccttggcgacacggcgtgggattttggtagcatcggcggcgtctttacctccgtgggcaagctggttcatcaagtgttcggcaccgcctacggggtgctgttcagcggtgtcagttggaccatgaagatcgggatcggcattctcctgacgtggctgggcctcaatagcaggagcaccagcctgagtatgacctgcattgccgtggggatggtgacgctgtacctcggcgtcatggttcaggccgatagcgggtgtgtgatcaattggaagggccgggaattaaaatgcgggtccggcatcttcgtcaccaatgaagtgcacacctggaccgaacagtacaagttccaggccgactcgccgaaacgcctgtccgccgctatcggccgggcctgggaggaaggagtatgcggaatccgctccgccacccggctcgagaacatcatgtggaaacagataagcaacgagttgaaccacatcctccttgagaacgatatgaaattcaccgtcgtggtgggggacgccaacggaatcttggcgcaggggaagaagatgatccgcccacaacccatggagcacaagtattcctggaaatcctggggcaaggccaaaatcatcggcgccgatattcagaacacaacattcatcatcgacgggccggacactccggagtgccctgatggacagcgggcctggaacatctgggaggtcgaagactacggattcggcatcttcacgacgaacatatggctgaagctcagagactcctacacccagatgtgcgaccatcggctaatgtccgcggccatcaaggactcaaaagctgtgcacgccgacatgggctactggatcgagtccgagaagaacgagacatggaagctggcccgcgcgagcttcattgaggtcaaaacctgcatctggcccaagtcgcacacgctctggtctaatggggtcctcgagtcagagatgatcatccctaaaatatatggcgggccaatctcacagcataactatcggcccggctacttcacacagacggctgggccctggcacctgggcaaactcgaactagacttcgatttgtgcgagggtacaaccgtggtggtagacgagcactgcgggaaccgcggcccgagcctccggaccaccactgttacgggtaagatcattcacgagtggtgctgtcgcagctgcaccctgccacccctgaggtttcgcggcgaggatgggtgctggtacggcatggagatccggccagtcaaggagaaggaggagaacctcgttcgctcaatggtatcggccggcagcggagaggtcgacagcttctccctggggatcctttgtgtcagtatcatgatcgaggaagtgatgcggtcccgctggagccgcaagatgctcatgaccggaactctggccgtgtttctactcctgatcatggggcagctgacctggaatgaccttattcggctttgcatcatggtcggagccaatgcgagcgatcgcatgggcatgggcaccacctacttggccctcatggccactttcaagatgcggccgatgttcgccgtgggcctgctgtttcgtcgcctcacgagccgcgaggtgctcttgctcaccatcggcctgtcactggtagccagcgtggaactccccaactcactggaggagctgggggacggcctcgcgatgggcatcatgatgctgaagctgttgacagaattccagccccatcagctgtggaccacgttactctctctgaccttcgttaagaccaccctgtcgctcgactacgcttggaagacgaccgcgatggtcctgtctatcgtgtccctgttccctctctgcctgagcaccacatctcagaagacaacctggctaccggtccttcttggtagtttcggctgcaagcccttaaccatgttccttattacagagaacaagatctgggggcgtaaaagctggccgctgaacgagggcatcatggccatagggatagtgagcatcctgcttagcagcctgctcaagaacgacgttcctctcgcagggccgttgatcgccggcgggatgctgatcgcctgctacgtcatcagcggctcaagcgcagacctctcccttgaaaaggccgcggaagtgagctgggagcaagaagccgagcacagcggggccagccacaatatcctcgtggaggtgcaggatgatggcaccatgaaaatcaaggacgaggaacgcgacgacacgctgacaatcctgctcaaggccacgctcttagccgtgtccggggtgtaccccatgtcgatccccgcgaccttatttgtctggtacttctggcagaagaagaaacagcggtccggcgtgctctgggacacgcccagcccgcccgaggttgagcgcgccgtcctggacgatggcatctaccggatactgcagcgcgggctgctcggccgttcacaggtgggagtgggcgtcttccaggatggagtgttccacaccatgtggcacgtgacccgcggggccgtactgatgtatcaggggaagcggctggagccatcctgggcttccgtcaagaaagacctcatcagctacgggggcggttggcgcttccaaggctcctggaacaccggggaggaggtacaggtaatcgccgtagaacccggtaagaacccgaagaacgttcagacgacccccggtaccttcaagaccccggaaggggaagtaggcgcgatcgctctggacttcaagccggggacgagcggttccccgattgtcaaccgcgaaggcaagatcgtcgggctgtacggtaatggggtcgtaaccacctctggaacgtatgtgtccgctattgcccaggccaaagcatcccaggaaggccccttacccgagatcgaggacgaggtcttcaagaaacgcaacctgacgatcatggacctacacccgggctcgggcaaaacacggcgttatctccccgccatcgtgcgggaggcgatcaagcgcaagctgcgaaccctcatcctcgcgccgactcgggtggtcgccagcgagatggcggaggcccttaagggaatgccgatccgttaccaaactactgccgtcaagagcgagcacaccggcagagaaatcgtggacttgatgtgccacgccaccttcaccatgcgcctcctgtccccggtacgggtccccaactataacatgatcatcatggacgaggcgcactttacagaccccgcgagcatcgccgcacgcggatacatcagtacgcgggtgggcatgggggaggcggcagccatcttcatgaccgcgactccgccgggaagcgtcgaggccttccctcaatccaatgccgtaatacaggacgaggagcgcgacatccctgaacggagctggaactccgggtatgattggatcaccgacttccccgggaagaccgtgtggttcgtcccgtctataaagtccggcaacgacatcgcgaactgcctgcgcaaaaacgggaaacgggtgatccaactcagccgcaagacctttgacacggagtatcagaagaccaagaataatgattgggattatgtggtgactaccgacatcagtgagatgggcgccaatttcagagccgatcgagtgatcgatccccgacgctgccttaagcccgtgatcctgaaggacgggcccgagcgggtcattctcgccggcccgatgccggtgacggtcgcgagcgcggcccagcgcaggggtaggatcgggcgcaaccaaaacaaggagggcgatcagtacgtgtacatggggcagcccctgaataacgacgaggatcatgcccactggaccgaggccaagatgttactcgacaatattaacactcccgagggcatcatcccagcgctgtttgagcccgagcgggagaagtccgcggccattgatggagagtaccgcctgcgtggcgaggcccgtaaaactttcgtggaattgatgcggcgaggtgatctgcctgtttggctgagctacaaggtggcctccgagggattccagtatagcgaccggcgctggtgcttcgacggcgagcggaataaccaggtgctcgaagaaaacatggatgtcgagatatggacaaaagaaggtgagcggaagaagctgcggccaaggtggctggacgctaggacctattccgacccgctcgcactcagggaattcaaggagttcgccgccgggaggcgcagcgtgagcggagaccttatcctagagatcggaaaacttccccagcacctgacgctccgggcccaaaacgcgctggacaacctggtaatgttgcacaattcggagcagggagggaaggcctatcgccacgcaatggaagagctccccgacactatagagaccttaatgcttctggccctaatcgcggtcttgactggcggcgtgacactctttttcctgtccggcaaaggcctcgggaagacctccatcggtctactatgtgtcaccgccagctctgcccttttatggatggccagcgtcgagcctcactggatcgccgcaagtatcatcctggaattcttcctgatggtgctgttgataccggaacccgaccgtcaacgaacgccccaggacaatcagctcgcctacgtggtcatcggtttgctgttcatgattctaaccgtggccgccaatgaaatgggtctgctcgagaccactaagaaggatctgggaattggctacgttgctgcggaaaaccaccagcacgccactatgctggacgtcgacctgcggccggcctctgcgtggactttgtatgctgtcgctaccaccgtgatcacgccaatgatgcgccacaccatcgagaataccacagccaatataagcctgactgcgatcgcgaatcaagccgcgatcctcatgggactcgacaaaggatggcccatcagcaagatggacattggcgtgcccttgctggctttgggttgctacagccaggtaaacccactgaccctgaccgcggccgtgcttatgctggtagcgcattacgccatcatcggccccgggttacaagccaaagccacccgcgaggcgcagaaaagaacggcagccgggatcatgaagaatcccaccgtggacggcatcgtggccatcgacctggaccccgtcgtgtacgatgccaagttcgagaaacagctggggcagatcatgctgctaatcctgtgcaccagccagatcttattaatgcgcaccacatgggcgctgtgtgagagtatcaccctggccaccggccctcttacgactctgtgggaggggagccccggcaaattttggaatacaaccatagccgtgtccatggccaacatcttccggggcagttacctggcaggggctggactcgcgttcagtctaatgaagtccctcgggggcggtcggcggggtaccggagcccagggcgagacacttggcgagaagtggaagcgccagctgaatcaactgtctaagagcgagttcaacacctacaagcgaagcgggatcatggaggtcgatcgttcggaagcaaaggagggcctcaagcgcggggagaccaccaagcacgccgtttcacgaggcactgcgaaactgcgttggttcgtggagaggaacctggtcaaacccgagggtaaggttatcgacctgggctgcggccgcggcgggtggagttattactgcgcagggctcaagaaggtgaccgaagtcaaggggtatacaaaaggcgggccgggccacgaggagccgattcccatggccacctacgggtggaaccttgtgaagctgcattccggcaaggacgtatttttcatgcctcccgagaagtgcgatacgctgctgtgcgacatcggcgagtccagcccgaatccgacgatagaggaaggccggacactaagggttctcaagatggtcgagccctggctgaagggcaatcagttttgcatcaagatcctgaacccctacatgccgtcagtggttgagaccctcgagcagatgcaaagaaaacacggaggcatgctggtgcggaaccctctgagccgtaattccacacacgagatgtactgggtgagctgcgggacgggcaacatagtctcggccgttaacatgaccagccggatgctcttaaaccgcttcaccatggcccaccgcaagcctacctatgaacgggacgtcgacctgggcgcggggacgagacacgtcgccgtggagccggaggtggctaacctcgatataatcggccaacggatcgagaacatcaagaacgagcataagtctacgtggcattacgacgaggacaacccgtacaagacctgggcctatcatggcagctacgaggtcaagccttccgggagtgccagtagcatggtgaacggggtcgtgcgactgttgactaagccctgggatgtgattcctatggtcacccagatagcgatgacggacaccaccccgttcggacagcagcgggtgttcaaggaaaaggtggacacgagaacgcctcgtgctaagcgagggacgacccagatcatggaggtcacggccaaatggctctggggattcctctcccggaacaagaagccgcgcatctgcacccgggaggagttcacccgcaaggtccggagcaacgccgcaatcggcgcggtatttgtcgatgaaaatcagtggaactctgccaaggaagccgtggaggatgagcgtttctgggacctggtgcaccgcgagcgcgagctccataaacaggggaagtgtgctacatgtgtatataacatgatgggcaagcgcgagaagaagctgggggagtttggcaaggcgaagggttctcgggcaatctggtacatgtggctgggggccaggttcctagagtttgaggccctaggctttatgaacgaagaccactggttcagccgtgagaactccctgagcggggttgaaggtgagggtttgcataagctgggctacatcttgcgagacatcagcaagatcccaggcgggaacatgtatgccgacgacacggcaggctgggacacccggatcaccgaggacgatttgcagaacgaggccaagatcaccgacatcatggagcccgaacacgccctgttagccacgagcatcttcaaactcacctaccagaacaaggttgtcagagtccagcggcccgcaaagaacgggaccgtgatggacgtcatctcacgccgggaccaacgcggctctggccaggtggggacctatggcctgaacacgttcacaaacatggaggtgcagctgatccggcagatggagtcggaggggatttttctcccctctgagctggagacccccaatctagcagagagggtcctcgactggctgaagaagcacggcgcggagcgactgaaacgcatggccatatctggcgatgattgcgtcgtgaagccgatcgacgacagatttgccacagccctcacggctctaaacgacatgggtaaagtccgcaaggacatcccccagtgggagcccagcaagggctggaacgactggcagcaagtacccttctgcagtcaccacttccaccaactgataatgaaagacggacgggagatcgtggtcccctgccggaaccaggacgagttggtgggccgggccagggtgagccagggtgcaggctggtccctgagagagaccgcgtgtttaggcaagtcttacgcgcagatgtggcagctcatgtacttccataggcgggacttacgcctggcggccaatgctatctgtagtgccgttcccgtggactgggttcctacgtcacggaccacatggagcattcatgcgcaccaccagtggatgacaacagaggatatgctttccgtctggaatcgcgtgtggatcgaggaaaacccatggatggaggacaagacccacgtgagctcctgggaggaagtcccctacttaggtaagagggaggaccaatggtgcggcagcctgatcgggctcaccgccagagccacatgggctactaacatacaggtcgccatcaaccaggtgcgccggcttatcgggaacgagaactacctcgactacatgacgtccatgaagcggttcaaaaacgagagcgaccccgagggggcgttatggtaa

SEQ ID NO: 24047 - RNA, 9879 nt, synthetic construct
  misc_feature 1..9879: note = derived and/or modified CDS sequence (opt11) from DENV-1__JN819411__SS-prME
  source 1..9879: mol_type = other RNA
agtgtcaccatgcttctcatgctgctgcccaccgccctcgccttccacctgaccacgcgcggaggggaaccacacatgatcgtgagcaagcaggagcggggtaagagcctgctgttcaagaccagcgcgggggtgaacatgtgtaccttaatcgccatggacctgggcgagctctgcgaagacaccatgacctacaagtgcccccgaatcaccgaagccgagccggacgacgtggactgctggtgtaacgctacggacacctgggtgacctacgggacctgcagccaaactggcgagcaccggcgcgacaagcggtccgtggccctggcgccccacgtggggctgggcctcgagacccgtaccgagacatggatgagctccgaaggcgcgtggaagcagatccagcgggtcgagacctgggccctccgtcatccagggttcactgtgatcgcgctgttcctcgcgcacgccattggcaccagcatcacccaaaaggggataatatttatcctgctcatgctcgtgacccccagtatggccatgcggtgcgtcggcataggtaaccgcgacttcgttgaggggctgagcggcgccacgtgggtggacgttgtactggaacacgggagctgcgtgactaccatggctaagaacaagcccaccctcgacatcgaactgctgaagacggaagtcaccaaccctgcggtgctccggaagttatgcatcgaggcgaagatcagtaacaccaccacggactcccgctgcccgacccagggcgaggcgaccctggtggaggaacaagacgccaacttcgtctgccggcggaccttcgttgacaggggctggggtaacggctgtggcctattcggcaaggggagcctgctgacgtgtgccaagtttaagtgcgtgaccaagctggagggtaagatcgttcaatacgagaacctgaaatactccgtgatcgttaccgtccataccggtgaccagcatcaagtggggaatgagacgaccgagcacggaaccatagcgactatcacgccccaggcacccaccagcgagatccagctaaccgactacggggccctcaccctcgactgcagcccccgaaccggcctggacttcaacgagatggtcctcctgacgatgaaagagaagtcctggctagttcacaaacagtggttcctcgacctgccgcttccatggacctccggtgccagcaccagtcaagagacctggaaccggcaggacctcctcgtgacgttcaagaccgcccatgctaagaagcaggaggtcgtggtgctgggatcccaagaaggcgcaatgcacaccgccctcaccggtgccacggagatccagaccagcggcaccaccacgattttcgccgggcaccttaagtgccgtctgaagatggacaagctcactctgaaggggatgtcctacgtcatgtgcaccgggagctttaagctcgagaaagaggtggcggagacccagcacggcacggtgctggtccaggtgaagtacgaggggactgacgccccatgcaagatcccattctccacccaggacgaaaagggggttacccagaatggccggctcatcacggccaacccaatcgtcaccgataaggagaagcccgtgaacatcgagaccgaaccgcccttcggggagagctacatcgtggtaggcgcaggcgaaaaggcgctgaagctgagctggttcaagaaggggagctccatcgggaagatgttcgaggccacagcccgcggggcccggcgcatggccatactcggcgataccgcatgggactttgggagcatcggcggcgtgttcacctccgtggggaagttagtccatcaggtgttcggcaccgcctacggggtgctctttagcggcgtctcctggaccatgaaaatcgggatcggcatccttttgacgtggctgggccttaactcccgctccacctccctatccatgacttgcatcgccgtggggatggtcacgctgtacctcggcgtcatggtgcaggccgactctgggtgcgtgatcaattggaagggccgggaactgaagtgcgggtccggcatattcgtcacgaacgaggtgcacacctggaccgagcagtacaagttccaggccgacagtcctaagcgcctgagcgcggccattggcaaggcgtgggaggaaggggtgtgcggcatccggtctgcaacccgcctcgaaaacatcatgtggaagcagatcagcaacgagctgaaccacatcctgctcgaaaacgacatgaagtttaccgtcgtggttggggacgccaacggcatcctggcgcaggggaagaagatgatccggccccagcccatggagcacaagtattcttggaagtcctggggcaaggccaagattatcggcgccgatatccagaatacgacattcatcatcgacgggcccgacaccccggaatgccccgacggccagcgcgcctggaatatctgggaggtcgaggactacgggttcggcatcttcactacgaacatctggctgaagctccgggactcctatacccaaatgtgcgaccatcgcctgatgagcgcggcaatcaaggactcgaaagcagtgcacgccgatatgggctactggatcgaatcagagaagaacgagacctggaagctggcgcgggcgtccttcatcgaggtgaagacatgcacatggcctaagtcgcacaccttgtggtccaacggggtcctggagagtgagatgattattccgaagatctacggcgggccgatctcccagcacaactaccgccccggatacttcacccagaccgccgggccttggcaccttggcaagctcgagctggactttgacttatgcgagggcacgaccgtggtggtcgacgaacattgcgggaaccggggcccgagcctccggaccaccacggtcacagggaagatcatccacgagtggtgctgtcggtcctgcaccctgccacccctgcgcttccggggtgaggatgggtgctggtacggcatggagattcgccccgtgaaggagaaagaagagaacttagtgcggagcatggtgtctgcgggctctggggaggtagactccttctccctgggcatcctatgcgtctccatcatgatcgaagaggtaatgcgctcccggtggagtcgcaagatgctaatgaccgggacgctggccgtgtttctgctactgatcgtcggtcagctgacctggaacgacctaatccgcctgtgcatcatggtgggtgcaaacgcctccgaccggatgggcatgggcaccacgtacctggcactcatggcaacgtttaagatgcgccctatgttcgccgtggggctgctgttcagaagactgacaagccgggaagtactgctgctcaccatcgggttgtcccttgtggcgagcgtcgagctcccgaactccctggaggagctgggggacggcctcgctatgggcatcatgatgttaaagctgctcaccgagttccagccgcaccaactgtggacgaccctgctcagcctcaccttcgtgaagaccacgctgagtctcgactacgcctggaagacgaccgcgatggtgctgtcaatcgtttccctgttcccactctgcctgagcaccacgagccagaaaaccacctggctcccggtgctcttggggagctttggctgtaagcccctaaccatgttcttgatcaccgagaacaaaatatgggggcgcaaatcgtggcccttgaacgagggcatcatggccatcgggatcgtgtccatcctgctatcctcactgctgaagaacgacgtccccctcgccggcccgctgatcgccggcgggatgctaatcgcctgttatgtgatcagcggcagtagcgcagacctctcactggagaaggccgcggaagtgagctgggaacaggaggccgagcactccggagcttcacacaacatcctggtcgaagtgcaggacgacggcactatgaagattaaggatgaggagcgggacgataccctcaccatcctgctgaaggccacccttcttgccgtgagtggggtctaccccatgagcatccccgcgacgctgttcgtctggtacttctggcagaaaaagaaacagcgctcaggcgtcctctgggacaccccctcaccgcccgaggtcgagcgggccgtgctggacgacggcatctaccgcatactgcagagagggctgctcggcagatcccaggtaggggtcggagtgttccaggacggggtgttccacacaatgtggcatgtcacgcggggcgccgtgctgatgtaccagggcaaacgtctggagcccagctgggcgagcgtcaaaaaggacctcatcagctacgggggcgggtggcggttccagggaagttggaacactggggaggaagtccaggtgatcgccgtggagcctggcaagaacccgaaaaacgtccagaccacccccgggaccttcaagacaccagagggggaagtgggtgcgatagcgctggacttcaagcccgggaccagcggctccccgatcgtgaaccgcgagggcaagatcgtcggtctgtacggcaacggggtggttactacaagcggtacatacgtctccgcaatcgcccaggccaaggcgagccaggaggggccactcccggagatcgaggacgaggtattcaagaaaaggaacctgaccatcatggacctgcacccggggagcggcaagaccaggcgttacctccccgccatcgtacgcgaggcgatcaagcggaagctgcggaccctcattctcgcccccacgcgcgtcgtagcgtccgagatggccgaggctctgaagggcatgccgattcggtaccagaccaccgccgttaagagcgagcacaccggccgcgagatcgttgacctgatgtgccatgccacgtttaccatgcgactcctgtcgccggtgcgcgtgcccaactataacatgatcatcatggacgaagctcacttcactgaccccgccagcatcgccgctcggggctacatctctacccgcgtgggcatgggggaagccgccgccatattcatgacggccacgccgcccggcagcgtagaggcattcccccagtccaatgcagtgatccaggacgaggagcgggacatacccgagcgcagctggaactccgggtacgactggatcaccgacttccccgggaagaccgtctggttcgtgccctcaatcaagtccggcaacgacattgcgaactgtctgagaaagaacggcaagcgggtgatccagttgagccgcaagacgtttgataccgagtaccagaagaccaagaacaatgactgggactacgtcgtaactacggatatctccgagatgggcgcgaactttcgagcagatcgggtgatcgacccccggcggtgtttgaaacccgtgatcctgaaggacgggcctgagcgcgtcatcctcgccggcccgatgcccgtgaccgtggcgagcgccgcccagcggcgcgggaggatcgggcgcaaccagaacaaagaaggcgaccagtacgtgtacatggggcagcccctgaacaacgacgaggaccacgcccactggactgaagccaagatgcttctcgacaacatcaacacccccgaggggatcatcccggcgctgttcgagcccgagcgcgagaaatctgcagccattgacggggagtaccggctgcgaggcgaggccaggaagacgttcgtcgaactcatgcgccggggcgacctgcccgtgtggctgagctacaaggtggcttccgaagggtttcagtactcagacagacgctggtgcttcgatggggaacgaaacaaccaggtcctcgaagaaaacatggatgtggagatctggactaaggagggtgagcgcaagaaacttagacctcgctggctggacgcgcgaacgtactccgatccgctcgccctgcgtgagttcaaggagttcgccgccggccgccggagcgtcagcggcgacctgatcttggagatcgggaaactgccccagcatctgaccctccgcgcgcagaacgcgctggacaacctggtcatgctccacaactccgagcagggcgggaaggcctacagacacgccatggaggagcttcccgacaccatcgagaccttaatgctcttagctctgatcgcggtgctcaccgggggagtgacgctgttcttcctgagcggcaagggactaggcaagacctccatcggcctgttgtgcgtcacggccagctcggcgttactgtggatggccagcgtggaaccccattggatcgccgcgtccatcatcctggagttcttcctcatggtgctcttgatcccggagcccgaccgccagcgaacgccgcaagacaaccagctcgcgtacgtcgtgatcgggttactgttcatgatcctcaccgtggccgccaatgagatgggcctcttagaaaccacgaagaaggacctcgggatcggctacgtcgccgcagagaaccaccagcatgccaccatgctggatgtggacctgcgcccggccagtgcctggactctctacgccgtcgccaccacggtcatcacacccatgatgcggcacaccatcgagaacaccacggccaatatttccctaaccgcaatcgcgaaccaggccgcgatcctaatggggctcgacaaagggtggccgatttcgaagatggatatcggagtgcccctactggcactcggttgctactcccaggtgaaccccctgaccctcaccgccgctgtcctcatgttggtggcgcactacgcaatcattggcccagggctacaggccaaggcgacacgcgaggcccagaagcgcaccgccgccggcataatgaaaaaccctactgtggacggcatcgttgccatcgacctagaccctgtggtgtacgacgccaaattcgaaaagcagctggggcagatcatgctgctcatcctgtgtaccagccaaatcctgttgatgcggacgacctgggccctttgcgagtccatcaccttagcgacaggaccactcacaaccctatgggagggcagcccgggtaagttttggaacactaccatcgccgtctccatggccaacatcttccgcggcagctacctggccggggccggcctcgcgttctccctgatgaaaagcctcgggggtgggcggcgcggaacgggcgcccaaggggagaccctcggcgagaagtggaagcggcaactgaaccagctgagtaaaagcgagttcaatacgtacaagagaagcggcatcatggaggtggaccggtccgaagccaaggagggactcaagagaggggagaccacgaagcacgccgtgtcgcggggcaccgcgaagctgcgctggtttgttgagcggaacctggtgaagcccgagggcaaagtcatagacctggggtgtggtcgcgggggctggtcctactactgcgccgggctcaagaaggtcaccgaggtgaagggctacactaagggcgggcccggtcacgaggagccggtgcccatggccacctacgggtggaacctggtcaagctgcacagcggtaaggacgtgttcttcatgcccccagaaaagtgcgacacgctcctgtgcgacatcggggaaagttctccgaaccccaccatcgaggaaggccggaccctccgcgtgctgaagatggtcgagccctggctgaaggggaaccagttctgcatcaaaattctgaacccctatatgccgtccgtggttgaaacgctcgagcagatgcagcggaagcacggtggcatgctggtccgcaaccccttgagccggaactccacgcacgagatgtactgggtcagttgcgggaccggcaacatcgtgagtgccgtcaacatgacctcacgcatgctcctgaatcggttcactatggcccaccgcaaacccacgtatgagcgcgacgtggacctgggcgcggggacccggcacgttgccgttgagcccgaggtagcaaacctcgacatcatcggccaacgcatagaaaacataaagaacgagcacaagctgacctggcactatgacgaggataacccgtacaaaacctgggcataccacgggtcctacgaggtcaagcccagcggctccgcctcatccatggtcaacggggtggtccggctgctcacgaagccttgggacgtgatccccatggtgacccagatcgcgatgaccgacaccacgcccttcggccagcagcgcgtgttcaaggagaaggtggacacccggacgccccgcgccaagcggggcaccacgcagatcatggaggtgacagccaagtggttgtgggggttcctgagtcgcaacaagaagccgcggatctgcacccgcgaagagttcacccggaaggtccgctctaacgccgccatcggcgcggtgttcgtggacgagaaccagtggaacagcgccaaggaagccgtcgaggacgagcggttttgggacctcgtgcaccgcgagagagagctgcataagcagggtaagtgcgcaacgtgcgtgtacaacatgatgggcaagcgtgaaaagaagctgggggagttcggcaaggccaagggcagccgggccatatggtacatgtggctcggagcccgcttcctggagttcgaggccttagggttcatgaacgaggatcactggttctctcgcgagaacagcttatccggggttgagggcgaaggactgcacaaactgggctacattctccgagacatctccaagatcccgggtgggaacatgtatgccgatgacacagcaggctgggacacccggataaccgaggacgaccttcaaaacgaagccaagatcacagacatcatggagcccgagcacgctctactcgccaccagcatcttcaagctgacctaccagaacaaggtggtgcgcgtccagcgacctgctaagaacgggaccgtgatggatgtgatcagccggcgcgaccaacggggctccggccaagtcgggacctacggcctgaataccttcaccaacatggaggtgcagctcatccgccagatggagtcggagggcatcttttcccccagcgagctggaaactccgaacttagctgagcgcgtgctcgactggttagaaaagcatggcgccgagcgcctgaaacggatggccatcagtggggatgattgcgtcgtgaagcccatcgacgaccgcttcgctacagctctcaccgcgctgaacgacatgggcaaggtgcggaaggacatcccccaatgggagcccagcaagggctggaacgactggcagcaggtcccgttctgttcccatcacttccaccagctgatcatgaaagacggtcgcgagatcgtggttccatgccgtaaccaggacgaactcgttggccgcgcccgggtgagccagggggccggatggtccctgagggagaccgcgtgcctgggcaagagctacgcgcagatgtggcagctcatgtacttccaccggcgcgacctgaggctggcggccaacgccatctgttccgccgtgcccgtcgactgggtgcctaccagccgcaccacgtggagcatccacgcgcaccaccagtggatgaccaccgaagatatgctctccgtctggaaccgggtctggatagaggagaacccgtggatggaggacaagacccacgtgagctcttgggaggaggtgccctacctaggcaaacgcgaggaccaatggtgcggaagcctgatagggctcacggctcgcgccacctgggccaccaacatccaagtagccatcaaccaagttcggagactgatcggcaacgagaactacctggactacatgacctccatgaaacggttcaagaatgaaagcgaccccgagggggcgctctggtga

SEQ ID NO: 24048 - RNA, 9879 nt, synthetic construct
  misc_feature 1..9879: note = derived and/or modified CDS sequence (opt11) from DENV-1__FJ639812__SS-prME
  source 1..9879: mol_type = other RNA
agcgtgaccatgctgctgatgctgctgcccacagccctcgctttccacctgaccaccaggggcggcgaaccgcacatgatcgtgtccaagcaggagcggggcaagagcctcttgtttaaaactagcgcgggggtgaacatgtgcaccttgatcgccatggacctaggcgagctctgcgaagataccatgacctataagtgccccagaatcaccgaggcagaacccgacgacgtggactgttggtgtaacgccaccgacacctgggtcacctacggaacctgcagccagaccggcgagcaccggcgagacaagcggtccgtggccctggcgccccacgtgggcttggggttggaaacgcgcacggagacatggatgagctccgaaggcgcctggaagcagatccagcgggtcgagacctgggccctgcgccaccccgggttcacggtgatagccttgttcctcgctcacgccattggcactagcattacccagaaagggatcatattcatattactgatgctcgtgaccccatcaatggcgatgcggtgcgtcggcatcggcaaccgcgatttcgttgaggggttgtcaggcgccacgtgggtggacgtcgtgctcgaacacgggtcctgcgtcaccaccatggcaaagaacaagccgacactcgatattgaactgctaaagaccgaggtgactaatcccgccgtattgcgaaagttatgcatcgaagccaaaatcagcaacacgacaacagattcccgatgtccgacccagggcgaagccaccttggtcgaagagcaggatgccaacttcgtctgtcggcgcacttttgtggaccgtggctggggtaacggctgtggcctgttcggaaaggggagcctgctgacttgcgccaaattcaaatgtgtgacgaagctcgagggcaaaatcgtccagtacgaaaatttaaagtacagtgtgatcgtgaccgtccacacgggcgaccagcaccaagtgggtaacgagacgaccgagcacggaacgatcgcgaccatcacgccccaggcccctacgtcggagattcagcttaccgactatggggccctcaccctggactgcagcccccgcaccggcctggacttcaacgagatgatgctactgacgatgaaggagaaaagctggctggtccacaagcaatggtttctcgatttaccgctaccctggacctccggggccagcacgagccaggaaacctggaacagacaggacttgctagtcacgttcaagaccgcccacgcgaaaaagcaggaggtagtcgtgctgggctcccaggagggggccatgcacaccgccctcaccggtgccacggagatccagacgagcgggaccaccaccatcttcgccggccaccttaagtgccgactgaagatggacaagctcacgctgaagggcatgagctatgtgatgtgcaccgggagcttcaagctagagaaggaagtcgcggagacccaacacgggacggtcctggtgcaggtcaagtacgagggcaccgatgcaccttgcaagatcccgttcagcacacaggacgaaaagggggtgacccagaacgggaggctcatcacagccaacccaatagtgaccgacaaggaaaagcctgtcaacatcgagaccgagccgcctttcggggagagctatatcgtggtgggcgccggcgagaaggcgctgaagctgtcctggttcaagaaaggcagctcaatcggcaagatgttcgaggctaccgcccgcggggcccgtcgcatggcaatcctcggcgatactgcctgggacttcggcagcattggaggcgtcttcaccagtgtggggaagctggtccaccaggtcttcggtaccgcctatggcgtcctgtttagcggcgtaagttggaccatgaagatagggatcggcatactcctgacatggctaggccttaatagccggtccacaagcctgtccatgacgtgcatcgcagtcgggatggtgaccctgtacttaggcgtaatggtccaagccgacagcgggtgtgtgatcaactggaagggacgagaactgaaatgcgggtccggcatcttcgtgacaaacgaggtccacacctggaccgagcagtacaagttccaggctgactcgccgaagcgactgagcgcggccatcggcaaagcctgggaggagggggtgtgcggcatacggtctgcgacccggctagagaatataatgtggaagcaaattagcaacgagctgaaccacatcctgctcgagaatgacatgaaatttacggtggtcgtgggggacgccaacggcattctggcgcagggtaaaaagatgatccggccacagcccatggaacacaagtactcctggaaatcctggggcaaagccaagatcataggcgccgacatccagaacacgaccttcattattgacgggcccgacaccccggaatgccccgacggtcaacgagcctggaacatctgggaggtggaagattacgggttcggaatcttcaccaccaacatctggctgaagctccgcgacagctatacccaaatgtgcgaccatcgtctgatgagcgcggccatcaaggattccaaagctgtccacgccgacatgggctactggatcgaaagcgagaagaatgagacatggaaacttgcacgtgcgtccttcatcgaagtcaaaacgtgcacgtggcccaagtcccataccttatggtccaacggggttctggaatcggaaatgataatccccaagatctacggcggccccatatcccagcataattaccgccccggatactttacccagaccgcggggccatggcaccttggcaaactcgagctggatttcgacctgtgcgagggaacgactgtcgtcgtggacgaacactgcgggaaccggggccctagcctccgcaccaccacggtcaccgggaaaatcatacacgaatggtgttgccggtcctgtaccctgccgcctctacgtttccggggcgaggacgggtgctggtacggcatggagataaggcccgtgaaagagaaggaggagaacctcgtacggtcaatggtctccgccggcagcggcgaagtggacagcttcagcctgggcatcctttgtgtgtcaattatgatcgaggaggtgatgcgctcccggtggagtcggaagatgctcatgacagggacgctagcggtgtttctgctcctgattatgggccaactgacctggaacgacctcatccgcttatgtataatggtgggggccaacgcgtccgaccggatgggaatggggaccacctacctggctctcatggccacgttcaaaatgcgccctatgtttgctgtcgggttgctgttcaggcgcctcacctctcgggaggtactgctgctcaccatcgggctctccctcgtggcctctgtcgagctccccaactccttggaggaactgggggacggactcgcgatgggcatcatgatgctcaagctgctcaccgagtttcaaccccaccagctgtggacaaccctgctctcactgacattcgtcaagaccactctgtccctcgactacgcctggaagaccacagccatggtcctgagcatcgttagtttatttcccctctgtctctcgacaacgtcccagaagaccacctggctacctgtactcctggggtcatttggctgcaagccactgaccatgttcttgatcactgagaacaagatttgggggcgcaagtcatggcccctgaacgaggggatcatggcaatcgggatcgtcagcatcctcttatccagcctgctgaagaatgacgtccccctagccggtccgctgattgccggggggatgctgatcgcctgctatgtgatttcagggtccagcgccgatcttctgctggaaaaggccgcggaggtctcctgggagcaagaagccgaacacagcggtgcctcccacaacatattggtggaagttcaggacgacggtacgatgaagatcaaggacgaggagagggatgacaccctcacgatcctgctcaaggccaccctgctggccgtgagcggggtttaccctatgtccatccccgccaccctcttcgtttggtacttctggcagaaaaagaagcagcgcagtggcgtcctgtgggacaccccctccccgccggaagtggagcgggccgtgctggacgacggcatataccgcattctgcagcgggggctcctgggccgctcgcaggtgggagtgggcgtgttccaggacggggtcttccacaccatgtggcacgtgacccggggcgcagtgctgatgtaccagggtaagcgtttggagcccagctgggcaagcgtcaagaaagatttaataagctacgggggagggtggcggttccagggcagctggaacacgggggaagaagtccaggtgatcgccgtcgaacccggaaagaacccgaagaatgtgcaaactacacccggtaccttcaaaacgcccgagggtgaggtgggcgcgatcgccctggactttaagccagggacctccgggagccctatagtcaacagagagggcaagatcgtggggctctatggtaatggggtcgttaccaccagtggcacgtatgtgagcgccattgcccaggcaaaggcttcccaggaggggcccctccccgagatcgaggacgaggtgttcaagaagcgaaatctcaccatcatggacctccaccccgggtctggcaagacccgcagatacctgcccgccatcgtccgcgaggcaataaaacggaaattaagaacgctcattctggctcccacgcgcgtggtagctagcgagatggccgaggcgctgaaagggatgccgattcggtaccaaaccacagccgtcaagtccgagcataccggccgtgaaatcgtagacctcatgtgccacgccacgttcactatgcggctgctgagcccggtccgcgtccccaactacaacatgatcatcatggacgaggcgcacttcaccgacccggcgtccatcgccgcccgggggtacataagtactcgcgtgggcatgggggaggccgcggccatcttcatgacggcgaccccgcctgggtccgtggaggccttcccccagagcaatgccgtgattcaagatgaggaacgggacatccctgagagatcctggaattccggttacgactggatcaccgacttcccaggcaagaccgtatggtttgtgccctccatcaagagcggcaacgacatcgcgaactgcctccgtaagaacgggaagcgcgtaatccagctgtcccgcaagactttcgatactgagtaccagaagaccaagaataatgactgggactacgtggtgacaacagacatcagcgaaatgggcgccaactttcgcgctgaccgggtcatagaccccagacggtgccttaagcccgttatactcaaggacgggcctgagcgcgtgatcctggccggcccgatgcccgttaccgtggcgtccgcggcccagaggcgcggaaggatcgggcgtaaccagaacaaggaaggcgaccagtacgtgtacatgggccagccactcaataatgacgaggaccacgcccactggaccgaggctaagatgctactggacaacatcaacacccccgagggcataatccctgcgctgttcgagccggagagagagaagtccgccgccatcgacggagagtaccgactccgaggcgaggcccggaagacgttcgtggagctcatgcggcgaggcgacctgcccgtgtggctttcctacaaggtcgcgagcgaggggttccagtactcagaccgccggtggtgtttcgacggagaacgcaacaaccaagtgctggaggagaatatggacgtggaaatctggactaaagagggggagcggaagaagctgcgcccccggtggctcgatgcccgcacgtacagcgacccgctagcgctgcgggagttcaaggagttcgccgcaggccgaagatccgtctcgggcgacctcatactggagatagggaagcttccccagcacctcaccctgcgtgcccagaatgctttggacaacctcgtgatgctgcacaacagcgagcaaggcgggaaagcctaccggcacgcgatggaggagctgccggacaccatagagacgctgatgttgctggccttaatagcggtgctgactggaggggttacccttttcttcctctccggaaagggactggggaaaacctcgatcggattactctgcgtgactgcatcctctgcactgctgtggatggcctccgtggagccccattggatcgccgccagcatcatcctcgagttcttcctgatggtcctgctcatcccggagcccgaccgtcagcggacgccccaggacaaccagttagcctacgtcgtaatcgggctcctctttatgatcctgaccgttgccgctaacgagatggggctgctggagacgacgaagaaggacctgggcatcggctacgtagccgccgaaaatcaccagcacgctaccatgctggacgtggatctccgcccggcctccgcttggaccctgtacgctgtagcaaccacggtcatcacccccatgatgcggcataccatcgagaacaccaccgccaacatcagcctgactgccatcgccaaccaagccgctatcctcatgggcctggacaaagggtggccaatttctaaaatggacataggagtgccccttctcgcacttgggtgctattcacaggtcaaccccctgaccctaaccgcggctgtgctgatgctggtcgcgcactatgctatcataggtcctgggttacaggccaaggcgaccagggaggcccagaagagaaccgcggcaggtatcatgaaaaaccccaccgtcgacggcatcgtggccatcgacttagaccccgtggtttatgatgcgaagttcgaaaagcaattggggcaaataatgctcttgattttgtgcacctcacagatcctccttatgcggacgacctgggccctgtgtgaaagcatcacactcgcgacaggcccactgacgaccctgtgggagggttctcccggaaagttctggaacaccactattgccgtgagcatggccaatatctttcgggggtcctacttagcgggggcaggtctggcgtttagcctgatgaaatccctcggcggcgggcggcgcggaacgggcgcccagggggagaccctgggggagaagtggaagcggcagctgaaccagctcagcaagtccgagtttaacacctacaagcgaagcggcatcatggaagtggatcgatcggaggcaaaggagggccttaaaagaggggagaccacaaagcatgcagtatcccggggcactgcgaagctgcgctggttcgtcgagcggaacctggtgaaacccgagggcaaggttatcgaccttgggtgtggccggggtggttggtcttactactgcgccggtttaaagaaggtgacggaggtcaagggatacaccaaaggcgggcctggccacgaggaaccgatccctatggccacctacgggtggaacctggtcaagctccacagtggcaaggacgtgttcttcatgccgccagagaagtgcgacactctgctgtgtgacatcggggagagctccccgaacccaactattgaggagggccggaccctccgcgtgctgaagatggtcgagccatggctcaagggcaaccagttctgcatcaagatcctcaacccctacatgccaagcgtggtggaaaccctcgagcagatgcaacggaagcatgggggcatgctggtccgcaatcccttgagtcggaactcaacgcacgagatgtactgggtgagttgcggaactggcaatatcgtcagcgccgtgaacatgacaagccgcatgttactgaacagattcaccatggcgcaccgtaagccgacgtacgagagagatgtcgacctgggagctgggacccggcacgtggcggtagagcccgaggtggccaacctcgacatcatcggtcagaggatcgagaacattaagaacgagcacaagtctacctggcattacgacgaggacaatccgtataagacctgggcctaccatgggtcatacgaagtcaagccgagcggatccgccagctccatggtcaacggggtagtccggctcttgactaaaccttgggacgtgatccccatggttacgcagatcgcgatgaccgacaccacaccattcggccagcaacgcgtcttcaaggagaaggtggacacccggacgccacgcgccaagcggggcaccactcagataatggaagttaccgccaagtggctgtgggggttcctgagccgaaacaagaagcctcggatctgcacccgcgaggagttcactcggaaggtccgctccaacgccgcgatcggcgcggtgttcgtggacgagaaccagtggaactccgccaaggaggccgttgaggacgagcggttctgggacctggttcatcgcgagcgagaactgcacaaacaggggaagtgcgcgacgtgcgtgtacaacatgatgggtaagagagaaaagaaattaggtgagttcggcaaggcgaagggctcccgtgctatctggtacatgtggctcggagcccgctttttggagtttgaagccttggggttcatgaacgaggaccactggttctcccgggagaacagcctctccggtgttgaaggtgaggggctgcacaagctgggctatatcctccgcgacatctcgaagatcccgggcgggaacatgtacgccgatgacaccgccggctgggatacccggatcaccgaagatgacctgcaaaacgaagccaagatcacggacatcatggagcccgaacacgccctactagccacatccatcttcaagctaacttaccagaacaaggtagtgagggtgcagcgccccgccaagaacgggacagtgatggacgtcatctccagacgcgaccagcggggctcgggacaggtcggaacctacggcctgaacacgtttaccaacatggaggttcagttgatccgtcagatggagagcgaggggatctttctgccaagtgagctggagaccccgaacttagcagaaagagtgcttgactggctggagaagcacggcgccgagcgcctcaagcggatggcaataagtggggatgattgcgtcgttaagcctattgacgaccgcttcgccaccgccctcaccgcgctgaacgacatgggcaaggtgcgtaaagacattccccagtgggagccctccaagggatggaacgattggcaacaagtcccgttctgcagccatcatttccaccagctcatcatgaaagacgggcgcgaaatcgtcgtaccatgtaggaaccaagacgaattggtcggccgggcccgggtatcacagggggccggatggagcctgagagagaccgcctgcctggggaagtcctacgcccagatgtggcagctcatgtacttccaccgtcgcgacctgagactggcggccaacgccatctgtagcgccgttcccgtcgattgggtgcctacctcgcgcaccacttggagcatccacgcgcaccaccaatggatgaccacggaggatatgttgtcggtctggaaccgggtctggatcgaggaaaacccgtggatggaagacaagacccacgtgtcaagctgggaggaggtcccctacttaggcaagcgggaagaccagtggtgcggctccttgattgggctgacggcccgcgccacctgggccaccaatatacaggtagccatcaatcaggttcggaggctgatcggcaacgagaactatctcgactacatgactagcatgaagcggttcaagaatgaaagtgaccccgagggtgcgctgtggtga

SEQ ID NO: 24049 - RNA, 9879 nt, synthetic construct
  misc_feature 1..9879: note = derived and/or modified CDS sequence (opt11) from DENV-1__FJ639813__SS-prME
  source 1..9879: mol_type = other RNA
tcagtgaccatgctgctcatgctgctccccaccgccctcgcgttccacctgaccaccaggggcggggagccccatatgatcgttagcaagcaggagcggggcaagtccctcctgttcaagaccagcgcgggtgtcaacatgtgtactctaatcgcgatggatctgggcgagttgtgcgaggacaccatgacctacaagtgcccccgcatcaccgaagccgaacccgacgacgtggactgctggtgcaacgccaccgacacgtgggtgacctacgggacctgctcccagaccggggagcatagacgcgacaagcggagcgtcgcgctggcaccccacgtggggctggggctcgagactaggactgagacgtggatgagttccgaaggagcctggaagcagatacagagggtcgagacctgggcccttcgacaccccgggttcacggtcatcgccctctttctagcgcacgccatcggcacttcgattacccagaaggggatcatcttcatcctgctgatgctcgtgaccccaagcatggcaatgcgttgcgttggcattgggaacagggacttcgtggaggggctgtcgggcgccacgtgggtagacgtagtgctagaacacgggtcctgtgtgaccaccatggctaagaataagcctacgcttgacatcgaactgctgaagacagaggtaatgaaccccgcggtgttaaggaaactgtgcatagaggcgaagataagcaacacaaccaccgactcccgctgtcccactcagggcgaggcgacacttgtggaggaacaagacgccaacttcgtgtgccggaggacgttcgtggaccggggctggggtaatggctgcggactctttgggaaagggtcgctgctgacttgcgccaagtttaagtgcgtcacgaagctagaggggaagatcgtccagtatgaaaacctcaagtactccgtaatcgtcactgtccacaccggcgaccagcaccaggtggggaacgagactacggagcacgggaccatcgcgactatcacgccccaagcccccacatctgagatccagttgacagactacggtgccctcaccctggattgctcgccgcgaaccggattagactttaacgagatggtcctcctgactatgaaggaaaagtcgtggctcgtgcacaagcagtggttcttagacctgcccctgccgtggacttccggggccagcacttcacaggagacatggaaccggcaggatctactggtgacattcaagaccgcccatgccaagaagcaagaggttgtagtgttaggctcccaggagggcgcaatgcacactgcccttacgggggccaccgagattcaaactagcggcaccaccacaatctttgccggtcacctgaagtgccgcctcaagatggacaagctcaccttgaagggtatgtcatatgtcatgtgtaccggttcattcaagctggagaaggaagtggcggaaacccaacacggcactgtgctggtccaggtgaagtacgaggggacagatgccccctgcaagatccccttctccactcaagacgaaaagggcgtaactcagaacggccggctcattacagcgaacccgatcgtcaccgataaggagaagcctgtgaacatagagaccgagccgcccttcggggaatcctatatcgtggtgggcgccggagagaaggcgctcaagctgtcgtggttcaagaagggtagctccatcggcaagatgttcgaagccaccgccagaggtgcccggcgaatggccatcctcggcgacaccgcatgggactttggaagcatcggaggcgtgttcacatccgtcgggaagctagtccaccaagtcttcggaaccgcatacggggtgctcttttctggcgtctcctggacaatgaagatcggcatcggcatcctcctgacatggctgggcctcaactcgcgttccacgagcttttcaatgacctgcatcgctgtcgggatggtcaccctatacctgggcgtaatggtgcaggccgactccggttgcgtaatcaactggaagggtcgggagctcaagtgcgggtccggaatttttgtcaccaacgaggttcatacgtggaccgaacagtacaagttccaggctgactcgccgaagaggttaagcgcggccatcggcaaggcttgggaggagggggtctgcggcattagaagcgccacccggctagaaaacatcatgtggaagcagatctctaacgagctcaaccacatcctgctcgagaacgacatgaagttcaccgtcgtggtgggtgatgccaacggcatcctggcgcaggggaagaagatgatccggccccagcccatggagcacaagtactcctggaagtcgtggggcaaagccaagattatcggagcagacatccagaacacaacgttcatcattgacgggccagacactccggagtgtcccgatggccagcgcgcgtggaacatatgggaggtcgaggactacggcttcggcatcttcaccacgaatatctggctgaagctgcgagactcctacacgcagatgtgcgaccaccgcttaatgtcagctgccattaaggactctaaggccgtgcacgccgatatgggatattggattgagagcgagaagaacgagacctggaagctagcaagagcgtcctttatcgaggtgaaaacctgcacgtggcccaagagccataccttgtggagcaacggagtactcgaatcggaaatgatcatccccaagatctacggtgggccgatctcacagcataactaccgccctggatacttcacccagactgccggtccatggcacctgggtaaactggaactcgacttcgacctatgtgagggcaccacggtggttgtcgacgagcattgtggcaacagagggccgagcctccgcaccacgaccgtcacggggaagatcatccatgagtggtgttgtcgctcctgcacactgccgccactgcgcttccggggtgaagacgggtgttggtacgggatggagatccgaccggtaaaggagaaagaggaaaacttggtgcgcagcatggtttctgccggcagcggcgaggttgacagcttctccctcggaatcctgtgtgtctccatcatgattgaggaagtgatgcgcagtcggtggagccgcaagatgctaatgaccgggactcttgccgtgttcctgcttctcatcatgggccagctgacctggaacgatctgatacgcctctgcatcatggtcggagccaacgctagcgatcggatgggcatggggaccacttacttggccttgatggccactttcaagatgcggccgatgttcgccgtggggctcctcttccgtcgcctcacgtctcgggaggtattactgctgacgatcggcctctccttggtagccagcgtagaactccccaattccctcgaggagctgggtgatggactcgcgatgggcataatgatgctcaaacttctgaccgagttccagccacaccagctatggaccaccttgctgagcttaaccttcgtaaaaaccaccttgtccttggactacgcttggaagacgaccgccatggtgttgagcatagtgtccctgttccctctgtgcctctcgaccacatcccagaagacgacctggttaccggtcctgttagggtcgttcggctgtaaaccactgactatgttcctcattacagagaacaaaatctggggtcgcaaatcctggcccctgaacgaagggattatggctatcgggatcgttagcatcctgctctccagtctcctgaagaacgacgtgcccctcgcgggcccgctcatcgccggcgggatgctgatcgcctgttacgtcatctccggctccagcgccgacctgtccttggagaaggccgctgaggtgagctgggaacaggaggccgagcactctggggccagccataacattctggtggaggtgcaggacgacgggaccatgaagatcaaggacgaggaacgtgatgatacgttgacgatcctattaaaggccaccctgctggccgtctccggggtgtaccccatgagcatcccggcaactctgtttgtctggtacttctggcagaagaagaagcagcgctctggcgtactctgggacacaccctcgccgcccgaggtggaaagagcagtcttagatgatggcatctaccgaatcctgcagcgggggctgctgggcaggtcccaggttggggtgggcgtattccaggacggggtgttccacaccatgtggcacgtgactcggggcgccgtgctcatgtaccaggggaaacgcttggagcccagctgggcctccgtgaaaaaggatctgatcagctacgggggaggttggcggttccaggggtcgtggaacaccggtgaggaggtgcaagtcatcgccgtggagcccggcaagaacccgaaaaacgttcagacgacgcctggtaccttcaaaacccctgagggggaggtcggggctatcgctctcgacttcaaacccgggacgtccggctccccgatcgttaaccgcgagggcaaaatagttgggctgtacggcaacggcgtcgtgaccaccagcggcacgtacgtgtctgcgatcgcgcaggccaaggcgagccaagagggtccgctgcctgagatcgaggacgaggttttcaagaagcggaacctcactattatggacctgcacccgggctctggcaagacccgccggtacctgcccgctatcgtgcgagaggcgatcaaacggaagctccgcactctcattttggcacccacccgagttgtagcgtctgagatggccgaggcattgaaggggatgcctatccggtaccaaacgaccgcagtaaagagcgaacacacgggccgcgagatagtggatctgatgtgccacgccacctttacaatgcggctgctctcccccgtccgcgtaccgaactacaatatgatcatcatggatgaggcgcactttaccgaccccgcgagcatcgccgcgcgggggtacatttcaaccagggtaggcatgggggaggccgctgctatcttcatgaccgccacgccccctggcagcgtggaagccttcccacagagtaatgccgtgatccaggacgaggaacgggacatcccagaacgtagttggaactctggctacgactggatcaccgacttccccgggaagaccgtgtggttcgttccgagcatcaaatccggcaacgacatcgcgaattgtctaaggaaaaatgggaagcgcgtgattcagctctcccgtaaaacctttgacacggagtatcagaaaaccaaaaacaacgattgggactatgtggtaaccacagacatctccgagatgggtgcaaacttcagagcagaccgggtgattgatcccagaaggtgtttgaaacccgttattctgaaggacggcccagagcgtgtcattctggcgggtccgatgcctgtaactgtcgcgagtgccgcacagagacgcggccggatcggtagaaaccagaacaaggagggagaccagtacgtgtatatggggcaacccctgaataacgacgaggaccacgcccactggaccgaagccaagatgctattggacaacataaacacccctgagggcataatccctgccctcttcgagcccgagcgcgagaagtccgccgccattgacggggagtaccgactgcgaggcgaggccaggaaaaccttcgtggagctgatgcgtcgtggcgacttacccgtctggctgagctacaaggtagcttccgaagggttccagtacagcgaccgcagatggtgcttcgacggggagcggaataatcaggtgctggaggagaatatggacgtcgagatatggacgaaggagggcgagcggaagaaattacgcccccgatggctagacgcacggacctactccgacccgctcgccctccgggaatttaaggagttcgccgctggccgccggtcagttagcggcgatctgatactggaaatagggaagttaccccaacatctgacacttcgcgcccaaaatgcgctcgataacctggtgatgctgcacaactcggagcagggcggaaaggcctacaggcacgcaatggaagagttgcccgacaccatagagactctgatgctgctcgccctgatcgcggtcctgactggcggggtcaccctcttctttttatctggcaagggcctgggtaagacctctataggcctactatgcgtcactgccagctccgcactgctgtggatggccagcgtggaaccccattggatcgccgcgtccatcatcctggagtttttcttaatggtactcttgatcccggaacccgaccgccagcggacgccacaggacaaccagctggcctatgtggttatcgggttactgttcatgatcctcaccgtggccgccaatgagatgggcctcctggaaaccaccaaaaaggacttaggtatcggatacgtggccgcggaaaaccaccagcacgctacgatgctagacgtagacctgcgcccggccagcgcttggaccctgtacgctgtggcgaccaccgtgatcacgcccatgatgcggcatacaatcgaaaatactaccgcgaatatcagtttgaccgcaatcgccaaccaggccgcgatcttgatgggactggacaaggggtggcccatcagcaagatggatatcggcgtcccccttctggcactgggttgctatagccaagtaaatcccctcaccttgaccgccgccgtactgatgctagtcgcccactacgccatcattggccccgggctgcaggccaaggcaacccgggaggcccagaagcgcacggccgccggcatcatgaagaaccccaccgtggacgggatagtggccattgacttggaccccgtagtctacgatgccaaatttgagaagcagttagggcaaatcatgctgctgatcctctgcacaagccagatcctgttaatgcggacaacgtgggccctctgcgagtcaatcacccttgcgaccgggcctctaacgactctctgggaggggtcgcccgggaagttctggaataccacgatcgcagtgagtatggccaacatcttccgcggcagctacctggccggggcaggcctggcgttctccctcatgaaatcactagggggcgggcgacgcggtaccggagcccagggtgaaacgctgggtgagaaatggaagcggcagctcaaccagctgtccaagagcgagtttaacacgtacaagcgcagcggtatcatggaggtcgatcgttcagaggcgaaggagggtctgaagcgcggggaaaccaccaagcacgctgtgagccgaggtacggcgaaactccgctggttcgtggaacgtaacctagtaaagcccgagggcaaagtgattgatctggggtgcggccgcgggggctggtcctactactgcgccggcctgaagaaagtcaccgaggttaaggggtacactaagggaggtccaggccacgaagaaccaatgcccatggccacctacgggtggaacctggtgaagctgcacagcggtaaggacgtattcttcatgccgcccgaaaagtgcgacaccctactctgcgatatcggtgagtccagcccgaacccaacgatcgaagagggtagaaccctgcgcgtcctgaaaatggtagaaccttggctcaaggggaatcagttttgcatcaaaatcctgaacccctacatgccgagcgtggtagagaccctggagcagatgcagcggaagcacggaggtatgctagtacgcaaccccctgagcagaaactccactcatgagatgtattgggtgagctgcgggaccggcaacatcgtcagcgcagtgaacatgacctctcgcatgctactcaatcggtttaccatggcgcaccgcaagcctacttacgagcgagacgtggacttgggagcggggacgcggcacgttgccgtggaacccgaggttgccaatctggacattatcgggcagcgcatcgaaaatatcaagaacgagcacaagtcgacctggcactacgatgaagacaacccatacaagacctgggcctaccacgggtcgtacgaggtcaagccgtcgggctcggcttcgagcatggtgaacggggtcgttcggctcctgaccaagccctgggatgtaatccccatggtaacgcagatcgcaatgaccgacaccaccccgttcggacagcagcgcgtgttcaaggaaaaggtcgacacccggacgccccgcgcaaaacggggcaccacgcaaatcatggaggtgacggccaagtggttatgggggttcctctcccgcaacaagaagcccaggatctgcactcgagaggagtttaccaggaaggtgcgcagcaacagcgccatcggcgcggtgttcgttgacgagaaccaatggaacagtgcgaaggaggcggtcgaggacgagcggttttgggacctggtgcaccgcgagcgggagctacacaaacaaggtaaatgtgcaacctgcgtttacaacatgatgggcaagcgcgagaagaaacttggggagttcggtaaagctaagggtagccgcgcgatctggtacatgtggcttggagcacgcttcctggagttcgaggccctaggctttatgaacgaagatcactggttctcccgcgagaactcactgtcgggggtggaaggggaggggcttcataaactcggctacatcttgcgtgacatctctaagatcccaggagggaacatgtacgccgacgacacggccggctgggacacccggatcaccgaagacgacctgcaaaacgaggcgaagataacggacatcatggaaccggagcacgccctcctggctacttcaatcttcaagctgacctaccagaacaaggtggtccgcgtgcagcgccccgccaagaacggaacagtaatggacgtcatcagccggcgcgaccagcggggctcgggccaggtaggaacgtatggcctaaacacgtttaccaacatggaggtacagctgatccgccagatggagagcgaaggtatcttctcccccagcgaactggagaccccgaaccttgccgaacgggttcttgattggctagagaagcacggtgcggaacgactcaagcggatggctataagcggagacgactgcgtcgtaaagccgatcgacgaccgctttgccactgcattgactgcgctaaatgatatggggaaggtacggaaggacatacctcagtgggagccaagcaagggctggaacgactggcagcaggtcccattttgttcccaccatttccaccagctcatcatgaaggacgggcgcgagatcgtggttccgtgccggaaccaggacgagctggtgggcagagcacgcgtgagccagggggccgggtggagtttacgcgaaacagcctgcctcggtaagagctacgcgcagatgtggcagctcatgtacttccatcggcgcgacctgagactcgccgcgaatgctatctgtagcgccgtccccgtggactgggtgcccacatcccgtacaacctggtccattcacgcacaccaccagtggatgacgaccgaggacatgctgtctgtgtggaatcgggtgtggatcgaggaaaacccctggatggaggacaagacccacgtgagctcttgggaggaagtaccctacctgggcaagcgcgaggaccaatggtgcggaagcctcatcggcttaaccgcccgggcgacgtgggccaccaacatacaggtggccatcaaccaggtgcggcgcctaatcggcaacgagaactatctcgactacatgacaagtatgaagcgattcaaaaacgagtcagaccccgagggcgccctgtggtag

SEQ ID NO: 24050 - RNA, 9879 nt, synthetic construct
  misc_feature 1..9879: note = derived and/or modified CDS sequence (opt11) from DENV-1__JN819412__SS-prME
  source 1..9879: mol_type = other RNA
agcgtgaccatgctgctcatgctgctgccaaccgcccttgctttccacctgaccacccgcggcggggagccacacatgatcgtgtctaaacaagagcggggcaagagtctcctgttcaagacctcggcgggtgtaaacatgtgcaccctgatagccatggacctgggcgaattgtgcgaggacaccatgacctacaaatgcccccgcatcacagaagccgagcccgatgacgtcgactgctggtgtaacgcaaccgacacttgggttacgtacggcacctgcagccagaccggcgagcaccggcgcgacaagcggtccgtggccctggcgccacacgtaggcctgggtttggagacgcgcaccgaaacgtggatgagctccgagggggcctggaagcagatccagcgggtcgagacctgggccctgcgccaccccggcttcacggtgatcgccctgttcctcgcacatgccatcggcaccagcatcacccaaaaggggatcatctttatcctgctgatgctcgtgactccctccatggcgatgcgttgcgtaggcattggcaaccgcgacttcgtagaggggctgtcgggcgccacgtgggttgacgtagtgctggagcacgggtcctgcgtgacaacaatggccaaaaataaacccacgctcgatatcgagctgctgaagacggaagtcaccaaccccgctgtgctccgtaagctatgcatcgaagctaagatcagcaacacgaccacggactcccgctgcccgactcagggcgaggccaccctggtcgaggagcaggacgcgaacttcgtctgccggcgaaccttcgtggatcggggatgggggaacggctgcgggcttttcggcaagggtagcctgctgacgtgcgccaagttcaagtgcgtgaccaagttagagggcaagatcgtccagtacgagaacctgaaatactccgtgatcgtgaccgtccacaccggcgaccagcaccaagttggtaacgagacgaccgagcacggcactatcgcgactatcacgccccaagcccccacgtccgagatacagctgaccgactacggagccctcaccttagactgcagtccccgcaccggcctcgatttcaacgaaatggtcctgctgacgatgaaagagaaatcctggctggtgcacaaacagtggttcctcgacctgccgctgccctggacctccggggccagcaccagccaggagacctggaatcggcaggaccttttggtaacgttcaagaccgcccatgcgaagaagcaggaggtcgtggtgctcggctcacaagagggcgccatgcacaccgccctcacgggggccacggagatccagaccagcggcaccactacgatcttcgccggacatctcaaatgccgcttgaaaatggacaagctcacgctgaaggggatgtcctacgtcatgtgcaccgggagcttcaagctggagaaggaggttgcggagacccagcacggcacggtgctggtccaggtcaagtacgagggtacggacgccccttgtaagatccccttctccacccaggacgagaagggggttacccagaacggccgtttgatcaccgcgaaccctatcgttaccgacaaggagaagcccgttaatatcgaaaccgagccgcccttcggtgagtcctacattgtggtcggcgctggagagaaggcgctgaagctgtcatggtttaagaaggggagctccatcggcaagatgttcgaggccaccgcccgcggggctagacgcatggccatactcggcgacacggcgtgggacttcggctcaattggcggcgtgttcacctcggtggggaagctggtccaccaggtgtttggcaccgcatacggggtgttgttcagcggagtctcctggaccatgaagatcgggatcggtatcctactgacgtggcttggcctcaactcacgctccacatctctgtccatgacttgcatcgccgtggggatggtgaccctgtacctcggcgtcatggtgcaggccgacagcgggtgcgtgatcaactggaaaggccgggaactgaaatgtgggtccggcatctttgtaacgaacgaggtgcatacctggaccgagcagtacaagttccaggccgacagcccgaaacgcctgtcagcggctatcgggaaggcgtgggaggagggggtgtgcggcatccggtccgccacacgcctcgagaacatcatgtggaagcagatttcaaacgagttgaaccacatcctgctcgagaacgacatgaagtttacagtcgtcgtgggggacgcaaacggcatcctggcgcaggggaagaaaatgatccggccccagccgatggagcacaagtattcctggaagtcctggggcaaggcaaagataatcggcgccgacatccagaacacgaccttcatcatcgacgggcccgacaccccggaatgcccggacggtcagcgggcctggaacatctgggaagtcgaagactacgggtttgggatcttcacaacgaacatctggcttaaactccgggactcctacacccagatgtgcgaccacaggcttatgagcgcggccatcaaggactccaaggcagtgcacgctgacatgggctactggatagagagtgagaagaatgagacctggaagttagcccgggcgtccttcatcgaggttaagacgtgcacatggcccaagagccacaccctctggtccaacggggtcctggagagcgagatgatcatccccaagatctacggcggtccgataagtcagcataattatcggccaggttacttcacccagaccgccgggccctggcacctgggcaagctcgaactggacttcgacctgtgcgaggggacgaccgtggtggtcgacgagcactgcgggaacagaggcccgagcctccgcacgactacggtgactgggaagataatccacgagtggtgctgccggtcctgtaccctgccgcccctgaggttccggggtgaggatgggtgctggtacggaatggaaatacgacccgtgaaggagaaggaggagaacctcgtccgatcgatggtgtctgcgggcagcggggaagtggactcattctccctgggcatcctgtgcgtcagcatcatgatagaagaggtgatgagatcccggtggagccggaaaatgctcatgaccgggacactggccgtctttttactcctgatcatgggacagctgacgtggaacgacctcatccggctttgcatcatggtgggggccaacgcgagcgaccggatgggcatggggaccacctacctggccctcatggccaccttcaagatgcgcccaatgttcgcagtggggctcctgtttcggagactaaccagccgggaagttctgttattaaccatcgggctgtctctggtcgccagcgtggagctccctaactccctggaggagctgggggacggcctcgcgatgggcatcatgatgttaaagctgctcaccgagttccagccgcaccagctgtggactaccctactcagcctgaccttcgtcaagaccacgctatccctagactacgcctggaagaccaccgccatggtgcttagcatcgtttccttattccccctctgtctaagcacgacgtcccagaagaccacatggcttccagtcctcctggggagcttcggctgcaagccactgaccatgttcttgatcaccgagaacaagatttgggggcgcaagtcctggcccctgaacgaaggcatcatggctatcggtatcgtgagcatcctgctttccagcctcttgaagaacgacgtgccccttgcaggtccgcttattgccggcgggatgcttatcgcctgctacgtcatcagcggctccagcgccgatctcctgctggagaaagccgcggaggtgtcctgggagcaggaggccgagcacagcggggcaagccacaacatcctcgtagaggtccaggacgacgggacgatgaagatcaaggacgaggaacgggatgacaccttgaccatcctgctaaaggcgaccctgctggccgtctccggggtgtatcccatgtccatccccgcgacgttgtttgtgtggtacttctggcagaagaagaagcaacgcagcggcgtgctgtgggataccccctccccgcccgaggtggagagagccgttctggacgatggcatctaccgcatactgcaacgggggctcctggggcgcagccaagtaggggtcggcgtattccaggacggggtctttcacaccatgtggcacgtaacccggggcgccgtcctgatgtaccagggcaagcgcctcgagccatcctgggccagcgtgaagaaagacctgatctcctacgggggcgggtggcggttccagggcagctggaacacgggggaggaggtgcaggtgatcgccgtggagcccggcaaaaacccgaagaacgtgcagaccacgcccggcacctttaagacgcccgagggggaggtcggtgcgatcgccttggacttcaagcccgggacctccggcagcccgatcgtgaaccgcgaaggtaagatcgtggggctctacggcaacggggtcgtgaccacctccggtacgtacgtgagcgcgatcgcccaggccaaggcaagtcaggaggggcccctgccagaaatcgaggacgaggtcttcaagaagcggaacctgacgatcatggacctccatccgggaagcggcaagacccgccgctatctgcccgccatagtgcgcgaggctatcaagcggaagctgcgcacactcatcctggcccccacgcgcgtggtcgctagcgagatggctgaggcactgaaggggatgcccatccggtaccagactaccgccgtgaagtccgaacacactggccgtgagatagtagacctcatgtgccatgcaacgttcaccatgcggctgctcagccccgtccgcgtgccgaactacaacatgatcataatggacgaggcgcacttcaccgaccccgcctccattgccgctcggggctacatcagcaccagagttggcatgggggaggctgcggccatcttcatgacggctacgccgcccggatccgtcgaggccttcccgcagagcaacgcggtgatccaggacgaggagcgggacatccccgaacgctcctggaatagcggctacgactggatcaccgatttccccgggaagaccgtgtggttcgtgccttccatcaagtctggcaacgacatcgctaactgcctccggaaaaacgggaagcgtgtgatccagctgtcccggaagacgttcgacaccgagtaccagaagaccaagaacaatgactgggactacgtggtcaccacggacatcagcgagatgggcgccaacttccgcgccgaccgggtaattgacccccgccggtgcctgaagccagtgatcctcaaggacgggccagagcgtgtgatccttgccggcccgatgccagtgacagttgcgtccgccgcccagcggagaggccggatagggcgcaaccagaacaaggagggcgaccagtatgtatacatggggcagcccctgaacaacgatgaggaccacgctcactggaccgaggcgaagatgctcctggacaatatcaacactccagaggggatcatcccggcgctgttcgagcccgagcgagagaagtccgcggccatcgacggggagtaccggctccgcggtgaggccagaaagacgttcgtagagctcatgcggcggggcgacctgcccgtctggctctcctacaaggtggccagcgaggggttccagtactccgaccgccggtggtgcttcgacggcgagcgcaataaccaggtgctggaggagaacatggacgtcgagatttggaccaaggagggggagcgtaagaagctccgcccgcggtggttggacgcaaggacctactccgacccgctggctttgagagagttcaaggagttcgccgccggccgccggtccgtgagcggagacctcatcctggagatcgggaaactgccccagcatctcaccctacgcgcgcagaatgcgctcgacaatctcgttatgctgcataacagcgagcagggcgggaaggcctaccggcacgccatggaagagctgcccgacaccattgagactctgatgcttcttgccctcatcgcggtcctgaccggcggggttactctgttcttcctctccggcaagggcttagggaaaaccagcatcggtttgctctgcgtaacggcatcctcggccctgctgtggatggcctccgtcgagccccactggatagccgcgagcatcatactcgagtttttcctgatggtgctattaatcccggaacccgatcgccagcggacgccccaggacaaccaattagcctacgtcgtcatcggcctcttgttcatgatcctgacagtggcggcaaacgagatgggcctactcgagaccacgaagaaggacctagggatcggctacgttgccgcggagaaccatcagcacgccaccatgctggacgtcgacctccgcccggcctccgcctggaccctgtatgccgtggcgacaacggtgatcacccccatgatgcggcacaccattgagaacacgaccgccaacatcagcctcacagccatcgccaaccaggccgcgatcctcatgggcctggacaaggggtggcccatctccaagatggacatcggcgtgcccctgctcgcccttggctgttattcgcaagtgaacccgctgacactcaccgccgccgtgctgatgctcgtcgcgcactacgccatcatcggccccgggctccaggcaaaagccacgcgcgaggcccaaaagcgcacagctgccggcatcatgaagaatcccaccgtggacgggattgtcgccatagacctggaccccgtggtgtacgatgccaagtttgagaaacagctggggcagatcatgctcctgatcctctgcacctcccagatcctgctgatgcggacgacctgggccttatgcgagagcatcaccctcgcgaccggccccctgacgaccttatgggaaggttcccccggaaagttctggaacacgaccatcgccgtatccatggctaacatcttccgcgggtcttacctcgccggtgctggcctggcgttcagcctgatgaaaagtctcgggggagggcgccgcgggacgggcgcccaaggggaaacgctcggcgagaagtggaagcgacaactcaaccagctcagcaagtccgagttcaacacctacaaacgcagtgggatcatggaggtggaccggagcgaggctaaggagggcctgaagcggggggaaaccacgaaacacgccgtgagccgcggcaccgcaaagctgcgctggttcgtggagaggaacctggtcaagccggaaggcaaggtgattgatctcgggtgcggccgcggggggtggagctactactgtgccggcctgaagaaagtgacagaggtcaagggctacactaagggcgggcccggccacgaagaaccgatccccatggccacgtacgggtggaacctggtcaaactccactccggcaaggacgtattcttcatgccgcccgagaagtgcgacacgctcctgtgcgacatcggggagagctccccgaaccccacaatcgaggagggccggaccctccgcgtcctgaagatggtggaaccctggctaaaggggaaccagttctgcatcaagatcctcaacccctacatgcctagcgtggtcgagaccctggagcagatgcagcgaaagcacgggggcatgctggtgcgcaaccccctctcccggaacagcacgcacgagatgtactgggtttcctgcgggaccggcaacatcgtcagcgccgtgaacatgacctcccgtatgctgttaaaccggttcaccatggcccatcgcaagcccacctacgagcgcgacgtggacctcggcgcaggtacccggcacgtcgccgtggagcccgaggtggccaacttagacatcatcggccagcgcatcgagaatatcaagaacgagcataaaagcacctggcattacgacgaggacaacccgtataaaacctgggcctaccacgggtcctacgaggtcaagccctctggctctgcgagctccatggtgaacggggtcgtgcggctgctcacgaagccctgggacgtgatccccatggtcacccagatcgcgatgaccgacaccacgccgttcggccaacaacgcgtgttcaaggagaaagtggacacaagaacgccacgagccaagcgggggaccactcagattatggaggtaaccgccaagtggctgtggggcttccttagccgcaacaagaagcccaggatctgtacccgcgaggagtttacccggaaggtgcgctccaacgccgccataggcgcggtgttcgtggacgagaaccaatggaatagcgccaaagaggccgtggaggacgagcggttctgggatttagtgcatcgcgagcgggagctgcacaagcaggggaagtgcgccacgtgtgtctacaatatgatgggcaagcgcgagaagaagctaggggagttcggcaaggcgaagggctctcgggcgatctggtacatgtggctcggggcccgcttcctcgaatttgaggccctgggcttcatgaatgaggaccactggttctcgcgggagaactctctatccggggtcgagggcgaggggctgcacaaactgggctacatcctccgcgacataagcaagatcccgggcgggaacatgtacgctgacgacaccgcgggctgggacacacggatcaccgaggacgacctacagaacgaggcaaagatcacggatatcatggagcccgagcatgcactgctcgccaccagcattttcaagctaacctatcagaacaaagttgtccgcgtgcagcgccccgccaagaacgggacggtgatggatgtcatcagccggcgcgaccagcggggctccggccaggtggggacgtacggcctgaacaccttcaccaacatggaagtgcagttaatccgccagatggagagcgaggggatattcctgccctccgagctggagactccgaacctcgcggaacgggtcctggactggctggaaaagcacggcgccgagcgcttaaagcggatggcgatcagcggggacgactgtgtagtgaagcccatcgacgaccgattcgctacggcccttacggcgctgaacgacatgggcaaagtgcggaaggacatcccccagtgggagcccagtaagggctggaacgactggcagcaggtcccgttctgcagccaccacttccatcaactcatcatgaaggacggacgcgagattgtggtaccatgtaggaatcaggacgagctagttggccgcgcccgggtgtcacagggggccggctggagcctgagggagaccgcctgcttggggaagtcatacgcccagatgtggcagctgatgtacttccatcggcgcgacctacggctcgctgccaacgccatctgctccgccgtccccgtcgactgggtacccacctcacgcaccacgtggagcatccacgcgcaccaccaatggatgacaaccgaggatatgctgagcgtgtggaaccgggtgtggatcgaggagaacccatggatggaggacaagacacacgtgtcctcatgggaggaggtcccttacctgggcaagcgcgaggaccagtggtgcggctccttaatcggactgacggcccgcgccacctgggctaccaacatccaggtagcgatcaaccaggtgcgacgcctgatcggcaacgagaactatctcgactacatgaccagcatgaaacggttcaaaaacgagagcgacccagagggagcgctgtggtaa

SEQ ID NO: 24051 - RNA, 9879 nt, synthetic construct
  misc_feature 1..9879: note = derived and/or modified CDS sequence (opt11) from DENV-1__FJ810415__SS-prME
  source 1..9879: mol_type = other RNA
agtgttactatgcttctcatgttattacccaccgccttagctttccacctgactactcgtggcggggagcctcacatgattgtaagcaagcaagagcggggcaagagcctcctatttaagacctccgcaggggtgaacatgtgcaccctgattgccatggacctaggggagctctgcgaggacaccatgacctacaagtgccccaggatcacagaggccgagcccgacgatgtcgactgctggtgtaacgccaccgacacctgggtgacctacgggacatgctcgcaaacgggtgagcaccgtcgagaaaagcggtccgttgccctggcgcctcacgtgggcctgggactagagactcgcaccgagacctggatgagctctgagggcgcttggaagcagatccagcgggtcgagacctgggctctgcgccatccaggttttacggttatagccttctttctggctcacgccatcggcaccagcatcacccaaaagggggtcatctttatcctcctgatgctggttacaccgtccatggccatgcggtgcgttggcatcggcaatcgcgactttgtggaggggcttagcggcgccacgtgggtcgacgttgtgctggagcacgggtcctgcgtgactactatggccaagaacaagcccaccctggatatcgagctcctgaaaacggaagtgactaaccccgcggtgctgcggaaactatgtatagaagccaaaatttccaataccactaccgactcccgctgcccgacccagggcgaggcgaccttggtcgaggaacaagacgccaacttcgtgtgccggcgcaccttcgtggaccgcggctgggggaacggctgcgggctgttcggtaagggaagcctcttaacgtgcgcaaagttcaagtgcgtcaccaagttggaaggaaagatagtgcagtacgagaacctcaaatattccgtgatcgtcaccgttcacaccggcgaccagcaccaggtcgggaacgagacgaccgaacacggcacgatcgcgaccatcacgccccaagcccccacgagcgagatccagctaacggattatggggctctaaccctcgactgcagcccccggacgggcctggacttcaacgagatggtgttgcttacgatgaaagaaaagtcctggctggtgcacaagcagtggtttttggacctaccgctgccctggacttcaggggcctctaccagccaagaaacctggaacagacaggacttgcttgtcaccttcaaaacggcccatgcgaagaagcaggaggtagtggtcttgggttcccaggagggagcgatgcacaccgcactgactggggctacggagatccagacctcgggcaccaccaccatatttgccgggcacctaaagtgtcgcctgaaaatggacaagctgaccctcaaaggcatgtcctacgtgatgtgcaccgggtcattcaaactggagaaggaagtggcggagactcagcatggaactgtcctggtacaggtgaaatatgagggcaccgatgccccctgcaagattcctttctccacccaagacgagaagggcgtcacccagaacgggcggcttatcactgccaacccaatcgtgaccgacaaggagaagcccgtgaatatcgagaccgagccgcccttcggggagagctacatcgtagttggtgccggcgagaaggcgctcaaactgaactggttcaagcgagggtccagcatcggcaagatgttcgaagccactgcccgcggagcgcgccgcatggccatcctgggagacacggcgtgggacttcgggtccatcggcggtgtgttcacctcagtcgggaaacttgtgcatcaggtcttcggtaccgcctacggggtgctattctccggcgtgtcttggaccatgaagatcggtatcggcatcctgctcacgtggctgggcctgaacagtcggtcgacctcactcagcatgacctgcatagctgtggggatggtcaccctctacttgggcgttatggtccaggccgactccgggtgcgtcatcaactggaagggccgcgagctaaagtgcgggagcggcatcttcgtgacgaacgaggtgcacacctggaccgagcagtacaagttccaggccgacagtccgaaaagactgagcgcggccattggtaaggcctgggaggaaggggtctgcggaataaggagtgccacccggctggagaatatcatgtggaagcagataagcaacgagttaaaccacatcctgctggagaacgacatgaaattcacggtggtggtcggtgatgccaacggtatcctcgcgcagggcaagaagatgatccgaccccaacccatggagcataagtactcctggaagtcctggggcaaggcaaagattatcggggccgacatccagaacacgaccttcatcatcgacgggcccgacacacccgagtgcccagacggccagcgggcctggaacatttgggaggtggaggactacgggttcggcgtgttcacgactaacatctggctgaagctgcgcgacagctatacacaaatgtgcgaccaccggctcatgtccgcggcgatcaaggacagcaaggccgtccacgcggacatggggtattggatcgagtccgagaagaacgaaacatggaagctcgcccgcgcgagcttcatcgaggtgaagacgtgcacttggcccaaatcccacaccctatggagcaacggggtgctcgaatccgagatgatcatccctaagatctacggagggccgatcagccagcacaactacagaccgggctactttacccagaccgccgggccctggcacttagggaagctggagctcgatttcgacctctgtgagggcactaccgtcgtggtggacgagcactgcgggaaccgcggaccgtccctgaggactacaactgtgaccgggaagatcatccacgaatggtgttgccgcagctgcaccctaccacccctgcggttccgcggagaggacgggtgctggtacggaatggagattcggcctgtgaaggagaaggaggagaacctggtgcgctccatggtcagtgccggctcaggggaggtggactccttcagcttaggcatcctttgcgtgtccatcatgattgaggaagttatgcgcagccgctggtccagaaaaatgctgatgacggggacgctcgcggtcttcttactactcatcatggggcagttgacctggaacgacctgatcagactctgcatcatggtcggggccaacgcgagcgaccgcatgggcatgggcacgacttacctggctctgatggctacgttcaagatgcgtccgatgttcgccgtcgggctccttttccgccggctaacctccagggaggtgcttctgctgaccataggcttgagcctcgtcgcttctgtggagttgcccaacagtcttgaggaactgggggatggcctggcgatgggaatcatgatgctcaaattactaaccgagttccagccgcaccagctatggacgactttgttatcgctcacctttgtgaaaactacgctgagcctggactacgcctggaagaccaccgcgatggtcctctccatcgtgagcctgttccctctgtgcctctccaccacgagccagaaaaccacgtggctgcccgtgctgctcgggtccttcggttgcaagcccctgaccatgttcctgataaccgagaacaaaatatgggggcgcaagtcctggcccctgaatgagggcataatggccatcgggatcgtttccatcttgttaagctccctcctcaagaacgacgtcccgttagccgggccgttgatcgccggcgggatgctaatcgcgtgctatgttatctccggctcgtccgctgacctttcactcgagaaggccgcagaggtctcctgggagcaggaagccgaacacagcggggcatcccacaacatcctggtggaggtgcaggacgacgggaccatgaaaatcaaagacgaggagcgcgacgacactctgaccattctcctaaaggccaccctgctcgcggtcagcggtgtgtaccccatgtccatcccagcgacgctgttcgtgtggtacttctggcagaaaaagaagcagcggagcggcgtcctgtgggacactccgtccccacccgaagtggaaagggcagtgctcgacgatggaatctaccgtatcttacagcgagggctgctgggacggagccaagtcggggtgggggtgtttcaggacggggtcttccacaccatgtggcacgtgacccgaggcgccgtgctcatgtaccaggggaagcggctggagccgtcctgggcaagcgtcaagaaggacctgatttcctacgggggcgggtggcgattccagggctcatggaacactggggaagaggtccaggtgatagccgtcgaacccggcaagaacccgaagaacgtgcagaccacccccggcaccttcaaaacgcccgagggggaggtgggcgcaattgctctcgacttcaagccagggacctccggcagcccgatagtcaaccgggagggcaagatcgtggggttatacggcaacggtgtcgttaccacctccggcacttacgtgagcgccatcgcccaggccaaggcgtcccaagagggtccgctgcccgagatcgaggacgaggtttttaagaagcgaaaccttaccataatggatctgcacccgggctccggcaagacccggcgctacctgcccgcgattgtccgggaggccataaagcgcaaactacgcaccctgatactggcgccgactcgggtggttgcgagcgagatggcagaggcgctcaaggggatgccaatccgctaccagaccaccgccgtcaagtccgagcacaccggccgggagatcgtggacctgatgtgccatgccacgtttactatgcgactgctcagtccggtgcgggtccccaactacaacatgatcattatggatgaagcgcacttcaccgaccccgcaagtatcgcagcccgagggtacattagcacccgggtgggcatgggggaggccgcagccatctttatgacagccacgccgcccggctctgtcgaagcattcccccaatcgaacgccgtcatacaggatgaggagcgcgatattcccgagcggtcctggaatagtggctacgactggatcacggacttccccggtaagacggtatggttcgttccctccatcaagagtggcaacgacattgcgaattgcttacgcaagaacggcaagcgggtcatccagctgtctcgcaagacgttcgacacggagtaccagaagaccaagaacaacgactgggactatgtggtgaccacggatatctctgagatgggcgccaacttccgggccgacagggtcattgatccccggcgctgcctcaagcccgttatcctgaaggacgggcccgagcgggtcatactggccggcccgatgccggtcaccgtggcgtccgccgcccagcgcaggggccgcatcgggcgcaaccagaacaaggagggtgaccagtacgtctatatgggccagcccctcaacaatgacgaggaccacgcccactggaccgaggccaagatgctgctggacaacattaacactcccgagggcatcatcccagccctctttgagcccgagcgggaaaagtccgccgcaatcgacggggagtaccgactgcggggcgaggcccgcaagacgttcgtggagctgatgcggcgcggcgacctccccgtgtggctgtcgtataaggtcgccagcgaaggattccagtactcagaccggcgatggtgcttcgacggcgagcggaacaaccaggtgctggaggagaatatggacgtagagatctggaccaaggagggggagcgcaaaaagctcaggccgaggtggctcgacgcgagaacctactccgaccccctggccttacgcgagttcaaagagttcgcagctggccggcgctcagtcagcggcgacctgatcttggaaattggaaagctcccacagcacctgaccctacgggcccaaaatgcgctcgataaccttgtcatgttgcacaacagcgagcagggcgggaaagcgtatcgccacgcaatggaggaattacccgacaccatcgagacgctgatgctcctcgccttaatcgcggttctgaccggaggggtcaccctcttctttctgtccggcaagggcctgggtaagacgtctattggccttctgtgtgtgaccgcaagcagcgccctgctctggatggcttccgttgaaccccactggatcgccgcaagcattatcctggagttcttcctgatggtgctactgatcccggagcccgatcggcaacgcacccctcaggacaaccagctggcctacgtggttatcgggctcctgttcatgatactgaccgtcgccgccaacgagatgggcctcctggagaccacgaagaaggatctggggatcggctacgtggccgcggagaaccaccagcacgcaaccatgctagacgtggacctgcacccagcgtccgcctggaccctgtacgccgtcgcgactacggtgataacccccatgatgcggcacaccatcgagaacaccacggccaatatcagcctgacggccatcgccaaccaggccgcgatcctgatgggcctggacaaagggtggcccatctccaaaatggacatcggagtgcccctcttggccctggggtgctacagtcaagtaaacccgctcaccctgactgccgctgtcctgatgctcgtggcgcactatgccatcatcggccccgggctgcaggccaaggcaacgcgcgaggcccagaagcgcaccgcggctggcatcatgaagaaccccacggtcgatggcatcgtggccatcgacctagatcctgtggtctatgacgccaagttcgagaagcaacttgggcagatcatgctgctcatcctctgcacttcccagatactgctcatgcggacgacgtgggcactgtgcgagagcatcacactggcgacaggcccgctaacgacgctctgggagggctcccctggtaagttctggaacaccaccatagccgtaagcatggcaaacatcttccgcggctcctatctggcaggggccggactggcttttagccttatgaagtccctcgggggcgggcggcgcggcacgggcgcacagggggagaccctgggagagaaatggaagcggcagctcaaccagctaagcaagtccgagttcaatacctacaaacgcagcggcatcatggaggtggaccggtcagaggctaaggagggcctgaagcgtggggaaaccaccaagcacgccgtctccaggggcaccgcgaaacttcgctggttcgtcgaacggaacctggtgaagcccgaaggcaaggtcatcgacctggggtgcggccgagggggctggagctactactgtgccgggctgaagaaggtaaccgaggtgaagggctacaccaagggcgggcccggccacgaagaaccgatccccatggcgacctacggttggaatctcgtaaagctgcactccggcaaggacgtgttcttcatgcctcctgaaaagtgtgacacgctgttgtgcgacatcggggagagttccccaaatcccaccatcgaagagggccggactctccgcgtgctgaagatggtcgagccctggcttcgggggaaccagttctgcataaagatcctaaacccctacatgccgagcgtggtggagaccctggagcaaatgcagcgcaagcacgggggcatgctcgtccggaaccccctctcccgcaacagcacgcacgagatgtactgggtgtcatgcgggaccggcaatatcgtgagcgctgtgaacatgacctcgcggatgctactcaatcgcttcaccatggcccaccgcaagcctacgtacgagcgggacgtggacctcggggcggggacacgccacgtagctgtcgaacccgaggtggccaatctggacatcattggccagcggatcgaaaacatcaagaatgagcacaagagtacctggcattacgacgaagataatccgtacaagacctgggcctaccacggttcttacgaggtcaagccctctggctccgcatcatctatggtaaacggggtggtcagactcctgacaaagccatgggatgtgatccccatggtcacccagatcgcaatgaccgacaccacaccgttcggacagcagcgcgttttcaaagagaaggtggacacccgcacgccccgagctaagcgcggaaccacgcagatcatggaggtgaccgccaagtggctctgggggttccttagccgcaataaaaagccccgcatctgcacgcgggaggagttcacccgcaaggtcaggtcgaatgccgccatcggtgcggtgttcgtggacgaaaaccagtggaacagcgccaaggaggccgtcgaggatgaaaggttctgggacctggtgcaccgggagcgtgagctgcataagcaggggaaatgcgcgacgtgtgtgtacaacatgatgggcaaacgtgagaagaagctcggggagtttggcaaggcgaaaggctcaagggccatctggtacatgtggctgggggcccggttcctggagttcgaagccctgggcttcatgaatgaggatcactggttctcccgcgagaacagtctgtccggggtcgagggcgaagggctgcataagctgggctacattctgcgggacatcagcaagatcccaggagggaacatgtatgccgacgacaccgcgggctgggacacccggatcaccgaggacgacctccagaatgaggccaaaatcacggatatcatggagcccgagcacgccttactggccacttccatttttaagctgacttaccagaacaaagtggtgagggtccaaaggcccgccaagaatggtactgtgatggacgtcatcagccgcagagaccagcgcggctccggccaggtcggcacgtatggactcaataccttcaccaacatggaggtgcaactgatacggcagatggagagtgaggggatcttccttccctccgagctggaaaccccgaacctggcggagcgcgccctggactggctggagaaacacggggccgagcgactgaagcgcatggcaataagcggtgatgattgcgtagtcaagcccattgacgacagatttgccacggcgcttaccgccctcaacgacatggggaaggtgcgcaaagacatcccacaatgggagccctccaagggctggaatgactggcaacaggtcccgttctgcagccaccatttccaccagcttattatgaaggacggcagggagatcgtcgtaccctgccgcaaccaggacgagttggtgggacgggcccgcgtcagccaaggggccggttggagcctccgggagaccgcgtgcttaggcaagtcctacgcgcagatgtggcagctaatgtacttccaccgccgggacttgcgcctggcagccaacgccatctgtagcgcggtccccgttgactgggtccccactagccgtaccacgtggagcatacacgcccaccaccagtggatgaccaccgaagatatgctgtcggtatggaatcgcgtctggatagaagagaacccgtggatggaggataaaacccacgtctccagctgggaggaggtgccctacctcggtaaacgtgaggaccagtggtgtggcagtctgattggcctgacggcccgggccacctgggccaccaacatccaggtggcgataaatcaggtgcgccggctcatcggcaatgagaactacctggattacatgacttccatgaaacgcttcaaaaacgagtcggaccccgagggggccctgtggtga

SEQ ID NO: 24052 - RNA, 9879 nt, synthetic construct
  misc_feature 1..9879: note = derived and/or modified CDS sequence (opt11) from DENV-1__FJ639814__SS-prME
  source 1..9879: mol_type = other RNA
agcgtgacgatgctgctcatgttgctgcccaccgccctcgccttccacctcaccacaaggggcggggagccccatatgattgtgagcaaacaggagagaggtaagagcttgctgttcaagacatcagcgggggtgaatatgtgcaccctcatcgccatggatctgggcgagctctgcgaggacacgatgacgtataagtgcccccgcatcactgaagccgaaccagacgacgtggattgttggtgcaacgctaccgacacgtgggtgacttatggtacgtgcagccagaccggtgagcaccgtagggagaaaaggtccgtggccctggcaccccacgtgggcctggggctcgagacccgcaccgagacctggatgagctccgagggcgcctggaagcaaattcagagagtggagacgtgggccctgcgccatcccgggttcacggtgatcgccttcttcctggcacacgccatcggcaccagcatcacccagaaggggataatcttcatcctcctgatgctggtcaccccctccatggctatgcggtgcgtcgggatcgggaaccgcgacttcgttgaggggttgagcggtgccacatgggtggatgtcgtgctcgaacacgggtcctgcgtaacgaccatggctaagaacaagcccaccctggacatcgagttactaaagacggaagtgacaaaccccgcggtgctgcggaagctatgcatcgaagctaagatatctaacactaccactgattcccgctgtccgacccagggggaagccaccctggtagaggagcaagacgccaacttcgtctgcagacgaaccttcgtggaccggggctggggaaatggttgcgggctgttcggtaaagggagtctcctgacctgtgctaagttcaagtgcgtcaccaagctcgaggggaagattgtacagtacgagaacctcaagtacagcgtcatcgtgacagtacatactggcgaccaacaccaggtaggtaacgagaccaccgagcacggcaccatcgcaaccatcacaccccaggcgcccacgtccgagatccagctcaccgactacggagccctgacactcgactgcagcccccggaccggcctggactttaacgagatggtcttgttgacaatgaaggagaagtcctggttggtgcataagcagtggttcttggacctcccgctgccgtggacctccggggcctctacatctcaggagacatggaaccggcaagacctgctcgtgacttttaagaccgcccacgccaagaaacaggaggtcgttgtcctgggctcccaggagggcgccatgcacaccgccctgaccggggccacggaaatacagaccagcggcaccaccacgatcttcgccgggcacctcaaatgtcgcttgaaaatggacaagctgacgctcaaagggatgtcctatgtaatgtgtaccggcagctttaagctggagaaagaagtagctgagacccaacacggcaccgtgctggtacaggtgaagtacgagggtactgacgcaccgtgcaaaatccccttcagtacccaggatgagaagggggtgacccaaaatggtcgcctgatcacagccaacccgatcgtaacggacaaggagaagcccgttaacatcgaaactgagccacccttcggggagagctacattgtggtcggcgccggagagaaggcactcaagttgtcctggttcaaaagggggagctccattggcaagatgtttgaggccaccgctcgcggggcaagacgcatggcaatcctgggcgacacagcgtgggatttcgggagcattggcggcgtcttcacttccgtgggcaagctcgtccaccaagtcttcgggactgcctacggggtactcttcagcggcgtctcctggaccatgaagatcggcatcggcatcctcctgacgtggctcggcttgaatagccggtccacctcgctcagcatgacttgcatcgccgtggggatggttacactgtacctgggcgtcatggtacaagccgacagcggctgcgtgataaattggaagggccgcgaactcaagtgcgggtcaggcatctttgttactaacgaagtgcacacatggaccgagcagtacaagtttcaggccgacagcccgaagcggctgagcgccgccatcggcaaggcctgggaggagggcgtctgcggaatccgctccgccacccggctggagaacattatgtggaaacaaatttcgaatgagctaaatcacatccttctagaaaacgacatgaagttcaccgtcgtggttggggacgccaacggcatcctggcacaggggaagaagatgatccgcccccagccaatggagcacaagtactcttggaagtcctggggaaaggccaagattatcggcgccgacattcagaataccaccttcatcatcgacgggccggacacgcccgagtgccccgatggccagcgggcttggaacatatgggaagtcgaggactacgggtttggtgtgttcacgacgaacatctggctgaaactgcgcgacagctacacccaaatgtgcgatcaccggctaatgtcagcggcgataaaggactcaaaggccgtgcacgccgacatgggctactggatcgagagcgagaagaacgagacttggaagctggcccgcgcctccttcatcgaggtcaagacctgcacgtggcccaagagccacaccctgtggtccaacggggtgcttgagagcgagatgatcataccgaagatctacggcggaccgatctcccagcacaactaccggcccggttacttcacccagaccgctgggccctggcatctgggcaagctggaactagacttcaacctgtgcgagggcactaccgttgtcgtagacgaacattgcgggaatcgcggccctagcctacgtaccacgacggtgaccgggaagataatccatgagtggtgctgtcgctcttgcacgctgccgccactgcggttccgcggcgaggacgggtgctggtacggcatggagatccgacccgtcaaggagaaagaagagaacctggtgagaagcatggtgtccgccggctcaggggaggtcgacagtttcagccttggcattctctgcgtgagcatcatgatagaggaagtcatgcggtcgaggtggagccgcaaaatgttgatgaccgggacgctcgccgtatttctgctgctcatcatgggccagttaacgtggaacgacctgatccggctctgcatcatggtgggggccaacgccagcgatcgcatgggcatgggaacgacctatctggccctgatggccacgttcaagatgcgaccgatgttcgcggtggggctcctgttccggaggctcaccagccgagaggtgctcctgctgacaatcggcttgtccctggttgcctcagttgaactgcccaactccctcgaagaactgggagacggcttagcgatgggtatcatgatgctcaaacttctgacagagttccaaccgcaccagctctggacgacgctactttcactcaccttcgtgaagaccacgctgtccctggactacgcctggaagaccacggccatggtgctcagcatcgtctccctgttccccttgtgcctctctacgacgtcccagaagaccacctggctgccagtgctgctcgggagctttggttgtaagccccttaccatgtttctgatcaccgagaacaagatttggggcagaaagtcttggcccctgaacgagggcattatggccatcggcatcgttagcatactcctgtcctcgctcctgaagaacgacgtccccctggctggaccgctcatcgccggcgggatgttaatcgcgtgctatgtgatcagcggtagtagcgctgacctgtccttggagaaggccgcggaggtgagctgggaacaggaagccgagcactccggggccagtcataacattctggtcgaggtccaggacgacggtacgatgaagatcaaagacgaggagcgcgacgacaccctgaccattctcttaaaggccactttgctcgccgtgtccggggtctaccccatgagcatccccgcgaccctgttcgtgtggtacttctggcagaagaaaaagcagcgatccggcgtactctgggacacccccagtcctcccgaagtcgagagagcagtgctcgacgacggcatctatcggatcctgcagcgcgggctgttaggccgttcccaggttggggtcggcgtatttcaggacggggtgttccacaccatgtggcacgttacccgcggcgcggtgttgatgtaccagggcaagagactggagccctcatgggcctcagtgaagaaagacctgatttcgtacgggggaggttggcggtttcagggctcctggaacacgggggaggaagtccaagtaatcgccgtggaacccggcaagaacccgaagaacgtccagacaacacccggtacgttcaagacgcccgagggggaagttggcgctattgccctcgactttaaaccagggacctctggctcaccgatcgtgaaccgggagggcaaaatcgtcgggctgtacggcaacggggtagtaactacatcaggcacgtatgtctccgccatagcccaagccaaggcgagccaggaggggcctctgcccgagatcgaggacgaggtgttcaagaagcggaaccttaccatcatggatttacatccgggaagcggcaagacccggcgttacctacccgccattgtgcgagaagccataaagcgcaaactccgcaccctgatactggcccccacgcgcgtcgtggcgtccgagatggccgaagccctcaagggaatgcccatccgctatcaaaccaccgccgtcaagtcggaacataccggccgtgagatcgtcgacctgatgtgccacgccacgtttacgatgcgtctgctctccccggtgcgtgtgccgaactacaacatgatcatcatggacgaggcgcattttaccgaccctgccagtatcgccgcccgcggctacatatccacccgggtcgggatgggagaggccgctgccatattcatgacggccacgccgcccggaagcgtggaagcatttcctcagtccaacgccgtgatccaggatgaggagcgcgacatccccgagcgtagctggaactccggatacgactggataacggacttccccgggaagaccgtctggtttgtccctagcatcaagtctggcaatgacatcgcgaactgtctgcgcaagaacgggaagagggtgattcagctgtcgcgcaagacgttcgacaccgagtatcagaagaccaagaacaacgactgggactatgtcgtcaccacggacatttctgagatgggggccaatttccgggctgatagagtgatagacccgcggcggtgcctcaagcccgttatcctgaaggacgggcccgaacgtgtgattctggcaggcccgatgcccgtgacggtcgcttcagccgcgcagcgcagaggccggatcggtcgaaaccagaacaaggagggagaccagtatgtgtacatgggccaacccctcaacaacgacgaggaccacgctcactggaccgaggctaagatgctgctggacaacatcaacactcccgagggcattatcccggccttattcgagcccgagcgggaaaagtccgcagccatagacggggaatacagactgaggggcgaagccaggaagacgttcgtcgaactgatgcggcgcggcgaccttcccgtatggttatcctacaaggtggcctccgaagggttccagtacagcgaccggagatggtgcttcgacggcgagcggaacaaccaggtcctggaggagaacatggacgtggagatctggacgaaggagggggaacgtaagaagctccgaccccgctggctggacgcgcggacctatagcgaccctctggcactccgcgagttcaaggagttcgccgccgggcgtcgaagcgtgtcaggggacctgattctggagattgggaagctcccccagcacttgaccctgcgggcccagaacgcgctcgacaaccttgtcatgttacataactcggagcagggcggcaaggcctaccggcacgccatggaggagttacccgacacaatcgagacgctgatgttgttagccctgatcgcggtgctgacaggaggggtgacactcttcttcctctcgggcaagggcctcgggaagacctcaattggcctactgtgcgtcacggcgagctccgccctgctctggatggcgagcgtggaaccccactggatcgccgcgtccatcatcctggagtttttccttatggtgcttcttatcccggaacccgacaggcaacgcacgccccaggacaatcagctggcctatgtcgttattgggctcttgttcatgatactgaccgtggccgccaacgagatgggactcctggagaccacgaagaaggacctgggtatcgggtatgtcgccgctgagaatcaccagcatgcaaccatgcttgacgtagatctgcaccccgcatccgcatggaccctctacgcagtagcgacaacagtcatcactcccatgatgaggcataccatcgagaataccacggcgaacatctctctcaccgccatagccaaccaggccgcgatcctgatgggcctagacaaggggtggcccatcagcaagatggatataggcgtgccactcctggctctgggttgctactcccaggttaacccgctgaccctgaccgccgccgtcctgatgctcgtggctcactacgccatcatcggccccggacttcaggccaaggccacgcgtgaggcccagaaacgaaccgcggccggcataatgaaaaacccaaccgtggacggcattgtcgcgatagacctggacccagtcgtgtacgacgccaagtttgaaaagcagttagggcagataatgctccttatcctctgcaccagccagattctgctgatgcggactacctgggccctctgcgaatccatcacccttgctaccggcccgcttacgactctctgggaggggagccccggcaaattctggaacaccaccatcgctgtctcaatggccaatatcttccgcggcagttaccttgccggggctgggctggcattttcgctcatgaagtccctagggggagggcggcgcgggacgggtgcccaaggcgagaccctgggcgagaagtggaaacggcagctcaaccagctgagcaagagcgagtttaacacgtacaaaaggagcgggataatggaggttgaccggtctgaggccaaggaaggtttgaagcgcggggagacaactaagcacgcagtaagcagaggcaccgcaaagctccgatggtttgtcgagcgaaacctagtcaagcccgagggcaaggtgattgacctggggtgcgggcgcgggggctggtcctactactgcgccgggctgaaaaaggtaaccgaggtgaaggggtacaccaaaggtggacccggccacgaggaacctatccccatggccacctacgggtggaacctcgtgaaacttcacagtggtaaggacgtcttctttatgccgccggaaaaatgcgacacgctcctctgcgacataggggagtcctcgccgaacccgacaatcgaggaggggcggaccctgagagtactgaagatggtggaaccctggctacggggaaaccagttctgcataaagatcttaaacccctatatgccgtccgtcgtggagaccctggagcagatgcagagaaagcacgggggcatgctcgtaagaaaccccctctcacgcaattccacacatgagatgtactgggtaagctgtgggactggcaatatcgtgtccgccgtgaacatgaccagccggatgctactcaatcgcttcaccatggcccaccgcaagcccacgtacgaacgggacgtcgacctaggcgccgggacccgccatgtggctgtcgagccagaggtcgccaatctagatattatcggccaacgtatagagaatatcaagaacgagcacaagtctacctggcactatgacgaggacaacccctataaaacctgggcctaccacgggagctacgaagtcaagccctccgggtctgcaagttctatggtcaacggggtggtgagattactgacgaaaccctgggatgttatccccatggtgacccagatcgccatgaccgacaccaccccgttcggacagcaacgggtgttcaaggagaaagtcgacaccaggactccccgggccaagcgcgggaccacgcagatcatggaggtgacagccaaatggctgtgggggttcctctcccggaataagaaaccacgcatttgcacccgggaggagtttacccggaaggtacggagcaacgctgccataggtgcggtcttcgtggatgaaaaccaatggaactcagccaaggaggccgttgaggacgagcgcttctgggacctggtccacagagagcgtgagcttcacaaacaagggaagtgcgccacatgcgtgtacaacatgatgggcaagcgggagaagaagctcggggagttcggcaaggcgaagggctcccgtgccatctggtacatgtggctgggtgcccggtttttggaatttgaagcgttgggcttcatgaacgaggaccactggtttagccgagaaaactccctcagcggggtggagggggaggggttgcacaaattggggtacatactgcgggacatctccaagataccgggtgggaacatgtacgctgacgacaccgcgggatgggataccagaatcactgaggacgacctgcaaaatgaggcaaagatcacggacatcatggagcccgagcatgctctgctggcaaccagcatcttcaagctgacctaccagaacaaggttgtgcgggtgcagcgtcctgcaaagaacgggaccgtcatggacgtgatcagcaggcgggaccagcgcggtagtggacaggtggggacgtatggcctcaacaccttcaccaacatggaggtccagctcatccggcagatggagtccgaggggatcttcctgcccagcgaactcgagaccccgaacctggcggagcgcgcccttgattggttagagaagcacggcgccgagcggctgaagagaatggctatctccggtgatgactgcgttgtcaaacctatagacgatcggttcgcgacagcgctgacggctctaaacgacatggggaaggtccgcaaggatatcccccagtgggagcccagcaagggctggaacgattggcaacaggtgccgttttgctcccatcacttccaccagctgatcatgaaagacgggcgggagatcgtcgtcccctgccgcaaccaagacgagctggtggggcgcgcacgcgtatcgcaaggggccggctggtccctccgggagactgcctgcctgggtaagtcctacgcccaaatgtggcagctgatgtatttccaccgcagggacctccgcctggccgctaacgccatctgctccgcggtgcccgtggactgggtgcccacctcccggaccacgtggagcatccacgctcatcaccagtggatgacgaccgaggacatgctgtccgtctggaatcgcgtatggatcgaggagaatccgtggatggaagacaagacccacgtcagctcctgggaggaggttccctacctaggcaagcgcgaggatcagtggtgcggcagccttatagggctaacggcgcgggcaacttgggcgactaacatccaggtggcgatcaaccaggtgcgccgtttaatcggcaacgagaactacctggactacatgacatccatgaagcgcttcaagaacgagagcgaccccgagggcgccctctggtga

SEQ ID NO: 24053 - RNA, 9879 nt, synthetic construct
  misc_feature 1..9879: note = derived and/or modified CDS sequence (opt11) from DENV-1__FJ639815__SS-prME
  source 1..9879: mol_type = other RNA
agcgtgaccatgctgctcatgttgctccccaccgccctggccttccatctgacaacccgcggcggagagccccacatgatcgtcagcaagcaggaacggggcaagagcttactgttcaagacgagcgcgggggtgaatatgtgcaccctcatagccatggacttgggagagctctgcgaggataccatgacctataagtgccccagaattaccgaggccgaacccgatgatgtggactgctggtgtaacgccacggacacttgggtcacctacgggacctgctctcagaccggcgaacaccggcgcgagaagcgatccgtagctctggctcctcatgtggggttggggctcgaaacccgcaccgagacatggatgagctccgagggtgcttggaagcagatccagcgggtcgaaacctgggccctgcgccacccgggttttacggtgatcgccttctttctggcgcacgccatcggaaccagcatcacccagaaaggtataatcttcattctgctgatgctggtgacgccctccatggccatgcggtgcgtgggcatcggcaaccgcgacttcgtggaggggctcagcggcgccacgtgggtggacgtcgtgctagaacatgggtcctgtgtcacgaccatggcgaaaaataagcccaccctggacatcgaactcctgaaaacagaggtcaccaaccccgcagttctgcggaagctctgtatcgaagctaagatcagcaataccaccacggactcccgctgcccgacccagggggaagccaccctggtggaggagcaagatgccaactttgtgtgtcgacgcaccttcgtggaccggggctgggggaacgggtgcgggctattcggaaaggggagcctcttaacatgtgctaagttcaagtgcgttaccaagctagaggggaaaatcgttcagtacgagaatctcaagtacagcgtgatagtgaccgtacacaccggcgaccaacatcaggtggggaacgagacaaccgagcacggtaccatcgcgaccatcacgccccaggcccccacatctgagatccaacttaccgattacggggccctgaccctcgactgctcgccccggaccggcctggatttcaacgagatggtcctgctcacgatgaaggagaagtcgtggctggtgcacaagcagtggttcttggacctgccgttaccctggacctccggggcctcgaccagccaggagacctggaacagacaagacctgcttgtgacgttcaaaaccgcccacgcgaagaaacaagaggtggtggtgctgggctcgcaggagggcgctatgcacaccgcgctaaccggggcgacggagatccagacgagcgggaccactacgatcttcgccggacacctcaaatgccgcctaaaaatggacaagctgactctcaaggggatgtcctacgtcatgtgcaccgggagcttcaagctggagaaggaagtggcggaaacccagcacggcacagtgctggttcaggttaagtacgaaggcaccgacgccccgtgcaaaatacccttctccacccaagacgagaagggggtgacccaaaacggcagactgatcacggccaacccgattgtcaccgacaaggagaagcccgtgaacatcgagaccgagcctcccttcggggaatcgtacatcgtggtcggcgccggggagaaggctctcaaactgtcctggttcaagcgcgggtcatccatcggtaagatgtttgaggccactgcacgcggggcccgccgcatggccatcttaggcgacacggcgtgggatttcggtagcattggcggtgtgttcacctccgtcggtaagctcgtacatcaggtcttcggcaccgcctatggggtgttgttctctggcgtctcctggactatgaaaatcgggatcggcatactgttaacttggctgggtttgaactcacggtccaccagcctctccatgacctgcatcgccgtgggcatggtaactctgtatctgggcgtcatggtccaggccgacagcgggtgcgttatcaactggaagggccgcgaactcaagtgcggatccggtatcttcgtgacgaacgaggtgcacacctggaccgagcagtacaagttccaggccgactcgcccaagcggctcagcgcggctataggcaaggcctgggaggagggtgtttgcggcatccgctccgccacccggctggagaacatcatgtggaagcagatcagcaatgaactcaaccacatccttctggagaacgacatgaagttcaccgtggttgtgggagacgctaacggaatcctcgcccaagggaagaagatgatccgcccccagccgatggagcacaagtactcctggaagtcctggggaaaggctaagattattggcgccgacatacagaacaccaccttcattatcgacggtcccgacacaccagagtgccccgacggccagcgggcatggaacatctgggaggtcgaggactacgggttcggtgtgttcaccacgaacatctggctgaagctgcgcgactcctacacccagatgtgcgaccaccgcctcatgagtgcggccattaaggattcaaaggccgttcacgcagacatgggctactggatcgaaagcgagaaaaacgagacctggaagctggcccgagcttccttcatcgaggtcaagacatgtacgtggcccaaaagccacaccctgtggtccaacggggtgctcgaaagcgagatgatcatccccaagatctacggcgggcccatctcccagcacaactaccggcccggctacttcacccagaccgcagggccctggcacttaggcaaactggagctcgactttgacctgtgtgagggaacaaccgttgtcgttgacgaacactgtggtaaccgtgggccgtccctgcggaccaccacggtgaccgggaagatcatccacgagtggtgctgccgctcctgtacactgccgcccctccggtttcgcggcgaggacgggtgctggtacggcatggaaatccgacccgtcaaagagaaggaggagaacctggttcgctctatggtttccgcaggctccggggaggtcgatagtttctctctcgggatcctgtgcgtgagcatcatgatcgaagaggtgatgcggagccgctggagccgcaagatgctgatgactgggacgttagccgtcttcctgcttctcatcatgggacagttaacctggaacgacctgatccggctctgcatcatggtgggggcaaacgcttccgaccgcatgggcatggggaccacctacctggccctgatggccacgttcaagatgcggcccatgttcgccgtggggctcctgttccgccgactaaccagcagagaggtcctcctcttgaccattggcctctccctggtggcctccgtcgagctccccaactctctcgaggagctgggtgacggactggcaatgggtatcatgatgcttaaactgctgaccgagttccaaccacaccagctctggacaaccctgctgagcttaaccttcgttaagaccacgctttccctggattacgcttggaaaaccaccgccatgctcctctcaatcgtgtcactgtttccactctgcctgagcaccacatcccagaagacgacttggctgcctgtcctcctgggctctttcggctgcaagcccctgacgatgttcctcatcaccgagaacaagatttgggggcgtaagagttggccactgaatgagggaatcatggccatagggatcgtgtcgatcctgctttcctctctactgaagaacgacgtgcccctcgccgggccgctgatcgccggagggatgttgatcgcttgctacgttatcagcggcagcagcgccgacctctccctggaaaaggctgcggaggtgtcatgggagcaggaggcagagcactccggggcgagccacaacatcttagttgaggtccaagacgacggcacgatgaaaatcaaggacgaagagcgggacgacaccctcaccatccttctgaaggccaccctcctggccgtgtccggggtgtatcctatgagcatcccagcgacgctgttcgtgtggtacttctggcagaaaaagaagcagagatccggcgtactttgggatacgcctagcccgcccgaggtggagcgcgccgtcttagacgacggcatctaccggatcctgcagcgcgggctcctaggccgctcacaagtgggggtgggcgtcttccaggacggggtgttccacacgatgtggcatgtgacccggggtgctgttttgatgtaccagggcaagaggctggagccatcatgggcgtccgtgaagaaggacctcatcagctacgggggcgggtggcgcttccagggctcctggaacacgggtgaggaggtgcaggtcattgccgtggagcctggcaagaacccgaagaacgtgcagacgactccaggcaccttcaagacgcccgagggagaggtcggcgcgatcgccctggacttcaagcccggcaccagcggctcaccgatcgtgaaccgggagggcaagatcgtggggctgtacggcaacggggtcgtgacaacctccggcacgtacgtgtccgcaatcgcccaggcgaaggcgagccaagaggggcctctccccgagattgaggatgaggtcttcaagaagcgtaacctgaccatcatggaccttcaccccggcagcggtaagacccggagatacctccccgccattgttagagaagctatcaagaggaagctgcgaaccctgatcctcgcccctacacgggtggtagcttccgagatggccgaagcgctgaagggaatgcccataaggtaccaaaccaccgccgtcaagagcgagcacaccggccgggagatcgtggacctgatgtgccacgccactttcacgatgcgcctcttgtcaccggtccgtgtgcccaactacaacatgatcatcatggatgaagcgcactttacggaccccgcaagcatcgccgcccgcgggtacatctccacccgggtgggtatgggggaagccgcggcgatcttcatgacggccacgccgcccggcagcgtcgaggccttcccccagtccaatgccgtgatccaggacgaggagcgcgacatccccgaacggagttggaactccggctacgactggatcaccgacttccccgggaagaccgtttggttcgtgccctccatcaagtccggtaacgatatcgcgaattgcctacgcaagaacgggaagagggtgattcagttgagccgcaagacgttcgacactgagtaccagaagaccaagaacaatgactgggactacgtggtcactacggacatttccgagatgggcgccaacttccgggccgaccgcgtgattgaccccagacgctgcctgaagcctgtcatcctgaaggacgggcccgaacgggtcatattagccggccctatgcccgttaccgtagcgagcgccgcgcaacgacggggacgcatcggacgcaaccagaacaaagagggcgaccagtacgtgtacatggggcagcctttaaacaacgatgaggaccacgcccactggaccgaggctaagatgctgctcgacaacatcaatacccccgagggcatcatcccggctctgttcgagcccgagcgagagaagtccgccgccattgacggtgagtaccgcctgcggggcgaggcgcgcaagactttcgtggagctcatgcggcgcggtgacctgcccgtctggttaagctacaaggtggcctccgaggggttccagtatagcgaccgccgctggtgcttcgatggcgagcggaacaaccaggtgctcgaagagaacatggacgtcgagatctggaccaaggagggggagcgcaaaaagttgcggccccgctggctggacgcgcggacctactccgaccctctcgcacttagagagttcaaggagttcgcggccggccggcgcagcgtgagcggcgatctgatcctagagatagggaaactgccacagcacctgacccttcgagcccagaatgcgctagacaacctggtgatgctccacaattctgaacaaggcgggaaagcctaccgccacgcaatggaggagctgcccgacaccatcgaaacgcttatgcttctggcattgatcgcggtccttacaggcggggtgactttattcttcctgtcgggtaaaggcctcgggaagaccagcataggccttctatgcgtgaccgccagctccgccctcctgtggatggcctccgtggagccgcattggattgccgcgagcatcatcctggagtttttcctcatggtcctactgatcccggagcccgaccggcagcgcacgccccaagacaaccagctcgcctatgtagttatcgggctgctgttcatgattttaaccgtggccgccaatgagatgggcctgcttgaaacgacgaagaaagacctcgggatcggctatgtggccgcggagaatcaccagcacgccaccatgctggacgtcgacctgcaccccgccagcgcctggaccctctacgcggtagcgaccacggtaatcactcccatgatgagacacacgattgagaacacgacagccaacatttccctgacagccatcgccaatcaggccgcgatcctgatgggattagacaaggggtggcccatctctaagatggacatcggagtccccctgctggctctcgggtgctactcgcaggttaatccgctcaccctgaccgccgccgtactcatgctggtcgcccactacgccatcatcggccccgggctgcaggccaaggcgacgcgggaggctcaaaagcgcacagcggccggcatcatgaagaaccccaccgtggacggcatcgtggccatcgacctcgaccctgttgtgtacgacgctaagttcgagaagcagctgggccagataatgttactcatcctgtgtacaagccagattctcctcatgcggacaacttgggccctgtgcgagtccatcaccctggcgaccggcccgctcacgaccctgtgggaggggagccccggcaagttctggaataccaccatcgccgtctcaatggccaacatcttccgcggcagctacctggccggggccgggctcgccttctcccttatgaagagcctcgggggcgggcgacgcgggactggggcccagggggagaccctcggcgagaaatggaagcggcagctgaaccagctaagtaagtcagagttcaacacttacaagcgcagcgggatcatggaggtcgaccggtccgaggctaaggagggcctcaagcgcggggagacgaccaagcacgccgtgtcacgggggacagctaagttacgctggttcgtggagagaaacctggtaaagcccgagggcaaggtaattgacctggggtgcggccgggggggctggtcctactactgcgccgggcttaagaaggtaaccgaagtcaaaggctacaccaagggaggccccggacacgaggaaccgatccccatggccacctacggctggaacctggtgaagcttcatagcggcaaggacgtgtttttcatgccgcccgagaagtgcgacacgctcctgtgtgatatcggggagtccagcccgaatccgactatcgaagaaggcagaactctgcgcgtcctcaaaatggtggagccctggctgcggggaaaccaattctgcatcaaaatcctgaatccctacatgccgtcggtggtcgagaccctggagcagatgcaacgcaagcacggaggcatgctagtgcggaaccccctgagccgcaacagtacgcacgagatgtattgggttagctgtggcaccggcaacatcgtatccgcagtgaacatgacctcgagaatgctccttaatcgcttcaccatggcccaccgcaaaccaacatatgagcgggacgtcgacctgggcgcggggactcgccatgttgcggtcgagcctgaggtggccaatctcgacattatcggccagcgtatcgagaacattaagaacgagcacaagtccacctggcattacgatgaagataacccctacaagacctgggcctatcatggctcctatgaagttaaaccctcgggatccgcctccagcatggtgaacggggttgtgcgcctgctgacgaagccctgggacgtgatcccaatggtcacccagatcgcgatgaccgacaccacaccgttcgggcagcaacgcgttttcaaggaaaaggtagacacccgcacgccgcgggcaaagaggggaacgacacaaatcatggaggtgactgctaagtggctatgggggttcctgtcccggaacaagaaaccccgcatatgcacgcgggaggagttcacccgaaaggtgcggagcaacgccgccatcggcgctgttttcgtagacgagaaccagtggaacagcgctaaagaagccgttgaggacgagcgcttctgggacctggtgcaccgggagcgcgaacttcacaagcaggggaaatgcgccacgtgtgtttacaacatgatgggcaaacgggagaagaagctgggcgagttcggaaaggcgaagggttcgcgcgccatctggtacatgtggctgggggcccggttcctcgaattcgaggccctgggctttatgaatgaagaccactggttcagccgagagaactccctgtctggggtggaaggtgaagggctccacaaattaggatacattctgcgggacatcagcaagatccctggcggaaacatgtatgccgatgacactgcgggctgggacacgcgtataaccgaggacgacctgcagaatgaggccaagataacggacatcatggagcccgaacacgccctcctagccaccagcatcttcaagctcacgtaccaaaacaaagtggtccgcgtgcagcggcctgcgaagaacggtaccgtgatggatgtcatcagccgcagggaccagcggggaagcgggcaagtcgggacgtacgggctgaatacctttaccaacatggaagtacagctaattagacagatggagtcagaggggattttcctgccctcggaactggagacccctaatctcgcggagcgcgccctagactggctggagaagcatggcgccgagcggctgaagcgcatggccatttccggcgacgactgcgttgtgaagccaatcgacgatcggtttgccacagccctcaccgccctgaacgacatgggcaaggtgcgcaaagatattccccagtgggagcccagcaagggctggaacgactggcagcaggtcccgttctgctctcaccactttcaccagctgatcatgaaggatggtcgggagatcgtggtgccctgccgcaaccaggacgagctcgtaggccgggcgagggtgtcccagggggccggctggtcactacgggagacggcctgcctcggcaagagctacgcgcagatgtggcagttaatgtacttccacagacgcgacctgcgcctggccgccaacgccatctgctcggcggtgcccgttgactgggtgcccacaagccggaccacgtggagcatccacgcccatcaccaatggatgaccactgaagacatgctttcagtgtggaaccgcgtctggatcgaggaaaacccgtggatggaggacaaaacccatgtgagcagctgggaggaggtaccctacctgggaaagagagaggaccagtggtgcgggagcctgatcgggctaaccgcacgggccacctgggccaccaacatacaggtcgctatcaaccaagtgcgccggctgatcggcaacgagaactacttggactacatgacctccatgaagcgcttcaagaatgagagcgaccccgagggtgccctctggtga

SEQ ID NO: 24054 - RNA, 9879 nt, synthetic construct
  misc_feature 1..9879: note = derived and/or modified CDS sequence (opt11) from DENV-1__FJ639818__SS-prME
  source 1..9879: mol_type = other RNA
agcgtgacgatgttgctcatgctgctgccaaccgccttggcctttcacctgaccactcgcggtggggagccccacatgatagtctcaaaacaggagaggggcaagagcctgctgtttaagacctcagctggggttaacatgtgcacactgatagccatggacctgggcgaactctgcgaggacaccatgacctacaagtgtcccaggatcactgaggctgagccggacgacgtggactgctggtgcaacaccaccgacacctgggttacctatggtacctgctcacagacgggcgaacaccgccgagacaaacggtctgtggccctggcgccccacgtgggcctagggctcgagacccggaccgagacctggatgagctcagagggcgcatggaagcagattcaacgggttgagacgtgggccctgcgccaccccgggttcaccgtaatcgctttgttcctggcccatgcgatcggcaccagcattacacaaaaaggaatcatctttatactccttatgctcgtgacgccctccatggccatgcggtgcgtggggatcggcaaccgcgacttcgtggaggggctgtcgggagcaacctgggtggacgttgtgctggagcacgggtcctgcgtgacgaccatggccaaaaacaagcccactcttgacatagaactgttaaagacggaggtcaccaaccccgccgtgctccggaagttgtgtatcgaggcgaagatctcaaacaccacgacagactcccgctgcccaacccaaggggaggccaccctggtggaggagcaggatgccaacttcgtctgccggcgcacgtttgtggaccggggttgggggaacggctgcggtttattcggcaaagggagcctgctaacgtgtgccaagttcaagtgtgtgactaagctcgagggcaagatcgtccagtacgagaacctgaagtactccgtcatcgttaccgtccatacgggcgatcaacaccaggtggggaacgagaccaccgagcatggcaccatagcgaccatcacgccgcaggctcccacgtccgagatccagctgactgactacggggcactcaccttagactgctcaccccggacggggctggatttcaacgaaatggtcctcttaactatgaaagaaaagtcgtggctggtgcacaagcaatggttcctcgacctgccgctgccctggacaagcggggccagcacaagccaggagacttggaaccgacaggatctcctggttaccttcaagaccgcccatgctaagaagcaggaggtcgtggtgctgggttcccaggagggcgcgatgcacaccgccttgacgggcgccacggagatccagaccagcgggaccacaactatcttcgctggtcaccttaagtgccgcctgaagatggagaagctcaccctcaagggtatgtcatacgtgatgtgtaccggaagcttcaagctggaaaaggaggtggccgaaacacagcacggcaccgttctggtgcaggtgaaatacgagggcaccgatgcgccttgtaaaatccccttctccacacaggacgagaagggggtgacgcagaacggccggctcatcactgccaaccccatcgtcaccgataaggagaagcccgtgaacatagagaccgaaccgcccttcggggagagctatatcgtggtcggggccggtgagaaggctcttaagctgtcctggttcaagaaggggagctccattggcaagatgtttgaggcgacagccagaggcgctcggcggatggccatcctcggcgatacagcctgggacttcgggagcattggtggcgtgttcacctccgtggggaagctggtccaccaggtgtttggtaccgcgtacggcgtgctgtttagcggcgtctcctggacgatgaagatcgggatcggcattctcttaacctggttaggccttaacagcaggtcgactagcctgagcatgacctgcatcgccgtggggatggtgacgttataccttggcgttatggtgcaggccgacagcggatgcgtgatcaactggaagggacgggaactgaagtgcggctccggcatcttcgtcactaacgaggttcacacctggaccgagcagtacaagtttcaggcagatagcccgaagcgcctgagcgccgcgatcggaaaggcgtgggaggagggggtgtgcggaattcggtccgctacccgcctcgaaaacatcatgtggaaacaaatttcaaacgaattaaatcacatcttactcgagaacgacatgaaattcacggtcgtggttggggacgccaatggaatcttggcccaggggaagaaaatgatccggccccagcccatggagcataagtactcctggaaatcctggggcaaggcgaaaataatcggcgccgacatccagaacaccacgttcatcatcgacgggcccgacaccccggagtgccccgacggccaacgcgcctggaacatctgggaggtcgaggattacgggtttggcatattcacgaccaatatctggctaaaactccgggactcctatacccaaatgtgcgaccaccgcttgatgagcgccgcaatcaaggactcgaaggccgtgcacgccgacatgggttactggatagagtcagagaagaacgagacctggaagctggcccgggcctccttcatcgaagtgaagacgtgcacctggcccaagagccacacgttatggagcaatggagtcctcgagagcgagatgatcatccccaaaatctacggcgggccgatctctcagcacaattacagacccggctactttacccagacggcagggccgtggcacctgggcaaactcgaactggatttcgacctgtgcgaaggcaccacggtggttgtcgacgagcactgtgggaaccgaggcccgtctctccgcaccaccactgtgaccgggaaaatcatccacgagtggtgttgtcggtcctgcacactccctcccctgcgcttccggggcgaggacgggtgctggtacggcatggagatccgccccgtgaaagagaaggaggagaacctcgtccggtcgatggtttccgccggcagcggggaagtggacagcttctccctgggcattctgtgcgttagcatcatgatcgaggaggtgatgcgctcccggtggagcaggaagatgctgatgacggggactctggcggtgttcctgcttctgatcatgggtcagctgacctggaacgacctgattcgtctgtgcattatggtaggggctaacgcttccgatcggatgggcatgggcactacacaccttgcattaatggcgaccttcaagatgcgtcccatgttcgctgtggggctgctgtttcggcgcctgactagcagagaagtgctgttgctcaccattgggctgagcttagtcgcctcagtcgaactccccaactccctagaagagctgggggacggtctcgccatgggcatcatgatgctgaaactgctcacggaatttcagccccaccagctgtggaccacattactctccttaaccttcgtcaagacgaccctgtcgctcgactatgcctggaaaaccaccgcgatggtgttaagcatagtgtccctgttccccctctgcctgagcaccacgtcccagaagacgacctggctgccagtcctactagggagcttcggctgcaaacccctgaccatgttcctgatcacggagaacaagatctgggggagaaagtcctggccccttaacgagggcatcatggctattgggatcgtcagcatactgttgtccagcctactgaagaacgacgtccccctggccggcccgctgatcgcgggcggtatgctgatagcctgttacgtcatcagcggctccagcgccgacttgtcgctggaaaaagcagcagaggtgagctgggagcaggaagcggagcactccggggcgagccacaacatccttgtggaggtccaggacgatggcaccatgaagatcaaggacgaagaacgggacgacacactcaccattctgctgaaggccacgctcctagccgtgtccggggtgtatccaatgagtattccggcaaccctcttcgtctggtatttctggcagaagaaaaaacaacgctccggcgtgctctgggacacacctagcccgcccgaggtggagcgggccgtactggacgatggcatctaccgcatcctgcaacgggggttgctcggacgctcacaggtgggtgtaggcgtcttccaggacggggtgtttcacacaatgtggcacgtgacgcggggcgctgtccttatgtaccagggcaaacgcctagaacccagctgggccagcgtgaagaaggatctcatcagctacgggggcggatggcgctttcaaggctcctggaacaccggggaggaggtgcaggtcatagccgtggaacctggcaagaacccgaagaacgttcagaccacccccggcacgttcaagacccccgaaggggaggtcggcgccatagcgttagactttaagccgggaacctctggctctcccatcgtgaaccgagagggtaagatagtcggcctatacggcaacggggtcgtaaccacgagcgggacctacgtgtccgcaatagcccaggccaaagctagccaagaagggcctctccccgagattgaggacgaagtcttcaaaaagcggaatctgaccatcatggacctgcacccgggctcgggcaagacgcgccggtacttgcccgcgatcgtacgtgaagccatcaagcggaagcttaggactctgatcctggcccccacacgcgtagtcgcctccgaaatggcggaggcactaaagggtatgcctatcaggtaccaaaccaccgccgtcaagagcgaacatacgggccgcgaaatcgtggatctgatgtgccacgccactttcaccatgcgattactttccccggtacgcgtgcccaactataacatgatcattatggacgaggcccacttcactgaccccgcgagcatcgcggcccgagggtacatttccacacgcgtgggaatgggcgaggccgctgcgatattcatgaccgctacgccgcccggtagcgtcgaggcctttcctcagtccaatgccgtgatccaggacgaggagcgagatatccccgagcgcagctggaactctggctacgactggatcaccgacttccccggtaagacagtctggtttgtaccgtcgattaagtctggcaacgacatcgccaattgcctcagaaaaaacggtaagcgcgtaatccagctcagccggaagacattcgacacagagtaccagaagactaagaacaacgactgggattatgtggtgaccaccgacatttccgagatgggcgctaatttccgcgccgaccgggtgatcgacccccgccggtgcctgaagcccgtgatccttaaagacgggcccgagcgcgtcattctcgccggtccaatgcccgtgaccgtggccagcgcggcccagcggcgcggccggatcgggcgcaatcaaaacaaagaaggtgatcagtacgtgtacatggggcagccgctgaacaacgacgaggaccacgcccactggaccgaggccaaaatgttgctcgacaacatcaatacgcccgaaggcatcatccctgcgctgttcgaaccggagcgggagaagtccgcggccatcgacggagaataccgcctccgcggagaagcccggaaaaccttcgtggagctgatgcgccggggcgacctgccagtctggctgtcttacaaagtggcctcagaaggtttccagtactccgaccgccgctggtgcttcgatggcgagcgcaacaatcaagtgctggaggagaatatggacgtggagatttggaccaaagagggggagcggaagaagctgcgtccccggtggctggatgccagaacgtactctgaccccctcgcgttgcgggaattcaaggagtttgccgccggccgtcgtagcgtgtcaggcgacctgatactcgagatcgggaagctcccgcaacacctgaccctccgggcccagaacgccctggataacttagtaatgttgcacaactcagagcagggcgggaaggcgtaccggcacgccatggaggagctgcccgacacgatcgagaccttaatgctcctggctctgatagcggtgctcacaggcggtgtgaccctcttctttctgtccgggaaaggcctggggaagacatccatcggactgctgtgtgtaaccgccagctccgccttgctgtggatggccagcgtcgagccccattggatcgcagcctccatcatcctggagttctttcttatggtgctgctgatcccggaaccagaccgccagcggacgcctcaggacaatcagctagcgtacgtcgtcattgggcttttattcatgattctcaccgtcgcagccaacgagatgggcttgctcgagaccacaaagaaggacctcgggataggctacgtggctgccgaaaaccatcagcacgcgaccatgctggacgtcgatctgcgccctgccagcgcctggacactctacgccgtggccacgacagtcatcacccccatgatgcgtcacaccatcgagaatacgacagcgaacatcagtctgaccgccatcgctaaccaggccgccatactaatgggcctcgacaaggggtggcccatcagcaagatggacattggtgtccccctgctggctctcgggtgctacagtcaggtgaacccgctcaccctgacggccgccgttctcatgctggttgcccactacgcgatcatcgggcccgggctgcaggccaaagctacccgagaggcccaaaagcgcacagctgcgggcataatgaagaatcccacagtggacggcattgtggccatcgatctcgaccccgttgtgtacgacgcaaagttcgagaaacagctggggcagattatgcttctcatactatgcacgtcacagatattgttaatgagaaccacctgggcgctttgcgaatcgatcacattagccaccgggcccctcaccaccctgtgggaaggcagccccggcaaattctggaacaccacgatcgcggtgagtatggcaaatatcttccgcggctcatacttagcgggagccggcctagcattctccctgatgaagtcactcgggggcgggcggcgcggaaccggtgcacagggggagacccttggcgaaaagtggaagcggcagctgaaccagctctccaagtcagagtttaacacgtacaagcgaagcgggatcatggaggttgaccggtccgaggccaaagaagggttgaagcgcggggagacgaccaagcacgccgtgagcagggggaccgcgaagctgagatggtttgtggagcggaacctggtcaagcctgagggaaaagttatcgacctggggtgcggacggggaggctggagttactactgcgcgggactaaagaaagtgactgaagtaaagggctacaccaagggcggaccgggccacgaagagcccatccccatggccacctacgggtggaacctggtgaagctgcacagcgggaaggacgtgttctttatgccgcccgagaagtgcgacacgctgttatgcgacataggggagtcatcgcccaaccccaccatcgaggaaggacggacgctcagagtcctgaagatggtcgagccgtggttgaagggcaaccagttttgcatcaagatccttaatccctacatgccgtccgttgtcgagacattagagcagatgcagcgcaaacacgggggcatgctcgtacgcaaccccctgagccggaactccacgcatgagatgtactgggtctcctgcggcactggcaacatcgtatccgccgtaaacatgaccagccgcatgctcctgaatcggttcacgatggcccaccgcaaacccacctacgaaagagacgtggaccttggcgccgggacacggcatgtggcggtggagcccgaagtggccaacctcgacataatcggccagcgaatcgagaatatcaagaacgagcataaatccacctggcactatgacgaagacaatccgtacaagacttgggcataccacgggagctacgaggtcaagccgtccggctctgccagctccatggtgaatggggtcgtacggctgttaaccaagccctgggatgtgatccccatggtcacccagatcgccatgaccgacacgaccccttttggccaacaacgcgtgttcaaggagaaggtcgacacccgtactccacgggcgaagcggggcacgacccagatcatggaagtgaccgccaaatggctgtggggttttctctcccggaacaaaaagccccggatctgcacccgcgaagagttcacgcgcaaggtgcggtcaaacgccgcgatcggtgcggttttcgtcgacgaaaaccagtggaacagcgcgaaggaggccgtggaggatgagcggttctgggacctggtgcaccgggagcgggagctccacaagcaaggaaagtgtgccacctgcgtctacaatatgatgggcaagcgcgaaaagaagctgggggaattcgggaaggcgaagggctctcgggcgatctggtatatgtggttaggcgcccgattcttagagttcgaggctctgggcttcatgaacgaggaccactggttcagcagggagaattccctgagcggggtagagggagaagggctgcacaagctgggctatatcctgcgagacatatcaaagatcccgggcggaaacatgtacgcggacgacaccgcaggctgggacactcggataacggaagacgacctccagaacgaagcgaaaatcaccgatatcatggagcccgaacacgccctgctggccacctcaatctttaagctcacctaccaaaacaaagtggtacgcgtgcagcgccctgccaagaatggcacggtgatggatgtcatctcacgtcgcgaccagcggggaagcggccaggtgggtacctatgggctgaacaccttcaccaacatggaggttcagctgatacgccagatggagtcagaggggatctttctccctagcgagctggagacaccgaacctggccgagcgggtcctcgactggctggagaagcacggcgcggagcgcttgaagagaatggccatctcgggggacgattgcgtggtaaagccaatcgacgaccgcttcgccaccgctttgacggccttaaatgacatgggcaaagtgcggaaggacatcccccagtgggagcccagcaagggctggaacgattggcagcaagtccccttctgctcccaccacttccaccagttgattatgaaggacggccgagagatcgtggttccgtgccggaatcaggatgaactagtcggccgggcccgggtgagccagggggcaggatggtccctgagggagaccgcatgtctgggcaagagctacgcacagatgtggcagctgatgtacttccatcggcgcgaccttcgactcgcagcgaacgccatctgctcagctgtccccgtcgactgggttcccacaagccgcaccacctggagcatccacgcccaccatcaatggatgaccaccgaggatatgctttccgtctggaaccgggtatggattgaggagaacccgtggatggaggacaagacgcatgtcagcagctgggaggaggtcccttacctgggaaagcgtgaggaccaatggtgcgggagcctgatcggccttacggccagggccacatgggccaccaacatccaggtagccatcaaccaggtgcgtcgccttatcggcaacgagaactacctagattacatgacgtccatgaagcggttcaagaacgaaagcgaccccgaaggcgctctctggtga

SEQ ID NO: 24055 - RNA, 9879 nt, synthetic construct
  misc_feature 1..9879: note = derived and/or modified CDS sequence (opt11) from DENV-1__FJ639819__SS-prME
  source 1..9879: mol_type = other RNA
agcgtgacaatgctgctaatgttactgcccactgccctcgccttccacctgaccacccggggcggtgagccccacatgatcgtgagcaaacaggagcgggggaagtccctcctgttcaaaacttctgcgggggtgaacatgtgcaccctgattgccatggaccttggcgagctctgcgaggacaccatgacttataagtgcccccgcattaccgaggcggagccggatgacgtggactgctggtgcaacgcgaccgacacttgggtgacctacgggacctgcagccagaccggcgaacaccggcgcgagaagcggtccgtggccttggcgccccatgttggcctggggctcgagacccgaacggagacctggatgagctccgagggcgcctggaagcagatccagcgggtcgagacatgggccctgcgccaccccgggttcacagtgatcgctttcttcctggcgcacgccatcggcaccagcatcacacagaaggggatcatcttcatcctgttaatgctagtgaccccctccatggccatgcggtgcgtcggcatcgggaaccgagacttcgtggaggggctatctggcgctacttgggtggacgtagtgctggagcacggttcctgcgtcaccaccatggccaaaaacaagcccactctggacatcgagctcctgaagacggaggtcaccaatcccgcggtgctgcggaagctctgtatcgaggccaagatcagcaacaccacaactgactcacgatgcccaacccaaggcgaggccactctggtggaggagcaggacgccaacttcgtctgtcggcgcaccttcgtggaccggggctggggcaatggctgcgggctgttcggcaaggggagcctcctgacgtgcgccaaattcaagtgcgtgaccaagctggaaggcaagatcgtccagtacgagaatttgaaatactccgtcatagtgacggtccacaccggcgaccagcaccaggtggggaacgagacgaccgaacatggcactatcgcgaccatcacgccgcaggccccaacgtcggagatccagctgaccgactatggggccctaaccctagattgcagcccccgcaccggcctggactttaacgagatggtccttctcacgatgaaggagaagtcttggctggtccacaagcagtggttcctggacctcccgcttccgtggacgtccggggccagcacatcacaggagacctggaaccggcaggatctgctcgtgacattcaagaccgcccacgcgaagaagcaagaagtcgtggtgctgggctcacaggagggcgcgatgcacacagcactcaccggggccacagaaatacagaccagcggcaccaccacgatctttgccgggcacctcaaatgccgcctgaaaatggataagctgaccctcaaaggcatgtcctacgtcatgtgtaccgggagcttcaaactggagaaggaggtggcggaaacacagcacggtacggtgcttgtccaggtgaagtacgagggcacggatgccccctgcaagatacctttcagtacgcaggacgagaagggcgtgacccagaacggcaggcttatcacggcgaatcccatcgtcacagacaaggagaagcccgtgaatatcgagaccgagccccccttcggggagagctacatcgtggtcggcgccggcgagaaagcgcttaaactgtcatggttcaaacgcggaagcagcatcggaaagatgttcgaagctaccgcccgcggggcccgcagaatggcgatcctgggcgacactgcgtgggacttcgggtccatcggcggcgtgttcacctcagtaggcaaactcgtccaccaagtattcggcacagcctacggagttctgttcagcggcgtctcctggaccatgaagatcgggatcggcatcctgctcacatggctgggcctaaactccaggtccaccagcttgtccatgacatgcatcgccgtcggcatggtgaccctgtacctgggcgtcatggtccaggccgacagcgggtgcgttatcaactggaagggccgcgagctcaagtgcgggagcggcatctttgtgacaaacgaggtacacacgtggaccgagcagtataagttccaggccgacagcccaaagcggctgagcgcggccatcggcaaggcctgggaggagggggtgtgcggcatcaggtccgccacccggctggagaacatcatgtggaagcagatcagcaatgagctcaaccacatccttttggagaatgacatgaagttcaccgtcgtggtgggggacgccaacggaatcctggcacaggggaagaagatgatccgcccccagcctatggagcacaagtactcctggaagagttggggcaaggccaagattatcggagccgacatccaaaacactacgtttatcatagatgggcccgacaccccggagtgccccgacggccagcgcgcctggaacatctgggaagtcgaggactatgggttcggcatcttcaccacgaatatttggctgaagctgcgcgactcctacacgcagatgtgcgatcaccgactcatgtctgcggccatcaaggactccaaggcagtgcatgccgatatgggctactggatcgagtcggagaagaacgagacctggaaacttgcccgcgcgtccttcatagaggtgaagacctgcacgtggcccaagagccataccctgtggtccaatggggtcctagagagcgagatgatcatcccgaagatctacggagggccgatctcccagcacaattaccgacccggctatttcacccaaaccgctgggccgtggcacctgggcaagctggaactagatttcgacctgtgcgagggcacgacagtcgttgtcgacgagcactgcgggaaccgcggcccgagcctgcgaaccaccacagtgaccgggaagattatccacgagtggtgctgccgctcttgcaccttaccgcccctgcggttccgcggcgaggatgggtgctggtatggtatggagatccggcccgtgaaggagaaggaggagaacctggtccgcagcatggtgtccgccggctcaggggaggttgacaacttcagtctcggcatcctgtgcgtgtccattatgatcgaggaggtaatgcggagcaggtggtcccgcaagatgttaatgaccgggacactcgcagtgttcctgctgctaatcatgggccagctgacttggaatgacctgatccggctgtgcatcatggtcggggccaacgcgtccgaccgtatgggcatgggcaccacctacctggccctgatggccacgttcaagatgcggccgatgttcgccgttgggttactgttccgccggctgacctcccgcgaggtgctcctgctgaccataggccttagcctagtcgcttccgtggagctgcccaacagtctcgaggaattaggggacggcctcgcgatgggaatcatgatgctgaagctgctgaccgagttccagccccaccagctctggaccaccctgttgtccttgaccttcgtcaagaccacgctgagcctagactacgcatggaagaccacagccatggtgctttccatcgtgagcctgttccccctgtgcctctccaccacgtcccagaagaccacctggctgccggtcctgctcgggtccttcggctgcaagcctctgactatgttcctaatcaccgagaacaagatctgggggcgcaaatcatggccactcaacgagggcatcatggccatcgggatagtgtccatcctattgtcttccctcctgaaaaacgatgtgcccctagccggcccgctcattgccggcgggatgctcatcgcatgctacgtcatcagcggaagctccgccgacctgtcactggagaaggctgcggaggtgtcctgggagcaagaggccgaacacagcggagcttcacacaacatactggtggaggtacaggacgatggcacgatgaagataaaagacgaagagcgcgacgacaccctgaccattctcttaaaagccaccctgctcgccgtgagcggcgtgtaccccatgtccattcccgcgacgctgttcgtatggtacttctggcagaagaagaagcagcggtccggcgtgctgtgggacaccccctccccgcccgaggtagaacgcgcagtcctggacgacggcatataccggatcttgcagcgcggcttattgggccggagccaggtgggtgtgggcgtcttccaggacggagtattccacaccatgtggcatgtgacgcgcggcgctgtcctcatgtaccagggcaagcggctggagccctcctgggcctgcgtgaagaaggacctgatctcctacgggggcgggtggcgattccagggcctctggaatacgggggaggaggtgcaggttatcgccgtggaaccagggaagaaccctaagaatgtgcagaccactcccggcaccttcaaaactcccgagggggaggtgggcgcgatcgcgctggacttcaaacccgggacctccggcagcccgattgtgaatcgggagggcaagatcgtcggcctgtacggaaacggggtcgtgaccacctccggcacttacgttagcgcgatcgctcaggcaaaggcgagtcaggaagggcccctacccgagatcgaggacgaggtattcaagaagcgcaacctgaccatcatggacttgcatccgggtagcggtaagaccaggcgctacctcccggccatcgtccgagaggccataaagcgcaaactgcgcaccctgatactcgctcccacccgggtggtcgcgtccgaaatggccgaagccctgaaggggatgcccatacgctaccagaccaccgccgtcaagagcgagcataccggccgggaaatcgtggacctaatgtgccatgccacgttcaccatgcgcctcctaagccccgtccgggtacccaactacaatatgattatcatggacgaggcgcacttcaccgatcccgcctccatcgccgcacgcgggtacattagcacccgtgtaggcatgggggaggcagcagcaatcttcatgacggccactccgcccggttctgtcgaggcctttccccagtcgaacgccgtgatccaggacgaggagcgggacatccccgagcggtcatggaatagcggctatgactggatcaccgacttccccgggaaaaccgtgtggttcgtcccctccatcaaaagcggcaacgacatcgccaactgcctccgcaagaacgggaagcgggtaattcagctctcgaggaaaacgttcgataccgagtaccaaaaaaccaagaacaacgactgggactacgtggtcaccacagatatcagcgagatgggcgcaaacttccgggccgaccgggtgattgacccccggcgctgcctgaagcccgtgatcctcaaagacggcccagagcgggtgatcctggccggaccgatgcccgttaccgtcgcgtccgccgcccagagacggggccgcatagggcgcaaccagaataaggagggcgaccaatacgtttacatggggcagcccctgaacaacgacgaggaccacgcccactggaccgaagcaaagatgctcctcgacaacatcaacactcccgagggcatcataccggcgctgttcgagcccgaacgggagaagtccgcagccatcgacggcgagtaccggttacggggagaagcccgcaaaaccttcgtggaactcatgcggcgcggcgacctgcccgtctggctgtcctacaaggtggccagcgaggggttccagtactccgaccggcgctggtgcttcgacggcgagcggaataaccaggtgttagaggagaacatggacgttgaaatctggaccaaggaaggagagcgcaagaagttacggccccgctggctggacgcgcggacgtacagcgacccgctcgcccttcgcgagttcaaggagttcgccgccggccggcgctcagttagcggcgacctgatactcgagattgggaagctaccgcagcacctaactctccgtgcgcaaaacgctctggataacctggtgatgctccacaactccgagcaaggcgggaaggcctaccggcacgccatggaggagctgcccgacacaatcgagacgttaatgctacttgccctgatcgcagtcctcaccggcggagtgactctgtttttcctcagcggcaagggcttggggaagacctcaattggcctgctgtgtgtgacggcctccagcgctttactctggatggcctccgttgaaccccactggatcgcggcgtccatcatccttgagttcttcctaatggtgctgctgataccggagcccgaccggcagcgcacgccccaggacaatcagctcgcctacgtagtcatagggctgctgttcatgatcctcaccgtggccgccaatgagatgggcctgctggaaactacaaaaaaagaccttggcataggctacgtcgccgcggagaaccaccagcacgccaccatgctggatgtcgacctgcacccggcctccgcctggaccctctacgctgtggcgaccacggtgatcacccccatgatgcggcacaccatcgaaaacacaactgccaacatttcgctgaccgcgatcgccaaccaggcagcgattttgatgggactggacaaggggtggcccatctccaagatggacatcggtgtccccctgctggccctcgggtgctacagccaggtgaacccgctgaccctgaccgccgccgtcttaatgctggtcgcacactatgccataatcggccccggcctgcaggccaaggcgacccgcgaggcccagaagcgcaccgcagcaggcatcatgaagaaccccactgttgacgggatcgttgccatagacctcgaccccgtggtatacgacgcgaagttcgagaagcagctggggcagatcatgctgctcatcctgtgcacctcccagatcctgctcatgcggacgacctgggcactgtgcgagagcatcaccctggcgaccggcccacttacgaccttgtgggagggttccccgggcaagttctggaacaccaccatcgccgtgtctatggcaaacatctttcgcggcagttacctggccggggccggcctcgcgttcagcctgatgaagagtctcgggggcgggcgtcgcggcacgggcgcccagggggagacgctcggcgagaagtggaagcgccagctgaatcagctgtcaaagtccgagtttaacacctacaagcgcagcggcataatggaggtggaccggtccgaggcgaaggagggtctcaaacgcggggagacaacgaagcacgccgtaagcaggggcaccgcgaaactgcgctggttcgtcgagcggaacctggtcaagcccgagggcaaagttatcgacctggggtgtggccgcgggggatggagctactactgtgccgggttgaagaaggtgaccgaggtcaaaggctacactaagggagggccgggccacgaggagcccatccccatggccacctatgggtggaacctggtgaagctgcactctggtaaggacgtgttcttcatgccgcccgaaaagtgcgacacgctcctctgcgacatcggggagtcctcaccgaaccccacaatcgaggagggccggaccctgcgcgtgctcaaaatggtggagccctggctacggggcaatcaattttgcatcaagatcctgaacccctacatgccgagcgtggtcgagaccctcgagcagatgcagcgcaagcacggcggcatgttggtgcgcaaccccctgtcccgcaacagcacgcacgaaatgtactgggtgtcctgcgggactggcaacatcgtctctgcagttaatatgacctccagaatgctcctgaaccgcttcacgatggcccaccggaagcccacgtacgagcgggacgtggacctgggcgcggggacccgtcacgtagccgtggagccagaggtggccaacctcgatatcatcggccagcgcatagagaacatcaagaatgagcacaagagcacatggcactacgacgaggacaacccgtacaagacctgggcctaccacgggtcctacgaagtcaagccaagcggctccgccagctcaatggtgaacggggtcgtgcgcctgctaacgaagccctgggacgtgatccccatggtcacccagatcgcgatgacagatacaactccgttcggccagcagcgggtattcaaagagaaggtagacacccgcacgcctcgggccaagcgcggcaccacgcagataatggaagtcaccgccaagtggctctgggggttcctgagccgaaataagaagccacgcatctgtacccgagaggagttcacacgcaaggtacggtccaacgccgccatcggcgcggtattcgtagacgaaaaccagtggaatagcgccaaggaggcagtggaggatgagcgcttctgggacctggtgcaccgggagcgcgagctccacaagcaggggaagtgcgcgacgtgcgtttacaacatgatgggcaagcgggagaagaagctgggggagttcggcaaagcgaagggctcccgcgccatctggtacatgtggctaggggcccggttcctcgaattcgaggccttggggttcatgaatgaagaccactggttctcccgcgagaacagcctgtccggggtggagggcgaggggttgcacaagctgggctatatcctgcgagacatcagcaagatcccgggcgggaacatgtacgccgacgacaccgctggctgggacactcgcatcaccgaggacgacttgcagaacgaggccaagatcacggacatcatggagcccgagcacgccctgctggccacctcaatcttcaaactcacataccagaacaaggtggtccgtgtgcagcgtcccgccaagaacgggaccgtgatggacgtcatcagccgccgagaccagcgcggctccggccaggtggggacttacggtctgaacaccttcaccaacatggaggtacagctgatccggcagatggagagcgagggcatcttcctgccctccgagctggagaccccgaacctggcggaaagagtcctagactggctggagaagcacggcgccgagcggctgaagcgcatggccatctccggggacgactgcgtggtgaagcccatagacgatcggttcgccacggccctcacggcgctgaacgacatgggtaaggtccgcaaagacatcccccaatgggagcccagtaagggctggaacgactggcaacaggtgccgttctgcagccaccacttccaccagctgatcatgaaggacgggcgggagatcgtggtcccctgccgcaaccaggacgagctcgtgggccgggcacgcgtgtcccaaggtgccggctggagcctgcgggagactgcctgcttggggaagtcctacgcccaaatgtggcagctcatgtacttccaccgcagggacctgcgcctggctgccaacgccatctgcagtgcggtccccgtggattgggtgcctacatcccggaccacgtggtcgatccacgcgcatcatcagtggatgaccacagaggacatgttatccgtctggaaccgcgtgtggatcgaggagaatccgtggatggaagacaagacccatgtgtcgagctgggaggaggtcccctacctgggcaagcgcgaggaccagtggtgcggcagcctgatcgggctcacggcccgggcgacctgggccaccaacattcaggtggccatcaatcaagtgcgccgtttgataggcaacgagaactatctcgattacatgactagcatgaagcgcttcaaaaacgagtccgaccccgagggggcgctctggtag

SEQ ID NO: 24056 - RNA, 9879 nt, synthetic construct
  misc_feature 1..9879: note = derived and/or modified CDS sequence (opt11) from DENV-1__FJ639820__SS-prME
  source 1..9879: mol_type = other RNA
agcgtgacgatgcttttaatgctgctgcccaccgccctcgccttccacctgaccactcgcggtggggaaccccacatgatagtgtccaagcaggaacggggcaaaagtttgctgttcaagactagcgcgggggtgaacatgtgtacactgatagccatggaccttggcgaactctgcgaggacacgatgacctacaagtgcccccgcataaccgaggccgagcccgacgacgtggactgctggtgcaacgccaccgatacctgggtcacctatggaacctgcagccagacgggcgaacaccgacgcgacaagcggagtgtggccttggctcctcacgtcggactaggcctggagacccgcaccgagacctggatgagctctgagggcgcatggaagcagatccaacgggttgaaacatgggcactgagacaccccgggttcacggtgatagcactattcctggcgcatgccatcggtacctcaatcacacagaagggaatcattttcatcttactgatgctcgtgaccccaagtatggcaatgcggtgcgtcggcatcgggaatagggacttcgtggaagggttgagcggcgccacatgggtagacgtcgtcttagagcacgggtcctgtgtgaccaccatggctaagaacaaacccaccctcgatatcgaacttctgaagacggaggtcaccaaccccgcggtgcttcggaaactgtgcatagaggccaagatctccaacaccaccactgactcccgatgccccacgcagggcgaggccacccttgttgaagagcaggatgccaatttcgtatgccgacgcacattcgttgaccggggttgggggaacggctgcggcctcttcggtaaggggtcactgctgacttgcgccaagttcaagtgtgtaacgaaactcgaaggcaagatcgttcagtacgagaacttaaagtactccgtcatcgtgacagtccacaccggcgaccagcaccaggtgggtaatgaaacaacagaacatggtaccatcgcaacgataactccccaagccccaacgagcgagatccaattaaccgactacggggccctgaccctggactgcagcccccgcaccggcctggacttcaacgaaatggtcctcctaacgatgaaggaaaagtcctggctggtgcacaagcaatggttcttggacctgcccctgccctggacctctggggccagcacctctcaagaaacctggaaccgtcaggaccttcttgtgacgttcaagaccgcccacgcgaagaaacaggaggtggtagttctaggctcccaagagggggccatgcacaccgccctcaccggggctacggaaattcagaccagcggcaccaccacaatattcgctgggcacttaaagtgcaggctgaagatggacaagctcaccctcaagggcatgtcctacgtgatgtgtaccggatcgttcaagctggagaaggaggtagcggagacccagcacggcacagtgctagtacaggtaaagtatgagggaacagatgctccctgcaagatccccttctcaacccaagacgagaagggggtgacccagaacggcagactcattacggccaaccctatcgttaccgacaaagaaaaaccagtaaacatcgagactgaaccgcccttcggcgagagctacatcgtggtcggagccggcgagaaggcgctgaagctgtcctggttcaaaaaggggagctccatcggtaaaatgttcgaggccacagctcgcggggcccggcgcatggccatcttaggtgacacagcgtgggacttcggatcaattgggggcgtgtttacctccgtggggaagctggtgcaccaggtgtttggtaccgcttacggggtgctattttcgggcgtcagttggaccatgaagatcgggattgggatcctcctgacgtggctgggcctcaacagccgctccacgagcctgtccatgacctgtatcgccgtcgggatggtgactctctaccttggagttatggtgcaggccgacagcgggtgtgtgatcaactggaaaggtcgggaactgaagtgcggatccggtatcttcgtcaccaacgaggtacacacatggaccgagcaatacaagttccaggcagacagccctaagcgactgagcgcagccataggcaaagcctgggaggagggagtgtgcggcatccgttccgcaacccgcctcgagaacatcatgtggaagcagatctcgaacgaattaaaccacatcctactagagaacgacatgaagttcaccgttgtggtaggagatgccaacggtatcctagctcaagggaagaagatgatccggccccagcccatggaacacaagtacagctggaagtcctggggcaaggcaaagatcatcggcgccgacatccagaacaccacgtttatcatcgatggacccgacaccccggaatgcccggatggccagagagcctggaatatttgggaagtggaggactacgggtttggtatctttacgaccaatatatggctgaagctgcgggattcatacacccagatgtgcgaccaccgactgatgtctgcggcgatcaaggactccaaggccgtgcacgctgacatgggctactggatcgagagcgagaagaacgaaacttggaaactcgcccgagcatcctttattgaggtcaagacatgtacctggcccaagagccataccctctggtccaatggggtgcttgagagcgagatgatcatccccaaaatctatggcgggccgataagccagcacaactatcgccccggctactttactcagaccgccgggccctggcatttgggcaagcttgagctggacttcgacctgtgtgagggcacgaccgtcgtagtcgacgagcactgcgggaatcggggtccgtcgctccgtacgaccacggtaaccggtaaaatcatccatgaatggtgctgccggtcatgcactctgccgcccctgcgcttccggggcgaggacgggtgctggtacggcatggagatccgccccgtgaaagaaaaggaggaaaacctcgtccgttccatggtgtccgccggaagcggtgaagttgatagcttctcgctgggcatcctgtgcgtcagcatcatgatcgaggaggtcatgcgttcccggtggagccgaaagatgctcatgaccggcacactggcggtgttcctgttactgattatgggccagctaacctggaacgatctcatccgcctgtgcatcatggtcggggccaacgcttctgataggatgggcatgggcaccacctacctggccctcatggcgacattcaagatgcgcccgatgttcgccgtggggctgctgttccggcgtctaaccagccgggaagtactgttattaaccattgggctgtccctagtcgccagcgtggagctccccaactccctagaggagcttggggacggcctcgcgatgggcatcatgatgctgaagctcctcaccgagttccagccccatcagctgtggacgaccctgctcagcctgacattcgtcaaaaccacgctctccctcgactacgcgtggaagaccaccgccatggtactaagcatcgtgtcactctttcccctctgcctgtcaaccacgtcccaaaagaccacgtggctgccggtcctcctgggtagcttcggctgtaagcctctgaccatgttcctcattaccgaaaataagatatgggggcgtaagtcctggccactgaacgagggcattatggctatcgggatcgtgagcatcctgctctcttcgctgctgaaaaatgatgtgcctctcgcaggcccgctcatagccggaggcatgctaatcgcctgctacgtcattagcggatccagcgccgacctctccctggagaaggccgcggaggtgtcgtgggagcaggaggccgagcacagtggggccagccacaacatcctcgtggaggtgcaggacgacggcacgatgaagatcaaggacgaggagcgtgatgataccctaacgatcctgctgaaggccacccttctggccgtttcaggggtgtaccccatgagcatccctgcgacgctgttcgtctggtacttttggcaaaagaaaaagcaacgctccggcgtgctctgggacacacccagcccgcccgaggtggagagagccgtgctcgacgatggaatctaccgcatactgcagcgggggctcctcggccgctcccaggtgggggtcggcgtcttccaggatggggtgtttcatacaatgtggcacgtgacccgaggcgcggtgctgatgtaccagggcaaacgcctggagccaagctgggcttctgtgaagaaggacctaatctcgtacgggggcgggtggcggtttcagggctcctggaacacgggagaggaagttcaagtcatagccgtggaaccgggaaaaaaccctaagaacgtgcaaaccacccccggcacctttaaaacgcccgagggggaagtcggagctatcgccctcgatttcaaacctgggacaagcggctccccgatcgtgaacagagagggcaaaattgtcgggttgtacggcaacggagtggtcaccaccagtggaacgtacgtgagcgcgatcgcccaagcaaaggcaagccaggaggggcccctcccggagatcgaggatgaggtcttcaagaagcggaacctgaccatcatggacctgcacccgggctcaggtaagacccggcggtatctccctgcgatagtgcgcgaggccatcaagagaaaattacgcactctgatcctcgcaccgactcgcgttgtcgcgtccgagatggctgaggctctgaaggggatgcctatccggtatcagaccaccgcagtcaagtctgagcataccggccgcgagatcgtggatctgatgtgccacgcaacgtttaccatgcggctcctgtccccagtccgcgtgcccaactacaacatgataatcatggacgaggcgcacttcactgaccccgcctccatcgccgcccggggttacatctccacgcgtgtgggtatgggtgaggctgcagccatctttatgactgccactccgccaggcagtgtcgaggctttcccccagtccaatgccgtgatccaggatgaggagcgggacatccctgagcgctcatggaactccggctatgactggatcaccgacttccccgggaagactgtgtggttcgtgccctctatcaagtcaggtaacgacatcgcgaactgcttacgcaagaacggtaaacgcgtgatccagctatctcggaaaactttcgacactgaataccagaaaaccaagaataatgactgggattacgtggtgacaaccgacatcagcgagatgggcgccaatttccgcgctgaccgggtaatcgacccccgccggtgcctgaaaccagtaatactgaaagacgggcccgagcgagtcatactcgcggggccgatgcccgtgaccgtcgcgagcgccgcccagcggagaggccggatcgggaggaatcagaacaaagaaggagaccagtacgtctatatggggcaacccctaaataatgacgaagaccacgcccactggaccgaggccaagatgttgctcgacaacatcaacacgcctgagggcattatacctgcgttgttcgagcccgagcgtgaaaagtcggctgcaatcgacggggaataccggctgcgcggcgaggcccggaagacgtttgtggagctcatgcggaggggggatctgcccgtctggctgagctacaaagtggcctccgaagggttccagtatagcgaccgccggtggtgtttcgacggcgagcgcaacaaccaggtcctcgaggaaaacatggacgtcgagatttggaccaaggagggggagcgaaagaagctgcgccccagatggctggatgcgcgcacatactccgaccccttagcgctgcgggagttcaaagaattcgcagccggccgccgcagcgtgtctggcgacctgatactcgagattgggaagctccctcagcacctcaccctgcgcgcccagaatgcgctggataacctggccatgctccacaactcagagcagggcgggaaggcctaccggcacgccatggaggagctgcccgacacgatagagacgcttatgttgctggctctgatcgcggtgcttacgggcggggtaacactatttttcctgagtggcaagggcctagggaagacgtcgatcggcttactgtgcgtgacggcctcatccgccctcctctggatggcttctgtggagccgcattggatcgccgctagcataatcctggagttcttcctcatggtcttgctgatacccgagccagaccgtcagcggacgccccaggacaaccagttagcctatgtggtgatcgggctgctgtttatgatcctcaccgtcgccgccaacgaaatgggccttctggagaccactaagaaggaccttgggatcgggtacgttgcggcagagaatcaccagcacgctaccatgctggatgtcgatctgcgcccagcgagtgcctggacactctacgctgtcgcaaccacggtgataacccctatgatgcgtcacacgatcgagaacaccacggccaacatcagcctgacggccatcgccaaccaagcagccatcctgatggggctcgacaaggggtggcctatcagcaagatggacatcggcgtgccattactggccctagggtgctactcccaggtcaatccactaaccctgaccgcggcggtactcatgctggtggcccactacgcgatcatcggccccgggctgcaagctaaggccactagggaggcccagaagcggactgccgccggcattatgaagaacccgaccgtcgacggcatcgtggccatagatctcgaccccgtggtctacgacgcgaagtttgaaaagcagctggggcagatcatgttgcttatcctgtgcacctcgcagatcctgctcatgcggacaacctgggcgttatgcgaatccatcacactggccaccggcccgctcaccacactctgggagggaagccccggcaagttctggaacactaccatcgccgtatccatggccaatatattccgaggcagctacttagccggggccggcctcgccttttccctgatgaagtccctcggaggcgggcggcgcggcaccggcgcccagggggagaccctgggcgaaaagtggaagcggcagctgaaccagctgagtaagagcgaattcaacacctacaagaggagtggtataatggaagttgatcggagtgaggccaaagagggtctcaagcgcggggagaccacgaagcacgcggtctcccggggcaccgccaagctgcgctggttcgtggagcggaacctggtcaagccggagggcaaggtgatagacctgggttgcggcagagggggctggtcctactattgtgccgggctcaagaaggtgaccgaggtgaagggctatacgaaggggggtcctggtcacgaggagccgattcctatggccacttacgggtggaacctggtcaaactgcacagcggaaaggacgtgtttttcatgccgccggagaagtgcgacacactactctgcgacattggggagtccagcccgaaccccaccatcgaagagggccggaccctgcgcgtcctcaagatggtcgagccctggttgaagggcaaccagttctgcatcaaaatcctgaacccctacatgccgtcggtcgtggagacgctcgagcagatgcagcggaagcacgggggcatgttggttcgcaatcccctgagccggaattccacgcacgaaatgtactgggtgagctgcgggaccggcaacatcgtatccgcagtgaacatgaccagccgaatgctcttgaaccggttcacaatggctcaccgcaagcccacgtacgagcgcgacgtagacctgggcgcgggaacccgtcatgttgctgtagaacccgaggtggccaacctagacatcataggccagcgcatcgagaacatcaaaaacgagcacaagtccacatggcactacgatgaggataacccgtacaagacctgggcttaccatgggagctacgaggtgaagccatccgggtcggcgtccagcatggtcaacggtgtggtccgactgctgacgaagccatgggacgtgatccccatggtgacacagatagccatgaccgacaccacgccgttcggccagcagcgcgtcttcaaggagaaggtggacacccgaacgcctcgcgccaagcggggaactacgcagatcatggaggttactgccaaatggctctgggggttcctatcccgcaacaagaagccccggatatgtacccgcgaggaattcacgcggaaggtccgcagcaacgcagcaattggggctgtgttcgttgatgagaaccagtggaactcggccaaagaggccgtcgaggacgagcggttctgggacctggtgcatcgcgagcgagagttgcacaagcaaggtaagtgcgcgacgtgcgtctataacatgatgggtaagagggagaagaaactgggggagttcggaaaggccaaaggctcaagggccatatggtatatgtggctgggggcccgcttcctagagttcgaggcactgggctttatgaacgaagaccattggttcagccgtgagaactccctgtccggtgtcgaaggagaggggctccacaaactggggtacatcctgcgggacatctccaagatcccgggtgggaatatgtacgcggacgacaccgccggctgggatacccggatcacggaggacgatttgcagaatgaggccaagatcacggacattatggagccagagcatgccctgctcgccacctcgatattcaagttgacctatcagaacaaagtggtgcgagttcagcgccccgctaaaaacggtaccgtgatggacgtcatatcccgtcgggaccagcgcggctccggccaggtcgggacgtacggccttaacacgttcacgaacatggaagtgcagctgatccggcagatggagagcgaggggatattcctccctagcgagctggagaccccgaacctggccgagcgggtgctcgactggctggagaagcacggcgccgagcgcctcaagcgaatggcgatctctggggacgactgcgtagtgaagcctatcgatgaccgcttcgcgacggcgctcaccgcgctaaatgacatgggcaaggtgcgtaaggacattccccaatgggaacccagcaagggctggaatgattggcagcaggtgcctttttgctcccaccacttccaccagctgataatgaaggatgggagagagatcgttgtgccgtgtcggaaccaggacgagctcgtcggccgcgctcgggtgagccaaggggctggctggtccctccgggagaccgcctgcctgggcaagagctacgcccagatgtggcagctcatgtattttcatcggcgtgatctgcggctggccgcgaatgccatttgctccgcggtgccggtggactgggtgcccacaagccgcaccacgtggagtatccacgcgcatcaccagtggatgactaccgaagacatgttgtccgtgtggaaccgggtctggatagaggagaacccgtggatggaggataagactcacgtgtcatcctgggaggaggtgccctatctgggcaaacgcgaggaccagtggtgcggcagcctgatcgggctcacggctagagcaacctgggccacgaatatacaagtcgctatcaaccaggtgcgccgtttaatcgggaacgagaattacctggactacatgacctccatgaagcgcttcaagaacgaaagcgatcccgaaggggccttatggtga

SEQ ID NO: 24057 - RNA, 9879 nt, synthetic construct
  misc_feature 1..9879: note = derived and/or modified CDS sequence (opt11) from DENV-1__FJ639821__SS-prME
  source 1..9879: mol_type = other RNA
tcagccaccatgctgcttatgctgctgcccacagccctggccttccaccttacgacccgcggtggggaaccccacatgatcgtgtccaagcaggagcggggcaagagcctcctgttcaaaaccagcgccggggtgaatatgtgcaccctgatcgccatggacctgggcgagctctgtgaggataccatgacatacaagtgtccccgcatcaccgaggcggagccggacgacgtggactgctggtgcaacgccactgacacctgggtgacctacgggacctgcagccagaccggcgaacaccggcgcgaaaagcggtccgttgcgttagcaccccatgtcggcctggggcttgaaacccgaacagagacgtggatgagctcggagggcgcctggaagcagattcagcgggttgagacctgggcgctgcgacaccccgggtttacagtgatcgctttcttccttgcgcacgccatcggcacctctattacccagaagggtatcatattcatcctcctgatgctggttaccccctcgatggccatgcggtgcgtaggcatcggcaacagggactttgtcgaaggactcagcggtgccacttgggtggacgtggtcttagagcacggctcttgcgtgaccaccatggcgaagaacaaacccaccctggacatcgagctcctgaagacggaggtcaccaaccctgcagtgctgcggaagctctgcattgaggccaagatcagcaataccaccacggactcccgctgccccacgcaaggcgaggccaccctggtcgaagaacaagacgccaacttcgtgtgccggcgcacattcgtcgaccggggttgggggaacggctgtgggctgttcggcaaggggagcctcctgacttgcgcgaagttcaagtgtgtgaccaaactggaaggcaaaatcgtgcagtacgagaacctcaagtactccgtcatcgtgacagtgcacaccggcgaccagcaccaagtcgggaatgagacgaccgagcacggaaccatcgctacgatcactcctcaggcccccacgtcggagatccaattgaccgactacggggcactgacccttgactgcagcccccggaccggcctggacttcaatgagatggtgctgctcacgatgaaggagaagtcatggctggttcacaagcagtggttcctggacctcccgctaccctggacctcaggggcgagcactagccaggagacctggaatcggcaagacctgctcgtgacgttcaagaccgcgcatgccaagaagcaggaggtagttgtactgggctcccaggagggagccatgcacacagccctgaccggggccacggagatccagacctcgggaacgaccacgatcttcgcggggcacttaaagtgtagactaaagatggacaagttgactctcaaggggatgtcctacgtcatgtgcaccgggagcttcaagctggagaaggaggtcgccgagacccagcacggcacggtgcttgtgcaggtacggtacgagggaacagatgccccatgcaagatacccttcagtacccaggacgagaaaggggtgacccagaacggccgcctgatcacggccaacccgatcgtgaccgacaaggagaagcccgtcaacatcgagacggagccgcccttcggcgagagctacatagtggtaggcgcgggcgaaaaggcactcaaactgtcctggtttaaacgggggagttccatcggcaagatgttcgaggccaccgcgaggggggcccgcagaatggcgatcctgggcgacacggcctgggacttcggctcgatcgggggcgtcttcacatccgtggggaagctcgtgcaccaggtctttggtaccgcgtacggggtgctgttcagcggagtctcctggacgatgaagatcggcatcgggatcctgttgacctggcttggactgaattcccgctccaccagcctctccatgacctgcatcgctgtcgggatggtgaccctctacttaggtgtgatggtccaagccgacagcgggtgcgtgatcaattggaagggccgtgagctcaaatgcgggtccggaatattcgtgacgaacgaggtccacacgtggaccgagcagtacaagttccaagcggacagtcctaagcgcctgtcggccgccatcggcaaagcctgggaggagggggtatgtggcatacggtccgcgacccgcctggaaaatatcatgtggaagcaaatctccaatgagctcaaccacatcctgctggagaacgacatgaaattcacagtggtcgtgggggacgcgaacggcatcctcgcccaggggaagaagatgatccgtccccagccgatggagcacaagtactcctggaaaagttggggcaaggccaagatcattggcgccgacattcagaacacgaccttcatcatcgatgggcccgatacaccggagtgccccgacggccagcgagcgtggaacatctgggaggttgaggactatgggtttgggatcttcaccacgaacatctggttgaagctgagggactcctacacccagatgtgtgaccaccgcctcatgagcgccgccatcaaggacagtaaagccgtccacgccgacatgggctactggatcgaaagcgagaagaacgagacttggaaactggcgcgggcctccttcatcgaggtgaagacatgcacgtggcccaagagccacaccttatggtccaatggtgtgctcgagagcgagatgataatacctaagatatacggcgggccgatatcccagcataactaccgccccgggtactacacacaaacggcagggccatggcacctcgggaagctggagctcgacttcgatctatgcgagggcactaccgtcgtcgtggatgagcactgcgggaaccggggaccaagcctgcgcaccaccacggtcaccgggaagatcatccacgagtggtgctgtagatcctgcaccttaccacccctccgattccggggcgaggacgggtgctggtacggcatggagatccgccccgtgaaggagaaggaagaaaacctggtgcggtcgatggtatccgccggcagcggggaggtggacaacttctctcttggcatactctgcgtgtccataatgatcgaagaggtcatgcgaagccggtggtcccgaaagatgctgatgaccgggacactagccgtgtttctgttgctcatcatgggccaattaacctggaacgacctgatccgcctctgcattatggtgggggcgaatgccagcgacggtatgggcatggggaccacctatctggccctgatggccaccttcaagatgcgaccgatgttcgccgtcggcttgctgtttcgccggttaacctcgagggaggtccttctgctcaccatcggactcagcctggtggcatccgtcgagctgcctaacagcctagaggagctgggggacggactggccatgggtatcatgatgctcaagttgctgaccgagttccagccccaccagttatggacaaccctactgtccctcacctttgtcaagactacactgtcgctggattatgcctggaaaaccaccgccatggtcctctccatcgtcagcctgttccccctttgcctctccaccacaagccaaaagaccacttggctgcctgttctcctaggctcgtttggttgtaagcccctgaccatgtttctcatcacagagaacaagatctggggccgcaagtcgtggccactaaacgaagggatcatggcgataggcatcgtctccattctgctgagctccctgctgaagaatgacgtgcccttagccggcccgctcatcgctggaggcatgttgatcgcgtgctacgtgatcagcgggagctctgccgacctgagcctcgacaaagcggccgaggtcagctgggagcaggaggccgagcacagcggcgcctcgcacaacattagcgtggaagtccaagacgacgggacgatgaagatcaaggacgaggaacgcgacgataccttgaccatcctgctcaaagccaccctgctggcggtctccggcgtgtaccccatgagcatacccgccaccctcttcgtgtggtacttctggcagaagaagaagcagcggtccggcgtcctgtgggataccccaagcccgcccgaagtggaacgtgccgtcctggacgacgggatctaccggatcctacagcgcggcctgctcggtcgttcccaggtcggcgtgggggtattccaggacggtgtctttcacactatgtggcatgttacccgcggcgccgtactgatgtaccaggggaaacggctcgaaccctcgtgggcctgcgtcaagaaggacctgatctcctacggcggtggctggagattccaggggagctggaacacgggcgaggaggtccaggtgatcgcagttgagcccggcaagaacccgaagaatgtccagaccacccccgggacctttaaaacgcccgagggcgaggtaggggccatagcactggatttcaagcccggcacgagcgggagcccaatcgtgaacagggaggggaagatcgtgggcctctatgggaacggcgtggtcaccacctccgggacatacgtgtctgcgattgcccaggcgaaggccagtcaggaaggtcccctgccggagatcgaggacgaggtgttcaaaaagcgcaatctaaccataatggacctacacccgggcagcgggaagacacggagatacctgcctgccatcgtccgggaggccatcaagcgcaagctacgcaccctcatcctggcccccacgcgggtggtggcctctgaaatggcggaggccctgaagggcatgcccatcaggtaccagaccaccgctgtcaagtccgagcacaccggacgcgagatcgtggacctcatgtgccacgcgaccttcaccatgaggttgctgtccccggtgcgggtccccaattacaatatgatcatcatggacgaagcccatttcaccgaccccgcctccatcgccgccaggggctatataagcacgcgcgtggggatgggcgaggcggccgccatcttcatgacggctacgccgcccggttccgtggaggccttcccccagagcaacgctgtcatccaggatgaagagcgcgacatccccgagaggtcctggaacagcggctacgattggattaccgacttccctggcaagaccgtgtggttcgttccttccattaagtcaggtaatgacattgcaaactgtctccgcaagaacggtaaacgggtcatccagttgtcccggaagacgtttgacaccgagtaccaaaagactaagaacaacgactgggactacgtggtaactactgacataagcgagatgggtgctaacttccgggcagaccgcgtcattgacccgcggcgctgcctgaagcccgtgatactcaaggacgggcccgagcgagtgatcctggccggcccgatgcccgtcacagtggcctcggccgctcagcgccggggtcgcatcggcagaaaccagaacaaagagggcgaccaatacgtctacatgggtcagcccctgaacaatgacgaggaccacgctcactggacggaggcgaagatgctcctggataacataaacaccccggagggaataatcccggccctgtttgagccagagcgggagaagtctgcggctatcgacggagagtaccgcctccggggtgaggcccgcaagacgttcgtggagctgatgcggcgcggggacctgcccgtctggctctcctacaaggtcgcatcggaaggattccagtacagtgaccgtcgatggtgctttgacggggagagaaacaatcaagttctggaggagaacatggacgtggaaatctggaccaaggagggcgaacgcaagaaactgcggccacgctggttggacgcgaggacctactccgaccccctggccctgcgcgagtttaaggagttcgctgcaggccggcgcagtgtctccggggacctcatcctggagatcggcaagctgccccagcacctcacgctccgggcccagaacgcattagacaacctcgttatgctgcacaacagcgagcagggagggaaagcctaccgccacgccatggaggagctgccggataccattgagacgctcatgctgttagccctcattgccgtgctgaccgggggcgttactcttttcttcttatccggcaaagggttagggaaaacctccatcggcttactgtgtgtgacggcaagctctgccctgctctggatggcctccgtggagccccactggatcgcggccagcataatcctcgagttcttcctgatggtcttattgatcccggagcccgaccggcaacggacgcctcaggacaaccaactcgcctacgtagttatcggcctcttattcatgattctgacagtagccgccaatgagatgggtctgctcgagaccactaaaaaagacctaggtattggctatgtggcggccgagaaccaccagcacgccactatgctggacgtcgacttacacccggcgtccgcctggacactgtatgcagtcgccaccacagtcatcaccccgatgatgcggcacactatcgagaacacaacggcaaatatctccctgaccgctatcgccaaccaggcagccatcctcatggggctggacaagggctggcccatctccaaaatggacataggggtgcccctgcttgccctcggctgttatagccaggtcaacccgctcaccctcaccgctgcggtgctgatgctggtggcccactacgcaatcatcgggcccggcctccaggcgaaggccacgcgcgaggcgcagaagcgcaccgccgccggcattatgaagaaccccaccgtcgacggaatcgtggcgatcgacctggatcccgtggtttacgatgtgaagtttgagaaacagctgggccagatcatgcttctgatactttgtacgtcacagattctgctgatgcggacgacctgggctctctgcgaaagcatcacgctcgcgaccgggccgctgacgactctgtgggagggctcccccggcaaattctggaataccaccatcgccgtgagcatggcaaacatcttccggggctcatacttggccggcgccgggctggcgtttagcctgatgaagtccctcggcgggggccgacgtggcacgggggcccaaggcgagactctgggtgagaagtggaagcggcaattaaaccagctcagtaaatccgagtttaacacctacaagcgctcaggcatcatggaggtcgaccggtctgaggccaaggaagggctcaagcgcggggagaccacgaaccacgctgtgagcagaggcaccgccaagctgcgctggttcgtggagcgcaacctcgtcaagcccgagggaaaggtgattgacttaggatgtggtcgcggggggtggagctattactgcgccggcctcaagaaggtaacggaggtcaagggctacacgaagggtgggcccgggcacgaggagccgatccccatggcaacctacggctggaacctagtgaagctccactccgggaaagacgtgttcttcatgccgcccgagaagtgcgacacactactgtgtgacatcggtgagtcaagcccgaaccccaccatcgaggagggcaggaccctccgcgtcctcaagatggtagaaccctggctgcggggcaaccagttctgcatcaagatcctgaacccctacatgccgagcgtcgtagaaaccctggagcagatgcagcgtaaacacggcggtatgctggtgcggaaccccctctcccgcaacagcacgcacgagatgtactgggtttcgtgcggcactggcaacatcgtgagcgccgtgaacatgacctcccgcatgctgctgaaccgcttcactatggcccatcgcaagcccacctacgagcgcgacgtagacctcggggcgggcactcgccacgtcaccgtggagcccgaggtggctaatctggacatcatcgggcagcgcatcgagaacattaagaatgagcacaagtcgacctggcattacgacgaggacaatccgtacaagacgtgggcctaccacggatcctatgaagtaaagcctagcggctcggccagcagcatggtaaacggcgtagtgaggctactcaccaagccctgggacgttatcccaatggtgacccagatagccatgaccgacacgaccccgttcggccaacaaagagtgtttaaggagaaggtggacacgcgcacgccccgggcaaagcgcggcacgacccagatcatggaggtcaccgccaagtggctgtggggcttcctgagccggaacaagaagccccgcatctgcacccgggaggagtttacacgtaaggtgaggtccaacgccgccattggtgccgtgtttgtcgacgagaaccagtggaactcagcgaaggaggccgtggaggacgaaagattctgggacctcgtgcatcgggaacgcgagctgcacaagcagggcaagtgcgcgacctgcgtctacaacatgatgggcaagcgggaaaagaagcttggcgagttcggcaaggcaaaggggagccgggcgatctggtacatgtggctcggcgcccggttcctggagttcgaagccctggggttcatgaacgaggatcattggttctcacgcgagaacagcctctccggagtggagggcgagggcctgcacaagttaggctatattctccgggatatcagcaagattcctggagggaacatgtacgccgacgataccgcggggtgggacacccggattacggaggacgacctgcagaacgaggctaagatcaccgatatcatggagccggagcatgcactgctcgccacctccatctttaagctaacctatcaaaacaaggtggtccgcgtgcagcgaccagccaaaaacggtacggtcatggatgtcatcagccgccgggaccagcgcggctccggccaggtcggcacctacgggttaaatacattcacaaacatggaggtacaactaatccggcagatggagagcgaggggatctttctgccgtcggagctggagacgccgaacctagccgagcgcgtcctggattggctggaaaagcatggggctgaacggctcaaacgcatggcgatctcgggcgatgactgcgtggtaaagcccatcgacgaccggtttgccacagcactgactgccctgaacgacatggggaaggtcagaaaggacatcccccagtgggagccatccaaggggtggaacgactggcaacaagtcccgttttgctcgcaccacttccaccagctcatcatgaaggacggccgggagatcgtggtcccgtgccgcaaccaggatgagctggtggggcgggcgcgcgtctcccagggggctggttggagtttacgggaaactgcctgcctaggtaagtcatatgcccagatgtggcagctcatgtacttccaccgccgagacctacgcctcgcagcgaacgccatctgcagcgccgtccccgttgattgggttcccacctcccgaacgacctggagcatccacgcccaccaccaatggatgaccaccgaggacatgctgagcgtctggaacagggtgtggatcgaggagaacccttggatggaagataagacgcacgtgtccagctgggaagaggtcccctacctggggaagagagaggaccagtggtgcgggtcccttatcggccttacggcgcgggccacctgggctaccaacatccaggttgctatcaaccaggtccgccgcctgatcgggaacgagaattacctcgactacatgacgagcatgaagcgtttcaagaacgagtcggatcccgaaggcgccctgtggtga

SEQ ID NO: 24058 - RNA, 9879 nt, synthetic construct
  misc_feature 1..9879: note = derived and/or modified CDS sequence (opt11) from DENV-1__FJ639824__SS-prME
  source 1..9879: mol_type = other RNA
agcgtgactatgctgctcatgctgctgcccaccgcacttgccttccatcttaccacacgcggcggggagcctcacatgatcgtcagcaagcaggagcggggtaagtcattactgttcaagaccagtgcgggggtgaatatgtgcaccctgatcgccatggatctcggcgagttatgtgaggacaccatgacctacaagtgcccccgcataactgaggcggagccagacgacgtggactgctggtgtaatgcgacagacacatgggtgacctacggaacctgcagccagaccggagagcaccggcgcgacaagcgaagcgtggcccttgcgccgcacgtgggcctaggactagaaacccggaccgagacctggatgtcgtctgaaggtgcctggaaacagatacagagagtcgaaacctgggcgctgaggcaccccgggttcacggtgatagccctgttcttggcgcacgccatcgggaccagcatcactcagaagggcattatctttatcctgctcatgctcgtgacgccctccatggccatgagatgcgttggcatcggtaaccgcgacttcgtggaggggctgagcggcgccacatgggtggatgtagtgttggagcacgggtcctgcgtgaccactatggccaagaacaaacctaccctcgacattgagctgctgaagacggaggtcaccaaccccgcagtgttacggaagctgtgcatcgaggcgaagatcagcaacacaactactgactcacgctgccccacgcagggcgaggccaccctggtagaggaacaggacgctaactttgtgtgccggcgcaccttcgtggaccggggctgggggaatggctgcggactattcgggaaggggtccctactgacctgcgccaaatttaagtgcgtgaccaagctcgaggggaaaatcgtacaatacgagaatctgaaatactccgtgattgtaaccgtccacacgggtgaccagcaccaggtggggaacgagacgacggagcacggtaccatcgcgaccataacgcctcaggcacccacgagcgagattcagctcactgactacggggccctcaccctggactgctcgcccaggaccggtctggacttcaatgagatggtcctcctcacgatgaaggagaagtcctggctggtgcacaagcagtggttcctcgacttgccactaccctggaccagtggcgccagcactagtcaggagacctggaacaggcaggacctcctggtgacgtttaagactgcacatgcgaagaagcaggaggtcgtggtgttaggctcccaagagggagccatgcacaccgccttaaccggggccacagagatccagaccagcggcacgacgacgatctttgccgggcacctgaagtgcagactgaagatggacaagttaaccctcaagggcatgtcctacgtgatgtgcaccggcagctttaagctggagaaagaggtggcagagacgcaacatggcactgtgctggtccaggtgaagtacgaggggactgacgcaccctgcaaaatccccttctcaacccaggacgaaaagggggtgacccaaaacggccgcctcattacggccaacccgatcgtcaccgacaaggagaagcccgttaatatcgaaactgaaccgcccttcggggagtcatacatcgtggtgggggccggcgagaaggcactgaagctgtcctggttcaagaaggggagttccataggcaagatgttcgaagccaccgcccgcggggcccggaggatggccatcctgggcgacacggcatgggactttgggtcgatcggcggcgtgttcacctccgtgggtaagcttgtccaccaggtgtttgggacggcctatggagtgctgttttctggagtctcttggaccatgaagatcggaatcggcatactgctgacgtggctggggctcaacagccgcagcacctccctgtccatgacgtgcatcgccgtggggatggtgaccctgtacttgggcgtcatggtgcaggccgacagcgggtgcgtgatcaactggaaaggccgggagcttaagtgcgggtcggggatcttcgttacgaatgaggtgcacacctggacagagcagtacaagtttcaagctgattccccgaagcgcctttcggcggccatcgggaaggcctgggaggagggagtctgcggaatacggtccgctacccgacttgagaacatcatgtggaagcagatcagcaacgagctgaaccacatccttctcgagaacgatatgaagttcacggttgtcgtgggggatgcgaacggcatcctggcgcaggggaagaaaatgatacggccgcagccaatggagcacaagtatagctggaagtcttggggcaaagccaagatcataggcgccgacatccaaaacacgacgttcatcatagacgggccagacaccccggagtgcccagacggccaacgcgcgtggaacatctgggaggtcgaggactacgggttcggcatcttcactacaaacatttggctcaagctacgagactcctacacccagatgtgcgaccaccgcctgatgagtgcggccattaaggacagcaaggccgtacatgcggacatgggatactggatcgagtccgaaaagaatgaaacctggaagctggcccgagcgtccttcatcgaagtgaagacttgcacgtggccaaagtcgcacaccctgtggagtaacggagtcctggagagcgagatgatcatccccaagatctacggcggtccgataagtcagcacaactaccgccccggctacttcacccagacagcaggcccctggcacctgggcaagctcgagctggacttcgatctatgcgagggcacgacagtagtggtagacgagcactgtgggaaccgtggtccgagcctccgcaccaccacggtgaccggtaagatcatccacgagtggtgctgcagaagttgcaccctgccacccttacgcttccggggagaagacgggtgctggtatggcatggagatccgcccagtgaaggagaaggaggagaatcttgtcaggagcatggtatccgccggtagcggggaggtcgatagtttcagtctgggcatcctgtgcgtcagcatcatgatcgaggaggtcatgcgctcccgttggagcaggaaaatgcttatgaccgggacgcttgctgtattcctgctcttaatcatgggtcagctgacgtggaatgacctcattcgcctgtgtatcatggtcggagcgaatgcgtcggatcggatgggcatggggacgacttatctggccctcatggcaaccttcaagatgcgcccgatgtttgccgtggggttactttttcggcgcctcaccagtagagaagtgctgctgctcacaatcgggctctccctggttgcctctgtggaattaccaaactccttggaggagctgggggacggcctcgcgatgggcattatgatgcttaagctgctcaccgagttccagcctcaccagttatggacaaccctgctcagcctgacctttgtaaagaccacgctgtccttagactacgcctggaagactaccgcgatggttctgagcatcgtgtccttattccccctctgtttgagcaccacttctcagaagaccacctggctcccggtcctcctggggtcattcggctgcaagcccttaaccatgttcttgatcaccgagaacaagatatgggggcgcaagtcctggcccctgaacgagggcatcatggctatcggaattgtgagcattcttctcagctcccttttaaagaacgacgtgcccctcgcgggccctttggtcgcagggggaatgttgatcgcctgctatgtgatatcaggaagcagcgccgacctcagtcttgagaaggccgcggaagtgagctgggagcaggaggccgagcattccggggcaagccacaacatcctggttgaggtccaggatgatggcacgatgaagatcaaagacgaggagcgagacgacaccctcaccatcctgcttaaggccactctactggccgtgtcaggggtttaccccatgagcatccccgctacgctgttcgtgtggtacttctggcagaagaaaaagcagaggtccggcgtgctctgggatactccctcgccccccgaggtcgagcgtgcggtccttgacgacggcatttaccgtatcctgcagcggggacttctcggccgctcccaagtgggggtcggcgtattccaggacggggtgtttcacaccatgtggcacgtaacgcggggcgccgtgctgatgtaccaggggaagcgactggaacccagctgggcgtccgtcaaaaaggatctcataagctacggaggcgggtggagatttcagggctcctggaacactggcgaggaagttcaggttatcgccgtggagcccggaaagaacccaaagaacgtccaaaccacgcccggcaccttcaagacgcccgagggggaggtgggcgcgatagccctggacttcaagccaggtacctcaggctcacccatcgtgaaccgcgagggcaagatagtcggtctgtacggcaacggggtggtgaccaccagcggaacgtacgtctccgcgattgcccaggccaaagcgagtcaggaggggcccctgcccgagatagaggacgaggttttcaagaagaggaacctgaccatcatggacctgcacccgggttcaggcaagaccagacgctaccttcccgctatagtacgcgaggccatcaagcgtaagctgcgcaccctgatactcgcccccacgagagtagtggcgtccgagatggccgaggccctgaaggggatgcctatccgctaccagactacagccgtcaagtctgagcacactggccgagagatcgtcgacttaatgtgtcacgcaacgtttaccatgcggctcctgtccccggtgagggtgcccaactacaacatgatcattatggacgaggcgcacttcactgaccccgccagtatcgccgcccgggggtacatctccacgcgcgtcggaatgggggaggccgcagccatcttcatgacggccaccccaccaggcagcgtggaggcgttcccccagtctaatgcggtgatccaagacgaggagagagacatccccgaaagatcgtggaatagcggctatgactggataaccgacttccccgggaagaccgtctggttcgtgcccagtatcaagtccggcaacgacatcgccaattgcctgcggaagaatgggaagcgcgtcatccagctcagccggaagacgttcgataccgagtaccagaagacaaagaataacgactgggactatgtcgttacaacggacatctccgagatgggagctaacttccgtgccgaccgggtgatagacccccgccggtgcctgaagcctgttatcctgaaggacggtcccgagcgcgtgatcctcgcgggaccaatgcccgtcaccgtagccagcgccgcccaacggcgaggcaggatcggacgcaaccagaacaaggagggcgaccagtacgtgtacatggggcagcccttaaacaacgacgaagaccacgcccactggacggaggccaagatgctgctcgacaatatcaacaccccggagggcattatccccgcgctgttcgagcccgagcgcgagaagtccgccgccatcgacggggaataccggctgcgcggcgaggcccggaaaacgttcgtcgagctcatgcgccggggcgatctacctgtgtggctgagctacaaggtggcctccgaagggttccagtactcggaccgcagatggtgcttcgacggcgagaggaataatcaagtcttggaagagaatatggacgtggagatctggaccaaggagggggagagaaaaaagctgcgccctcggtggctggacgcgcgaacctactccgacccgttagccttgagagagtttaaggagttcgccgcaggccgccggtcagtgagcggcgacctgatcctcgagatcgggaagctgccccagcatcttaccctccgcgcccagaacgcgcttgacaacctagtcatgctgcacaactccgagcaaggcgggaaggcctaccgccatgccatggaggagctgcccgacaccatagagactctcatgctgctggccctgatcgcggtgttaaccggaggggtgactctgttctttttgagcggcaaaggcctgggtaaaacctccataggactgttatgcgtcacggcaagcagtgccctcctatggatggcgagcgtagaaccgcactggatagccgcgtccatcatcctggaattcttcctcatggtgctgctgatcccggaacccgaccgccagcggacgccccaggacaaccaactcgcctacgtcgtcatcgggctgttgttcatgattctcaccgtggccgccaacgaaatgggtctgttagagaccacgaagaaggacctcggcattggctacgtcgccgctgagaatcaccagcacgccaccatgctggatgtagatcttaggcccgccagcgcctggaccttgtacgctgtggcaaccacggtcattacccccatgatgcggcacaccattgagaacacaactgccaacatcagtctgaccgctatcgcaaatcaggccgctattctcatggggctcgacaaggggtggcccatcagcaaaatggacatcggcgtgcccctgttggccctcggatgctattcccaagtgaaccctttaaccctgaccgccgcggtactcatgctagtagcgcactatgccatcatcggcccggggctgcaggccaaggccacgcgcgaggcccagaagcgcactgccgcgggaataatgaagaaccccactgtggacggcatcgtcgctattgacctcgaccccgtggtgtacgacgctaaattcgagaagcagctagggcaaatcatgctacttatcctgtgcacctcccaaatcctgttgatgaggacgacctgggccttgtgcgaaagcatcacgttagcgaccggtccgctcaccaccttatgggaggggtcacccggcaaattctggaacaccaccatcgccgtgagtatggccaacatattccgcgggagctacctagcaggggcaggcctcgcgtttagtctcatgaagtccctcgggggcgggcgaaggggtacgggcgcccagggggagaccctcggcgagaagtggaagagacagctgaaccaactttctaagagcgagttcaacacctacaaacgctcggggataatggaggtcgacagatccgaggccaaggagggcctaaaacgaggggagaccacgaaacacgccgtgagcagaggcacggcgaagctgcgctggttcgtcgaacggaacctagtgaaacccgagggcaaagtgatcgacttagggtgcggccgggggggctggtcctattactgcgcagggcttaagaaggtgacggaggtgaagggttacaccaagggcggacccggccacgaggaaccgatccccatggccacttatgggtggaacctggtaaagctacattcgggcaaggacgtcttcttcatgccgccggagaaatgcgatacacttctgtgtgatatcggagagtccagcccaaaccctacaatcgaagagggtcggaccctgcgggtgctcaagatggtggagccctggctgaagggcaaccagttctgcatcaaaatcctgaacccctacatgccgtccgtcgtggagaccctcgaacagatgcaacggaagcacggaggaatgcttgtgcgcaaccccttgagccggaacagtacgcacgagatgtactgggtcagctgcggtaccggcaacatagtgtccgccgtgaacatgacttctcgcatgctcctgaatagattcacaatggcccaccgcaagcccacgtacgaacgggacgttgatctgggcgcggggaccagacacgtggcggtggaacccgaggtcgccaacctagacattataggccagcgtatcgagaacatcaaaaacgagcataagtccacatggcactacgacgaggacaatccttacaagacctgggcctaccacggttcgtatgaggtcaaaccctccggcagcgctagtagcatggtaaatggggtggttagactgctgacgaagccctgggatgtcatccccatggtaacccagatcgcgatgaccgatacaacgccgttcggccagcagcgagtattcaaggagaaagtcgacacccggacgccccgcgccaagcggggcaccactcagattatggaggtgaccgcaaagtggctctggggtttcctgtcgagaaacaagaagccccgaatctgtactcgcgaggagtttacccggaaggtccgctcgaacgctgccatcggcgcggtcttcgtggatgagaaccagtggaactccgccaaggaggccgtcgaggacgagcgcttctgggacctggtccaccgcgagcgggagctccataagcaggggaagtgcgcaacctgcgtttataatatgatgggcaagcgcgagaagaagctcggggagttcggaaaagcgaaggggtcccgggccatctggtacatgtggctgggagctcggttcctcgagttcgaggccctcggcttcatgaatgaggaccactggttctctcgggagaactccctgtcgggggtcgagggcgaaggtctgcataagctgggctacatcctgcgggatatctctaagattccaggtggcaatatgtacgccgacgacacagcgggctgggatacaagaattacagaggacgacctccagaacgaggcaaagatcacggacatcatggagcccgagcacgccctgctggccacctccatattcaagctcacctatcagaacaaggtcgtgcgcgtgcagcgccccgccaagaacgggacggtgatggacgtgatttcgcgccgcgaccagcggggcagtggtcaggtgggaacgtatggcctcaacacattcaccaacatggaagtccagctgattcgccagatggagtccgaggggatcttcctccccagcgagctggagaccccgaacctggcggaaagagtgctggactggctggaaaagcacggcgccgagaggctgaagaggatggccatctccggagacgactgcgtagtcaaacctatagacgaccgctttgccaccgccctcaccgccctgaacgacatgggcaaagtgcgaaaagacataccccagtgggagcccagcaaggggtggaacgactggcaacaggtcccgttctgttcccaccactttcaccaactgatcatgaaggacgggcgcgagatcgtcgttccctgccggaaccaggacgagctcgtcggtcgtgcccgggtcagccaaggggctggctggtctctgcgcgagaccgcctgcctgggcaagagctacgcccaaatgtggcagctgatgtactttcaccgccgcgatctgcgcctggctgccaacgccatctgctcggccgtccctgtggactgggtcccgacgagccgcactacttggagcatccatgcgcaccaccagtggatgaccacagaggatatgctcagtgtatggaaccgagtgtggatagaggaaaatccctggatggaggataaaacacacgtcagttcctgggaagaggtcccctacttaggcaaacgcgaggaccagtggtgcgggtctctgatcgggttgacggcgcgcgccacgtgggcgaccaatatccaggtagcgatcaaccaggtccgccgccttatcggaaatgagaactacctagactacatgacctccatgaagcggttcaaaaacgagagcgatcccgaaggggcactctggtaa

SEQ ID NO: 24059 - RNA, 9879 nt, synthetic construct
  misc_feature 1..9879: note = derived and/or modified CDS sequence (opt11) from DENV-1__JN819425__SS-prME
  source 1..9879: mol_type = other RNA
tccgtgactatgttgctcatgctactgccgactgccctcgcattccacctcaccacccgaggcggggagccccacatgatcgtgagcaagcaggagcggggtaagagcctcctgtttaagacctcggcgggggtgaacatgtgcaccctgatcgccatggacctgggcgagctatgcgaggacaccatgacctacaagtgcccccgcatcaccgaggccgaacccgacgacgtggactgctggtgtaacgccaccgacacctgggttacctacggtacctgctctcagaccggcgagcatcggagggagaagcgatcagtggccctggcgccccatgtaggcttgggtctcgagacccgaactgaaacttggatgtcgtccgagggggcctggaaacaaatccagcgcgtcgaaacctgggcgctgcggcaccccggttttacggtcatagccttcttcctggcgcatgccattggaaccagcatcacccagaagggcattatcttcatcctcttgatgctggtcacaccctccatggcgatgcggtgcgtcggcatcggcaaccgagacttcgtggagggtctcagcggcgccacgtgggtggatgtagtgctagagcacgggtcctgcgtgaccaccatggccaagaataagcctaccctggacatcgaactcctgaagactgaagtaaccaatcccgcggtcctgcggaaactgtgcatcgaggccaaaattagcaacaccaccacggattcgagatgcccgacccagggcgaggccacactggtggaggagcaggatgctaactttgtatgtcggcgcaccttcgtggaccggggctggggaaatggctgcgggctgttcgggaaagggagcctcctaacgtgtgcgaagtttaaatgcgtgaccaagctcgaggggaagattgtccagtacgagaatctaaagtactccgtgatcgtgaccgtccataccggcgaccagcaccaggttggtaacgagacgaccgagcacggcaccatcgccaccatcacaccccaggcccccacgagcgaaatacaattaaccgactacggagccctgaccctcgattgtagcccccggactggcctcgatttcaacgagatggtgctgctcacgatgaaggaaaagagctggctggtgcacaagcagtggtttttggacctcccgttgccatggacgtccggggcatccaccagccaggagacctggaacaggcaagaccttcttgtaacgttcaaaaccgcccacgcgaagaagcaagaggtagtggtgctgggcagccaagagggcgctatgcacaccgctctgaccggggccactgagatccagacaagcggcaccaccacgatcttcgccggacacctcaagtgccgccttaagatggacaagctgaccttaaagggtatgtcctatgtcatgtgtaccgggagcttcaagctggagaaagaggtagcagagacccagcacggcacggtcttggtccaggtgaaatacgagggcacagacgcgccctgcaaaatccctttctccacccaggacgaaaagggagtgacccagaacggccgcctaattacggccaatccgatcgtcaccgacaaggagaagcccgttaacatagagacggaaccaccattcggcgagagctacatcgtggtgggcgccggcgagaaggcgttaaagctgtcctggttcaagcgcgggtcttccatcggcaagatgttcgaggcaaccgcccgcggcgcccggcgcatggccatcctaggcgatactgcgtgggatttcggtagcattggtggcgtgttcacaagtgtgggcaaacttgtacaccaggtgttcggcaccgcctacggggtgctgttcagcggagtgtcgtggaccatgaagattgggatcggcatcctgttgacttggttaggcctgaactcccgcagtacctctctctctatgacatgcattgccgtcgggatggtgacactgtacctgggcgtcatggtgcaagccgacagcggatgcgtgatcaactggaaggggcgcgagctcaaatgcgggtccggcatctttgtcacgaatgaggtacacacttggacggagcagtataagttccaggctgacagcccgaagcggctttccgcggccatcggcaaggcgtgggaagagggggtgtgtggcatccgatccgcgacccggctggagaatataatgtggaaacaaatcagcaacgagcttaaccacatcctgctggagaatgacatgaagttcaccgtcgtggttggggatgcgaacggtattctagcgcaggggaagaagatgatccgtccccagcctatggagcacaagtactcctggaagtcctggggcaaggccaaaataatcggagccgacatccagaacacgacctttatcatcgatgggcctgataccccggagtgcccagatggccaaagagcctggaacatctgggaggtagaggattatggctttggcgtgttcactaccaacatctggttgaagctccgcgactcttacacccagatgtgcgaccaccgtctcatgagcgcggccattaaggactccaaggccgtgcacgccgacatgggatactggatcgaatcggagaagaacgagacttggaaactggcgcgcgctagtttcatcgaggtcaaaacctgcacctggcccaaatctcacacgttatggtccaacggagtgctcgagtcagaaatgataatccccaagatctacggaggcccgatctcccaacacaactacagaccgggttattttacgcagacagccgggccctggcacctgggtaagctggaactcgacttcgacctctgtgaaggtacgaccgtggttgtggacgagcactgcgggaatagaggacctagtctgcggacgaccacggtgacggggaagatcatccatgagtggtgttgtaggtcctgtacattgccgcctctgaggttccgcggcgaggacgggtgttggtacggcatggagatcaggcccgtgaaagaaaaggaagagaacctagttcgcagcatggtgtccgcgggcagcggcgaggtggatagcttttccctggggatcctatgcgtgtcaatcatgatagaggaggtgatgcggtcccgctggtcgcgaaagatgctgatgaccggcactctagccgtatttctgctgctcatcatgggccagctaacctggaacgacctaatccggctctgcatcatggtgggcgccaacgcgtcagatcggatgggcatgggcacaacctatctggctctgatggccactttcaagatgcggcccatgttcgcagtgggcctcctgttccgccggctgaccagccgtgaggtcctcctgctgaccattgggctctccctcgtggcaagcgtcgagctgcccaactctctcgaggaactgggggacggcctggcgatgggcataatgatgctgaagctgctgaccgagttccagccccaccaactctggacgaccctgctgtcgttgacctttgtaaaaacgacgctttccctggactatgcatggaagaccacggccatggtgctcagcatcgtctccctgttccccctgtgcttaagtaccacgtcccaaaagacaacttggctgccggtcctgctcgggagcttcggctgcaagcccttgaccatgttcctcattaccgaaaacaagatctggggccggaagtcctggcccctgaacgagggcatcatggcgataggtattgtatcgatcctgctatcaagcctgctgaaaaacgatgtccccctggctggaccactcatcgccggagggatgttaattgcctgctacgtaatcagcggctccagcgccgacctgtccctcgagaaggccgtgaagatttcttgggagcaggaggcggagcattccggcgccagccacaatatcctggtcgaggtgcaggacgacggcacaatgaaaatcaaggacgaagagagagacgacaccctcacgattctcctaaaagccaccctgctagccgtgtccggagtataccccatgagcataccagcgacactgttcgtctggtatttctggcaaaagaagaagcagcgctctggcgttctctgggacacccccagccctcctgaggtcgaacgcgcggtgctcgatgacgggatctaccgcatcttacagcgcgggttattaggccggtcccaggtgggggtcggagttttccaggacggagttttccacaccatgtggcacgtaacgcgcggtgccgtgctgatgtaccagggcaaacggctggagcccagctgggcgtcggtcaaaaaggatctgatttcatacgggggcgggtggcgcttccaaggctcctggaacacaggcgaggaagtccaggttatagccgtagagcccggcaagaacccgaagaacgtccagaccacccccgggacctttaagacacccgagggggaagtgggcgcaatcgcgctagacttcaagcccgggacctcaggatccccgatcgtgaaccgggaaggcaagatcgtcgggctgtacgggaacggagttgtgacgaccagcggtacatacgtcagcgccattgcccaagccaaagcatctcaggagggtcccctaccggagatcgaggacgaggttttcaagaagcggaaccttaccatcatggacctacaccctggtagcggcaagacccggcgctacctccccgcgattgtgcgggaggccatcaagagaaaactacgcaccctgatcttagccccaactcgagtagtggcttccgagatggccgaggctttaaaggggatgcccatccgctaccagaccaccgccgtcaaaagtgaacataccggtagggaaatcgtcgacctaatgtgccatgccaccttcaccatgaggctgctctccccggtgcgagttcccaactacaatatgattatcatggacgaggcccactttaccgaccccgcgagcatcgccgcccgcgggtacatctccacccgggtcggtatgggggaggccgccgctatcttcatgaccgccacaccacccggatcagtggaggcatttccgcaatcaaacgcagttatacaagatgaggagcgcgacatccctgagaggagctggaactctggttacgattggataacggactttcccggaaagaccgtctggttcgtgccctccatcaaaagtggaaacgacatagccaattgtctgcgcaagaacgggaagcgcgtgattcagctgagtcgcaagacgttcgataccgaataccagaagaccaagaacaatgactgggattacgtcgttaccacggacatcagcgagatgggggcgaacttccgggccgaccgtgtgatcgatccccggcgatgcctcaagcccgtaatcctgaaggacgggcccgagcgggtgatcctggctggtcccatgcccgttacagtcgccagcgcggcccagcgccgaggccgcatagggcgcaaccagaacaaggagggggaccagtacgtgtacatggggcagcctctaaataatgacgaggatcacgcccactggaccgaggcgaagatgctgctagacaacattaacacccccgagggcataatacctgccctcttcgaacccgagcgggaaaagagcgcggccattgacggggagtacaggctgcggggagaggctagaaagacgttcgtcgaattgatgcgtcgcggcgacctcccggtgtggttaagctataaagtggcctccgaagggttccagtacagtgatcggcgctggtgcttcgacggtgagcgtaacaatcaagtcctcgaggaaaacatggatgtggagatatggacgaaggagggggaacgcaaaaagctgcggccccgctggctggacgcccggacgtactccgatccgctggcgctccgcgagttcaaggagttcgcagccggccgccgcagcgtaagcggggacctgatcctggagatcggcaagctcccgcagcatctgaccttacgggcacagaacgccctcgacaacctcgtcatgttacacaattccgaacagggcggaaaggcgtaccgacatgccatggaggagctccccgacaccattgagacgctgatgctgttagccctaattgccgtcctgaccggaggggtaacactgttcttcctgagcggcaagggcttagggaagacctccataggtctactgtgtgtcactgctagctcagccctgttatggatggctagcgtggagccccattggattgccgctagcattatcctggagttcttcctgatggtcctactgatcccagagcccgatcggcagcgcacgcctcaggacaaccagctggcgtacgttgtcatcggcctcctcttcatgatcttaaccgtggccgccaacgaaatgggtctcttagagaccacaaagaaggatttggggataggctacgttgccgcagaaaaccaccagcacgcgaccatgctcgacgtagatctacacccggctagcgcctggaccctgtacgctgtggccaccaccgtcatcacccccatgatgcgacacacaatcgagaacaccacggcgaatatcagtctcaccgccatcgccaaccaggccgctatactgatgggcttagacaaggggtggcctatcagcaagatggacatcggcgttcccttattggcgttaggatgctactcccaggtgaacccgctcacccttaccgcggctgtcctcatgctcgtggcccactacgcgataatcggcccaggtctgcaggctaaggcaacgcgagaggcccagaagagaactgccgcgggcatcatgaaaaaccccactgtggacggcatcgtagccatcgacctggaccccgtcgtgtatgacgccaagtttgagaagcagctcgggcagatcatgttactgatcctatgcaccagccagattctgctgatgcgtacgacctgggcactgtgcgagtccatcacattggccaccggaccgctaactactctatgggaggggtcgcccggcaagttctggaacaccactatagcggtcagtatggccaacatcttccgcggctcttacctggccggggccggcctggccttctccctcatgaagtccctcgggggaggaaggcgcggtacgggcgcgcagggtgagaccctaggcgaaaagtggaaacggcagctcaaccagctttccaagagcgagtttaacacctataagcgcagcgggatcatggaagtggatcgatctgaggccaaggaaggcctgaagcgcggcgagaccactaaacacgccgtgtcccggggcacagcaaaactccgttggttcgtggaacgcaacttagttaagcccgagggcaaagtgatcgatctggggtgcggccgcggaggctggtcctactactgcgcggggctcaagaaagtcaccgaagtgaagggctacaccaaaggaggccccggtcatgaggaaccgattccgatggctacctacgggtggaacctcgtgaaactgcactccggcaaggacgtcttcttcatgccgcccgagaagtgcgacacgctgctttgcgatattggggagtccagtcccaaccccacgatcgaggaaggccggaccctgcgcgtgctgaaaatggtagaaccctggctccggggcaaccagttctgcataaagatcctgaacccctatatgccgtccgtcgtggagactctggagcaaatgcagcgcaagcacgggggaatgttagtcagaaaccccctgagccgcaattccacgcatgagatgtattgggtcagctgcgggaccggcaacatagtgtctgccgtaaatatgaccagcagaatgctgctcaatagattcaccatggcacatcgcaagcccacgtatgaacgtgacgtggacttgggcgccggaacccgccatgtggcggtggagccggaagtcgctaacctggatatcatcggccaacggatcgagaacatcaagaatgagcacaagtccacctggcactacgacgaagacaatccgtataaaacttgggcgtaccacgggtcttatgaggtgaagccctccggcagcgcttcgagtatggtgaacggggtggttcgcctcttgaccaagccatgggacgtcattcctatggtcacccaaatagccatgacagataccacacccttcggccaacaacgagtattcaaagaaaaagtcgacacccgcactccccgtgccaagcgtggcaccacgcagatcatggaggtgacggccaagtggctgtggggtttcctctcccgaaacaagaagccccgcatttgcacccgcgaggagttcacccggaaggtgcgttccaacgccgccatcggagccgtattcgtggacgagaaccagtggaacagcgctaaggaggccgttgaggatgagcgtttttgggacctggtccatcgggagagagaacttcacaagcaagggaagtgtgccacgtgcgtatacaacatgatgggtaagcgggaaaagaagctcggagagttcggcaaggccaagggttccagagcgatctggtacatgtggctgggggctcggtttctggagttcgaggccctcggattcatgaatgaagaccactggttcagccgcgagaactcactgagcggggtagagggcgaaggattacataagctcggctacatcctgcgtgacatctctaaaattccgggcgggaacatgtacgccgacgacaccgccggctgggacacaagaatcactgaggatgacctgcaaaacgaggccaagatcacagacataatggaaccagagcacgccctcctggcaacctctattttcaagctgacctaccagaacaaggtcgtgcgtgtacagaggccggctaagaacgggaccgtaatggacgtgatctccagacgggatcagcgcggcagcggccaggttgggacgtacggtctcaacacctttaccaatatggaggttcaactgatcagacagatggagtccgaggggatcttcctgcccagcgagctcgagacccccaatctggcagagcgcgctcttgactggctagagaagcacggcgccgagcgtctgaagcgcatggccatcagcggtgacgactgtgtcgtcaagccaatcgacgacagatttgccaccgccctcaccgcgctcaatgatatggggaaggttagaaaggacattcctcaatgggagccctctaagggctggaacgactggcagcaggtccctttttgttcccatcatttccaccagctgataatgaaggacgggcgcgagatcgtggtcccctgccggaatcaggacgagctggtgggccgggctcgcgttagccagggcgccggctggtccctccgggaaaccgcctgcctgggtaaaagctatgctcagatgtggcagctgatgtatttccaccggcgggacctaaggctggcggccaacgccatctgctccgcggtccccgtggattgggtgccaaccagccgaacaacgtggagcatccacgcgcaccaccagtggatgacaaccgaggacatgctgtcagtctggaacagggtgtggattgaggagaatccgtggatggaggacaaaacccacgtgagctcctgggaggaggtcccttacttggggaagcgagaggatcagtggtgcggcagcctgattgggctgacagcccgggcgacctgggctaccaacatccaggtggccatcaaccaagtgcgccggctcatcggcaatgaaaactacttagactacatgacctccatgaagcgctttaagaacgagagcgacccggaaggtgcactgtggtga

SEQ ID NO: 24060 - RNA, 9879 nt, synthetic construct
  misc_feature 1..9879: note = derived and/or modified CDS sequence (opt11) from DENV-1__FJ850099__SS-prME
  source 1..9879: mol_type = other RNA
tcagtaactatgctactcatgctcctgcctacggccttagcgttccacctgactacacgaggtggagaaccccacatgatagtctccaagcaagaacgcgggaaaagcctcctattcaaaacatcagcaggagtaaacatgtgtaccttaattgccatggacctaggtgaactctgcgaagatactatgacatacaaatgtcctagaataaccgaagccgaacccgatgacgtagactgctggtgtaatgccaccgacacttgggtgacatacgggacatgcagtcagacgggggaacaccgacgggacaaacgctctgttgccctcgcgcctcatgtcggactagggttggaaacgcgaactgaaacatggatgtcatctgaaggtgcatggaagcagatccaacgagtagaaacttgggcactgagacaccccggatttacggttatagcactatttctcgcacacgccattggcacgagcattacgcagaaggggataatcttcatacttctgatgcttgtcacgccatctatggccatgcgctgcgttggaataggtaatagagacttcgtcgaagggctctcgggagccacttgggtagacgtcgtactcgaacacggaagctgcgtgactaccatggccaaaaacaagcccactctagacatcgaactcctgaagacggaagttactaaccccgcagtcctccgcaaactatgcatcgaagcgaagataagtaacacaacgacggacagtcgctgtccaactcagggagaagcaacccttgtggaagaacaagacgctaacttcgtatgcagacgaacattcgtcgacaggggatggggaaacgggtgcggattatttgggaaaggaagcctcctaacctgtgcgaagttcaaatgcgtcaccaagctagaaggaaaaatcgtccaatacgaaaacctaaaatatagcgtcatagtcaccgtacacacaggcgaccaacaccaagtcggcaacgaaaccaccgagcacggtaccatagcgaccataactccccaagcaccgaccagcgaaatacagcttaccgactacggcgcactgaccctcgactgctctccacgcaccggcctcgacttcaacgaaatggtactcctgaccatgaaagagaaaagctggctggtacacaaacaatggttcctagaccttccgctaccctggacaagcggtgcctcgacctcacaggagacatggaatcgccaagacctcctagtgacctttaagactgcacacgccaaaaagcaggaagtggttgttctaggaagccaggagggagccatgcacaccgctctaacgggcgcaaccgaaatccagacaagtggcactacaacaatattcgcagggcacttaaagtgcagactcaaaatggacaaactcaccctcaaaggaatgagttacgttatgtgcaccggatccttcaaactcgagaaggaagtcgcggagacccaacacggcacagtgctggtacaggtaaaatacgaaggtacggatgctccctgtaaaatacccttctcaacccaagacgaaaaaggggtgacacaaaacgggcggctgatcaccgcaaaccccatagtaacggacaaagaaaaacctgtaaatattgagacggaaccacccttcggagaaagttacatagtagtgggtgcgggggaaaaggcacttaagttatcgtggttcaaaaaggggagtagcatcggaaaaatgttcgaagccacggcacgaggggcgaggagaatggccatattaggtgataccgcatgggactttggctcgatcggtggagttttcacgagcgtgggaaaactggtacatcaagtgttcggcacagcatacggggtactattctccggggtcagctggacaatgaagatcggaattggtatactactaacatggttgggcctcaatagccggagcacaagcctctcaatgacgtgcatagccgtggggatggtaacactctacctgggcgtaatggtgcaagcggacagcggatgtgtcatcaattggaagggacgggagctcaagtgtggaagtggcatattcgtgaccaacgaagtacacacgtggacagaacagtacaaattccaagccgactcgcctaagcgattaagtgcagcgataggcaaagcatgggaagaaggcgtatgcggaatacggagcgcgacaaggttggaaaacataatgtggaagcagatctcaaatgagctcaaccacatcctacttgaaaatgacatgaaattcacggtagtggttggagatgcaaacggcatcctcgcccaaggcaagaaaatgatccgacctcaaccaatggagcacaaatattcatggaaaagttggggcaaagcgaagataataggagcagacatccaaaacacgacattcattatagacgggccggatactccggaatgcccggacgggcaacgcgcatggaacatctgggaggtagaagactacggctttggaatcttcaccaccaacatctggcttaaactgagggactcttacacgcaaatgtgcgaccacaggctaatgtcagccgcgattaaggatagcaaagccgtccacgccgatatgggatactggatcgaatccgagaaaaatgaaacttggaagctcgcaagagcgagcttcatcgaggtaaagacttgcacgtggccgaagtctcacaccctatggtcaaacggcgtactcgaaagcgagatgataataccaaagatttacgggggtcccataagccaacacaactaccgaccggggtactttacacaaacggccggcccctggcacctcggaaaattggagctcgacttcgacttatgtgaggggacaaccgtggtagtagatgaacactgcggtaatcgtggtccaagcctgcggacaacaacagtaaccggcaaaatcattcacgagtggtgctgcaggagttgcacgttaccgcccctccgcttccgcggagaagatgggtgctggtatgggatggagatacggcctgtcaaagaaaaagaagagaacctagtccggagcatggtatcagcaggcagcggagaagtagactcatttagcttagggattctctgcgtgagcataatgatcgaagaagttatgaggagccggtggagcagaaagatgttgatgacagggaccctagccgtgttcctacttctgattatgggccaactcacatggaatgacctcattcgtctctgcataatggtcggcgccaatgcatcggacaggatgggcatggggacaacatatctggccctaatggcgaccttcaagatgaggcccatgttcgcagtaggattgctgttcaggaggttaaccagcagggaagtcctactcctaacaatcggcttatccttagtagccagtgtagaactgcctaacagcctagaggaactaggagacggccttgcaatgggaataatgatgctaaaacttctcacagagttccaaccccatcagctctggacgaccctcctaagcctaaccttcgtgaaaacaactctaagtctagactacgcgtggaagacaacggcgatggtattaagcatagtcagcctatttcccttatgcctgtcaactaccagtcagaaaaccacctggcttcccgtcctactaggatcattcgggtgcaagcccctgacgatgttcctcataacagagaacaagatatgggggaggaagtcttggcctcttaacgaaggaatcatggccataggcatcgtaagcatactgctgtccagtctactgaaaaatgacgtacccctcgccggtcccctcatagcgggaggcatgctcatcgcctgctatgtgataagcgggagcagcgcggacttgtcgctagagaaggccgctgaagtgagctgggagcaagaagcggagcattcaggagcgtctcacaacatcctcgtagaggtccaagacgacggaactatgaaaataaaagacgaagaacgggacgacacgctcaccatactcctgaaggccacactactggctgtaagcggtgtataccccatgagcataccagctaccctgtttgtgtggtacttctggcagaagaagaaacagcgtagcggtgtcttgtgggacacgcccagcccaccggaagttgaaagagccgtcctagacgacggaatctaccgcatcctccaacgaggcctactagggagaagccaagtcggagtaggcgtcttccaggacggcgtattccacaccatgtggcacgtcaccagaggggccgtactgatgtaccaagggaagcggctagagccatcgtgggccagcgtcaagaaagatctgataagctatggcggcggctggcgctttcaggggtcatggaacacaggagaggaagtgcaagtaatagccgtcgaacccggcaaaaatcccaaaaatgtccagacaacaccggggaccttcaagacaccggaaggagaggtcggagcaatcgccctagactttaagccgggcacctcagggagccccatagtaaaccgagaagggaagatagtcggcctttacggcaacggagttgtaaccaccagtggaacgtacgtcagtgccatcgcccaggcaaaagcctcgcaggaagggcctctgcctgaaattgaggacgaggtattcaaaaagaggaacctcacgataatggacctgcacccaggatccggaaagacgcgccgctaccttcccgcaattgtacgcgaagctatcaagcggaaattacgcaccctcatacttgcgccaacacgggtggtggcaagcgaaatggccgaagccttaaagggaatgccaatacgataccaaaccaccgcggtcaaatcggaacacaccggacgggaaattgttgatctaatgtgtcatgcaaccttcacaatgcgattactatcaccagtacgagtccccaactataacatgattatcatggacgaagcgcattttactgaccccgcatctatagccgcacggggatacatttcgactcgggttgggatgggggaagcggcggccatattcatgacggcaacgccacccggctccgtggaagcattcccgcagagcaacgcggtaatccaggacgaggagagagacatcccagaaagatcctggaactcaggctacgactggattacggacttcccagggaaaacggtatggtttgtcccgtcgataaaaagcgggaacgacattgccaattgcctcaggaaaaacggtaaacgagtaatacaactatcccgaaagaccttcgacacggaataccagaaaaccaaaaacaatgactgggactacgttgtcacgaccgatatctcagaaatgggcgcaaacttcagagcagacagagtcatagaccccagacggtgcttgaaaccagtgatattaaaagacgggcccgagagagtaatccttgcaggaccaatgcctgtgacagtagcaagcgcggcccagagaagaggacggattggaaggaatcaaaacaaagaaggcgaccaatacgtctatatgggacaaccgctaaacaacgacgaggatcacgcacactggacagaggcaaaaatgctgctggacaacataaacacccccgaaggtatcatacctgctctattcgaaccggaaagggagaaaagcgctgcgatagatggcgagtataggttaaggggagaggctagaaagacattcgtcgagttgatgcgaaggggagacttaccagtatggctatcatacaaggtggcatcagaaggttttcaatatagcgacaggagatggtgcttcgacggggaacgcaacaaccaagttctcgaggagaacatggacgtagagatctggaccaaggagggagagagaaagaaactccggcctcgatggctggacgccagaacgtactcagacccactagccctcagagaatttaaggagtttgccgcggggcgtagaagcgtctcaggagacctcatactcgaaataggcaagctgccccaacacctcacactcagggcacagaacgcgctagacaacctggtcatgctgcacaactcggaacaaggagggaaggcctaccgacacgccatggaggaactcccggacacgattgaaacactgatgctgctagccctaatcgcagtgctcacgggaggtgtaacactcttctttttaagcgggaagggtctggggaaaacatcaataggcctactatgcgtgactgcgtcctcagccctgctgtggatggcatctgtcgagcctcactggatcgctgcctcaataatcctcgagttcttcctgatggtgctgttaataccggagccagaccggcaacgcaccccacaagataaccagctagcatacgtcgtcatcggattactattcatgatactcaccgtagcagcaaacgaaatggggctactagaaaccacgaagaaagacctagggataggatatgtagcggcggagaaccatcaacatgcaacgatgctcgacgtggacctgcgcccggcaagtgcgtggacgctctatgcagtggccacaacagtaatcaccccaatgatgcgacacaccatcgagaacacgaccgccaatattagcctcaccgcaatagcgaatcaagcggcaatactcatgggactcgataaagggtggccgatctcaaaaatggacattggcgtgcctctgctagcccttgggtgttactctcaagtgaatccactaaccctgacagccgccgtcctgatgctagtcgcacattatgcgattatcggacctggtcttcaagccaaagccacgcgggaggcgcagaagcggacagctgcaggaataatgaaaaacccaacagtcgacgggatcgttgcgatagacttggaccccgtagtctatgatgcaaaattcgagaagcagctgggccaaatcatgctcctgatcttatgtacatcccagatactgcttatgcgaacaacttgggcactgtgtgagagcatcaccctcgcgacgggaccgctaaccacactgtgggaaggctccccaggtaaattttggaacacaacgatcgcagtcagcatggccaacatattccgtggaagttaccttgcgggcgccgggctcgcgttctcactgatgaaaagcctcggtggcggtcgacgtggcactggggcacagggagaaactctcggcgagaagtggaaacgacagctaaatcaactcagcaaatcggagttcaacacatataagcgatccggcatcatggaagtagatcgttccgaagcaaaggaaggcctgaagagaggggaaaccaccaagcacgcggtctccagaggaaccgcaaagctgaggtggttcgtcgaacgaaacctcgtcaaacccgaggggaaagtgatagacctgggatgcggacgcggtgggtggagctactattgcgcgggcctcaagaaagttactgaggtcaagggctacacgaaaggcggcccaggtcacgaggaaccgattccaatggcaacgtacggttggaaccttgtgaagctccacagcggcaaagacgtgttctttatgccacccgagaaatgcgatacacttctatgcgatataggagagagctcccccaacccaaccattgaagaaggccgcaccctacgcgtgctcaaaatggtagaaccgtggcttaagggaaatcaattctgcataaagatactcaatccatacatgccgagcgtcgttgaaaccctagagcaaatgcagcgcaaacatggagggatgttggtccgaaacccgctaagccgaaacagcacccacgagatgtattgggtatcctgcggaacaggtaacatagtgtccgcagtcaacatgacatccaggatgctcttgaaccgctttacgatggcccaccgcaaacccacctatgagcgagacgtagatctcggagccggcacccgccacgtcgcagtggaacccgaagtagcaaacctggacattatagggcaacgaatcgaaaacatcaaaaacgaacacaaaagtacctggcattatgacgaggataacccgtacaaaacttgggcataccatggatcatacgaagtaaagccgagcggaagcgcatcgtcaatggtaaacggagtggtccgcctactaaccaagccgtgggacgtcataccgatggtgacccaaatagcaatgacagacacaacgccatttggccaacagagagtgttcaaagaaaaagtcgatacccgcacaccgcgagccaagagaggcacgacacaaataatggaagtaaccgcgaaatggctatggggattcctatcaaggaacaagaagccgcggatttgcacacgagaagagttcacacgaaaagtgcgctccaacgcagccataggagcagtcttcgtagatgagaaccaatggaactcagcgaaagaggcagttgaagatgagcggttctgggacctggtacaccgcgagcgagagctgcataaacagggcaaatgcgcaacgtgcgtctacaacatgatgggcaaaagggaaaagaagttaggagagttcggaaaagcgaaggggagtagagcaatatggtacatgtggctcggcgcccgattcctggagttcgaagcgctaggatttatgaatgaagatcattggttcagccgagaaaactctttgagcggtgtcgagggtgaaggactccacaaattggggtatatattgcgagacattagtaaaatcccgggagggaacatgtacgcagacgacaccgctgggtgggacacccggataacagaagatgacttacaaaacgaagccaagataacggacataatggagcctgagcacgcgttactcgcgacctctatcttcaagttgacttatcaaaataaagtagtaagagtgcaacggccggccaaaaacggaacagtcatggacgtaataagccgaagagaccagcgcggatcgggacaggtaggaacgtacggtcttaataccttcactaatatggaagtacaactaatacgccagatggaatcggaggggatcttcctgagcagcgagctcgagacccctaacctggcagagcgggtcctggattggctagagaagcacggcgcagaacggctcaagcggatggcgataagtggggacgattgcgtcgttaaaccgatagacgaccgattcgcgaccgcgctaaccgcgctcaacgacatgggaaaagtccgcaaggacatcccacaatgggagccaagcaaaggatggaatgactggcaacaggtcccgttctgctcacaccacttccaccagctaataatgaaagacgggcgcgaaatcgtcgtaccttgcagaaatcaggacgagctagtcggtcgcgcccgcgtaagccagggtgcagggtggtctctgagagagacggcatgcctaggaaagagctacgcacaaatgtggcagctcatgtatttccaccgccgcgatttacgcctggccgcgaacgccatatgcagtgccgtccccgtcgattgggtcccaacgagcagaacaacctggagcattcacgcacatcaccaatggatgacaacagaagacatgctttccgtttggaaccgggtctggattgaggaaaacccttggatggaagataaaacgcatgtaagctcgtgggaagaagttccttacctggggaagcgggaggaccaatggtgcgggagcctcatagggctcacagccagagcaacatgggcaacgaacattcaagtcgccataaaccaagtgagaagactgataggaaacgaaaactacctggactacatgacctcaatgaaaaggttcaaaaacgagtcggaccccgagggggctttatggtga

SEQ ID NO: 24061 - RNA, 9879 nt, synthetic construct
  misc_feature 1..9879: note = derived and/or modified CDS sequence (opt11) from DENV-1__FJ850100__SS-prME
  source 1..9879: mol_type = other RNA
agcgtgacaatgctgctgatgctacttcccactgcgctcgccttccacctgacaacccgcggcggtgagccacacatgatcgtaagcaagcaggagcgggggaagagcctgctgttcaaaaccagcgccggggtgaatatgtgtaccctaatcgccatggacctgggagagttatgcgaggacaccatgacctacaagtgtccccgcatcaccgaggccgagcccgatgacgtggactgctggtgtaacgctaccgacacctgggtgacctacggtacctgcagccagacaggcgagcatagacgcgacaagcgctcagtggcactggcgccccacgtcggcctagggcttgagacccgcaccgagacatggatgagctccgaaggcgcctggaagcagatccagcgggttgagacgtgggcacttcgccatcccggtttcacagtaatcgcactgtttctcgcgcacgcgatcggcaccagcatcacccaaaaagggatcatcttcatcctactgatgttagtgaccccgtccatggcgatgcgatgcgtcggcatcggcaaccgcgactttgtggaaggactgtcaggcgccacgtgggtggatgtcgttctggaacacggctcctgcgtcaccaccatggcgaagaacaagcccaccctcgacatcgagctgctgaagactgaggtaaccaacccagcggtgctcaggaagctgtgcattgaggctaagatcagcaacaccaccacagactcacgatgcccgacccagggcgaggctaccctggttgaggagcaagacgcgaacttcgtatgtcgccgcaccttcgtggacaggggctgggggaatggctgcgggttgttcggcaaggggagcctgctgacgtgcgccaagtttaagtgcgttacgaagctggaggggaaaatagtccagtatgagaatctgaagtactcggtgatcgttacagtccacaccggtgaccagcaccaagtcggcaatgagacgaccgagcatggaactatcgctaccataacgccccaggcccccactagcgagatccagctcaccgactacggggcgctcaccttggactgcagccctcgcacaggcctggactttaacgagatggtgctcctcacaatgaaggagaagagttggctggtccacaagcagtggttcctcgacctgccgttaccctggacttcgggggcgagcaccagccaggagacctggaacagacaagatctccttgtgacgttcaagaccgcccacgcaaaaaagcaggaagtcgtggtgctgggctcccaggagggcgccatgcatacagccctcactggagcgactgagatccagaccagcggcaccaccacgatcttcgccggacatctgaaatgtcgcctgaagatggataaactcaccctgaagggcatgtcctacgtcatgtgcaccgggtcattcaagttagaaaaggaggtagcggaaacccagcacggcacagtgctggtgcaagtaaagtacgagggtaccgacgccccctgcaagatccctttctccacccaggacgaaaagggcgttacccagaacggccggctcatcacggccaacccgatcgtcaccgacaaggaaaagcccgtgaacatagaaaccgagcctccctttggggaaagttacatcgtggtcggcgcgggagagaaggctctgaaactgtcctggttcaagaaggggagctctataggtaagatgttcgaggccaccgcccgcggggcgcggagaatggccattctcggcgacacggcttgggacttcggcagcatcggcggtgttttcacgtccgtagggaagctggtccaccaggtgttcgggaccgcatatggggtgctgttcagcggcgtctcgtggaccatgaagatcggaatcggaatcttgctgacgtggctgggactgaacagccgctccaccagtctgtctatgacctgcatcgccgtggggatggtgaccctctatctcggggttatggttcaagccgacagcgggtgtgtaatcaactggaagggccgggagcttaagtgcggcagtggcatcttcgtcacgaatgaggtgcacacgtggaccgaacaatacaagttccaagctgacagtccgaagcgactcagcgcggcgatcggcaaggcctgggaggagggggtgtgcggcatcagatccgccacacgtctcgagaacatcatgtggaagcagatcagcaatgagctgaatcacatactgcttgagaacgacatgaagttcacagtggtggtgggggatgcgaacggcatcctggcgcaggggaagaagatgatccgcccacagcccatggagcacaagtactcatggaagtcctggggcaaggccaagatcatcggcgccgacatccaaaacacgaccttcataatcgacgggcccgacaccccggagtgtccagatggccagcgcgcctggaacatctgggaagtcgaagattacgggttcggcatattcaccacgaatatttggctaaaactccgggactcttacactcaaatgtgcgaccatcgcctgatgagcgcggccatcaaggactccaaagccgtgcacgcggacatgggctactggatcgaaagcgagaagaacgaaacctggaagctggcccgggccagtttcatcgaggtgaagacctgcacgtggcccaagagccacaccctctggtccaatggggtcctggaatcagagatgattatacccaagatctacggcgggccgatcagccagcacaattaccgccccggatacttcacacaaaccgccgggccctggcacttgggcaagctcgagttagacttcgacctgtgcgagggcacgacggtggtggtcgacgagcactgtggtaacagaggccccagcctcaggaccacgacggtgaccgggaagataattcacgagtggtgttgccggtcctgcacgctgccgccactgcgattccggggtgaggacgggtgctggtacggcatggagatcagacccgtgaaggagaaagaggagaacctcgtacggagcatggtgtccgcgggcagcggggaggtggacagcttctccctgggcatcttgtgcgttagcataatgatcgaggaagtaatgcgctccaggtggtcccgtaagatgctcatgacaggcacgctggccgtgttccttttactgatcatgggccagctgacctggaacgacctcattcgtctgtgcatcatggtcggtgccaacgcatccgaccgaatgggcatgggcaccacccacctggccctcatggccaccttcaagatgcggcctatgtttgccgtgggtctgctgtttcggcgccttaccagccgcgaggtcctgctgcttaccatcggcttaagcctaatggccagcatggagctgcccaactcccttgaggagctgggggacggcctcgccatgggcatcatgatgttgaagctacttaccgagtttcagccccatcaactgtggactaccctactcagcttgaccttcgtcaagaccacgctgtccttggactacgcctggaagaccactgccatgatcctgagcatcgtgtccctgttccccctctgcctgagcacaacgagtcaaaagaccacctggctgccggtcctcctggggtccttcggctgcaagccactgaccatgtttcttatcaccgaaaataagatctggggtcgcaagtcctggccgctcaacgagggcatcatggcgatcgggatcgtgagcatcctgctcagcagccttctcaagaacgacgtgcccctcgcgggtccgctgatcgccggcgggatgctcattgcctgctacgtcataagcggctccagcgccgatctctccctggagaaggcggcggaagtatcctgggagcaggaggccgagcactccggcgccagccacaatatcctcgtggaggtccaggacgacggtacgatgaagattaaggacgaggagagggacgacacactaaccatcctgctgaaggccactctcctggcggtgtcgggtgtgtaccccatgtcaatccccgcaacgcttttcgtctggtacttttggcagaagaagaagcagcgctccggtgtgctctgggacaccccctcgccgcccgaagtggaacgggccgtcctcgacgacgggatctaccgcatcctgcagcgaggactgttaggccgatcccaggtaggggtgggcgtcttccaggacggggtgttccacaccatgtggcatgtgacaaggggagcagtcctgatgtaccagggcaagaggctagaacccagctgggcctccgtgaagaaggacctcatcagttacgggggggggtggcgcttccaaggctcatggaacacgggggaggaggtgcaggtaatcgccgttgagccagggaagaacccaaagaacgtccagaccactcccggcaccttcaagacgcccgaaggtgaagtcggggcgattgcactcgacttcaagcccgggaccagcggctccccgatcgtgaaccgcgagggaaagatcgtgggactgtacggtaacggggttgtgaccacgagcggcacgtatgtgtccgccatcgcccaggccaaagcgagccaggagggtcccctccctgagatcgaggacgaagtcttcaagaagaggaacctcacgataatggacctgcacccgggtagcggcaagactcgcagatacctccccgccatcgtgcgggaggccatcaagcggaagctgcgcaccttaatcctcgccccgacgcgcgtcgtggcgtccgagatggccgaggccctgaaggggatgcccatccggtaccagaccaccgccgtcaaaagcgagcacaccggccgcgagatcgttgacctgatgtgccacgccacgttcaccatgcggttactgtccccggtacgcgtgcccaactacaacatgatcataatggacgaggcgcacttcacagaccccgccagcatcgccgctagggggtacatcagcacccgtgtggggatgggggaggccgcggccatcttcatgacggcaacgccgcccggcagcgtagaggccttcccccaatccaacgccgtgatccaggacgaagaacgtgacatcccggagcgcagctggaactccggctacgattggatcaccgacttcccggggaagaccgtgtggttcgtaccgagcatcaagtccggcaacgacatcgccaactgcctccgaaagaacggtaagcgcgtgatacaattgtcccggaagacgttcgacaccgagtaccaaaagaccaagaacaacgactgggactatgtagtcaccacggacatctccgaaatgggagcaaacttccgcgccgatcgggtgatcgatccgaggcggtgcctgaagcctgtgatcctaaaggatgggcccgaacgcgtaattctcgccgggcccatgcccgtgaccgtggccagcgcagcccagagacgcggccgtatcgggcgcaatcagaacaaggagggcgaccagtacgtttatatggggcagcccttaaacaacgacgaggaccacgcccactggacagaggcaaaaatgctgctcgacaacatcaacacccccgagggcattatcccggcgctgttcgagcccgagcgcgaaaagtccgcggccatcgatggggagtaccgtctgagaggcgaggcccgtaagacgtttgtggagttaatgcgccggggcgacctgcccgtctggctgagctacaaagtggcctccgaggggttccagtacagcgaccgcaggtggtgcttcgacggagaacgcaacaaccaagtgctcgaggagaacatggacgttgagatctggaccaaggagggggagcggaagaagctgcgccccagatggctagacgcgcgaacatactccgacccactcgccctgcgggagttcaaagagttcgccgccggccgccgctcagtgtcgggtgacctgatcctcgagattgggaaactgcctcaacatctgaccctccgcgcacagaatgcgctggacaacctggtcatgctccacaacagcgagcagggcgggaaggcataccggcacgccatggaggagttgcctgacaccatcgagaccctgatgttgctagccttgattgcggtcctcacaggcggagtgaccctgttcttcctgagcggcaagggactcgggaagacctccatcggccttctttgcgtgacggccagtagcaccctcctgtggatggcatcggtcgagcctcactggatcgccgcctccatcatcctggaattcttcctcatggtgctgctgatcccggaacccgaccgccagcggactcctcaggacaaccagctcgcgtacgtggtgatcggcctgctgttcatgatcctcaccgtggccgccaacgagatgggcttgctggagacgaccaagaaggacctcggaataggctacgtggccgcagagaaccatcaacacgcgactatgctggacgtcgacctgcgcccggcgagcgcctggaccttgtacgccgtcgccacgaccgtaatcacgcccatgatgcggcacacaatagagaacacgaccgcgaacatctccttgaccgcaatcgccaaccaggccgcgatcctgatgggattagacaagggttggccaataagcaaaatggacatcggcgtccccctgcttgcactcgggtgctactcacaggtgaacccgctgaccctgacggccgccgtgctcatgttagtcgcccactatgccatcatcggccccgggctgcaggccaaggccacgcgcgaggcccagaagcgcacagccgcgggcatcatgaaaaacccgaccgtggatggcatcgtggccatcgacctcgatcccgtcgtgtacgatgccaagttcgagaagcagctgggacagattatgctgctaatcctgtgcacgagccagatactgctcatgcggacgacctgggcgctgtgcgagtccatcaccctggccacggggccgcttaccaccctgtgggaagggagccctggcaagttctggaacacaacgatcgcggtgtccatggccaacatctttcgcgggagttacctggccggtgcgggcctagcattctctctgatgaagtctctcgggggtggccggcgaggcactggcgcgcagggagagacactcggcgagaagtggaagcggcaactcaaccaactgtccaaaagcgagtttaacacctataagcgcagtggaattatggaggtcgaccgctccgaggccaaggaggggctcaagcgcggggaaacgacaaaacatgccgtaagccggggcaccgcaaagctgcgctggttcgtagagagaaacctggtcaagcccgagggcaaggtgatcgacctggggtgcggccgcgggggctggtcctattactgcgcggggctcaagaaggtcaccgaggtgaagggctacactaagggcgggccgggacatgaggagccaatcccaatggccacgtatggatggaacctagtgaagctgcacagcggcaaagatgttttcttcatgccgcccgagaagtgcgacaccctgctgtgcgacataggtgagtccagcccgaaccccacgatcgaagagggccggaccctgcgagtccttaagatggtcgagccctggctgaagggcaaccagttctgcatcaaaatcctgaacccctacatgccgtctgtggtcgaaacgctcgagcagatgcagcggaaacacgggggcatgctggttcgaaaccccctgagccggaactccacacacgagatgtattgggtgtcgtgcggtaccggtaacattgtttcagccgtgaatatgacgagccgcatgctcctgaaccggtttacgatggcacatcggaagccgacctacgagcgcgacgtggacctgggggccgggacccggcacgtggcggtagagcccgaggtggccaacttagacattatcggccagcgcatcgagaatataaagaacgagcataagtccacctggcactacgacgaggacaatccatacaaaacgtgggcgtaccacggtagctacgaggttaagccctcgggcagcgcatcctcgatggtgaacggggtggtccggctgctgaccaaaccctgggatgtgatccccatggtcacgcaaatcgccatgaccgacacgaccccgtttggccagcagcgcgttttcaaggagaaggtggacacccggacgccgcgcgcgaagcggggcacgacccagatcatggaggttaccgccaagtggctctgggggttcctgtcgcgtaacaagaaaccccgaatctgcacccgcgaggagttcacacgtaaggtacgcagcaacgccgccataggcgccgtattcgttgacgagaatcagtggaacagcgcgaaggaagccgtggaggacgagcggttctgggatctagtgcaccgcgaacgggagctccacaagcaggggaagtgcgctacctgtgtctacaacatgatgggcaagcgcgagaagaagctgggcgagttcggcaaggcaaaaggctcccgagcgatatggtacatgtggctgggggcccgcttcctggagtttgaggccctgggattcatgaacgaggaccactggttcagcagagaaaacagtctgagcggcgtagagggcgagggtctccacaagctaggctacatcttacgagatatctccaagatccctggggggaacatgtacgccgacgacaccgcgggctgggatacacggatcacagaggatgacctgcagaacgaggcgaagatcaccgacatcatggaacccgaacatgccctgctggccacatcgatcttcaagctcacttaccagaacaaggtcgtccgcgttcagcgccccgccaagaatggaacggtgatggacgtgatcagccggcgcgaccagcggggcagtggacaggttgggacctatggtctgaacaccttcaccaacatggaggttcagctgatccgccaaatggagagtgaggggattttcctcccaagcgagctggagacgcccaacttagccgagcgtgtcctcgactggctggagaagcacggcgcggagcggctgaagcggatggcgatctcaggcgacgactgcgtggtgaagcccatcgacgaccggttcgcgacggctttaacagcactgaacgacatgggcaaggtccgtaaggacatcccccagtgggagccctcgaagggctggaacgactggcagcaagtcccgttctgttcccatcactttcaccaacttatcatgaaggacgggcgagagatcgtcgtcccgtgccggaaccaggacgagctcgtgggccgcgcgcgggtctcccagggggccggatggtccctaagagagaccgcctgtctgggcaagagctacgcccagatgtggcagctcatgtacttccaccggcgcgacctgcggctggccgccaacgccatctgctccgccgtgccagtggactgggtgccgacgtcacgcacgacctggagcatccacgcccatcaccaatggatgaccaccgaggatatgctctccgtatggaatcgggtgtggatcgaggagaacccgtggatggaggacaagacgcacgtgagctcctgggaggaggtaccctaccttggcaagcgcgaggaccagtggtgcggctctttgatcggattaactgcgcgcgcaacctgggctaccaacatccaggtggcaattaaccaggtccgccgcctcatcgggaacgagaactacctggactacatgactagcatgaagaggttcaagaacgagagcgaccctgagggggcgctctggtga

SEQ ID NO: 24062 - RNA, 9879 nt, synthetic construct
  misc_feature 1..9879: note = derived and/or modified CDS sequence (opt11) from DENV-1__FJ882579__SS-prME
  source 1..9879: mol_type = other RNA
agcgtgaccatgcttctcatgctgctgcccaccgccctcgccttccacctgaccaccagaggaggcgagccccacatgatcgtgtccaagcaggagcggggcaaaagcttgctgtttaagaccagcgccggggttaacatgtgcacgctgatcgccatggacctgggcgagctctgcgaggacaccatgacctacaagtgtccccgcattaccgaagcggagcccgatgacgtggactgctggtgtaatgccacggacacctgggtcacctacggcacgtgcagccagaccggcgagcaccggcgtgataagcggagcgtggcccttgcgccccacgtgggcctgggactcgaaacccgcaccgagacctggatgagcagtgagggcgcgtggaagcagattcaacgggtcgagacatgggccctgcgccacccagggtttacggtaatcgccttcttcctggcccacgccataggcacctcaatcacccagaaggggatcatcttcatcctcctgatgctggtgacaccctccatggccatgcggtgcgtcgggatcggcaaccgcgactttgtggagggcctttccggggcgacgtgggtggacgtagtgctggagcacgggtcctgcgttaccaccatggcaaaaaacaagcccacattggacatcgagcttctgaagacagaggtgaccaaccctgcggttctccggaaactttgtatcgaggccaagatcagcaacaccaccactgactcccgctgtccgacccagggcgaggccaccctggtggaggagcaggacgccaacttcgtctgtcggcgcaccttcgtggaccggggctgggggaacggctgcgggctgttcggcaagggcagcctcctgacgtgcgccaagtttaagtgcgtgaccaagctggagggcaagatcgtccagtacgagaacctcaaatactccgtgatcgtgaccgtccacaccggcgaccagcaccaggtgggtaacgagacgaccgagcacggcaccatcgcgaccataacgccacaggcccccaccagtgagattcagctgactgattacggggccttaaccctcgactgcagcccccgcaccggcctagacttcaacgaaatggtcttgttaacgatgaaggagaagtcctggcttgtgcacaagcagtggttcctggacctcccactgccctggacctcaggggccagcaccagccaggagacctggaaccgccaggacctgctcgtgacattcaagaccgcccacgccaaaaagcaggaggtggtggtactaggttcccaggaaggtgccatgcacaccgccttaacgggggccacggagatccaaaccagcggtacaaccacgatcttcgccggccacctcaagtgccgcctgaagatggataagctgactctcaagggcatgtcctacgtcatgtgtaccgggagcttcaagcttgagaaagaggtggcagagacccagcacggcacggtcctggtccaggtgaaatatgagggcaccgacgccccctgtaagatccccttctcaacgcaggacgagaagggggttacccagaacgggcggttaatcactgccaatccaatcgtcaccgacaaggagaagcccgtgaacatcgaaaccgagccgccattcggggagagctacatcgtggtcggcgccggggagaaggcgctcaagttatcatggtttaagaagggaagctccatcggaaagatgtttgaggccaccgcccgcggcgcccggcgcatggccatcctgggtgatacggcgtgggacttcgggagcatcgggggggtgtttacctccgtggggaagctcgtccaccaggtcttcggcaccgcttacggggtgctgtttagcggtgtgagctggaccatgaaaatcgggatcgggatcctgctcacgtggctgggcttaaattcgcgctccacctcactctctatgacctgcattgcggtggggatggtgacactgtacctgggcgtgatggtgcaggccgacagcgggtgcgtgatcaactggaagggccgggagctgaagtgtgggtctggcattttcgtcacgaatgaagtgcacacctggaccgagcagtacaaatttcaggccgacagcccaaagcgactgagcgccgccatagggaaggcctgggaagagggagtgtgcggcatccgttccgccacccgcctggagaacatcatgtggaagcagatcagcaatgagctaaaccacatactgctggagaacgacatgaagttcaccgtcgttgtcggggatgccaacggcatattaacgcaagggaagaagatgatccggccccagcccatggagcacaagtactcctggaagtcctggggtaaggcgaagatcattggtgccgacatccaaaataccacctttataatcgacgggcccgacaccccagaatgccccgacggccaacgcgcatggaacatctgggaggtcgaggactacggattcggaatcttcacaacaaacatctggttaaagctgcgggactcctacacccagatgtgcgatcaccgccttatgagcgccgcgatcaaggactccaaggccgttcacgccgacatgggctactggatcgagtccgagaagaacgagacctggaagctggcccgggcctccttcatcgaggtaaagacgtgcacgtggcccaagtcccacaccctgtggtccaacggggtcttagagagcgaaatgatcatcccgaagatttacggcggacctatctcccagcacaactacaggcccggctattttacccaaacagccggtccctggcacctgggcaagttagaactcgacttcgacctgtgcgagggcaccaccgtggtagtcgatgagcactgcgggaaccggggcccgagcctccgcaccacgacggtgaccgggaagatcatccacgagtggtgctgccggtcctgcaccctcccgcccctgcgcttccgcggagaggacgggtgctggtacgggatggagattcgcccagtgaaagagaaggaggaaaacctggtacggagcatggtgtccgctggaagcggggaggtagacagcttctccctcggaatcctgtgcgtcagcataatgatcgaggaggtgatgcgctcccggtggagccgcaagatgctgatgacagggaccctcgccgtattcctgctgctcatcatgggccagctcacctggaacgacctgattcgcctctgcatcatggtcggtgctaatgcctctgaccggatgggtatgggcacgacgtacctggcgctgatggccaccttcaagatgcgcccgatgttcgcggtggggttgctgttccggcgcctgaccagccgggaggtgttactcctgaccataggcctcagcctggtcgccagcgtggagctgcccaactccctcgaggaattaggggacggcctcgccatgggcatcatgatgctcaagctgctgacggaattccagccccaccagctctggaccaccctgctgagcctcaccttcgtcaagacgaccctgtccctggactatgcttggaagaccaccgccatggtcctcagcatcgtgtccttgttcccgctgtgtctctcaaccacctcccaaaagaccacctggttgccggtcctgctcgggtcattcggctgcaagcccctgaccatgtttttaatcactgagaacaagatatgggggcgcaagagttggcccctcaacgagggaataatggctataggcatcgtgagcatcttgctgtccagcctcctgaagaacgacgtgcccttagccggcccgctcattgcgggcgggatgttgatcgcctgctacgtcatcagcggctccagcgccgacctgttactggagaaggcagccgaggtgtcctgggagcaggaggccgagcactccggagcctcccataacatcctggtggaggtccaggacgacggcacaatgaagataaaggatgaggagcgggatgacaccctaacaatcctgctgaaggccacgctcctggcagtcagcggggtgtaccccatgtccatccccgccacactgttcgtttggtacttctggcagaaaaagaagcagcgcagcggcgtgctttgggacaccccttcccctcccgaggtggagcgggctgtactcgacgacggcatctaccgcatcttgcagcgggggctgctcggccgcagccaggtgggggtgggcgtctttcaagacggggtgtttcataccatgtggcacgtgacgaggggcgccgtcctgatgtaccagggcaagcgcctggaaccctcctgggccagcgtgaagaaggacctcatcagctacgggggcgggtggcggttccagggcagctggaacaccggagaggaagttcaggtcatcgccgtggagcccggaaagaatccgaagaacgtacagaccacccccgggacgtttaagacgcccgagggggaggtcggagccatcgccttagatttcaagcctgggaccagcggctccccgatcgtcaaccgcgagggcaaaatcgtggggctatacggaaacggggtcgtgaccacgtccggcacctacgtttctgccatagcccaggctaaagccagtcaagaggggcccttaccagagatcgaggacgaggttttcaaaaagcggaacctgactatcatggacctgcacccgggcagcggcaagacccgccgatacctccccgcgatcgtgcgtgaggccataaagcgaaagctgagaacgctgattctcgcccccacccgcgtggttgccagcgagatggcggaggccctgaaggggatgcccattcggtaccagaccaccgccgtaaagtccgaacacacgggccgcgagatcgttgacctgatgtgccacgcgaccttcactatgcggctccttagcccggtgcgcgtgcccaattacaatatgattatcatggacgaggctcacttcacggaccccgcctccatagccgcccgggggtacatctcgacgcgcgtgggcatgggggaggccgccgcgatcttcatgaccgccacacctcccggctccgtcgaggccttcccccaatcaaacgctgttatccaagacgaggaacgggatatccccgaacgctcgtggaacagcggctacgactggatcaccgacttccccggaaagacggtgtggtttgtcccctcgatcaaaagcggaaacgacatcgcgaactgcctgcggaagaacgggaagcgcgtgatccagctcagtcggaagactttcgacaccgaataccagaaaaccaaaaacaacgactgggactacgtcgtcacgaccgatatcagcgagatgggcgcgaactttcgcgccgaccgagtgattgacccgcgccggtgcctgaagcccgtgatcctgaaagacggcccagagcgcgtcatcctcgccggccccatgcctgtgaccgtcgcctccgcggcccagcggcgcggccggatcgggcgcaaccagaacaaggagggagatcagtacgtgtacatggggcaacccctgaacaacgatgaggaccacgcgcactggactgaggccaagatgctgctcgacaatattaatacgccagaaggcatcatcccggccctgttcgagccagaacgcgagaagtccgctgccatcgacggggaataccggctgcgcggtgaggcccggaagaccttcgtggagctcatgcgccggggcgacctccccgtctggctgtcctacaaggtggccagtgaggggttccaatactctgaccgcagatggtgtttcgatggcgagagaaacaaccaagtactcgaggagaacatggatgttgagatctggactaaggagggggagcggaagaagctgcggccccggtggctggacgcccgcacctactccgatcctctcgcactgcgggagttcaaggagttcgcagccggccggcggtcagtgagcggggacctgatactcgagattgggaagctgccacagcacctaacgctccgcgcccagaacgctctagacaacctggtgatgctccacaactccgagcagggcggaaaggcctaccggcacgctatggaggaactgcccgatacgattgagaccctgatgttgctggccctgatcgcagtcctcaccggcggggtgactctattcttcttaagtggcaagggcctgggtaagacgagcatcggcctgctgtgcgtgactgcgtccagcgccctcctgtggatggcctccgtcgagccgcactggatcgcggcgtctatcatcctggagttctttctcatggtgctgctgatcccggagcccgaccggcagcgaacgccccaggacaaccagctcgcgtacgtggtcatcgggctgttgttcatgatcctcaccgtcgccgctaatgagatgggcctccttgagacgaccaagaaggacctagggataggctatgtggccgccgagaaccaccagcacgcgaccatgctggacgtcgatctgaggccggcgagcgcctggaccctctacgccgtggccacgaccgtgatcacgcccatgatgcggcataccatcgagaatacgaccgctaatatatctcttacagccatagccaaccaggccgcgatcctgatgggcctggacaaggggtggcccatctcgaagatggacatcggtgtgcccctgctggctctcgggtgctatagccaggtgaaccccctgaccctgacggcggccgtgctcatgctggtagcccactacgctatcatcggccccgggctgcaggccaaggcgacccgcgaggcccagaaacgcaccgccgcgggcatcatgaagaaccctaccgtggacggtatcgtggccatcgacctcgatcccgtcgtgtacgacgccaagttcgaaaagcagctggggcagattatgttacttatcctgtgcacgtcccagatcctgctcatgcggaccacttgggccctgtgcgagagcatcaccctagcaacgggtcctctcaccaccctgtgggagggatcgcccggcaagttctggaataccaccatcgcggtgagtatggctaacatcttccgcggctcgtatctggccggggccggccttgccttctcgctgatgaagtccctcgggggcgggcggagaggcactggcgcgcagggtgagaccttaggcgagaagtggaagcggcaactgaaccaactcagcaaatctgagttcaacacctacaaacgctccggtatcatggaagtcgaccggagtgaggccaaagagggccttaagcgtggggagacgactaagcacgccgtttccaggggcaccgccaaactgcgctggttcgtggagcggaacctggtcaagcccgagggcaaagtaatcgacctcgggtgcggccgcggggggtggagctactactgcgcgggtttaaagaaggtgaccgaggtcaagggctataccaagggtgggcccggacacgaggagccgattccgatggctacctacggatggaacctggtgaagctgcactccggcaaagacgtgttcttcatgccgcccgagaagtgcgacaccctcctgtgcgacattggggaaagctctccgaaccccacgatcgaggagggacgcactctgcgcgtcctaaagatggtggagccctggctgaaaggaaaccagttctgcatcaaaatcctgaacccctacatgccgagcgtggttgagacgctcgagcagatgcagcggaagcacgggggaatgctggtgcgcaatcccctgagccggaacagcactcacgagatgtactgggtgtcatgcggaaccggcaacatcgtctctgccgtaaacatgacgtcccgcatgctcctgaaccggttcaccatggcccacaggaagcccacttacgagcgcgacgtggacctgggcgcagggacgcggcacgtggcggtggagccggaggtagccaacctcgacataattgggcaacgcatcgagaacatcaaaaacgagcataaaagcacctggcactacgacgaggacaacccgtataagacgtgggcctaccacggctcctacgaggtgaagcctagcggctccgccagctccatggtgaacggggtcgtgcggctgctgaccaaaccctgggacgtgatccccatggtcacccaaatagccatgaccgacacgacgccgttcggccaacagcgcgttttcaaggagaaggtggacacccggacgcccagagcaaagcggggaacgacccagatcatggaagttaccgctaagtggctctgggggttcttgagccgcaacaagaagccccggatctgcactcgcgaggagttcacgcggaaggtgcgctccaacgccgccatcggcgccgtgttcgtcgacgagaaccagtggaactcagcgaaggaggccgtggaggatgagcggttctgggacctggttcacagagaacgggagctccacaagcagggcaagtgtgcaacctgcgtctacaacatgatgggcaagagagagaagaagttgggcgagttcggcaaggccaagggcagccgggcgatctggtacatgtggctgggggcccgcttcctcgagttcgaggccctgggcttcatgaatgaggaccattggttctcccgggagaacagcctgtccggggtggagggcgaggggctccataagctcggttacatcctgcgcgacatcagcaagatccccggcgggaacatgtacgctgacgatacagccggctgggatacccggataacggaggacgacctccagaacgaggcgaagatcaccgacatcatggagcccgagcatgccctgctggccacgtcaattttcaagctcacctaccagaacaaggtggttcgcgtgcagcgcccagccaagaacggaacggtgatggacgtcatcagccggcgcgaccagcggggctccggccaggtaggcacctacggcctgaacacattcactaacatggaggtgcagttgattcgccagatggagtcggaaggcattttcctcccctccgagctggagacgccgaacttggctgagcgtgtcctggattggctggagaagcatggagcggagcgcctgaagcgcatggccatctccggggacgactgcgtggtgaagcccatcgatgatcgcttcgccaccgccctcacggccctgaacgatatgggcaaggtccggaaggacatccctcagtgggaaccctccaaagggtggaacgactggcagcaagtccctttttgcagccatcacttccatcagctgatcatgaaggacgggcgcgagatcgtggtcccctgccgaaaccaggacgagctcgtgggccgcgcgcgggtatcccagggtgccggatggagtcttcgcgagaccgcctgcctggggaagtcctacgcccagatgtggcaactaatgtacttccacagacgcgacctacggctggccgccaacgccatctgtagcgccgtcccagtggactgggtgcccacctctcgcacgacctggtccatccacgcccaccaccaatggatgaccaccgaagacatgctcagcgtctggaaccgggtgtggatcgaggagaacccgtggatggaggataaaacgcacgtgagcagctgggaggaggtcccctacctgggcaagcgcgaggaccagtggtgcggaagtctgatcgggctcacggcgcgggccacctgggcgaccaacatacaggttgccatcaaccaggtgcggcgcctgatcggcaacgagaactacctggactacatgacaagcatgaagcggtttaagaatgagtcggaccccgagggggccctttggtag
